United States Patent 9,149,506 (MODIFIED POLYNUCLEOTIDES ENCODING SEPTIN-4) - sequence listing, part 13

SEQ ID NO: 21647 - DNA, 1557 bp, Artificial Sequence
  Description of Artificial Sequence: Synthetic coding sequence
atgatcagtgatgacctggtgaacagctaccacctgctgctgtgtgccctggacctggtgtatggaaatgccctgcagtgcagcaacaggaaggagctggtgaaccccaacttcaagggcctgtctgaggacttccacgccaaggacagcaagcccagcagtgaccccccctgcatcatcgagaagctgtgcagcctgcatgatggcctggtgctggaggccaagggcatcaaggagcacttctggaagccctacatcaggaagctgtatgagaagaagctgctgaagggcaaggaggagaacctgaccggcttcctggagcccggcaactttggagagagcttcaaggccatcaacaaggcctatgaggagtatgtgctgtctgtgggcaacctggatgagcgcatcttcctgggggaggatgctgaggaggagatcggcaccctgagccgctgcctgaatgccggcagcggcacagaaacagctgagcgggtgcagatgaagaacatcctgcagcagcactttgacaagagcaaggccctgcgcatcagcacccccctgactggagtgcgctacatcaaggagaacagcccctgtgtgacccctgtgtccacagccacccacagcctgagccggctgcacaccatgctgaccggcctgagaaatgcccccagcgagaagctggagcagatcctgcggacctgcagccgggaccccacccaggccatcgccaaccggctgaaggagatgtttgagatctacagccagcacttccagccagatgaggacttcagcaactgtgccaaggagatcgccagcaagcacttccgctttgctgagatgctgtactacaaggtgctggagagcgtgattgagcaggagcagaagaggctgggggacatggacctgagcggcatcctggagcaggatgccttccacaggagcctgctggcctgctgcctggaggtggtgaccttctcctacaagcccccaggcaacttccccttcatcacagagatctttgatgtgcccctgtaccacttctacaaggtgattgaggtgttcatccgggcagaagatggcctgtgccgggaggtggtgaagcacctgaaccagatcgaggagcagatcctggaccacctggcctggaagccagagagccccctgtgggagaagatccgggacaatgaaaatagagtgcccacctgtgaggaggtgatgccaccccagaacctggagcgggcagatgagatctgcatcgccggcagcccccggcgcatccagctgagccagaaccaccctgtgtacatcagcccccacaagaatgagaccatgctgagcccccgggagaagatcttctactacttcagcaacagccccagcaagaggctgcgggagatcaacagcatgatcagaactggagagacccccaccaagaagaggggcatcctgctggaggatggcagcgagagccctgccaagaggatctgcccagagaaccacagcgccctgctgcggcggctgcaggatgtggccaatgaccggggcagccactag

SEQ ID NO: 21648 - DNA, 1347 bp, Artificial Sequence
  Description of Artificial Sequence: Synthetic coding sequence
atgtttgactgcatggatgtgctgtctgtgtccccaggccagatcctggacttctacacagccagccccagcagctgcatgctgcaggagaaggccctgaaggcctgcttcagcggcctgacccagacagagtggcagcaccgccacacagcccagagcattgagacccagagcaccagcagcgaggagctggtgcccagcccccccagccccctgcccccaccccgggtgtacaagccctgctttgtgtgccaggacaagagcagcggctaccactatggagtgtctgcctgtgagggctgcaagggcttcttccgccgcagcatccagaagaacatgatctacacctgccaccgggacaagaactgtgtgatcaacaaggtgaccaggaaccgctgccagtactgccgcctgcagaagtgctttgaggtgggcatgagcaaggagagcgtgagaaatgacaggaacaagaagaagaaggagaccagcaagcaggagtgcacagagagctatgagatgacagctgagctggatgacctgacagagaagatcaggaaggcccaccaggagaccttccccagcctgtgccagctgggcaagtacaccaccaacagcagcgctgaccaccgggtgcggctggacctgggcctgtgggacaagttcagcgagctggccaccaagtgcatcatcaagatcgtggagtttgccaagaggctgcccggcttcaccggcctgaccatcgctgaccagatcaccctgctgaaggccgcctgcctggacatcctgatcctgcgcatctgcacccgctacaccccagagcaggacaccatgaccttcagtgatggcctgaccctgaacagaacccagatgcacaatgccggcttcggccccctgacagacctggtgttcacctttgccaaccagctgctgcccctggagatggatgacacagaaacaggcctgctgagcgccatctgcctgatctgtggggaccggcaggacctggaggagcccaccaaggtggacaagctgcaggagcccctgctggaggccctgaagatctacatcaggaagagaagacccagcaagccccacatgttccccaagatcctgatgaagatcacagacctgcggagcatcagcgccaagggagctgagagggtcatcaccctgaagatggagatccctggctccatgccacccctcatccaggagatgctggagaacagcgagggccacgagcccctgacccccagcagcagcggcaacacagctgagcacagccccagcatcagccccagctctgtggagaacagcggcgtgtcccagagccccctggtgcagtag

SEQ ID NO: 21649 - DNA, 1368 bp, Artificial Sequence
  Description of Artificial Sequence: Synthetic coding sequence
atgaccaccagcggccacgcctgccctgtgcctgctgtgaatggccacatgacccactacccagccaccccctaccccctgctcttcccccctgtgattggaggcctgagcctgccccccctgcacggcctgcacggccaccccccaccttctggctgcagcacccccagccctgccaccatcgagacccagagcaccagcagcgaggagctggtgcccagcccccccagccccctgcccccaccccgggtgtacaagccctgctttgtgtgccaggacaagagcagcggctaccactacggcgtgtctgcctgtgagggctgcaagggcttcttcagaagaagcatccagaagaacatgatctacacctgccaccgggacaagaactgtgtgatcaacaaggtgaccaggaaccgctgccagtactgccgcctgcagaagtgctttgaggtgggcatgagcaaggagagcgtgagaaatgacaggaacaagaagaagaaggagaccagcaagcaggagtgcacagagagctatgagatgacagctgagctggatgacctgacagagaagatcaggaaggcccaccaggagaccttccccagcctgtgccagctgggcaagtacaccaccaacagcagcgctgaccaccgggtgcggctggacctgggcctgtgggacaagttcagcgagctggccaccaagtgcatcatcaagatcgtggagtttgccaagaggctgcccggcttcaccggcctgaccatcgctgaccagatcaccctgctgaaggccgcctgcctggacatcctgatcctgcgcatctgcacccgctacaccccagagcaggacaccatgaccttcagtgatggcctgaccctgaacagaacccagatgcacaatgccggcttcggccccctgacagacctggtgttcacctttgccaaccagctgctgcccctggagatggatgacacagagaccggcctgctgagcgccatctgcctgatctgtggggaccggcaggacctggaggagcccaccaaggtggacaagctgcaggagcccctgctggaggccctgaagatctacatcaggaagaggcggcccagcaagccccacatgttccccaagatcctgatgaagatcacagacctgcggagcatcagcgccaagggagctgagagggtcatcaccctgaagatggagatccctggctccatgcctcctctcatccaggagatgctggagaacagcgagggccacgagcccctgacccccagcagcagcggcaacacagctgagcacagccccagcatcagccccagctctgtggagaacagcggcgtgtcccagagccccctggtgcagtag

SEQ ID NO: 21650 - DNA, 1011 bp, Artificial Sequence
  Description of Artificial Sequence: Synthetic coding sequence
atgatctacacctgccaccgggacaagaactgtgtgatcaacaaggtgaccaggaaccgctgccagtactgccgcctgcagaagtgctttgaggtgggcatgagcaaggagagcgtgagaaatgacaggaacaagaagaagaaggagaccagcaagcaggagtgcacagagagctatgagatgacagctgagctggatgacctgacagagaagatcaggaaggcccaccaggagaccttccccagcctgtgccagctgggcaagtacaccaccaacagcagcgctgaccaccgggtgcggctggacctgggcctgtgggacaagttcagcgagctggccaccaagtgcatcatcaagatcgtggagtttgccaagaggctgcccggcttcaccggcctgaccatcgctgaccagatcaccctgctgaaggccgcctgcctggacatcctgatcctgcgcatctgcacccgctacaccccagagcaggacaccatgaccttcagtgatggcctgaccctgaacagaacccagatgcacaatgccggcttcggccccctgacagacctggtgttcacctttgccaaccagctgctgcccctggagatggatgacacagaaacaggcctgctgagcgccatctgcctgatctgtggggaccggcaggacctggaggagcccaccaaggtggacaagctgcaggagcccctgctggaggccctgaagatctacatcaggaagagaagacccagcaagccccacatgttccccaagatcctgatgaagatcacagacctgcggagcatcagcgccaagggagctgagagggtcatcaccctgaagatggagatccctggctccatgccacccctcatccaggagatgctggagaacagcgagggccacgagcccctgacccccagcagcagcggcaacacagctgagcacagccccagcatcagccccagctctgtggagaacagcggcgtgtcccagagccccctggtgcagtag

SEQ ID NO: 21651 - DNA, 1011 bp, Artificial Sequence; identical to SEQ ID NO: 21650
  Description of Artificial Sequence: Synthetic coding sequence

SEQ ID NO: 21652 - DNA, 1326 bp, Artificial Sequence
  Description of Artificial Sequence: Synthetic coding sequence
atgaccaccagcggccacgcctgccctgtgcctgctgtgaatggccacatgacccactacccagccaccccctaccccctgctcttcccccctgtgattggaggcctgagcctgccccccctgcacggcctgcacggccaccccccaccttctggctgcagcacccccagccctgccaccatcgagacccagagcaccagcagcgaggagctggtgcccagcccccccagccccctgcccccaccccgggtgtacaagccctgctttgtgtgccaggacaagagcagcggctaccactacggcgtgtctgcctgtgagggctgcaagggcttcttcagaagaagcatccagaagaacatgatctacacctgccaccgggacaagaactgtgtgatcaacaaggtgaccaggaaccgctgccagtactgccgcctgcagaagtgctttgaggtgggcatgagcaaggagagcgtgagaaatgacaggaacaagaagaagaaggagaccagcaagcaggagtgcacagagagctatgagatgacagctgagctggatgacctgacagagaagatcaggaaggcccaccaggagaccttccccagcctgtgccagctgggcaagtacaccaccaacagcagcgctgaccaccgggtgcggctggacctgggcctgtgggacaagttcagcgagctggccaccaagtgcatcatcaagatcgtggagtttgccaagaggctgcccggcttcaccggcctgaccatcgctgaccagatcaccctgctgaaggccgcctgcctggacatcctgatcctgcgcatctgcacccgctacaccccagagcaggacaccatgaccttcagtgatggcctgaccctgaacagaacccagatgcacaatgccggcttcggccccctgacagacctggtgttcacctttgccaaccagctgctgcccctggagatggatgacacagagaccggcctgctgagcgccatctgcctgatctgtggggaccggcaggacctggaggagcccaccaaggtggacaagctgcaggagcccctgctggaggccctgaagatctacatcaggaagaggcggcccagcaagccccacatgttccccaagatcctgatgaagatcacagacctgcggagcatcagcgccaagggagctgagagggtcatcaccctgaagatggagatccctgagggccacgagcccctgacccccagcagcagcggcaacacagctgagcacagccccagcatcagccccagctctgtggagaacagcggcgtgtcccagagccccctggtgcagtag

SEQ ID NO: 21653 - DNA, 462 bp, Artificial Sequence
  Description of Artificial Sequence: Synthetic coding sequence
atggaccccccagctggctttgtgcgggccggcaacccagctgtggccgccccccagagccccctgagccctgagggcgcccacttccgggccgcccaccaccccaggagcacaggcagccgctgccccggcagcctgcagcccagccggcccctggtggccaactggctgcagagcctgcctgagatgcctgtggacttcaccggctactggaagatgctggtgaatgaaaattttgaggagtacctgcgggccctggatgtgaatgtggccctgaggaagatcgccaacctgctgaagccagacaaggagatcgtgcaggatggagaccacatgatcatccgcaccctgagcaccttcaggaactacatcatggacttccaggtgggcaaggagtttgaggaggacctgaccggcattgatgacaggaagtgcatgtctgaaacaggcttcagcagctag

SEQ ID NO: 21654 - DNA, 405 bp, Artificial Sequence
  Description of Artificial Sequence: Synthetic coding sequence
atgacccgggaccagaatggcacctgggagatggagagcaatgaaaattttgagggctacatgaaggccctggacatcgactttgccaccaggaagattgctgtgcggctgacccagaccaaggtgattgaccaggatggagacaacttcaagaccaagaccaccagcaccttcagaaattatgatgtggacttcaccgtgggcgtggagtttgatgagtacaccaagagcctggacaacagacatgtgaaggccctggtgacctgggagggagatgtgctggtgtgtgtgcagaagggggagaaggaaaatagaggctggaagcagtggattgaaggagacaagctgtacctggagctgacctgtggggaccaggtgtgccggcaggtgttcaagaagaagtag

SEQ ID NO: 21655 - DNA, 474 bp, Artificial Sequence
  Description of Artificial Sequence: Synthetic coding sequence
atggaccccccagctggctttgtgcgggccggcaacccagctgtggccgccccccagagccccctgagccctgagggcgcccacttccgggccgcccaccaccccaggagcacaggcagccgctgccccggcagcctgcagcccagccggcccctggtggccaactggctgcagagcctgcctgagatgcctgtggacttcaccggctactggaagatgctggtgaatgaaaattttgaggagtacctgcgggccctggatgtgaatgtggccctgaggaagatcgccaacctgctgaagccagacaaggagatcgtgcaggatggagaccacatgatcatccgcaccctgagcaccttcaggaactacatcatggacttccaggtgggcaaggagtttgaggaggacctgaccggcattgatgacaggaagtgcatggccggcgtgcagagccgggacctgagcagcctgtag

SEQ ID NO: 21656 - DNA, 3756 bp, Artificial Sequence
  Description of Artificial Sequence: Synthetic coding sequence
atgaggcggggcggctggaggaagagagcagaaaatgatggctgggagacctggggcggctacatggccgccaaggtgcagaagctggaggagcagttcagaagtgatgctgccatgcagaaggatggcaccagcagcaccatcttcagcggcgtggccatctacgtgaatggctacacagaccccagcgctgaggagctgaggaagctgatgatgctgcacggcggccagtaccacgtgtactacagccgcagcaagaccacccacatcatcgccaccaacctgcccaatgccaagatcaaggagctgaagggggagaaggtgatccggcctgagtggatcgtggagagcatcaaggccggccgcctgctgagctacatcccctaccagctgtacaccaagcagagctctgtgcagaagggcctgtccttcaaccctgtgtgcaggcctgaggaccccctgcccggccccagcaacatcgccaagcagctgaacaacagagtgaaccacatcgtgaagaagattgaaacagaaaatgaggtgaaggtgaatggcatgaacagctggaatgaggaggatgagaacaatgacttctcctttgtggacctggagcagaccagccctggcaggaagcagaatggcatcccccacccccggggcagcacagccatcttcaacggccacacccccagcagcaatggagccctgaagacccaggactgcctggtgcccatggtgaacagcgtggccagccggctgagccctgccttcagccaggaggaggacaaggccgagaagagcagcacagacttccgggactgcaccctgcagcagctgcagcagagcaccaggaacacagatgccctgaggaacccccacaggaccaacagcttcagcctgagccccctgcacagcaacaccaagatcaacggggcccaccacagcacagtgcagggccccagcagcaccaagagcaccagctctgtgtccaccttcagcaaggccgcccccagcgtgcccagcaagcccagcgactgcaacttcatcagcaacttctacagccacagccggctgcaccacatctccatgtggaagtgtgagctgacagaatttgtgaacaccctgcagaggcagagcaatggcatcttccctggccgggagaagctgaagaagatgaagacaggccgcagcgccctggtggtgacagacaccggggacatgtctgtgctgaacagccccaggcaccagagctgcatcatgcacgtggacatggactgcttctttgtgtctgtgggcatccggaacagaccagacctgaagggcaagcctgtggccgtgaccagcaacagaggcaccggccgggcccccctgcggcctggggccaacccccagctggagtggcagtactaccagaacaagatcctgaagggcaaggctgctgacatcccagacagcagcctgtgggagaacccagattctgcccaggccaatggaattgattctgtgctgagcagagctgagatcgccagctgcagctatgaggcccggcagctgggcatcaagaatggcatgttcttcggccacgccaagcagctgtgccccaacctgcaggccgtgccctatgacttccacgcctacaaggaggtggcccagaccctgtatgagaccctggccagctacacccacaacatcgaggccgtgtcctgtgatgaggccctggtggacatcacagagatcctggccgagaccaagctgaccccagatgaatttgccaatgctgtgaggatggagatcaaggaccagaccaagtgtgccgcctctgtgggcatcggcagcaacatcctgctggccaggatggccaccaggaaggccaagccagatggccagtaccacctgaagccagaggaggtggatgacttcatccggggccagctggtgaccaacctgcccggggtgggccacagcatggagagcaagctggccagcctgggcatcaagacctgtggggacctgcagtacatgaccatggccaagctgcagaaggagtttggccccaagacaggccagatgctgtaccgcttctgccggggcctggatgacaggcctgtgaggacagagaaggagaggaagtctgtgtctgctgagatcaactacggcatccgcttcacccagcccaaggaggccgaggccttcctgctgagcctgtctgaggagatccagaggcggctggaggccaccggcatgaagggcaagaggctgaccctgaagatcatggtgaggaagccaggggcccctgtggagacagccaagtttggaggccacggcatctgtgacaacatcgccaggacagtgaccctggaccaggccacagacaatgccaagatcatcggcaaggccatgctgaacatgttccacaccatgaagctgaacatcagtgacatgaggggcgtgggcatccacgtgaaccagctggtgcccaccaacctgaaccccagcacctgccccagccggcccagcgtgcagagcagccacttccccagcggcagctacagcgtgagagatgtgttccaggtgcagaaggccaagaagagcacagaggaggagcacaaggaggtgttccgggctgctgtggacctggagatcagcagcgccagcaggacctgcaccttcctgccccccttccctgcccacctgcccaccagcccagacaccaacaaggccgagagcagcggcaagtggaatggcctgcacacccctgtgtctgtgcagagccggctgaacctgagcattgaggtgcccagccccagccagctggaccagagcgtgctggaggccctgcccccagacctgcgggagcaggtggagcaggtgtgtgctgtgcagcaggccgagagccacggggacaagaagaaggagcctgtgaatggctgcaacacaggcatcctgccccagcctgtgggcaccgtgctgctgcagatccctgagccccaggagagcaacagtgatgctggcatcaacctgattgccctgcctgccttcagccaggtggaccctgaggtgtttgctgccctgcctgctgagctgcagcgggagctgaaggccgcctatgaccagaggcagaggcagggcgagaacagcacccaccagcagagcgccagcgcctctgtgcccaagaaccccctgctgcacctgaaggctgctgtgaaggagaagaagaggaacaagaagaagaagaccatcggcagccccaagaggatccagagccccctgaacaacaagctgctgaacagccctgccaagaccctgcccggggcctgtggcagcccccagaagctgattgatggcttcctgaagcatgagggccccccagctgagaagcccctggaggagctgagcgccagcaccagcggcgtgcccggcctgagcagcctgcagagcgaccctgctggctgtgtgcggcccccagcccccaacctggccggggctgtggagttcaatgatgtgaagaccctgctgcgggagtggatcaccaccatcagtgaccccatggaggaggacatcctgcaggtggtgaagtactgcacagacctgattgaggagaaggacctggagaagctggacctggtgatcaagtacatgaagaggctgatgcagcagagcgtggagagcgtgtggaacatggcctttgacttcatcctggacaacgtgcaggtggtgctgcagcagacctacggcagcaccctgaaggtgacctag

SEQ ID NO: 21657 - DNA, 3753 bp, Artificial Sequence
  Description of Artificial Sequence: Synthetic coding sequence
atgaggcggggcggctggaggaagagagcagaaaatgatggctgggagacctggggcggctacatggccgccaaggtgcagaagctggaggagcagttcagaagtgatgctgccatgcagaaggatggcaccagcagcaccatcttcagcggcgtggccatctacgtgaatggctacacagaccccagcgctgaggagctgaggaagctgatgatgctgcacggcggccagtaccacgtgtactacagccgcagcaagaccacccacatcatcgccaccaacctgcccaatgccaagatcaaggagctgaagggggagaaggtgatccggcctgagtggatcgtggagagcatcaaggccggccgcctgctgagctacatcccctaccagctgtacaccaagcagagctctgtgcagaagggcctgtccttcaaccctgtgtgcaggcctgaggaccccctgcccggccccagcaacatcgccaagcagctgaacaacagagtgaaccacatcgtgaagaagattgaaacagaaaatgaggtgaaggtgaatggcatgaacagctggaatgaggaggatgagaacaatgacttctcctttgtggacctggagcagaccagccctggcaggaagcagaatggcatcccccacccccggggcagcacagccatcttcaacggccacacccccagcagcaatggagccctgaagacccaggactgcctggtgcccatggtgaacagcgtggccagccggctgagccctgccttcagccaggaggaggacaaggccgagaagagcagcacagacttccgggactgcaccctgcagcagctgcagcagagcaccaggaacacagatgccctgaggaacccccacaggaccaacagcttcagcctgagccccctgcacagcaacaccaagatcaacggggcccaccacagcacagtgcagggccccagcagcaccaagagcaccagctctgtgtccaccttcagcaaggccgcccccagcgtgcccagcaagcccagcgactgcaacttcatcagcaacttctacagccacagccggctgcaccacatctccatgtggaagtgtgagctgacagaatttgtgaacaccctgcagaggcagagcaatggcatcttccctggccgggagaagctgaagaagatgaagacaggccgcagcgccctggtggtgacagacaccggggacatgtctgtgctgaacagccccaggcaccagagctgcatcatgcacgtggacatggactgcttctttgtgtctgtgggcatccggaacagaccagacctgaagggcaagcctgtggccgtgaccagcaacagaggcaccggccgggcccccctgcggcctggggccaacccccagctggagtggcagtactaccagaacaagatcctgaagggcaaggctgacatcccagacagcagcctgtgggagaacccagacagcgcccaggccaacggcatcgacagcgtgctgagcagagctgagatcgccagctgcagctatgaggcccggcagctgggcatcaagaatggcatgttctttggacatgccaagcagctgtgccccaacctgcaggccgtgccctatgacttccacgcctacaaggaggtggcccagaccctgtatgagaccctggccagctacacccacaacattgaagctgtgtcctgtgatgaggccctggtggacatcacagagatcctggccgagaccaagctgaccccagatgaatttgccaatgctgtgaggatggagatcaaggaccagaccaagtgtgccgcctctgtgggcatcggcagcaacatcctgctggccaggatggccaccaggaaggccaagccagatggccagtaccacctgaagccagaggaggtggatgacttcatccggggccagctggtgaccaacctgcccggggtgggccacagcatggagagcaagctggccagcctgggcatcaagacctgtggggacctgcagtacatgaccatggccaagctgcagaaggagtttggccccaagacaggccagatgctgtaccgcttctgccggggcctggatgacaggcctgtgaggacagagaaggagaggaagtctgtgtctgctgagatcaactacggcatccgcttcacccagcccaaggaggccgaggccttcctgctgagcctgtctgaggagatccagaggcggctggaggccaccggcatgaagggcaagaggctgaccctgaagatcatggtgaggaagccaggggcccctgtggagacagccaagtttggaggccacggcatctgtgacaacatcgccaggacagtgaccctggaccaggccacagacaatgccaagatcatcggcaaggccatgctgaacatgttccacaccatgaagctgaacatcagtgacatgagaggagtgggcatccacgtgaaccagctggtgcccaccaacctgaaccccagcacctgccccagccggcccagcgtgcagagcagccacttccccagcggcagctacagcgtgagagatgtgttccaggtgcagaaggccaagaagagcacagaggaggagcacaaggaggtgttccgggctgctgtggacctggagatcagcagcgccagcaggacctgcaccttcctgccccccttccctgcccacctgcccaccagcccagacaccaacaaggccgagagcagcggcaagtggaatggcctgcacacccctgtgtctgtgcagagccggctgaacctgagcattgaggtgcccagccccagccagctggaccagagcgtgctggaggccctgcccccagacctgcgggagcaggtggagcaggtgtgtgctgtgcagcaggccgagagccatggagacaagaagaaggagcctgtgaatggctgcaacacaggcatcctgccccagcctgtgggcaccgtgctgctgcagatccctgagccccaggagagcaacagtgatgctggcatcaacctgattgccctgcctgccttcagccaggtggaccctgaggtgtttgctgccctgcctgctgagctgcagcgggagctgaaggccgcctatgaccagaggcagaggcagggcgagaacagcacccaccagcagagcgccagcgcctctgtgcccaagaaccccctgctgcacctgaaggctgctgtgaaggagaagaagaggaacaagaagaagaagaccatcggcagccccaagaggatccagagccccctgaacaacaagctgctgaacagccctgccaagaccctgcccggggcctgtggcagcccccagaagctgattgatggcttcctgaagcatgagggccccccagctgagaagcccctggaggagctgagcgccagcaccagcggcgtgcccggcctgagcagcctgcagagcgaccctgctggctgtgtgcggcccccagcccccaacctggccggggctgtggagttcaatgatgtgaagaccctgctgcgggagtggatcaccaccatcagtgaccccatggaggaggacatcctgcaggtggtgaagtactgcacagacctgattgaggagaaggacctggagaagctggacctggtgatcaagtacatgaagaggctgatgcagcagagcgtggagagcgtgtggaacatggcctttgacttcatcctggacaacgtgcaggtggtgctgcagcagacctacggcagcaccctgaaggtgacctag

SEQ ID NO: 21658 - DNA, 2916 bp, Artificial Sequence
  Description of Artificial Sequence: Synthetic coding sequence
atggccaccgtgcgggccagcctgcggggggccctgctgctgctgctggccgtggccggcgtggccgaggtggccggcggcctggcccctggcagcgctggggccctgtgctgcaaccacagcaaggacaaccagatgtgcagagatgtgtgtgagcagatcttcagcagcaagtctgagagccggctgaagcacctgctgcagagggccccagactactgcccagagaccatggtggagatctggaactgcatgaacagcagcctgcccggggtcttcaagaagagtgatggctgggtgggcctgggctgctgtgagctggccatcgccctggagtgccggcaggcctgcaagcaggccagcagcaagaatgacatcagcaaggtgtgcaggaaggagtatgaaaatgccctcttcagctgcatcagcagaaatgagatgggctctgtgtgctgcagctatgccggccaccacaccaactgccgggagtactgccaggccatcttcagaacagacagcagccctggccccagccagatcaaggctgtggagaactactgtgccagcatcagcccccagctgatccactgtgtgaacaactacacccagagctaccccatgaggaaccccacagacagcctgtactgctgtgacagagcagaagatcatgcctgccagaatgcctgcaagaggatcctgatgagcaagaagacagagatggagatcgtggatggcctgattgagggctgcaagacccagcccctgccccaggaccccctgtggcagtgcttcctggagagcagccagagcgtgcaccctggggtgacagtgcaccccccacccagcacaggcctggatggagccaagctgcactgctgcagcaaggccaacaccagcacctgccgggagctgtgcaccaagctgtacagcatgtcctggggcaacacccagagctggcaggagtttgaccgcttctgtgagtacaaccctgtggaggtgtccatgctgacctgcctggctgatgtgcgggagccctgccagctgggctgcaggaacctgacctactgcaccaacttcaacaaccggcccacagagctgttccgcagctgcaatgcccagagcgaccagggcgccatgaatgacatgaagctgtgggagaagggcagcatcaagatgcccttcatcaacatccctgtgctggacatcaagaagtgccagcctgagatgtggaaggccatcgcctgcagcctgcagatcaagccctgccacagcaagagccggggcagcatcatctgcaagagtgactgtgtggagatcctgaagaagtgtggggaccagaacaagtttcctgaggaccacacagctgagagcatctgtgagctgctgagccccacagatgacctgaagaactgcatccccctggacacctacctgcggcccagcaccctgggcaacatcgtggaggaggtgacccacccctgcaaccccaacccctgcccagccaatgagctgtgtgaggtgaacaggaagggctgccccagcggggacccctgcctgccctacttctgtgtgcagggctgcaagctgggggaggccagtgacttcatcgtgcggcagggcaccctcatccaggtgcccagcagcgctggggaggtgggctgctacaagatctgcagctgtggccagagcggcctgctggagaactgcatggagatgcactgcatcgacctgcagaagagctgcatcgtgggcggcaagaggaagagccacggcaccagcttcagcattgactgcaatgtgtgcagctgctttgctggcaacctggtgtgcagcacccggctgtgcctgtctgagcacagcagtgaagatgacaggaggaccttcaccggcctgccctgcaactgtgccgaccagtttgtgcctgtgtgtggccagaatggccgcacctaccccagcgcctgcatcgcccgctgtgtgggcctgcaggaccaccagtttgaatttggcagctgcatgagcaaggacccctgcaaccccaacccctgccagaagaaccagcgctgcatccccaagccccaggtgtgcctgaccacctttgacaagtttggctgcagccagtatgaatgtgtgccccggcagctggcctgtgaccaggtgcaggaccctgtgtgtgacacagaccacatggagcacaacaacctgtgcaccctgtaccagaggggcaagagcctgagctacaagggcccctgccagcccttctgccgggccacagagcctgtgtgtggccacaacggggagacctacagctctgtgtgtgccgcctacagcgacagagtggccgtggactactacggggactgccaggccgtgggcgtgctgtctgagcacagctctgtggctgaatgtgcctctgtgaagtgccccagcctgctggccgccggctgcaagcccatcatccccccaggggcctgctgccccctgtgtgccggcatgctgcgggtgctgtttgacaaggagaagctggacaccatcgccaaggtgaccaacaagaagcccatcaccgtgctggagatcctgcagaagatccgcatgcacgtgtctgtgccccagtgtgatgtgtttggctacttcagcattgaaagtgaaattgtcatcctgatcatccctgtggaccactaccccaaggccctgcagatcgaggcctgcaacaaggaggccgagaagattgagagcctcatcaacagcgacagccccaccctggccagccacgtgcccctgagcgccctgatcatcagccaggtgcaggtgagcagctctgtgcccagcgctggggtgcgggcccggcccagctgccacagcctgctgctgcccctgagcctgggcctggccctgcacctgctgtggacctacaactag

SEQ ID NO: 21659 - DNA, 735 bp, Artificial Sequence
  Description of Artificial Sequence: Synthetic coding sequence
atgaaggagcggcgggccagccagaagctgagcagcaagagcatcatggaccccaaccagaatgtgaagtgcaagatcgtggtggtgggggacagccagtgtgggaagacagccctgctgcacgtgtttgccaaggactgcttccctgagaactacgtgcccaccgtgtttgagaactacacagccagctttgaaattgacacccagagaattgagctgagcctgtgggacaccagcggcagcccctactatgacaacgtgcggcccctgagctacccagacagtgatgctgtgctgatctgctttgacatcagcaggcctgagaccctggacagcgtgctgaagaagtggaagggggagatccaggagttctgccccaacaccaagatgctgctggtgggctgcaagagtgacctgaggacagatgtgtccaccctggtggagctgagcaaccaccggcagacccctgtgtcctatgaccagggcgccaacatggccaagcagattggagctgccacctacatcgagtgcagcgccctgcagagtgaaaattctgtgcgggacatcttccacgtggccaccctggcctgtgtgaacaagaccaacaagaatgtgaagaggaacaagagccagagggccaccaagaggatcagccacatgcccagcaggcctgagctgtctgctgtggccacagacctgaggaaggacaaggccaagagctgcaccgtgatgtag

SEQ ID NO: 21660 - DNA, 735 bp, Artificial Sequence; identical to SEQ ID NO: 21659
  Description of Artificial Sequence: Synthetic coding sequence

SEQ ID NO: 21661 - DNA, 348 bp, Artificial Sequence
  Description of Artificial Sequence: Synthetic coding sequence
atgctgctggtgggctgcaagagtgacctgaggacagatgtgtccaccctggtggagctgagcaaccaccggcagacccctgtgtcctatgaccagggcgccaacatggccaagcagatcggggccgccacctacattgaatgttctgccctgcagagcgagaacagcgtgcgggacatcttccacgtggccaccctggcctgtgtgaacaagaccaacaagaatgtgaagaggaacaagagccagagggccaccaagaggatcagccacatgcccagcaggcctgagctgtctgctgtggccacagacctgaggaaggacaaggccaagagctgcaccgtgatgtag

SEQ ID NO: 21662 - DNA, 351 bp, Artificial Sequence
  Description of Artificial Sequence: Synthetic coding sequence
atgaaggagcggcgggccagccagaagctgagcagcaagagcatcatggaccccaaccagaatgtgaagtgcaagatcgtggtggtgggggacagccagtgtgggaagacagccctgctgcacgtgtttgccaaggactgcttccctgagaactacgtgcccaccgtgtttgagaactacacagccagctttgaaattgacacccagagaattgagctgagcctgtgggacaccagcggcagcccctactatgacaacgtgcggcccctgagctacccagacagtgatgctgtgctgatctgctttgacatcagcaggcctgagaccctggacagcgtgctgaagaagtag

SEQ ID NO: 21663 - DNA, 351 bp, Artificial Sequence; identical to SEQ ID NO: 21662
  Description of Artificial Sequence: Synthetic coding sequence

SEQ ID NO: 21664 - DNA, 615 bp, Artificial Sequence
  Description of Artificial Sequence: Synthetic coding sequence
atggccgagcaggagcccacagctgagcagctggcccagattgctgctgaaaatgaggaggatgagcacagcgtgaactacaagcccccagcccagaagagcatccaggagatccaggagctggacaaggatgatgagagcctgaggaagtacaaggaggccctgctgggccgggtggccgtgtctgctgaccccaacgtgcccaacgtggtggtgacaggcctgaccctggtgtgcagcagcgcccctggccccctggagctggacctgactggagacctggagagcttcaagaagcagagctttgtgctgaaggagggcgtggagtaccgcatcaagatctccttccgggtgaaccgggagatcgtgtctggcatgaagtacatccagcacacctacagaaaaggagtgaagattgacaagacagactacatggtgggcagctatggccccagggctgaggagtatgagttcctgacccctgtggaggaggcccccaagggcatgctggcccggggcagctacagcatcaagagccgcttcacagatgatgacaagacagaccacctgtcctgggagtggaacctgaccatcaagaaggactggaaggactag

SEQ ID NO: 21665 - DNA, 537 bp, Artificial Sequence
  Description of Artificial Sequence: Synthetic coding sequence
atggccgagcaggagcccacagctgagcagctggcccagattgctgctgaaaatgaggaggatgagcacagcgtgaactacaagcccccagcccagaagagcatccaggagatccaggagctggacaaggatgatgagagcctgaggaagtacaaggaggccctgctgggccgggtggccgtgtctgctgaccccaacgtgcccaacgtggtggtgacaggcctgaccctggtgtgcagcagcgcccctggccccctggagctggacctgactggagacctggagagcttcaagaagcagagctttgtgctgaaggagggcgtggagtaccgcatcaagatctccttccgggtgaaccgggagatcgtgtctggcatgaagtacatccagcacacctacagaaaaggagtgaagattgacaagacagactacatggtgggcagctacagcatcaagagccgcttcacagatgatgacaagacagaccacctgtcctgggagtggaacctgaccatcaagaaggactggaaggactag

SEQ ID NO: 21666 - DNA, 615 bp, Artificial Sequence; identical to SEQ ID NO: 21664
  Description of Artificial Sequence: Synthetic coding sequence

SEQ ID NO: 21667 - DNA, 3576 bp, Artificial Sequence
  Description of Artificial Sequence: Synthetic coding sequence
atggaggccatgagcccccagcaggagaccctgggcggccagcccggccgcagcagcagcctgactggagtgtcccggctggccggcggcagctgcaccaagaagaagatgaagaccctggccgagcggcggcgcagcgcccccagcctcatcctggacaaggccctgcagaagaggcccaccacccgggacagccccagcgcctctgtggacacctgcaccttcctgagcagcctggtgtgcagcaacagaaccctgctgattgatggccgggcagagctgaagaggggcctgcagaggcaggagcggcacctgttcctgttcaatgacctgtttgtggtggccaagatcaagtacaacaacaacttcaagatcaagaacaagatcaagctgacagacatgtggacagccagctgtgtggatgaggtgggggagggcaacaccaatgccatgaagagctttgtgctgggctggcccaccgtgaactttgtggccaccttcagcagccctgagcagaaggacaagtggctgagcctgctgcagcgctacatcaacctggagaaggagaaggactaccccaagagcatccccctgaagatctttgccaaggacatcggcaactgtgcctacagcaagaccatcaccgtgatgaacagcgacacagccaatgaagtcatcaacatgagcctgcccatgctgggcatcaccggcagcgagcgggactaccagctgtgggtgaacagcggcaaggaggaggccccctaccccctcatcggccacgagtacccctacggcatcaagatgagccacctgcgggacagcgccctgctgaccccaggcagcaaggacagcaccacccccttcaacctgcaggagcccttcctgatggagcagctgccccgggagatgcagtgccagttcatcctgaagcccagccggctggccgccgcccagcagctgagtgacagcggccacaagaccttcaagagaagaagaagcatcatcaactgggccttctggaggggcagcagcacccacctggacaacctgcccagcagccccaccagccccatgcctggccagctgtttggcatcagcctgcccaacatctgtgaaaatgacaacctgcccaagcctgtgctggacatgctgttcttcctgaaccagaagggccccctgaccaagggcatcttccggcagagcgccaacgtgaagagctgccgggagctgaaggagaagctgaacagcggcgtggaggtgcacctggactgtgagagcatcttcgtcatcgcctctgtgctgaaggacttcctgaggaacatccctggcagcatcttcagcagtgacctgtatgaccactgggtgtctgtgatggaccagggcaatgatgaggagaagatcaacacagtgcagaggctgctggaccagctgccccgggccaacgtggtgctgctgcgctacctgtttggagtgctgcacaacatcgagcagcacagcagcagcaaccagatgacagccttcaacctggccgtgtgtgtggcccccagcatcctgtggcccccagccagcagcagccctgagctggagaatgagttcaccaagaaggtgtccctgctgatccagttcctgattgagaactgcctgcgcatctttggagaggagatcaccagcctcttccgggaggtgtctgtgcgctgtgacacccgggagaatgccagtgacatcagctgcttccagctgaatgacagcagctatgacagcctggagaatgagctgaatgaagatgtggatgccccctgcagcgacctggtgaagaagctgggccagggcagccgctccatggacagcgtgctgaccctgagtgactatgacctggaccagcctgaggtggagggcctgctgaccctgagtgactttgacctggcccacagcaaggatgaagatgtgcagatgaagaggcccctggagagcaagcctgtgaacatcctggtgtacaccaagatccccctgcgggaccacgcccgggcccccagcgccatgtgcacccccagctacctgagcacagctgctgccaatgctgccaagagcctgcggcggcaccggcgctgcagcgagcccagcattgactacctggacagcaagctgagctacctgcgggagttctaccagaagaagctgaggaagagcagctgtgatgccatcctgagccagaaggatgaggactacctgaagcagaaccagcccctgcaggaggagggcaagacctgcttcaagcagagcctggtgactggaacagatgtgtccaagaagaatgccaccacccagaacaccaagaagaagagcctgagcggcagcgagggcaaccacgtgaagctgttccccaagagcaagcctgtggccatctctgtggccagctacagccccatgagcagccaggaccacagcaagaaccagccctttgatgtgaacaccagcggctacagccccccccacacagcagatgccctgaagggccccaggacccaccggcgctgcagcgagcccaacatcgaggaccagaacaggaagctgacctacctgcggggcatctacagcaagaagcagcacaagaccagctgtgaggccggcctgctgcatggagaggaggactacctgaagaggcacaagagcctgcagatggagggccagaagctgatcaaccagagcctggtgatgggcatcgaggtgggcaagagcagcgccaccaaccagaacacagagaaggtgctgcccccccggctgaacctgtgccccaggaccagctacagcagcctgagcagccctggcaccagccccagcggcagctctgtgagcagccaggacagcgccttcagccagatcagcgagcacagcgtcttcacccccacagagaccagcagccccatcgactgcaccttccaggcccagaggaagcgggaggacctgagcccagacttcagcaatgccagccacgtgtctggcatgcctggccccagcagcggccaggcctgcagcaggcctgcctacaccaagaaggacaccatggagtggcacagccagatgcacagcgtgaccctgcaccccagcacctggctgagaaatggagtggccagcctgaagaactggagcctgaagaagaaggccaaggccgcccggcctgaggaggagaagatcgccagccccaagggccccctggagcccccaccccacgccagcggcgtgcctgaggccaacagcctgcaggaggagcagaaggacctgcccctgcgggctgctgagggcctgagccctgtgcagagcgcccagcgctgcagcagcagccccttccaggacagcgagcggcactgcagcagccccttcagcctggtggagagccggctgaagctgtgcatgaagagccatgaggagattgagcccggcagccagagcagcagcggcagcctgccctgggagcgggccagcgccagctcctggaccctggaggatgccaccagcccagacagcggccccaccgtggtgtgtgacattgaagatcgctacctgaccaaggacatctag

SEQ ID NO: 21668 - DNA, 3498 bp, Artificial Sequence
  Description of Artificial Sequence: Synthetic coding sequence
atgaccttctggatcatcatcaacaagaagatgaagaccctggccgagcggcggcgcagcgcccccagcctcatcctggacaaggccctgcagaagaggcccaccacccgggacagccccagcgcctctgtggacacctgcaccttcctgagcagcctggtgtgcagcaacagaaccctgctgattgatggccgggcagagctgaagaggggcctgcagaggcaggagcggcacctgttcctgttcaatgacctgtttgtggtggccaagatcaagtacaacaacaacttcaagatcaagaacaagatcaagctgacagacatgtggacagccagctgtgtggatgaggtgggggagggcaacaccaatgccatgaagagctttgtgctgggctggcccaccgtgaactttgtggccaccttcagcagccctgagcagaaggacaagtggctgagcctgctgcagcgctacatcaacctggagaaggagaaggactaccccaagagcatccccctgaagatctttgccaaggacatcggcaactgtgcctacagcaagaccatcaccgtgatgaacagcgacacagccaatgaagtcatcaacatgagcctgcccatgctgggcatcaccggcagcgagcgggactaccagctgtgggtgaacagcggcaaggaggaggccccctaccccctcatcggccacgagtacccctacggcatcaagatgagccacctgcgggacagcgccctgctgaccccaggcagcaaggacagcaccacccccttcaacctgcaggagcccttcctgatggagcagctgccccgggagatgcagtgccagttcatcctgaagcccagccggctggccgccgcccagcagctgagtgacagcggccacaagaccttcaagagaagaagaagcatcatcaactgggccttctggaggggcagcagcacccacctggacaacctgcccagcagccccaccagccccatgcctggccagctgtttggcatcagcctgcccaacatctgtgaaaatgacaacctgcccaagcctgtgctggacatgctgttcttcctgaaccagaagggccccctgaccaagggcatcttccggcagagcgccaacgtgaagagctgccgggagctgaaggagaagctgaacagcggcgtggaggtgcacctggactgtgagagcatcttcgtcatcgcctctgtgctgaaggacttcctgaggaacatccctggcagcatcttcagcagtgacctgtatgaccactgggtgtctgtgatggaccagggcaatgatgaggagaagatcaacacagtgcagaggctgctggaccagctgccccgggccaacgtggtgctgctgcgctacctgtttggagtgctgcacaacatcgagcagcacagcagcagcaaccagatgacagccttcaacctggccgtgtgtgtggcccccagcatcctgtggcccccagccagcagcagccctgagctggagaatgagttcaccaagaaggtgtccctgctgatccagttcctgattgagaactgcctgcgcatctttggagaggagatcaccagcctcttccgggaggtgtctgtgcgctgtgacacccgggagaatgccagtgacatcagctgcttccagctgaatgacagcagctatgacagcctggagaatgagctgaatgaagatgtggatgccccctgcagcgacctggtgaagaagctgggccagggcagccgctccatggacagcgtgctgaccctgagtgactatgacctggaccagcctgaggtggagggcctgctgaccctgagtgactttgacctggcccacagcaaggatgaagatgtgcagatgaagaggcccctggagagcaagcctgtgaacatcctggtgtacaccaagatccccctgcgggaccacgcccgggcccccagcgccatgtgcacccccagctacctgagcacagctgctgccaatgctgccaagagcctgcggcggcaccggcgctgcagcgagcccagcattgactacctggacagcaagctgagctacctgcgggagttctaccagaagaagctgaggaagagcagctgtgatgccatcctgagccagaaggatgaggactacctgaagcagaaccagcccctgcaggaggagggcaagacctgcttcaagcagagcctggtgactggaacagatgtgtccaagaagaatgccaccacccagaacaccaagaagaagagcctgagcggcagcgagggcaaccacgtgaagctgttccccaagagcaagcctgtggccatctctgtggccagctacagccccatgagcagccaggaccacagcaagaaccagccctttgatgtgaacaccagcggctacagccccccccacacagcagatgccctgaagggccccaggacccaccggcgctgcagcgagcccaacatcgaggaccagaacaggaagctgacctacctgcggggcatctacagcaagaagcagcacaagaccagctgtgaggccggcctgctgcatggagaggaggactacctgaagaggcacaagagcctgcagatggagggccagaagctgatcaaccagagcctggtgatgggcatcgaggtgggcaagagcagcgccaccaaccagaacacagagaaggtgctgcccccccggctgaacctgtgccccaggaccagctacagcagcctgagcagccctggcaccagccccagcggcagctctgtgagcagccaggacagcgccttcagccagatcagcgagcacagcgtcttcacccccacagagaccagcagccccatcgactgcaccttccaggcccagaggaagcgggaggacctgagcccagacttcagcaatgccagccacgtgtctggcatgcctggccccagcagcggccaggcctgcagcaggcctgcctacaccaagaaggacaccatggagtggcacagccagatgcacagcgtgaccctgcaccccagcacctggctgagaaatggagtggccagcctgaagaactggagcctgaagaagaaggccaaggccgcccggcctgaggaggagaagatcgccagccccaagggccccctggagcccccaccccacgccagcggcgtgcctgaggccaacagcctgcaggaggagcagaaggacctgcccctgcgggctgctgagggcctgagccctgtgcagagcgcccagcgctgcagcagcagccccttccaggacagcgagcggcactgcagcagccccttcagcctggtggagagccggctgaagctgtgcatgaagagccatgaggagattgagcccggcagccagagcagcagcggcagcctgccctgggagcgggccagcgccagctcctggaccctggaggatgccaccagcccagacagcggccccaccgtggtgtgtgacattgaagatcgctacctgaccaaggacatctag

SEQ ID NO: 21669 - DNA, 3507 bp, Artificial Sequence
  Description of Artificial Sequence: Synthetic coding sequence
atgtctgcccgggagcggcagcctgccctgaagaagaagatgaagaccctggccgagaggagaagaagtgcccccagcctcatcctggacaaggccctgcagaagaggcccaccacccgggacagccccagcgcctctgtggacacctgcaccttcctgagcagcctggtgtgcagcaacagaaccctgctgattgatggccgggcagagctgaagaggggcctgcagaggcaggagcggcacctgttcctgttcaatgacctgtttgtggtggccaagatcaagtacaacaacaacttcaagatcaagaacaagatcaagctgacagacatgtggacagccagctgtgtggatgaggtgggggagggcaacaccaatgccatgaagagctttgtgctgggctggcccaccgtgaactttgtggccaccttcagcagccctgagcagaaggacaagtggctgagcctgctgcagcgctacatcaacctggagaaggagaaggactaccccaagagcatccccctgaagatctttgccaaggacatcggcaactgtgcctacagcaagaccatcaccgtgatgaacagcgacacagccaatgaggtgatcaacatgagcctgcccatgctgggcatcactggaagtgagcgggactaccagctgtgggtgaacagcggcaaggaggaggccccctaccccctgattggacatgagtacccctacggcatcaagatgagccacctgcgggacagcgccctgctgaccccaggcagcaaggacagcaccacccccttcaacctgcaggagcccttcctgatggagcagctgccccgggagatgcagtgccagttcatcctgaagcccagccggctggccgccgcccagcagctgagtgacagcggccacaagaccttcaagagaagaagaagcatcatcaactgggccttctggaggggcagcagcacccacctggacaacctgcccagcagccccaccagccccatgcctggccagctgtttggcatcagcctgcccaacatctgtgaaaatgacaacctgcccaagcctgtgctggacatgctgttcttcctgaaccagaagggccccctgaccaagggcatcttccggcagagcgccaacgtgaagagctgccgggagctgaaggagaagctgaacagcggcgtggaggtgcacctggactgtgagagcatctttgtgattgcctctgtgctgaaggacttcctgaggaacatccctggcagcatcttcagcagtgacctgtatgaccactgggtgtctgtgatggaccagggcaatgatgaggagaagatcaacacagtgcagaggctgctggaccagctgccccgggccaacgtggtgctgctgcgctacctgtttggagtgctgcacaacatcgagcagcacagcagcagcaaccagatgacagccttcaacctggccgtgtgtgtggcccccagcatcctgtggcccccagccagcagcagccctgagctggagaatgagttcaccaagaaggtgtccctgctgatccagttcctgattgagaactgcctgcgcatctttggagaggagatcaccagcctcttccgggaggtgtctgtgcgctgtgacaccagagaaaatgccagtgacatcagctgcttccagctgaatgacagcagctatgacagcctggagaatgagctgaatgaagatgtggatgccccctgcagcgacctggtgaagaagctgggccagggcagccgctccatggattctgtgctgaccctgagtgactatgacctggaccagcctgaggtggagggcctgctgaccctgagtgactttgacctggcccacagcaaggatgaagatgtgcagatgaagaggcccctggagagcaagcctgtgaacatcctggtgtacaccaagatccccctgcgggaccacgcccgggcccccagcgccatgtgcacccccagctacctgagcacagctgctgccaatgctgccaagagcctgcggcggcaccggcgctgcagcgagcccagcattgactacctggacagcaagctgagctacctgcgggagttctaccagaagaagctgaggaagagcagctgtgatgccatcctgagccagaaggatgaggactacctgaagcagaaccagcccctgcaggaggagggcaagacctgcttcaagcagagcctggtgactggaacagatgtgtccaagaagaatgccaccacccagaacaccaagaagaagagcctgagcggcagcgagggcaaccacgtgaagctgttccccaagagcaagcctgtggccatctctgtggccagctacagccccatgagcagccaggaccacagcaagaaccagccctttgatgtgaacaccagcggctacagccccccccacacagcagatgccctgaagggccccaggacccaccggcgctgcagcgagcccaacatcgaggaccagaacaggaagctgacctacctgcggggcatctacagcaagaagcagcacaagaccagctgtgaggccggcctgctgcacggggaggaggactacctgaagaggcacaagagcctgcagatggagggccagaagctgatcaaccagagcctggtgatgggcatcgaggtgggcaagagcagcgccaccaaccagaacacagagaaggtgctgcccccccggctgaacctgtgccccaggaccagctacagcagcctgagcagccctggcaccagccccagcggcagctctgtgagcagccaggacagcgccttcagccagatcagcgagcacagcgtcttcacccccacagagaccagcagccccatcgactgcaccttccaggcccagaggaagcgggaggacctgagcccagacttcagcaatgccagccacgtgtctggcatgcctggccccagcagcggccaggcctgcagcaggcctgcctacaccaagaaggacaccatggagtggcacagccagatgcacagcgtgaccctgcaccccagcacctggctgagaaatggagtggccagcctgaagaactggagcctgaagaagaaggccaaggccgcccggcctgaggaggagaagatcgccagccccaagggccccctggagcccccacctcatgccagcggcgtgcctgaggccaacagcctgcaggaggagcagaaggacctgcccctgcgggctgctgagggcctgagccctgtgcagagcgcccagcgctgcagcagcagccccttccaggacagcgagcggcactgcagcagccccttcagcctggtggagagccggctgaagctgtgcatgaagagccatgaggagattgagcccggcagccagagcagcagcggcagcctgccctgggagcgggccagcgccagctcctggaccctggaggatgccaccagcccagattctggccccaccgtggtgtgtgacatcgaggaccgctacctgaccaaggacatctag

SEQ ID NO: 21670 - DNA, 3468 bp, Artificial Sequence
  Description of Artificial Sequence: Synthetic coding sequence
atgaagaccctggccgagcggcggcgcagcgcccccagcctcatcctggacaaggccctgcagaagaggcccaccacccgggacagccccagcgcctctgtggacacctgcaccttcctgagcagcctggtgtgcagcaacagaaccctgctgattgatggccgggcagagctgaagaggggcctgcagaggcaggagcggcacctgttcctgttcaatgacctgtttgtggtggccaagatcaagtacaacaacaacttcaagatcaagaacaagatcaagctgacagacatgtggacagccagctgtgtggatgaggtgggggagggcaacaccaatgccatgaagagctttgtgctgggctggcccaccgtgaactttgtggccaccttcagcagccctgagcagaaggacaagtggctgagcctgctgcagcgctacatcaacctggagaaggagaaggactaccccaagagcatccccctgaagatctttgccaaggacatcggcaactgtgcctacagcaagaccatcaccgtgatgaacagcgacacagccaatgaagtcatcaacatgagcctgcccatgctgggcatcaccggcagcgagcgggactaccagctgtgggtgaacagcggcaaggaggaggccccctaccccctcatcggccacgagtacccctacggcatcaagatgagccacctgcgggacagcgccctgctgaccccaggcagcaaggacagcaccacccccttcaacctgcaggagcccttcctgatggagcagctgccccgggagatgcagtgccagttcatcctgaagcccagccggctggccgccgcccagcagctgagtgacagcggccacaagaccttcaagagaagaagaagcatcatcaactgggccttctggaggggcagcagcacccacctggacaacctgcccagcagccccaccagccccatgcctggccagctgtttggcatcagcctgcccaacatctgtgaaaatgacaacctgcccaagcctgtgctggacatgctgttcttcctgaaccagaagggccccctgaccaagggcatcttccggcagagcgccaacgtgaagagctgccgggagctgaaggagaagctgaacagcggcgtggaggtgcacctggactgtgagagcatcttcgtcatcgcctctgtgctgaaggacttcctgaggaacatccctggcagcatcttcagcagtgacctgtatgaccactgggtgtctgtgatggaccagggcaatgatgaggagaagatcaacacagtgcagaggctgctggaccagctgccccgggccaacgtggtgctgctgcgctacctgtttggagtgctgcacaacatcgagcagcacagcagcagcaaccagatgacagccttcaacctggccgtgtgtgtggcccccagcatcctgtggcccccagccagcagcagccctgagctggagaatgagttcaccaagaaggtgtccctgctgatccagttcctgattgagaactgcctgcgcatctttggagaggagatcaccagcctcttccgggaggtgtctgtgcgctgtgacacccgggagaatgccagtgacatcagctgcttccagctgaatgacagcagctatgacagcctggagaatgagctgaatgaagatgtggatgccccctgcagcgacctggtgaagaagctgggccagggcagccgctccatggacagcgtgctgaccctgagtgactatgacctggaccagcctgaggtggagggcctgctgaccctgagtgactttgacctggcccacagcaaggatgaagatgtgcagatgaagaggcccctggagagcaagcctgtgaacatcctggtgtacaccaagatccccctgcgggaccacgcccgggcccccagcgccatgtgcacccccagctacctgagcacagctgctgccaatgctgccaagagcctgcggcggcaccggcgctgcagcgagcccagcattgactacctggacagcaagctgagctacctgcgggagttctaccagaagaagctgaggaagagcagctgtgatgccatcctgagccagaaggatgaggactacctgaagcagaaccagcccctgcaggaggagggcaagacctgcttcaagcagagcctggtgactggaacagatgtgtccaagaagaatgccaccacccagaacaccaagaagaagagcctgagcggcagcgagggcaaccacgtgaagctgttccccaagagcaagcctgtggccatctctgtggccagctacagccccatgagcagccaggaccacagcaagaaccagccctttgatgtgaacaccagcggctacagccccccccacacagcagatgccctgaagggccccaggacccaccggcgctgcagcgagcccaacatcgaggaccagaacaggaagctgacctacctgcggggcatctacagcaagaagcagcacaagaccagctgtgaggccggcctgctgcatggagaggaggactacctgaagaggcacaagagcctgcagatggagggccagaagctgatcaaccagagcctggtgatgggcatcgaggtgggcaagagcagcgccaccaaccagaacacagagaaggtgctgcccccccggctgaacctgtgccccaggaccagctacagcagcctgagcagccctggcaccagccccagcggcagctctgtgagcagccaggacagcgccttcagccagatcagcgagcacagcgtcttcacccccacagagaccagcagccccatcgactgcaccttccaggcccagaggaagcgggaggacctgagcccagacttcagcaatgccagccacgtgtctggcatgcctggccccagcagcggccaggcctgcagcaggcctgcctacaccaagaaggacaccatggagtggcacagccagatgcacagcgtgaccctgcaccccagcacctggctgagaaatggagtggccagcctgaagaactggagcctgaagaagaaggccaaggccgcccggcctgaggaggagaagatcgccagccccaagggccccctggagcccccaccccacgccagcggcgtgcctgaggccaacagcctgcaggaggagcagaaggacctgcccctgcgggctgctgagggcctgagccctgtgcagagcgcccagcgctgcagcagcagccccttccaggacagcgagcggcactgcagcagccccttcagcctggtggagagccggctgaagctgtgcatgaagagccatgaggagattgagcccggcagccagagcagcagcggcagcctgccctgggagcgggccagcgccagctcctggaccctggaggatgccaccagcccagacagcggccccaccgtggtgtgtgacattgaagatcgctacctgaccaaggacatctag

SEQ ID NO: 21671 - DNA, 3468 bp, Artificial Sequence; identical to SEQ ID NO: 21670
  Description of Artificial Sequence: Synthetic coding sequence

SEQ ID NO: 21672 - DNA, 2196 bp, Artificial Sequence
  Description of Artificial Sequence: Synthetic coding sequence
atggaccagggcaatgatgaggagaagatcaacacagtgcagaggctgctggaccagctgccccgggccaacgtggtgctgctgcgctacctgtttggagtgctgcacaacatcgagcagcacagcagcagcaaccagatgacagccttcaacctggccgtgtgtgtggcccccagcatcctgtggcccccagccagcagcagccctgagctggagaatgagttcaccaagaaggtgtccctgctgatccagttcctgattgagaactgcctgcgcatctttggagaggagatcaccagcctcttccgggaggtgtctgtgcgctgtgacaccagagaaaatgccagtgacatcagctgcttccagctgaatgacagcagctatgacagcctggagaatgagctgaatgaagatgtggatgccccctgcagcgacctggtgaagaagctgggccagggcagccgctccatggattctgtgctgaccctgagtgactatgacctggaccagcctgaggtggagggcctgctgaccctgagtgactttgacctggcccacagcaaggatgaagatgtgcagatgaagaggcccctggagagcaagcctgtgaacatcctggtgtacaccaagatccccctgcgggaccacgcccgggcccccagcgccatgtgcacccccagctacctgagcacagctgctgccaatgctgccaagagcctgcggcggcaccggcgctgcagcgagcccagcattgactacctggacagcaagctgagctacctgcgggagttctaccagaagaagctgaggaagagcagctgtgatgccatcctgagccagaaggatgaggactacctgaagcagaaccagcccctgcaggaggagggcaagacctgcttcaagcagagcctggtgactggaacagatgtgtccaagaagaatgccaccacccagaacaccaagaagaagagcctgagcggcagcgagggcaaccacgtgaagctgttccccaagagcaagcctgtggccatctctgtggccagctacagccccatgagcagccaggaccacagcaagaaccagccctttgatgtgaacaccagcggctacagccccccccacacagcagatgccctgaagggccccaggacccaccggcgctgcagcgagcccaacatcgaggaccagaacaggaagctgacctacctgcggggcatctacagcaagaagcagcacaagaccagctgtgaggccggcctgctgcacggggaggaggactacctgaagaggcacaagagcctgcagatggagggccagaagctgatcaaccagagcctggtgatgggcatcgaggtgggcaagagcagcgccaccaaccagaacacagagaaggtgctgcccccccggctgaacctgtgccccaggaccagctacagcagcctgagcagccctggcaccagccccagcggcagctctgtgagcagccaggacagcgccttcagccagatcagcgagcacagcgtcttcacccccacagagaccagcagccccatcgactgcaccttccaggcccagaggaagcgggaggacctgagcccagacttcagcaatgccagccacgtgtctggcatgcctggccccagcagcggccaggcctgcagcaggcctgcctacaccaagaaggacaccatggagtggcacagccagatgcacagcgtgaccctgcaccccagcacctggctgagaaatggagtggccagcctgaagaactggagcctgaagaagaaggccaaggccgcccggcctgaggaggagaagatcgccagccccaagggccccctggagcccccacctcatgccagcggcgtgcctgaggccaacagcctgcaggaggagcagaaggacctgcccctgcgggctgctgagggcctgagccctgtgcagagcgcccagcgctgcagcagcagccccttccaggacagcgagcggcactgcagcagccccttcagcctggtggagagccggctgaagctgtgcatgaagagccatgaggagattgagcccggcagccagagcagcagcggcagcctgccctgggagcgggccagcgccagctcctggaccctggaggatgccaccagcccagattctggccccaccgtggtgtgtgacatcgaggacaggaactgctgctag

SEQ ID NO: 21673 - DNA, 3498 bp, Artificial Sequence; identical to SEQ ID NO: 21668
  Description of Artificial Sequence: Synthetic coding sequence

SEQ ID NO: 21674 - DNA, 4542 bp, Artificial Sequence
  Description of Artificial Sequence: Synthetic coding sequence
atgatgatggccaggaagcaggatgtgcgcatccccacctacaacatctctgtggtgggcctgagcggcacagagaaggagaagggccagtgtggcatcggcaagagctgcctgtgcaacagatttgtgcggcccagcgcagatgagttccacctggaccacacctctgtgctgagcaccagtgactttggaggccgggtggtgaacaatgaccacttcctgtactggggcgaggtgagccgcagcctggaggactgtgtggagtgcaagatgcacatcgtggagcagacagagttcattgatgaccagaccttccagccccacaggagcacagccctgcagccctacatcaagagagctgctgccaccaagctggccagcgctgagaagctgatgtacttctgcacagaccagctgggcctggagcaggactttgagcagaagcagatgccagatggcaagctgctggtggatggcttcctgctgggcattgatgtgtcccggggcatgaacagaaactttgatgaccagctgaagtttgtgagcaacctgtacaaccagctggccaagaccaagaagcccatcgtggtggtgctgaccaagtgtgatgaaggagtggagcgctacatcagagatgcccacacctttgccctgagcaagaagaacctgcaggtggtggagaccagcgcccggagcaatgtgaatgtggacctggccttcagcaccctggtgcagctgattgacaagagccggggcaagaccaagatcatcccctactttgaggccctgaagcagcagagccagcagatcgccacagccaaggacaagtatgagtggctggtgagccgcatcgtgaagaaccacaatgaaaactggctgtctgtgtccaggaagatgcaggccagccctgagtaccaggactatgtgtacctggagggcacccagaaggccaagaagctgttcctgcagcacatccaccggctgaagcatgagcacattgaaagaagaaggaagctgtacctggccgccctgcccctggcctttgaggccctgatccccaacctggatgaaattgaccacctgagctgcatcaaggccaagaagctgctggagaccaagccagagttcctgaagtggtttgtggtgctggaggagaccccctgggatgccaccagccacatcgacaacatggagaatgaaagaatcccctttgacctgatggacacagtgcctgctgagcagctgtatgaggcccacctggagaagctgagaaatgaaaggaagagggtggagatgagaagagccttcaaggagaacctggagaccagccccttcatcacccctgggaagccctgggaggaggcccgctccttcatcatgaatgaagacttctaccagtggctggaggagagcgtgtacatggacatctacggcaagcaccagaagcagatcatcgacaaggccaaggaggagttccaggagctgctgctggagtacagcgagctgttctatgagctggagctggatgccaagcccagcaaggagaagatgggcgtcatccaggatgtgctgggggaggagcagcgcttcaaggccctgcagaagctgcaggccgagagagatgccctgatcctgaagcacatccactttgtgtaccaccccaccaaggagacctgccccagctgcccagcctgtgtggatgccaagattgagcacctgatcagcagccgcttcatccggcccagcgacaggaaccagaagaacagcctgagtgaccccaacatcgaccgcatcaacctggtgatcctgggcaaggatggcctggcccgggagctggccaatgagatccgggccctgtgcaccaatgatgacaagtatgtgattgatggcaagatgtatgagctgagcctgcggcccatcgagggcaatgtgcggctgcctgtgaacagcttccagacccccaccttccagccccacggctgcctgtgcctgtacaacagcaaggagagcctgtcctatgtggtggagagcattgagaagagccgggagagcaccctgggccggcgggacaaccacctggtgcacctgcccctgaccctcatcctggtgaacaagagaggagacaccagcggggagaccctgcacagcctcatccagcagggccagcagatcgccagcaagctgcagtgtgtgttcctggaccctgccagcgctggcatcggctacggcaggaacatcaatgagaagcagatcagccaggtgctgaagggcctgctggacagcaagaggaacctgaacctggtgagcagcacagccagcatcaaggacctggctgatgtggacctgcgcatcgtgatgtgcctgatgtgtggggaccccttcagcgcagatgacatcctcttccctgtgctgcagagccagacctgcaagagcagccactgcggcagcaacaacagcgtgctgctggagctgcccatcggcctgcacaagaagagaattgagctgtctgtgctgagctaccacagcagcttcagcatcaggaagagccggctggtgcacggctacatcgtgttctacagcgccaagaggaaggccagcctggccatgctgcgggccttcctgtgtgaggtgcaggacatcatccccatccagctggtggccctgacagatggagctgtggatgtgctggacaatgacctgagccgggagcagctgacagaaggagaggagatcgcccaggagattgatggccgcttcaccagcatcccctgcagccagccccagcacaagctggagatcttccaccccttcttcaaggatgtggtggagaagaagaacatcatcgaggccacccacatgtatgacaatgctgctgaggcctgcagcaccacagaggaggtgttcaacagccccagggctggcagccccctgtgcaacagcaacctgcaggacagtgaagaagatattgagcccagctacagcctcttccgggaggacaccagcctgcccagcctgagcaaggaccacagcaagctgtccatggagctggagggcaatgatggcctgtccttcatcatgagcaactttgagagcaagctgaacaacaaggtgcccccacctgtgaagcccaagccccctgtgcactttgagatcaccaagggggacctgagctacctggaccagggccacagagatggccagaggaagtctgtgagcagcagcccctggctgccccaggacggctttgaccccagcgactatgcagagcccatggatgctgtggtgaagcccagaaatgaggaggagaacatctacagcgtgccccatgacagcacccagggcaagatcatcaccatccggaacatcaacaaggcccagagcaatggcagcggaaatggaagtgacagcgagatggacaccagcagcctggagcggggcaggaaggtgtccatcgtgtccaagcctgtgctgtaccgcacccgctgcacccggctgggccgctttgccagctaccgcaccagcttctctgtgggcagtgatgatgagctgggccccatcaggaagaaggaggaggaccaggccagccagggctacaagggggacaatgctgtgatcccctatgaaacagatgaggaccccaggagaagaaacatcctgcggagcctgcggaggaacaccaagaagcccaagcccaagccccggcccagcatcaccaaggccacctgggagagcaactactttggagtgcccctgaccaccgtggtgaccccagagaagcccatccccatcttcatcgagcgctgcatcgagtacatcgaggccaccggcctgagcacagagggcatctacagagtgtctggcaacaagtctgagatggagagcctgcagaggcagtttgaccaggaccacaacctggacctggccgagaaggacttcaccgtgaacacagtggccggggccatgaagagcttcttcagcgagctgcctgaccccctggtgccctacaacatgcagattgacctggtggaggcccacaagatcaatgaccgggagcagaagctgcacgccctgaaggaggtgctgaagaagttccccaaggaaaatcatgaggtgttcaagtatgtgatcagccacctgaacaaggtgagccacaacaacaaggtgaacctgatgaccagcgagaacctgagcatctgcttctggcccaccctgatgaggccagacttcagcaccatggatgccctgacagccaccaggacctaccagaccatcatcgagctgttcatccagcagtgccccttcttcttctacaaccggcccatcacagagcccccaggggcccggcccagcagccccagcgctgtggccagcacagtgcccttcctgaccagcacccctgtgaccagccagcccagccccccccagagccccccacccaccccccagagccccatgcagcccctgctgcccagccccctgcacccccaccggcccaccccccagcccagcaggaacatcccctggcagaccaaggagcactag

SEQ ID NO: 21675 - DNA, 4500 bp, Artificial Sequence
  Description of Artificial Sequence: Synthetic coding sequence
atgatgatggccaggaagcaggatgtgcgcatccccacctacaacatctctgtggtgggcctgagcggcacagagaaggagaagggccagtgtggcatcggcaagagctgcctgtgcaacagatttgtgcggcccagcgcagatgagttccacctggaccacacctctgtgctgagcaccagtgactttggaggccgggtggtgaacaatgaccacttcctgtactggggcgaggtgagccgcagcctggaggactgtgtggagtgcaagatgcacatcgtggagcagacagagttcattgatgaccagaccttccagccccacaggagcacagccctgcagccctacatcaagagagctgctgccaccaagctggccagcgctgagaagctgatgtacttctgcacagaccagctgggcctggagcaggactttgagcagaagcagatgccagatggcaagctgctggtggatggcttcctgctgggcattgatgtgtcccggggcatgaacagaaactttgatgaccagctgaagtttgtgagcaacctgtacaaccagctggccaagaccaagaagcccatcgtggtggtgctgaccaagtgtgatgaaggagtggagcgctacatcagagatgcccacacctttgccctgagcaagaagaacctgcaggtggtggagaccagcgcccggagcaatgtgaatgtggacctggccttcagcaccctggtgcagctgattgacaagagccggggcaagaccaagatcatcccctactttgaggccctgaagcagcagagccagcagatcgccacagccaaggacaagtatgagtggctggtgagccgcatcgtgaagaaccacaatgaaaactggctgtctgtgtccaggaagatgcaggccagccctgagtaccaggactatgtgtacctggagggcacccagaaggccaagaagctgttcctgcagcacatccaccggctgaagcatgagcacattgaaagaagaaggaagctgtacctggccgccctgcccctggcctttgaggccctgatccccaacctggatgaaattgaccacctgagctgcatcaaggccaagaagctgctggagaccaagccagagttcctgaagtggtttgtggtgctggaggagaccccctgggatgccaccagccacatcgacaacatggagaatgaaagaatcccctttgacctgatggacacagtgcctgctgagcagctgtatgaggcccacctggagaagctgagaaatgaaaggaagagggtggagatgagaagagccttcaaggagaacctggagaccagccccttcatcacccctgggaagccctgggaggaggcccgctccttcatcatgaatgaagacttctaccagtggctggaggagagcgtgtacatggacatctacggcaagcaccagaagcagatcatcgacaaggccaaggaggagttccaggagctgctgctggagtacagcgagctgttctatgagctggagctggatgccaagcccagcaaggagaagatgggcgtcatccaggatgtgctgggggaggagcagcgcttcaaggccctgcagaagctgcaggccgagagagatgccctgatcctgaagcacatccactttgtgtaccaccccaccaaggagacctgccccagctgcccagcctgtgtggatgccaagattgagcacctgatcagcagccgcttcatccggcccagcgacaggaaccagaagaacagcctgagtgaccccaacatcgaccgcatcaacctggtgatcctgggcaaggatggcctggcccgggagctggccaatgagatccgggccctgtgcaccaatgatgacaagtatgtgattgatggcaagatgtatgagctgagcctgcggcccatcgagggcaatgtgcggctgcctgtgaacagcttccagacccccaccttccagccccacggctgcctgtgcctgtacaacagcaaggagagcctgtcctatgtggtggagagcattgagaagagccgggagagcaccctgggccggcgggacaaccacctggtgcacctgcccctgaccctcatcctggtgaacaagagaggagacaccagcggggagaccctgcacagcctcatccagcagggccagcagatcgccagcaagctgcagtgtgtgttcctggaccctgccagcgctggcatcggctacggcaggaacatcaatgagaagcagatcagccaggtgctgaagggcctgctggacagcaagaggaacctgaacctggtgagcagcacagccagcatcaaggacctggctgatgtggacctgcgcatcgtgatgtgcctgatgtgtggggaccccttcagcgcagatgacatcctcttccctgtgctgcagagccagacctgcaagagcagccactgcggcagcaacaacagcgtgctgctggagctgcccatcggcctgcacaagaagagaattgagctgtctgtgctgagctaccacagcagcttcagcatcaggaagagccggctggtgcacggctacatcgtgttctacagcgccaagaggaaggccagcctggccatgctgcgggccttcctgtgtgaggtgcaggacatcatccccatccagctggtggccctgacagatggagctgtggatgtgctggacaatgacctgagccgggagcagctgacagaaggagaggagatcgcccaggagattgatggccgcttcaccagcatcccctgcagccagccccagcacaagctggagatcttccaccccttcttcaaggatgtggtggagaagaagaacatcatcgaggccacccacatgtatgacaatgctgctgaggcctgcagcaccacagaggaggtgttcaacagccccagggctggcagccccctgtgcaacagcaacctgcaggacagtgaagaagatattgagcccagctacagcctcttccgggaggacaccagcctgcccagcctgagcaaggaccacagcaagctgtccatggagctggagggcaatgatggcctgtccttcatcatgagcaactttgagagcaagctgaacaacaaggtgcccccacctgtgaagcccaagccccctgtgcactttgagatcaccaagggggacctgagctacctggaccagggccacagagatggccagaggaagtctgtgagcagcagcccctggctgccccaggacggctttgaccccagcgactatgcagagcccatggatgctgtggtgaagcccagaaatgaggaggagaacatctacagcgtgccccatgacagcacccagggcaagatcatcaccatccggaacatcaacaaggcccagagcaatggcagcggaaatggaagtgacagcgagatggacaccagcagcctggagcggggcaggaaggtgtccatcgtgtccaagcctgtgctgtaccgcacccgctgcacccggctgggccgctttgccagctaccgcaccagcttctctgtgggcagtgatgatgagctgggccccatcaggaagaaggaggaggaccaggccagccagggctacaagggggacaatgctgtgatcccctatgaaacagatgaggaccccaggagaagaaacatcctgcggagcctgcggaggaacaccaagaagcccaagcccaagccccggcccagcatcaccaaggccacctgggagagcaactactttggagtgcccctgaccaccgtggtgaccccagagaagcccatccccatcttcatcgagcgctgcatcgagtacatcgaggccaccggcctgagcacagagggcatctacagagtgtctggcaacaagtctgagatggagagcctgcagaggcagtttgaccaggaccacaacctggacctggccgagaaggacttcaccgtgaacacagtggccggggccatgaagagcttcttcagcgagctgcctgaccccctggtgccctacaacatgcagattgacctggtggaggcccacaagatcaatgaccgggagcagaagctgcacgccctgaaggaggtgctgaagaagttccccaaggaaaatcatgaggtgttcaagtatgtgatcagccacctgaacaaggtgagccacaacaacaaggtgaacctgatgaccagcgagaacctgagcatctgcttctggcccaccctgatgaggccagacttcagcaccatggatgccctgacagccaccaggacctaccagaccatcatcgagctgttcatccagcagtgccccttcttcttctacaaccggcccatcacagagcccccaggggcccggcccagcagccccagcgctgtggccagcacagtgcccttcctgaccagcacccctgtgaccagccagcccagccccccccagagccccccacccaccccccagagccccatgcagcccctgctgcccagccagctgcaggccgagcacaccctgtag

SEQ ID NO: 21676 - DNA, 2250 bp, Artificial Sequence
  Description of Artificial Sequence: Synthetic coding sequence
atgatgatggccaggaagcaggatgtgcgcatccccacctacaacatctctgtggtgggcctgagcggcacagagaaggagaagggccagtgtggcatcggcaagagctgcctgtgcaacagatttgtgcggcccagcgcagatgagttccacctggaccacacctctgtgctgagcaccagtgactttggaggccgggtggtgaacaatgaccacttcctgtactggggcgaggtgagccgcagcctggaggactgtgtggagtgcaagatgcacatcgtggagcagacagagttcattgatgaccagaccttccagccccacaggagcacagccctgcagccctacatcaagagagctgctgccaccaagctggccagcgctgagaagctgatgtacttctgcacagaccagctgggcctggagcaggactttgagcagaagcagatgccagatggcaagctgctggtggatggcttcctgctgggcattgatgtgtcccggggcatgaacagaaactttgatgaccagctgaagtttgtgagcaacctgtacaaccagctggccaagaccaagaagcccatcgtggtggtgctgaccaagtgtgatgaaggagtggagcgctacatcagagatgcccacacctttgccctgagcaagaagaacctgcaggtggtggagaccagcgcccggagcaatgtgaatgtggacctggccttcagcaccctggtgcagctgattgacaagagccggggcaagaccaagatcatcccctactttgaggccctgaagcagcagagccagcagatcgccacagccaaggacaagtatgagtggctggtgagccgcatcgtgaagaaccacaatgaaaactggctgtctgtgtccaggaagatgcaggccagccctgagtaccaggactatgtgtacctggagggcacccagaaggccaagaagctgttcctgcagcacatccaccggctgaagcatgagcacattgaaagaagaaggaagctgtacctggccgccctgcccctggcctttgaggccctgatccccaacctggatgaaattgaccacctgagctgcatcaaggccaagaagctgctggagaccaagccagagttcctgaagtggtttgtggtgctggaggagaccccctgggatgccaccagccacatcgacaacatggagaatgaaagaatcccctttgacctgatggacacagtgcctgctgagcagctgtatgaggcccacctggagaagctgagaaatgaaaggaagagggtggagatgagaagagccttcaaggagaacctggagaccagccccttcatcacccctgggaagccctgggaggaggcccgctccttcatcatgaatgaagacttctaccagtggctggaggagagcgtgtacatggacatctacggcaagcaccagaagcagatcatcgacaaggccaaggaggagttccaggagctgctgctggagtacagcgagctgttctatgagctggagctggatgccaagcccagcaaggagaagatgggcgtcatccaggatgtgctgggggaggagcagcgcttcaaggccctgcagaagctgcaggccgagagagatgccctgatcctgaagcacatccactttgtgtaccaccccaccaaggagacctgccccagctgcccagcctgtgtggatgccaagattgagcacctgatcagcagccgcttcatccggcccagcgacaggaaccagaagaacagcctgagtgaccccaacatcgaccgcatcaacctggtgatcctgggcaaggatggcctggcccgggagctggccaatgagatccgggccctgtgcaccaatgatgacaagtatgtgattgatggcaagatgtatgagctgagcctgcggcccatcgagggcaatgtgcggctgcctgtgaacagcttccagacccccaccttccagccccacggctgcctgtgcctgtacaacagcaaggagagcctgtcctatgtggtggagagcattgagaagagccgggagagcaccctgggccggcgggacaaccacctggtgcacctgcccctgaccctcatcctggtgaacaagagaggagacaccagcggggagaccctgcacagcctcatccagcagggccagcagatcgccagcaagctgcagtgtgtgttcctggaccctgccagcgctggagctgctgacctgtcctggctgggccccatctag

SEQ ID NO: 21677 - DNA, 978 bp, Artificial Sequence
  Description of Artificial Sequence: Synthetic coding sequence
atggacatgtggacagccctgctgatcctgcaggccctgctgctgcccagcctggctgatggagccaccccagccctgcgctttgtggccgtgggggactggggcggcgtgcccaatgcccccttccacacagcccgggagatggccaatgccaaggagatcgccaggacagtgcagatcctgggcgctgacttcatcctgagcctgggggacaacttctacttcaccggggtgcaggacatcaatgacaagcgcttccaggagacctttgaagatgtgttcagtgacaggagcctgaggaaggtgccctggtacgtgctggccggcaaccacgaccacctgggcaatgtgtctgcccagatcgcctacagcaagatcagcaagcgctggaacttccccagccccttctaccgcctgcacttcaagatcccccagaccaacgtgtctgtggccatcttcatgctggacacagtgaccctgtgtggcaacagtgatgacttcctgagccagcagcctgagcggcccagagatgtgaagctggcccggacccagctgtcctggctgaagaagcagctggccgccgccagagaagattatgtgctggtggccggccactaccctgtgtggagcattgctgagcacggccccacccactgcctggtgaagcagctgcggcccctgctggccacctatggagtgacagcctacctgtgtggccatgaccacaacctgcagtacctgcaggatgaaaatggagtgggctacgtgctgagcggggccggcaacttcatggaccccagcaagaggcaccagaggaaggtgcccaacggctacctgcgcttccactatggaacagaggacagcctgggcggctttgcctacgtggagatcagcagcaaggagatgacagtgacctacatcgaggccagcggcaagagcctcttcaagacccggctgccccggcgggcccggccctag

SEQ ID NO: 21678 - DNA, 2349 bp, Artificial Sequence
  Description of Artificial Sequence: Synthetic coding sequence
atgaacagcgctgagcagacagtgacctggctgatcaccctgggcgtgctggagagccccaagaagaccatcagtgaccctgagggcttcctgcaggccagcctgaaggatggagtggtgctgtgccgcctgctggagcggctgctgcccggcaccatcgagaaggtgtacccagagcccaggtctgagagtgaatgtctgagcaacatccgggagttcctgcggggctgtggggccagcctgcggctggagacctttgatgccaatgacctgtaccagggccagaacttcaacaaggtgctgagcagcctggtgaccctgaacaaggtgacagctgacatcggcctgggcagtgacagcgtgtgtgcccggcccagcagccaccgcatcaagagctttgacagcctgggcagccagagcctgcacaccaggaccagcaagctgttccagggccagtaccgcagcctggacatgacagacaacagcaacaaccagctggtggtgcgggccaagttcaacttccagcagaccaatgaagatgagctgtccttcagcaaaggagatgtgattcatgtgaccagggtggaggagggcggctggtgggagggcaccctgaatggccgcacaggctggttccccagcaactacgtgcgggaggtgaaggccagcgagaagcctgtgagccccaagagcggcaccctgaagagcccccccaagggctttgacaccacagccatcaacaagagctactacaacgtggtgctgcagaacatcctggagacagaaaatgagtacagcaaggagctgcagacagtgctgagcacctacctgcggcccctgcagaccagcgagaagctgagcagcgccaacatctcctacctgatgggcaacctggaggagatctgcagcttccagcagatgctggtgcagagcctggaggagtgcaccaagctgcctgaggcccagcagagggtgggcggctgcttcctgaacctgatgccccagatgaagaccctgtacctgacctactgtgccaaccaccccagcgctgtgaatgtgctgacagagcacagcgaggagctgggggagttcatggagaccaagggggccagcagccctggcatcctggtgctgaccaccggcctgagcaagcccttcatgaggctggacaagtaccccaccctgctgaaggagctggagcggcacatggaggactaccacacagaccggcaggacatccagaagtccatggccgccttcaagaacctgagcgcccagtgccaggaggtgaggaagaggaaggagctggagctgcagatcctgacagaggccatccggaactgggagggagatgacatcaagaccctgggcaatgtgacctacatgagccaggtgctgatccagtgtgccggcagcgaggagaagaatgaaagatacctgctgctcttccccaacgtgctgctgatgctgagcgccagccccaggatgagcggcttcatctaccagggcaagctgcccaccaccggcatgaccatcaccaagctggaggacagcgagaaccacagaaatgcctttgagatcagcggctccatgattgaaagaatcctggtgtcctgcaacaaccagcaggacctgcaggagtgggtggagcacctgcagaagcagaccaaggtgacctctgtgggcaaccccaccatcaagccccacagcgtgcccagccacaccctgcccagccaccctgtgacccccagcagcaagcacgccgacagcaagccagcccccctgaccccagcctaccacaccctgccccaccccagccaccacggcaccccccacaccaccatcaactggggccccctggagccccccaagacccccaagccctggagcctgagctgcctgcggcctgccccacccctgcggcccagcgctgccctgtgctacaaggaggacctgagcaagagccccaagaccatgaagaagctgctgcccaagaggaagccagagaggaagcccagtgatgaggagtttgccagcaggaagagcacagctgccctggaggaggatgcccagatcctgaaggtgattgaggcctactgcaccagcgccaagacccggcagaccctgaacagcacctggcagggcacagacctgatgcacaaccacgtgctggctgatgatgaccagcccagcctggacagcctgggcagaagaagcagcctgagccggctggagcccagcgacctgtctgaagattctgactatgacagcatctggacagcccacagctacaggatgggcagcaccagcaggaagagctgctgcagctacatcagccaccagaactag

SEQ ID NO: 21679 - DNA, 2196 bp, Artificial Sequence
  Description of Artificial Sequence: Synthetic coding sequence
atgaacagcgctgagcagacagtgacctggctgatcaccctgggcgtgctggagagccccaagaagaccatcagtgaccctgagggcttcctgcaggccagcctgaaggatggagtggtgctgtgccgcctgctggagcggctgctgcccggcaccatcgagaaggtgtacccagagcccaggtctgagagtgaatgtctgagcaacatccgggagttcctgcggggctgtggggccagcctgcggctggaggacatgacagacaacagcaacaaccagctggtggtgcgggccaagttcaacttccagcagaccaatgaagatgagctgtccttcagcaaaggagatgtgattcatgtgaccagggtggaggagggcggctggtgggagggcaccctgaatggccgcacaggctggttccccagcaactacgtgcgggaggtgaaggccagcgagaagcctgtgagccccaagagcggcaccctgaagagcccccccaagggctttgacaccacagccatcaacaagagctactacaacgtggtgctgcagaacatcctggagacagaaaatgagtacagcaaggagctgcagacagtgctgagcacctacctgcggcccctgcagaccagcgagaagctgagcagcgccaacatctcctacctgatgggcaacctggaggagatctgcagcttccagcagatgctggtgcagagcctggaggagtgcaccaagctgcctgaggcccagcagagggtgggcggctgcttcctgaacctgatgccccagatgaagaccctgtacctgacctactgtgccaaccaccccagcgctgtgaatgtgctgacagagcacagcgaggagctgggggagttcatggagaccaagggggccagcagccctggcatcctggtgctgaccaccggcctgagcaagcccttcatgaggctggacaagtaccccaccctgctgaaggagctggagcggcacatggaggactaccacacagaccggcaggacatccagaagtccatggccgccttcaagaacctgagcgcccagtgccaggaggtgaggaagaggaaggagctggagctgcagatcctgacagaggccatccggaactgggagggagatgacatcaagaccctgggcaatgtgacctacatgagccaggtgctgatccagtgtgccggcagcgaggagaagaatgaaagatacctgctgctcttccccaacgtgctgctgatgctgagcgccagccccaggatgagcggcttcatctaccagggcaagctgcccaccaccggcatgaccatcaccaagctggaggacagcgagaaccacagaaatgcctttgagatcagcggctccatgattgaaagaatcctggtgtcctgcaacaaccagcaggacctgcaggagtgggtggagcacctgcagaagcagaccaaggtgacctctgtgggcaaccccaccatcaagccccacagcgtgcccagccacaccctgcccagccaccctgtgacccccagcagcaagcacgccgacagcaagccagcccccctgaccccagcctaccacaccctgccccaccccagccaccacggcaccccccacaccaccatcaactggggccccctggagccccccaagacccccaagccctggagcctgagctgcctgcggcctgccccacccctgcggcccagcgctgccctgtgctacaaggaggacctgagcaagagccccaagaccatgaagaagctgctgcccaagaggaagccagagaggaagcccagtgatgaggagtttgccagcaggaagagcacagctgccctggaggaggatgcccagatcctgaaggtgattgaggcctactgcaccagcgccaagacccggcagaccctgaacagcagcagcaggaaggagagcgccccccaggtgctgctgcctgaggaggagaagatcatcgtggaggagaccaagagcaatggccagaccgtcatcgaggagaagagcctggtggacacagtgtatgccctgaaggatgaggtgcaggagctgcggcaggacaacaagaagatgaagaagagcctggaggaggagcagagggccaggaaggacctggagaagctggtgaggaaggtgctgaagaacatgaatgaccctgcctgggatgagaccaacctgtag

SEQ ID NO: 21680 - DNA, 1878 bp, Artificial Sequence
  Description of Artificial Sequence: Synthetic coding sequence
atgacagacaacagcaacaaccagctggtggtgcgggccaagttcaacttccagcagaccaatgaagatgagctgtccttcagcaaaggagatgtgatccacgtgaccagggtggaggagggcggctggtgggagggcaccctgaatggaagaacaggctggttccccagcaactacgtgcgggaggtgaaggccagcgagaagcctgtgagccccaagagcggcaccctgaagagcccccccaagggctttgacaccacagccatcaacaagagctactacaacgtggtgctgcagaacatcctggagacagaaaatgagtacagcaaggagctgcagacagtgctgagcacctacctgcggcccctgcagaccagcgagaagctgagcagcgccaacatctcctacctgatgggcaacctggaggagatctgcagcttccagcagatgctggtgcagagcctggaggagtgcaccaagctgcctgaggcccagcagagggtgggcggctgcttcctgaacctgatgccccagatgaagaccctgtacctgacctactgtgccaaccaccccagcgctgtgaatgtgctgacagagcacagcgaggagctgggggagttcatggagaccaagggggccagcagccctggcatcctggtgctgaccaccggcctgagcaagcccttcatgaggctggacaagtaccccaccctgctgaaggagctggagcggcacatggaggactaccacacagaccggcaggacatccagaagtccatggccgccttcaagaacctgagcgcccagtgccaggaggtgaggaagaggaaggagctggagctgcagatcctgacagaggccatccggaactgggagggagatgacatcaagaccctgggcaatgtgacctacatgagccaggtgctgatccagtgtgccggcagcgaggagaagaatgaaagatacctgctgctcttccccaacgtgctgctgatgctgagcgccagccccaggatgagcggcttcatctaccagggcaagctgcccaccaccggcatgaccatcaccaagctggaggacagcgagaaccacagaaatgcctttgagatcagcggctccatgattgagcgcatcctggtgtcctgcaacaaccagcaggacctgcaggagtgggtggagcacctgcagaagcagaccaaggtgacctctgtgggcaaccccaccatcaagccccacagcgtgcccagccacaccctgcccagccaccctgtgacccccagcagcaagcatgctgacagcaagccagcccccctgaccccagcctaccacaccctgccccaccccagccaccacggcaccccccacaccaccatcaactggggccccctggagccccccaagacccccaagccctggagcctgagctgcctgcggcctgccccacccctgcggcccagcgctgccctgtgctacaaggaggacctgagcaagagccccaagaccatgaagaagctgctgcccaagaggaagccagagaggaagcccagtgatgaggagtttgccagcaggaagagcacagctgccctggaggaggatgcccagatcctgaaggtgattgaggcctactgcaccagcgccaagacccggcagaccctgaacagcacctggcagggcacagacctgatgcacaaccacgtgctggctgatgatgaccagcccagcctggacagcctgggccgccgcagcagcctgagccggctggagcccagcgacctgtctgaggacagcgactatgacagcatctggacagcccacagctacaggatgggcagcaccagcaggaagagctgctgcagctacatcagccaccagaactag

SEQ ID NO: 21681 - DNA, 1941 bp, Artificial Sequence
  Description of Artificial Sequence: Synthetic coding sequence
atgacagacaacagcaacaaccagctggtggtgcgggccaagttcaacttccagcagaccaatgaagatgagctgtccttcagcaaaggagatgtgatccacgtgaccagggtggaggagggcggctggtgggagggcaccctgaatggaagaacaggctggttccccagcaactacgtgcgggaggtgaaggccagcgagaagcctgtgagccccaagagcggcaccctgaagagcccccccaagggctttgacaccacagccatcaacaagagctactacaacgtggtgctgcagaacatcctggagacagaaaatgagtacagcaaggagctgcagacagtgctgagcacctacctgcggcccctgcagaccagcgagaagctgagcagcgccaacatctcctacctgatgggcaacctggaggagatctgcagcttccagcagatgctggtgcagagcctggaggagtgcaccaagctgcctgaggcccagcagagggtgggcggctgcttcctgaacctgatgccccagatgaagaccctgtacctgacctactgtgccaaccaccccagcgctgtgaatgtgctgacagagcacagcgaggagctgggggagttcatggagaccaagggggccagcagccctggcatcctggtgctgaccaccggcctgagcaagcccttcatgaggctggacaagtaccccaccctgctgaaggagctggagcggcacatggaggactaccacacagaccggcaggacatccagaagtccatggccgccttcaagaacctgagcgcccagtgccaggaggtgaggaagaggaaggagctggagctgcagatcctgacagaggccatccggaactgggagggagatgacatcaagaccctgggcaatgtgacctacatgagccaggtgctgatccagtgtgccggcagcgaggagaagaatgaaagatacctgctgctcttccccaacgtgctgctgatgctgagcgccagccccaggatgagcggcttcatctaccagggcaagctgcccaccaccggcatgaccatcaccaagctggaggacagcgagaaccacagaaatgcctttgagatcagcggctccatgattgagcgcatcctggtgtcctgcaacaaccagcaggacctgcaggagtgggtggagcacctgcagaagcagaccaaggtgacctctgtgggcaaccccaccatcaagccccacagcgtgcccagccacaccctgcccagccaccctgtgacccccagcagcaagcatgctgacagcaagccagcccccctgaccccagcctaccacaccctgccccaccccagccaccacggcaccccccacaccaccatcaactggggccccctggagccccccaagacccccaagccctggagcctgagctgcctgcggcctgccccacccctgcggcccagcgctgccctgtgctacaaggaggacctgagcaagagccccaagaccatgaagaagctgctgcccaagaggaagccagagaggaagcccagtgatgaggagtttgccagcaggaagagcacagctgccctggaggaggatgcccagatcctgaaggtgattgaggcctactgcaccagcgccaagacccggcagaccctgaacagcagcagcaggaaggagagcgccccccaggtgctgctgcctgaggaggagaagatcatcgtggaggagaccaagagcaatggccagacagtgattgaggagaagagcctggtggacacagtgtatgccctgaaggatgaggtgcaggagctgcggcaggacaacaagaagatgaagaagagcctggaggaggagcagagggccaggaaggacctggagaagctggtgaggaaggtgctgaagaacatgaatgaccctgcctgggatgagaccaacctgtag

SEQ ID NO: 21682 - DNA, 2166 bp, Artificial Sequence
  Description of Artificial Sequence: Synthetic coding sequence
atgaagacctttgatgccaatgacctgtaccagggccagaacttcaacaaggtgctgagcagcctggtgaccctgaacaaggtgacagctgacatcggcctgggcagtgacagcgtgtgtgcccggcccagcagccaccgcatcaagagctttgacagcctgggcagccagagcctgcacaccaggaccagcaagctgttccagggccagtaccgcagcctggacatgacagacaacagcaacaaccagctggtggtgcgggccaagttcaacttccagcagaccaatgaagatgagctgtccttcagcaaaggagatgtgattcatgtgaccagggtggaggagggcggctggtgggagggcaccctgaatggccgcacaggctggttccccagcaactacgtgcgggaggtgaaggccagcgagaagcctgtgagccccaagagcggcaccctgaagagcccccccaagggctttgacaccacagccatcaacaagagctactacaacgtggtgctgcagaacatcctggagacagaaaatgagtacagcaaggagctgcagacagtgctgagcacctacctgcggcccctgcagaccagcgagaagctgagcagcgccaacatctcctacctgatgggcaacctggaggagatctgcagcttccagcagatgctggtgcagagcctggaggagtgcaccaagctgcctgaggcccagcagagggtgggcggctgcttcctgaacctgatgccccagatgaagaccctgtacctgacctactgtgccaaccaccccagcgctgtgaatgtgctgacagagcacagcgaggagctgggggagttcatggagaccaagggggccagcagccctggcatcctggtgctgaccaccggcctgagcaagcccttcatgaggctggacaagtaccccaccctgctgaaggagctggagcggcacatggaggactaccacacagaccggcaggacatccagaagtccatggccgccttcaagaacctgagcgcccagtgccaggaggtgaggaagaggaaggagctggagctgcagatcctgacagaggccatccggaactgggagggagatgacatcaagaccctgggcaatgtgacctacatgagccaggtgctgatccagtgtgccggcagcgaggagaagaatgaaagatacctgctgctcttccccaacgtgctgctgatgctgagcgccagccccaggatgagcggcttcatctaccagggcaagctgcccaccaccggcatgaccatcaccaagctggaggacagcgagaaccacagaaatgcctttgagatcagcggctccatgattgaaagaatcctggtgtcctgcaacaaccagcaggacctgcaggagtgggtggagcacctgcagaagcagaccaaggtgacctctgtgggcaaccccaccatcaagccccacagcgtgcccagccacaccctgcccagccaccctgtgacccccagcagcaagcacgccgacagcaagccagcccccctgaccccagcctaccacaccctgccccaccccagccaccacggcaccccccacaccaccatcaactggggccccctggagccccccaagacccccaagccctggagcctgagctgcctgcggcctgccccacccctgcggcccagcgctgccctgtgctacaaggaggacctgagcaagagccccaagaccatgaagaagctgctgcccaagaggaagccagagaggaagcccagtgatgaggagtttgccagcaggaagagcacagctgccctggaggaggatgcccagatcctgaaggtgattgaggcctactgcaccagcgccaagacccggcagaccctgaacagcagcagcaggaaggagagcgccccccaggtgctgctgcctgaggaggagaagatcatcgtggaggagaccaagagcaatggccagaccgtcatcgaggagaagagcctggtggacacagtgtatgccctgaaggatgaggtgcaggagctgcggcaggacaacaagaagatgaagaagagcctggaggaggagcagagggccaggaaggacctggagaagctggtgaggaaggtgctgaagaacatgaatgaccctgcctgggatgagaccaacctgtag

SEQ ID NO: 21683 - DNA, 2262 bp, Artificial Sequence
  Description of Artificial Sequence: Synthetic coding sequence
atgaacagcgctgagcagacagtgacctggctgatcaccctgggcgtgctggagagccccaagaagaccatcagtgaccctgagggcttcctgcaggccagcctgaaggatggagtggtgctgtgccgcctgctggagcggctgctgcccggcaccatcgagaagacctttgatgccaatgacctgtaccagggccagaacttcaacaaggtgctgagcagcctggtgaccctgaacaaggtgacagctgacatcggcctgggcagtgacagcgtgtgtgcccggcccagcagccaccgcatcaagagctttgacagcctgggcagccagagcctgcacaccaggaccagcaagctgttccagggccagtaccgcagcctggacatgacagacaacagcaacaaccagctggtggtgcgggccaagttcaacttccagcagaccaatgaagatgagctgtccttcagcaaaggagatgtgatccacgtgaccagggtggaggagggcggctggtgggagggcaccctgaatggaagaacaggctggttccccagcaactacgtgcgggaggtgaaggccagcgagaagcctgtgagccccaagagcggcaccctgaagagcccccccaagggctttgacaccacagccatcaacaagagctactacaacgtggtgctgcagaacatcctggagacagaaaatgagtacagcaaggagctgcagacagtgctgagcacctacctgcggcccctgcagaccagcgagaagctgagcagcgccaacatctcctacctgatgggcaacctggaggagatctgcagcttccagcagatgctggtgcagagcctggaggagtgcaccaagctgcctgaggcccagcagagggtgggcggctgcttcctgaacctgatgccccagatgaagaccctgtacctgacctactgtgccaaccaccccagcgctgtgaatgtgctgacagagcacagcgaggagctgggggagttcatggagaccaagggggccagcagccctggcatcctggtgctgaccaccggcctgagcaagcccttcatgaggctggacaagtaccccaccctgctgaaggagctggagcggcacatggaggactaccacacagaccggcaggacatccagaagtccatggccgccttcaagaacctgagcgcccagtgccaggaggtgaggaagaggaaggagctggagctgcagatcctgacagaggccatccggaactgggagggagatgacatcaagaccctgggcaatgtgacctacatgagccaggtgctgatccagtgtgccggcagcgaggagaagaatgaaagatacctgctgctcttccccaacgtgctgctgatgctgagcgccagccccaggatgagcggcttcatctaccagggcaagctgcccaccaccggcatgaccatcaccaagctggaggacagcgagaaccacagaaatgcctttgagatcagcggctccatgattgagcgcatcctggtgtcctgcaacaaccagcaggacctgcaggagtgggtggagcacctgcagaagcagaccaaggtgacctctgtgggcaaccccaccatcaagccccacagcgtgcccagccacaccctgcccagccaccctgtgacccccagcagcaagcatgctgacagcaagccagcccccctgaccccagcctaccacaccctgccccaccccagccaccacggcaccccccacaccaccatcaactggggccccctggagccccccaagacccccaagccctggagcctgagctgcctgcggcctgccccacccctgcggcccagcgctgccctgtgctacaaggaggacctgagcaagagccccaagaccatgaagaagctgctgcccaagaggaagccagagaggaagcccagtgatgaggagtttgccagcaggaagagcacagctgccctggaggaggatgcccagatcctgaaggtgattgaggcctactgcaccagcgccaagacccggcagaccctgaacagcacctggcagggcacagacctgatgcacaaccacgtgctggctgatgatgaccagcccagcctggacagcctgggccgccgcagcagcctgagccggctggagcccagcgacctgtctgaggacagcgactatgacagcatctggacagcccacagctacaggatgggcagcaccagcaggaagagctgctgcagctacatcagccaccagaactag

SEQ ID NO: 21684 - DNA, 2412 bp, Artificial Sequence
  Description of Artificial Sequence: Synthetic coding sequence
atgaacagcgctgagcagacagtgacctggctgatcaccctgggcgtgctggagagccccaagaagaccatcagtgaccctgagggcttcctgcaggccagcctgaaggatggagtggtgctgtgccgcctgctggagcggctgctgcccggcaccatcgagaaggtgtacccagagcccaggtctgagagtgaatgtctgagcaacatccgggagttcctgcggggctgtggggccagcctgcggctggagctgctcttcccccccagccagcccccccagcacctggtgaccaccatcctgctgagcgccagcacctttgatgccaatgacctgtaccagggccagaacttcaacaaggtgctgagcagcctggtgaccctgaacaaggtgacagctgacatcggcctgggcagtgacagcgtgtgtgcccggcccagcagccaccgcatcaagagctttgacagcctgggcagccagagcctgcacaccaggaccagcaagctgttccagggccagtaccgcagcctggacatgacagacaacagcaacaaccagctggtggtgcgggccaagttcaacttccagcagaccaatgaagatgagctgtccttcagcaaaggagatgtgatccacgtgaccagggtggaggagggcggctggtgggagggcaccctgaatggaagaacaggctggttccccagcaactacgtgcgggaggtgaaggccagcgagaagcctgtgagccccaagagcggcaccctgaagagcccccccaagggctttgacaccacagccatcaacaagagctactacaacgtggtgctgcagaacatcctggagacagaaaatgagtacagcaaggagctgcagacagtgctgagcacctacctgcggcccctgcagaccagcgagaagctgagcagcgccaacatctcctacctgatgggcaacctggaggagatctgcagcttccagcagatgctggtgcagagcctggaggagtgcaccaagctgcctgaggcccagcagagggtgggcggctgcttcctgaacctgatgccccagatgaagaccctgtacctgacctactgtgccaaccaccccagcgctgtgaatgtgctgacagagcacagcgaggagctgggggagttcatggagaccaagggggccagcagccctggcatcctggtgctgaccaccggcctgagcaagcccttcatgaggctggacaagtaccccaccctgctgaaggagctggagcggcacatggaggactaccacacagaccggcaggacatccagaagtccatggccgccttcaagaacctgagcgcccagtgccaggaggtgaggaagaggaaggagctggagctgcagatcctgacagaggccatccggaactgggagggagatgacatcaagaccctgggcaatgtgacctacatgagccaggtgctgatccagtgtgccggcagcgaggagaagaatgaaagatacctgctgctcttccccaacgtgctgctgatgctgagcgccagccccaggatgagcggcttcatctaccagggcaagctgcccaccaccggcatgaccatcaccaagctggaggacagcgagaaccacagaaatgcctttgagatcagcggctccatgattgagcgcatcctggtgtcctgcaacaaccagcaggacctgcaggagtgggtggagcacctgcagaagcagaccaaggtgacctctgtgggcaaccccaccatcaagccccacagcgtgcccagccacaccctgcccagccaccctgtgacccccagcagcaagcatgctgacagcaagccagcccccctgaccccagcctaccacaccctgccccaccccagccaccacggcaccccccacaccaccatcaactggggccccctggagccccccaagacccccaagccctggagcctgagctgcctgcggcctgccccacccctgcggcccagcgctgccctgtgctacaaggaggacctgagcaagagccccaagaccatgaagaagctgctgcccaagaggaagccagagaggaagcccagtgatgaggagtttgccagcaggaagagcacagctgccctggaggaggatgcccagatcctgaaggtgattgaggcctactgcaccagcgccaagacccggcagaccctgaacagcacctggcagggcacagacctgatgcacaaccacgtgctggctgatgatgaccagcccagcctggacagcctgggccgccgcagcagcctgagccggctggagcccagcgacctgtctgaggacagcgactatgacagcatctggacagcccacagctacaggatgggcagcaccagcaggaagagctgctgcagctacatcagccaccagaactag

SEQ ID NO: 21685 - DNA, 1941 bp, Artificial Sequence; identical to SEQ ID NO: 21681
  Description of Artificial Sequence: Synthetic coding sequence

SEQ ID NO: 21686 - DNA, 201 bp, Artificial Sequence
  Description of Artificial Sequence: Synthetic coding sequence
atgacagacaacagcaacaaccagctggtggtgcgggccaagttcaacttccagcagaccaatgaagatgagctgtccttcagcaaaggagatgtgatccacgtgaccagggtggaggagggcggctggtgggagggcaccctgaatggaagaacaggctggttccccagcaactacgtgcgggaggtgaaggccagctag

SEQ ID NO: 21687 - DNA, 1344 bp, Artificial Sequence
  Description of Artificial Sequence: Synthetic coding sequence
atgacagacaacagcaacaaccagctggtggtgcgggccaagttcaacttccagcagaccaatgaagatgagctgtccttcagcaaaggagatgtgatccacgtgaccagggtggaggagggcggctggtgggagggcaccctgaatggaagaacaggctggttccccagcaactacgtgcgggaggtgaaggccagcgagaagcctgtgagccccaagagcggcaccctgaagagcccccccaagggctttgacaccacagccatcaacaagagctactacaacgtggtgctgcagaacatcctggagacagaaaatgagtacagcaaggagctgcagacagtgctgagcacctacctgcggcccctgcagaccagcgagaagctgagcagcgccaacatctcctacctgatgggcaacctggaggagatctgcagcttccagcagatgctggtgcagagcctggaggagtgcaccaagctgcctgaggcccagcagagggtgggcggctgcttcctgaacctgatgccccagatgaagaccctgtacctgacctactgtgccaaccaccccagcgctgtgaatgtgctgacagagcacagcgaggagctgggggagttcatggagaccaagggggccagcagccctggcatcctggtgctgaccaccggcctgagcaagcccttcatgaggctggacaagtaccccaccctgctgaaggagctggagcggcacatggaggactaccacacagaccggcaggacatccagaagtccatggccgccttcaagaacctgagcgcccagtgccaggaggtgaggaagaggaaggagctggagctgcagatcctgacagaggccatccggaactgggagggagatgacatcaagaccctgggcaatgtgacctacatgagccaggtgctgatccagtgtgccggcagcgaggagaagaatgaaagatacctgctgctcttccccaacgtgctgctgatgctgagcgccagccccaggatgagcggcttcatctaccagggcaagctgcccaccaccggcatgaccatcaccaagctggaggacagcgagaaccacagaaatgcctttgagatcagcggctccatgattgagcgcatcctggtgtcctgcaacaaccagcaggacctgcaggagtgggtggagcacctgcagaagcagaccaaggtgacctctgtgggcaaccccaccatcaagccccacagcgtgcccagccacaccctgcccagccaccctgtgacccccagcagcaagcatgctgacagcaagccagcccccctgaccccagcctaccacaccctgccccactag

SEQ ID NO: 21688 - DNA, 186 bp, Artificial Sequence
  Description of Artificial Sequence: Synthetic coding sequence
atgacagacaacagcaacaaccagctggtggtgcgggccaagttcaacttccagcagaccaatgaagatgagctgtccttcagcaaaggagatgtgatccacgtgaccagggtggaggagggcggctggtgggagggcaccctgaatggaagaacaggctggttccccagcaactacgtgaggtag

SEQ ID NO: 21689 - DNA, 120 bp, Artificial Sequence
  Description of Artificial Sequence: Synthetic coding sequence
atgacagacaacagcaacaaccagctggtggtgcgggccaagttcaacttccagcagaccaatgaagatgagctgtccttcagcaaaggagatgtgatccacgtgaccagggtggagtag

SEQ ID NO: 21690 - DNA, 546 bp, Artificial Sequence
  Description of Artificial Sequence: Synthetic coding sequence
atgtgcttccccaggagctctgtgaccacagatgaccaccagctggatggcatcaagagcacccgggccccagcccctggctgctgctgctgccccagcgagaccctgcggagcggggaggtggcccggagcagcgctgagagccggcggctgctcttcaagccagatgccacagatgagaaccctgtgccccacgtgctgtgccagagccccttctgcagtgaatgtccccacggcacccaggactaccacacagaccggcaggacatccagaagtccatggccgccttcaagaacctgagcgcccagtgccaggaggtgaggaagaggaaggagctggagctgcagatcctgacagaggccatccggaactgggagggagatgacatcaagaccctgggcaatgtgacctacatgagccaggtgctgatccagtgtgccggcagcgaggagaagaatgaaagatacctgctgctcttccccaacgtgctgctgatgctgagcgccagccccaggatgagcggcttcatctaccagggcgcctag

SEQ ID NO: 21691 - DNA, 2070 bp, Artificial Sequence
  Description of Artificial Sequence: Synthetic coding sequence
atcccccccagcaagcccctgcggggcagcagcctgtggggctgctggagccggcccaagaccatcagtgaccctgagggcttcctgcaggccagcctgaaggatggagtggtgctgtgccgcctgctggagcggctgctgcccggcaccatcgagaaggtgtacccagagcccaggtctgagagtgaatgtctgagcaacatccgggagttcctgcggggctgtggggccagcctgcggctggagacctttgatgccaatgacctgtaccagggccagaacttcaacaaggtgctgagcagcctggtgaccctgaacaaggtgacagctgacatcggcctgggcagtgacagcgtgtgtgcccggcccagcagccaccgcatcaagagctttgacagcctgggcagccagagcctgcacaccaggaccagcaagctgttccagggccagtaccgcagcctggacatgacagacaacagcaacaaccagctggtggtgcgggccaagttcaacttccagcagaccaatgaagatgagctgtccttcagcaaaggagatgtgattcatgtgaccagggtggaggagggcggctggtgggagggcaccctgaatggccgcacaggctggttccccagcaactacgtgcgggaggtgaaggccagcgagaagcctgtgagccccaagagcggcaccctgaagagcccccccaagggctttgacaccacagccatcaacaagagctactacaacgtggtgctgcagaacatcctggagacagaaaatgagtacagcaaggagctgcagacagtgctgagcacctacctgcggcccctgcagaccagcgagaagctgagcagcgccaacatctcctacctgatgggcaacctggaggagatctgcagcttccagcagatgctggtgcagagcctggaggagtgcaccaagctgcctgaggcccagcagagggtgggcggctgcttcctgaacctgatgccccagatgaagaccctgtacctgacctactgtgccaaccaccccagcgctgtgaatgtgctgacagagcacagcgaggagctgggggagttcatggagaccaagggggccagcagccctggcatcctggtgctgaccaccggcctgagcaagcccttcatgaggctggacaagtaccccaccctgctgaaggagctggagcggcacatggaggactaccacacagaccggcaggacatccagaagtccatggccgccttcaagaacctgagcgcccagtgccaggaggtgaggaagaggaaggagctggagctgcagatcctgacagaggccatccggaactgggagggagatgacatcaagaccctgggcaatgtgacctacatgagccaggtgctgatccagtgtgccggcagcgaggagaagaatgaaagatacctgctgctcttccccaacgtgctgctgatgctgagcgccagccccaggatgagcggcttcatctaccagggcaagctgcccaccaccggcatgaccatcaccaagctggaggacagcgagaaccacagaaatgcctttgagatcagcggctccatgattgaaagaatcctggtgtcctgcaacaaccagcaggacctgcaggagtgggtggagcacctgcagaagcagaccaaggtgacctctgtgggcaaccccaccatcaagccccacagcgtgcccagccacaccctgcccagccaccctgtgacccccagcagcaagcacgccgacagcaagccagcccccctgaccccagcctaccacaccctgccccaccccagccaccacggcaccccccacaccaccatcaactggggccccctggagccccccaagacccccaagccctggagcctgagctgcctgcggcctgccccacccctgcggcccagcgctgccctgtgctacaaggaggacctgagcaagagccccaagaccatgaagaagctgctgcccaagaggaagccagagaggaagcccatgaggagcagcaggcctgggaaggcccagctgctgtggaagaagatgctgcgcttctag

SEQ ID NO: 21692 - DNA, 4065 bp, Artificial Sequence
  Description of Artificial Sequence: Synthetic coding sequence
atgagcactggagacagctttgagaccaggtttgagaagatggacaacctgctgcgggaccccaagtctgaggtgaacagcgactgcctgctggatggcctggatgccctggtgtatgacctggacttccctgccctgaggaagaacaagaacatcgacaacttcctgagccgctacaaggacaccatcaacaagatccgggacctgaggatgaaggccgaggactatgaggtggtgaaggtgattggccgcggggcctttggagaggtgcagctggtgcgccacaagagcaccaggaaggtgtatgccatgaagctgctgagcaagtttgagatgatcaagagaagtgacagcgccttcttctgggaggagcgggacatcatggcctttgccaacagcccctgggtggtgcagctgttctacgccttccaggatgaccgctacctgtacatggtgatggagtacatgcctggaggagacctggtgaacctgatgagcaactatgatgtgcctgagaagtgggcccgcttctacacagctgaggtggtgctggccctggatgccatccacagcatgggcttcatccacagagatgtgaagccagacaacatgctgctggacaagagcggccacctgaagctggccgactttggcacctgcatgaagatgaacaaggagggcatggtgcgctgtgacacagctgtgggcaccccagactacatcagccctgaggtgctgaagagccagggcggagatggctactacggccgggagtgtgactggtggagcgtgggcgtcttcctgtatgagatgctggtgggggacacccccttctacgccgacagcctggtgggcacctacagcaagatcatgaaccacaagaacagcctgaccttcccagatgacaatgacatcagcaaggaggccaagaacctgatctgtgccttcctgacagaccgggaggtgcggctgggcagaaatggagtggaggagatcaagaggcacctgttcttcaagaatgaccagtgggcctgggagaccctgcgggacacagtggcccctgtggtgcctgacctgagcagtgacatcgacaccagcaactttgatgacctggaggaggacaagggggaggaggagaccttccccatccccaaggcctttgtgggcaaccagctgccctttgtgggcttcacctactacagcaacagacgctacctgagcagcgccaaccccaatgacaacagaaccagcagcaatgctgacaagagcctgcaggagagcctgcagaagaccatctacaagctggaggagcagctgcacaatgagatgcagctgaaggatgagatggagcagaagtgcaggaccagcaacatcaagctggacaagatcatgaaggagctggatgaggagggcaaccagaggaggaacctggagagcacagtgtcccagatcgagaaggagaagatgctgctgcagcaccgcatcaatgagtaccagaggaaggccgagcaggagaatgagaagagaagaaatgtggagaatgaggtgtccaccctgaaggaccagctggaggacctgaagaaggtgtcccagaacagccagctggccaatgagaagctgagccagctgcagaagcagctggaggaggccaatgacctgctgaggacagaaagtgacacagctgtgcggctgaggaagagccacacagagatgagcaagagcatcagccagctggagagcctgaaccgggagctgcaggagaggaaccgcatcctggagaacagcaagagccagacagacaaggactactaccagctgcaggccatcctggaggccgagcggcgggaccggggccatgattctgagatgattggagacctgcaggcccgcatcaccagcctgcaggaggaggtgaagcacctgaagcacaacctggagaaggtggagggggagaggaaggaggcccaggacatgctgaaccacagcgagaaggagaagaacaacctggagattgacctgaactacaagctgaagagcctgcagcagaggctggagcaggaggtgaatgagcacaaggtgaccaaggcccggctgacagacaagcaccagagcattgaggaggccaagtctgtggccatgtgtgagatggagaagaagctgaaggaggagcgggaggcccgggagaaggcagaaaatagagtggtgcagatcgagaagcagtgcagcatgctggatgtggacctgaagcagagccagcagaagctggagcacctgactggaaacaaggagaggatggaggatgaggtgaagaacctgaccctgcagctggagcaggagagcaacaagaggctgctgctgcagaatgagctgaagacccaggcctttgaagctgacaacctgaagggcctggagaagcagatgaagcaggagatcaacaccctgctggaggccaagaggctgctggagtttgagctggcccagctgaccaagcagtacagaggaaatgaaggccagatgagggagctgcaggaccagctggaggccgagcagtacttcagcaccctgtacaagacccaggtgaaggagctgaaggaggagattgaggagaagaaccgggagaacctgaagaagatccaggagctgcagaatgagaaggagaccctggccacccagctggacctggccgagaccaaggccgagagcgagcagctggcccggggcctgctggaggagcagtactttgagctgacccaggagagcaagaaggccgccagcaggaaccggcaggagatcacagacaaggaccacacagtgtcccggctggaggaggccaacagcatgctgaccaaggacatcgagatcctgcggcgggagaatgaggagctgacagagaagatgaagaaggccgaggaggagtacaagctggagaaggaggaggagatcagcaacctgaaggccgcctttgagaagaacatcaacacagagaggaccctgaagacccaggccgtgaacaagctggccgagatcatgaacaggaaggacttcaagattgacaggaagaaggccaacacccaggacctgaggaagaaggagaaggaaaataggaagctgcagctggagctgaaccaggagcgggagaagttcaaccagatggtggtgaagcaccagaaggagctgaatgacatgcaggcccagctggtggaggagtgtgcccacagaaatgagctgcagatgcagctggccagcaaggagagtgacatcgagcagctgcgggccaagctgctggacctgagtgacagcacctctgtggccagcttccccagcgcagatgaaacagatggcaacctgcctgagagcagaattgagggctggctgtctgtgcccaacagaggcaacatcaagagatatggctggaagaagcagtatgtggtggtgagcagcaagaagatcctcttctacaatgatgagcaggacaaggagcagagcaaccccagcatggtgctggacatcgacaagctgttccacgtgcggcctgtgacccagggagatgtgtacagagctgagacagaggagatccccaagatcttccagatcctgtatgccaatgaaggagaatgtaggaaggatgtggagatggagcctgtgcagcaggccgagaagaccaacttccagaaccacaagggccacgagttcatccccaccctgtaccacttccctgccaactgtgatgcctgtgccaagcccctgtggcacgtgttcaagcccccaccagccctggagtgccgccgctgccacgtgaagtgccaccgggaccacctggacaagaaggaggacctgatctgcccctgcaaggtgtcctatgatgtgaccagcgcccgggacatgctgctgctggcctgcagccaggatgagcagaagaagtgggtgacccacctggtgaagaagatccccaagaacccccccagcggctttgtgcgggccagccccaggaccctgagcaccaggagcacagccaaccagagcttcaggaaggtggtgaagaacaccagcggcaagaccagctag

SEQ ID NO: 21693 - DNA, 471 bp, Artificial Sequence
  Description of Artificial Sequence: Synthetic coding sequence
atggccccagcccgggccggcttctgccccctgctgctgctgctgctgctgggcctgtgggtggccgagatccctgtgtctgccaagcccaagggcatgaccagcagccagtggttcaagatccagcacatgcagcccagcccccaggcctgcaacagcgccatgaagaacatcaacaagcacaccaagcgctgcaaggacctgaacaccttcctgcacgagcccttcagctctgtggccgccacctgccagacccccaagatcgcctgcaagaatggagacaagaactgccaccagagccatggagctgtgtccctgaccatgtgcaagctgaccagcggcaagcaccccaactgccgctacaaggagaagaggcagaacaagagctatgtggtggcctgcaagccaccccagaagaaggacagccagcagttccacctggtgcctgtgcacctggacagagtgctgtag

SEQ ID NO: 21694 - DNA, 471 bp, Artificial Sequence; identical to SEQ ID NO: 21693
  Description of Artificial Sequence: Synthetic coding sequence

SEQ ID NO: 21695 - DNA, 831 bp, Artificial Sequence
  Description of Artificial Sequence: Synthetic coding sequence
atgctgcagcaggacagcaatgatgacacagaagatgtgtccctgtttgatgctgaggaggagaccaccaaccggcccaggaaggccaagatccgccaccctgtggccagcttcttccacctgttcttccgggtgtctgccatcatcgtgtgcctgctgtgtgagctgctgagcagcagcttcatcacctgcatggtgaccatcatcctgctgctgagctgtgacttctgggccgtgaagaatgtgacaggccgcctgatggtgggcctgcgctggtggaaccacattgatgaagatggcaagagccactgggtgtttgagagcaggaaggagagcagccaggagaacaagacagtgtctgaggccgagagccgcatcttctggctgggcctcatcgcctgcagcgtgctgtgggtgatctttgccttcagcgccctcttctccttcaccgtgaagtggctgcggcgcagccgccacatcgcccagacaggcctgaaggtgctgggcagccgggaccccccagccagcgccttccagagcgctggcatcaccggggtgagccgctgccccggccaccccagcaggaagttccaccaggtggacatcaacagcttcacccgcatcacagaccgggccctgtactggaagccagccccccggctgagcagcccccccctgcgggccgcccctggcaactgccagcagatggccccagcccggctcttcctgagcctgcggctgtgggcctggaggggcggcggggagagccccaacagccggggcaccggggagcccggccccaagttccacctggccagcggcatgcactag

SEQ ID NO: 21696 - DNA, 1419 bp, Artificial Sequence
  Description of Artificial Sequence: Synthetic coding sequence
atggaccatggaggagtgggcccctatgagctgggcatggagcactgtgagaagtttgagatcagcgagacctctgtgaacagaggccctgagaagatccggcctgagtgctttgagctgctgcgggtgctgggcaagggcggctacggcaaggtgttccaggtgaggaaggtgactggagccaacacaggcaagatctttgccatgaaggtgctgaagaaggccatgattgtgagaaatgccaaggacacagcccacaccaaggccgagaggaacatcctggaggaggtgaagcaccccttcatcgtggacctgatctatgccttccagacaggaggcaagctgtacctgatcctggagtacctgtctggaggagagctgttcatgcagctggagcgggagggcatcttcatggaggacacagcctgcttctacctggccgagatctccatggccctgggccacctgcaccagaagggcatcatctacagagacctgaagccagagaacatcatgctgaaccaccagggccacgtgaagctgacagactttggcctgtgcaaggagagcatccatgatggcaccgtgacccacaccttctgtggcaccatcgagtacatggcccctgagatcctgatgaggagcggccacaacagagctgtggactggtggagcctgggcgccctgatgtatgacatgctgactggagccccacccttcaccggagaaaataggaagaagaccatcgacaagatcctgaagtgcaagctgaacctgcccccctacctgacccaggaggcccgggacctgctgaagaagctgctgaagagaaatgctgccagccggctgggcgccggccctggagatgctggggaggtgcaggcccaccccttcttccgccacatcaactgggaggagctgctggccaggaaggtggagccccccttcaagcccctgctgcagagcgaggaggatgtgtcccagtttgacagcaagttcacccggcagacccctgtggacagcccagatgacagcaccctgtctgagagcgccaaccaggtgttcctgggcttcacctacgtggcccccagcgtgctggagagcgtgaaggagaagttctcctttgagcccaagatccgcagcccccggcgcttcatcggcagccccaggacccctgtgtcccctgtgaagttcagccctggggacttctggggccgcggggccagcgccagcacagccaacccccagacccctgtggagtaccccatggagaccagcggcatcgagcagatggatgtgaccatgtctggagaggccagcgcccccctgcccatccggcagcccaacagcggcccctacaagaagcaggccttccccatgatcagcaagaggcctgagcacctgaggatgaacctgtag

SEQ ID NO: 21697 - DNA, 1356 bp, Artificial Sequence
  Description of Artificial Sequence: Synthetic coding sequence
atgagaagaagaagaagaagagatggcttctacccagccccagacttccgggaccgggaggccgaggacatggccggcgtgtttgacatcgacctggaccagccagaagatgctggctctgaagatgagctggaggagggcggccagctgaatgaatccatggaccacggcggcgtgggcccctatgagctgggcatggagcactgtgagaagtttgagatcagcgagacctctgtgaacagaggccctgagaagatccggccagaatgttttgagctgctgcgggtgctgggcaaaggaggctacggcaaggtgttccaggtgaggaaggtgactggagccaacacaggcaagatctttgccatgaaggtgctgaagaaggccatgattgtgagaaatgccaaggacacagcccacaccaaggccgagaggaacatcctggaggaggtgaagcaccccttcatcgtggacctgatctatgccttccagacaggaggcaagctgtacctgatcctggagtacctgagcggcggggagctgttcatgcagctggagcgggagggcatcttcatggaggacacagcctgcttctacctggccgagatctccatggccctgggccacctgcaccagaagggcatcatctacagagacctgaagccagagaacatcatgctgaaccaccagggccacgtgaagctgacagactttggcctgtgcaaggagagcatccatgatggcaccgtgacccacaccttctgtggcaccatcgagtacatggcccctgagatcctgatgaggagcggccacaacagagctgtggactggtggagcctgggcgccctgatgtatgacatgctgaccggggccccacccttcaccggggagaacaggaagaagaccatcgacaagatcctgaagtgcaagctgaacctgcccccctacctgacccaggaggcccgggacctgctgaagaagctgctgaagagaaatgctgccagccggctgggcgccggccctggagatgctggggaggtgcaggcccaccccttcttccgccacatcaactgggaggagctgctggccaggaaggtggagccccccttcaagcccctgctgcagagtgaagaagatgtgtcccagtttgacagcaagttcacccggcagacccctgtggacagcccagatgacagcaccctgtctgagagcgccaaccaggtgttcctgggcttcacctacgtggcccccagcgtgctggagagcgtgaaggagaagttctcctttgagcccaagatccgcagcccccggcgcttcatcggcagccccaggacccctgtgtccacagccatgtgctag

SEQ ID NO: 21698 - DNA, 1509 bp, Artificial Sequence
  Description of Artificial Sequence: Synthetic coding sequence
atgagaagaagaagaagaagagatggcttctacccagccccagacttccgggaccgggaggccgaggacatggccggcgtgtttgacatcgacctggaccagccagaagatgctggctctgaagatgagctggaggagggcggccagctgaatgaatccatggaccacggcggcgtgggcccctatgagctgggcatggagcactgtgagaagtttgagatcagcgagacctctgtgaacagaggccctgagaagatccggccagaatgttttgagctgctgcgggtgctgggcaaaggaggctacggcaaggccatgattgtgagaaatgccaaggacacagcccacaccaaggccgagaggaacatcctggaggaggtgaagcaccccttcatcgtggacctgatctatgccttccagacaggaggcaagctgtacctgatcctggagtacctgtctggaggagagctgttcatgcagctggagcgggagggcatcttcatggaggacacagcctgcttctacctggccgagatctccatggccctgggccacctgcaccagaagggcatcatctacagagacctgaagccagagaacatcatgctgaaccaccagggccacgtgaagctgacagactttggcctgtgcaaggagagcatccatgatggcaccgtgacccacaccttctgtggcaccatcgagtacatggcccctgagatcctgatgaggagcggccacaacagagctgtggactggtggagcctgggcgccctgatgtatgacatgctgactggagccccacccttcaccggagaaaataggaagaagaccatcgacaagatcctgaagtgcaagctgaacctgcccccctacctgacccaggaggcccgggacctgctgaagaagctgctgaagagaaatgctgccagccggctgggcgccggccctggagatgctggggaggtgcaggcccaccccttcttccgccacatcaactgggaggagctgctggccaggaaggtggagccccccttcaagcccctgctgcagagcgaggaggatgtgtcccagtttgacagcaagttcacccggcagacccctgtggacagcccagatgacagcaccctgtctgagagcgccaaccaggtgttcctgggcttcacctacgtggcccccagcgtgctggagagcgtgaaggagaagttctcctttgagcccaagatccgcagcccccggcgcttcatcggcagccccaggacccctgtgtcccctgtgaagttcagccctggggacttctggggccgcggggccagcgccagcacagccaacccccagacccctgtggagtaccccatggagaccagcggcatcgagcagatggatgtgaccatgtctggagaggccagcgcccccctgcccatccggcagcccaacagcggcccctacaagaagcaggccttccccatgatcagcaagaggcctgagcacctgaggatgaacctgtag

SEQ ID NO: 21699 - DNA, 1932 bp, Artificial Sequence
  Description of Artificial Sequence: Synthetic coding sequence
atgaaggtgctgaagaaggccaccctgaaggtgcgggacagagtgaggaccaagatggagcgggacatcctggctgatgtgaaccacccctttgtggtgaagctgcactacgccttccagacagagggcaagctgtacctgatcctggacttcctgcggggcggggacctcttcacccggctgagcaaggaggtgatgttcacagaggaggatgtgaagttctacctggccgagctggccctgggcctggaccacctgcacagcctgggcatcatctacagagacctgaagccagagaacatcctgctggatgaggagggccacatcaagctgacagactttggcctgagcaaggaggccatcgaccacgagaagaaggcctacagcttctgtggcaccgtggagtacatggcccctgaggtggtgaaccggcagggccacagccacagcgctgactggtggagctatggagtgctgatgtttgagatgctgaccggcagcctgcccttccagggcaaggacaggaaggagaccatgaccctcatcctgaaggccaagctgggcatgccccagttcctgagcacagaggcccagagcctgctgcgggccctcttcaagagaaatcctgccaaccggctgggcagcggcccagatggagctgaggagatcaagagacatgtgttctacagcaccatcgactggaacaagctgtacagaagagagatcaagccacccttcaagccagctgtggcccagccagatgacaccttctactttgacacagagttcaccagcaggacccccaaggacagccctggcatccccccatctgctggggcccaccagctgttccggggcttctcctttgtggccaccggcctgatggaggatgatggcaagccccgggccccccaggcccccctgcacagcgtggtgcagcagctgcacggcaagaacctggtgttcagtgatggctacgtggtgaaggagaccatcggcgtgggcagctacagcgagtgcaagagatgtgtgcacaaggccaccaacatggagtatgctgtgaaggtgattgacaagagcaagagggaccccagcgaggagattgagatcctgctgcgctatggccagcaccccaacatcatcaccctgaaggatgtgtatgatgatggcaagcacgtgtacctggtgacagagctgatgaggggcggggagctgctggacaagatcctgcggcagaagttcttcagcgagcgggaggccagctttgtgctgcacaccatcggcaagacagtggagtacctgcacagccagggcgtggtgcaccgggacctgaagcccagcaacatcctgtatgtggatgaaagtggcaacccagaatgtctgcgcatctgtgactttggatttgccaagcagctgcgggcagaaaatggcctgctgatgaccccctgctacacagccaactttgtggcccctgaggtgctgaagaggcagggctatgatgagggctgtgacatctggagcctgggcatcctgctgtacaccatgctggccggctacaccccatttgccaacggccccagcgacaccccagaggagatcctgaccagaattggcagcggcaagttcaccctgagcggcggcaactggaacacagtgtctgaaacagccaaggacctggtgtccaagatgctgcacgtggacccccaccagaggctgacagccaagcaggtgctgcagcacccctgggtgacccagaaggacaagctgccccagagccagctgagccaccaggacctgcagctggtgaagggggccatggccgccacctacagcgccctgaacagcagcaagcccaccccccagctgaagcccatcgagagcagcatcctggcccagaggagagtgaggaagctgcccagcaccaccctgtag

SEQ ID NO: 21700 - DNA, 687 bp, Artificial Sequence
  Description of Artificial Sequence: Synthetic coding sequence
atgccccagttcctgagcacagaggcccagagcctgctgcgggccctcttcaagagaaatcctgccaaccggctgggcagcggcccagatggagctgaggagatcaagagacatgtgttctacagcaccatcgactggaacaagctgtacagaagagagatcaagccacccttcaagccagctgtggcccagccagatgacaccttctactttgacacagagttcaccagcaggacccccaaggacagccctggcatccccccatctgctggggcccaccagctgttccggggcttctcctttgtggccaccggcctgatggaggatgatggcaagccccgggccccccaggcccccctgcacagcgtggtgcaggtgattgacaagagcaagagggaccccagcgaggagattgagatcctgctgcgctatggccagcaccccaacatcatcaccctgaaggatgtgtatgatgatggcaagcacgtgtacctggtgacagagctgatgaggggcggggagctgctggacaagatcctgcggcagaagttcttcagcgagcgggaggccagctttgtgctgcacaccatcggcaagacagtggagtacctgcacagccagggcgtggtgcaccgggacctgaagcccagcaacatcctgtatgtggatgaaagtggcaacccctag

SEQ ID NO: 21701 - DNA, 2208 bp, Artificial Sequence
  Description of Artificial Sequence: Synthetic coding sequence
atgcccctggcccagctgaaggagccctggcccctgatggagctggtgcccctggaccctgaaaatggccagaccagcggggaggaggccggcctgcagcccagcaaggatgaaggagtgctgaaggagatcagcatcacccaccacgtgaaggccggcagcgagaaggctgaccccagccactttgagctgctgaaggtgctgggccagggcagctttgggaaggtgttcctggtgaggaaggtgaccaggccagattctggccacctgtatgccatgaaggtgctgaagaaggccaccctgaaggtgcgggacagagtgaggaccaagatggagcgggacatcctggctgatgtgaaccacccctttgtggtgaagctgcactacgccttccagacagagggcaagctgtacctgatcctggacttcctgcggggcggggacctcttcacccggctgagcaaggaggtgatgttcacagaggaggatgtgaagttctacctggccgagctggccctgggcctggaccacctgcacagcctgggcatcatctacagagacctgaagccagagaacatcctgctggatgaggagggccacatcaagctgacagactttggcctgagcaaggaggccatcgaccacgagaagaaggcctacagcttctgtggcaccgtggagtacatggcccctgaggtggtgaaccggcagggccacagccacagcgctgactggtggagctatggagtgctgatgtttgagatgctgaccggcagcctgcccttccagggcaaggacaggaaggagaccatgaccctcatcctgaaggccaagctgggcatgccccagttcctgagcacagaggcccagagcctgctgcgggccctcttcaagagaaatcctgccaaccggctgggcagcggcccagatggagctgaggagatcaagagacatgtgttctacagcaccatcgactggaacaagctgtacagaagagagatcaagccacccttcaagccagctgtggcccagccagatgacaccttctactttgacacagagttcaccagcaggacccccaaggacagccctggcatccccccatctgctggggcccaccagctgttccggggcttctcctttgtggccaccggcctgatggaggatgatggcaagccccgggccccccaggcccccctgcacagcgtggtgcagcagctgcacggcaagaacctggtgttcagtgatggctacgtggtgaaggagaccatcggcgtgggcagctacagcgagtgcaagagatgtgtgcacaaggccaccaacatggagtatgctgtgaaggtgattgacaagagcaagagggaccccagcgaggagattgagatcctgctgcgctatggccagcaccccaacatcatcaccctgaaggatgtgtatgatgatggcaagcacgtgtacctggtgacagagctgatgaggggcggggagctgctggacaagatcctgcggcagaagttcttcagcgagcgggaggccagctttgtgctgcacaccatcggcaagacagtggagtacctgcacagccagggcgtggtgcaccgggacctgaagcccagcaacatcctgtatgtggatgaaagtggcaacccagaatgtctgcgcatctgtgactttggatttgccaagcagctgcgggcagaaaatggcctgctgatgaccccctgctacacagccaactttgtggcccctgaggtgctgaagaggcagggctatgatgagggctgtgacatctggagcctgggcatcctgctgtacaccatgctggccggctacaccccatttgccaacggccccagcgacaccccagaggagatcctgaccagaattggcagcggcaagttcaccctgagcggcggcaactggaacacagtgtctgaaacagccaaggacctggtgtccaagatgctgcacgtggacccccaccagaggctgacagccaagcaggtgctgcagcacccctgggtgacccagaaggacaagctgccccagagccagctgagccaccaggacctgcagctggtgaagggggccatggccgccacctacagcgccctgaacagcagcaagcccaccccccagctgaagcccatcgagagcagcatcctggcccagaggagagtgaggaagctgcccagcaccaccctgtag

SEQ ID NO: 21702 - DNA, 501 bp, Artificial Sequence
  Description of Artificial Sequence: Synthetic coding sequence
gcccagccagatgacaccttctactttgacacagagttcaccagcaggacccccaaggacagccctggcatccccccatctgctggggcccaccagctgttccggggcttctcctttgtggccaccggcctgatggaggatgatggcaagccccgggccccccaggcccccctgcacagcgtggtgcaggtgattgacaagagcaagagggaccccagcgaggagattgagatcctgctgcgctatggccagcaccccaacatcatcaccctgaaggatgtgtatgatgatggcaagcacgtgtacctggtgacagagctgatgaggggcggggagctgctggacaagatcctgcggcagaagttcttcagcgagcgggaggccagctttgtgctgcacaccatcggcaagacagtggagtacctgcacagccagggcgtggtgcaccgggacctgaagcccagcaacatcctgtatgtggatgaaagtggcaacccctag

SEQ ID NO: 21703 - DNA, 2160 bp, Artificial Sequence
  Description of Artificial Sequence: Synthetic coding sequence
atgcagaccccagctgacttcccccgggtggagcgggacctggtgccctgccccaggaaggatgaaggagtgctgaaggagatcagcatcacccaccacgtgaaggccggcagcgagaaggctgaccccagccactttgagctgctgaaggtgctgggccagggcagctttgggaaggtgttcctggtgaggaaggtgaccaggccagattctggccacctgtatgccatgaaggtgctgaagaaggccaccctgaaggtgcgggacagagtgaggaccaagatggagcgggacatcctggctgatgtgaaccacccctttgtggtgaagctgcactacgccttccagacagagggcaagctgtacctgatcctggacttcctgcggggcggggacctcttcacccggctgagcaaggaggtgatgttcacagaggaggatgtgaagttctacctggccgagctggccctgggcctggaccacctgcacagcctgggcatcatctacagagacctgaagccagagaacatcctgctggatgaggagggccacatcaagctgacagactttggcctgagcaaggaggccatcgaccacgagaagaaggcctacagcttctgtggcaccgtggagtacatggcccctgaggtggtgaaccggcagggccacagccacagcgctgactggtggagctatggagtgctgatgtttgagatgctgaccggcagcctgcccttccagggcaaggacaggaaggagaccatgaccctcatcctgaaggccaagctgggcatgccccagttcctgagcacagaggcccagagcctgctgcgggccctcttcaagagaaatcctgccaaccggctgggcagcggcccagatggagctgaggagatcaagagacatgtgttctacagcaccatcgactggaacaagctgtacagaagagagatcaagccacccttcaagccagctgtggcccagccagatgacaccttctactttgacacagagttcaccagcaggacccccaaggacagccctggcatccccccatctgctggggcccaccagctgttccggggcttctcctttgtggccaccggcctgatggaggatgatggcaagccccgggccccccaggcccccctgcacagcgtggtgcagcagctgcacggcaagaacctggtgttcagtgatggctacgtggtgaaggagaccatcggcgtgggcagctacagcgagtgcaagagatgtgtgcacaaggccaccaacatggagtatgctgtgaaggtgattgacaagagcaagagggaccccagcgaggagattgagatcctgctgcgctatggccagcaccccaacatcatcaccctgaaggatgtgtatgatgatggcaagcacgtgtacctggtgacagagctgatgaggggcggggagctgctggacaagatcctgcggcagaagttcttcagcgagcgggaggccagctttgtgctgcacaccatcggcaagacagtggagtacctgcacagccagggcgtggtgcaccgggacctgaagcccagcaacatcctgtatgtggatgaaagtggcaacccagaatgtctgcgcatctgtgactttggatttgccaagcagctgcgggcagaaaatggcctgctgatgaccccctgctacacagccaactttgtggcccctgaggtgctgaagaggcagggctatgatgagggctgtgacatctggagcctgggcatcctgctgtacaccatgctggccggctacaccccatttgccaacggccccagcgacaccccagaggagatcctgaccagaattggcagcggcaagttcaccctgagcggcggcaactggaacacagtgtctgaaacagccaaggacctggtgtccaagatgctgcacgtggacccccaccagaggctgacagccaagcaggtgctgcagcacccctgggtgacccagaaggacaagctgccccagagccagctgagccaccaggacctgcagctggtgaagggggccatggccgccacctacagcgccctgaacagcagcaagcccaccccccagctgaagcccatcgagagcagcatcctggcccagaggagagtgaggaagctgcccagcaccaccctgtag

SEQ ID NO: 21704 - DNA, 2202 bp, Artificial Sequence
  Description of Artificial Sequence: Synthetic coding sequence
atggacctgtccatgaagaagtttgctgtgcggcgcttcttctctgtgtacctgcggaggaagagccgcagcaagagcagcagcctgagccggctggaggaggagggcgtggtgaaggagattgacatcagccaccacgtgaaggagggctttgagaaggctgaccccagccagtttgagctgctgaaggtgctgggccagggcagctatggcaaggtgttcctggtgaggaaggtgaagggcagtgatgctggccagctgtatgccatgaaggtgctgaagaaggccaccctgaaggtgcgggacagagtgcgcagcaagatggagcgggacatcctggccgaggtgaaccaccccttcatcgtgaagctgcactacgccttccagacagagggcaagctgtacctgatcctggacttcctgcggggcggggacctcttcacccggctgagcaaggaggtgatgttcacagaagaagatgtgaagttctacctggccgagctggccctggccctggaccacctgcacagcctgggcatcatctacagagacctgaagccagagaacatcctgctggatgaggagggccacatcaagatcacagactttggcctgagcaaggaggccatcgaccatgacaagagggcctacagcttctgtggcaccatcgagtacatggcccctgaggtggtgaacagaagaggccacacccagagcgctgactggtggagctttggagtgctgatgtttgagatgctgaccggcagcctgcccttccagggcaaggacaggaaggagaccatggccctgatcctgaaggccaagctgggcatgccccagttcctgtctggagaggcccagagcctgctgcgggccctcttcaagaggaacccctgcaaccggctgggcgccggcattgatggagtggaggagatcaagaggcaccccttctttgtgaccatcgactggaacaccctgtacaggaaggagatcaagccacccttcaagccagctgtgggccggcctgaggacaccttccactttgatcctgagttcaccgcccggacccccacagacagccctggggtgccccccagcgccaatgcccaccacctgttccggggcttctcctttgtggccagcagcctcatccaggagcccagccagcaggacctgcacaaggtgcctgtgcaccccatcgtgcagcagctgcacggcaacaacatccacttcacagatggctatgagatcaaggaggacattggagtgggcagctacagcgtgtgcaagagatgtgtgcacaaggccacagacacagaatatgctgtgaagatcatcgacaagagcaagagggaccccagcgaggagattgagatcctgctgcgctatggccagcaccccaacatcatcaccctgaaggatgtgtatgatgatggcaagtttgtgtacctggtgatggagctgatgagaggaggagagctgctggaccgcatcctgcggcagcgctacttcagcgagcgggaggccagtgatgtgctgtgcaccatcaccaagaccatggactacctgcacagccagggcgtggtgcaccgggacctgaagcccagcaacatcctgtacagagatgagagcggcagccctgagagcatccgggtgtgtgactttggatttgccaagcagctgcgggctggaaatggcctgctgatgaccccctgctacacagccaactttgtggcccctgaggtgctgaagaggcagggctatgatgctgcctgtgacatctggagcctgggcatcctgctgtacaccatgctggccggcttcaccccatttgccaatggaccagatgacaccccagaggagatcctggcccgcatcggcagcggcaagtatgccctgagcggcggcaactgggacagcatcagtgatgctgccaaggatgtggtgtccaagatgctgcacgtggacccccaccagaggctgacagccatgcaggtgctgaagcacccctgggtggtgaaccgggagtacctgagccccaaccagctgagccggcaggatgtgcacctggtgaagggggccatggccgccacctactttgccctgaacagaacaccccaggccccccggctggagcctgtgctgagcagcaacctggcccagaggcggggcatgaagaggctgaccagcacccggctgtag

SEQ ID NO: 21705 - DNA, 501 bp, Artificial Sequence
  Description of Artificial Sequence: Synthetic coding sequence
atgttcacagaagaagatgtgaagttctacctggccgagctggccctggccctggaccacctgcacagcctgggcatcatctacagagacctgaagccagagaacatcctgctggatgaggagggccacatcaagatcacagactttggcctgagcaaggaggccatcgaccatgacaagagggcctacagcttctgtggcaccatcgagtacatggcccctgaggtggtgaacagaagaggccacacccagagcgctgactggtggagctttggagtgctgatgtttgagatgctgaccggcagcctgcccttccagggcaaggacaggaaggagaccatggccctgatcctgaaggccaagctgggcatgccccagttcctgtctggagaggcccagagcctgctgcgggccctcttcaagaggaacccctgcaaccggctgggggagaagacagccctgtgcccccgggtgtcctgcagccggctgctgggcttctag

SEQ ID NO: 21706 - DNA, 1935 bp, Artificial Sequence
  Description of Artificial Sequence: Synthetic coding sequence
atgaaggtgctgaagaaggccaccctgaaggtgcgggacagagtgcgcagcaagatggagcgggacatcctggccgaggtgaaccaccccttcatcgtgaagctgcactacgccttccagacagagggcaagctgtacctgatcctggacttcctgcggggcggggacctcttcacccggctgagcaaggaggtgatgttcacagaggaggatgtgaagttctacctggccgagctggccctggccctggaccacctgcacagcctgggcatcatctacagagacctgaagccagagaacatcctgctggatgaggagggccacatcaagatcacagactttggcctgagcaaggaggccatcgaccatgacaagagggcctacagcttctgtggcaccatcgagtacatggcccctgaggtggtgaacagaagaggccacacccagagcgctgactggtggagctttggagtgctgatgtttgagatgctgaccggcagcctgcccttccagggcaaggacaggaaggagaccatggccctgatcctgaaggccaagctgggcatgccccagttcctgagcggggaggcccagagcctgctgcgggccctcttcaagaggaacccctgcaaccggctgggcgccggcattgatggagtggaggagatcaagaggcaccccttctttgtgaccatcgactggaacaccctgtacaggaaggagatcaagccacccttcaagccagctgtgggccggcctgaggacaccttccactttgatcctgagttcaccgcccggacccccacagacagccctggggtgcccccatctgccaatgcccaccacctgttccggggcttctcctttgtggccagcagcctcatccaggagcccagccagcaggacctgcacaaggtgcctgtgcaccccatcgtgcagcagctgcacggcaacaacatccacttcacagatggctatgagatcaaggaggacatcggcgtgggcagctacagcgtgtgcaagagatgtgtgcacaaggccacagacacagaatatgctgtgaagatcatcgacaagagcaagagggaccccagcgaggagattgagatcctgctgcgctatggccagcaccccaacatcatcaccctgaaggatgtgtatgatgatggcaagtttgtgtacctggtgatggagctgatgaggggcggggagctgctggaccgcatcctgcggcagcgctacttcagcgagcgggaggccagtgatgtgctgtgcaccatcaccaagaccatggactacctgcacagccagggcgtggtgcaccgggacctgaagcccagcaacatcctgtacagagatgaaagtggcagccctgagagcatccgggtgtgtgactttggatttgccaagcagctgcgggctggaaatggcctgctgatgaccccctgctacacagccaactttgtggcccctgaggtgctgaagaggcagggctatgatgctgcctgtgacatctggagcctgggcatcctgctgtacaccatgctggccggcttcaccccatttgccaacggcccagatgacaccccagaggagatcctggccagaattggcagcggcaagtatgccctgagcggcggcaactgggacagcatcagtgatgctgccaaggatgtggtgtccaagatgctgcacgtggacccccaccagaggctgacagccatgcaggtgctgaagcacccctgggtggtgaaccgggagtacctgagccccaaccagctgagccggcaggatgtgcacctggtgaagggggccatggccgccacctactttgccctgaacagaacaccccaggccccccggctggagcctgtgctgagcagcaacctggcccagaggcggggcatgaagaggctgaccagcacccggctgtag

SEQ ID NO: 21707 - DNA, 1935 bp, Artificial Sequence; identical to SEQ ID NO: 21706
  Description of Artificial Sequence: Synthetic coding sequence

SEQ ID NO: 21708 - DNA, 2226 bp, Artificial Sequence
  Description of Artificial Sequence: Synthetic coding sequence
atgcccatcgcccagctgctggagctgtggaagaagattgaggtggagcccatggagattgagaccacagaggaggacctgaacctggatgtggagcccaccacagaggacacagctgaggaggaggagggcgtggtgaaggagattgacatcagccaccacgtgaaggagggctttgagaaggctgaccccagccagtttgagctgctgaaggtgctgggccagggcagctatggcaaggtgttcctggtgaggaaggtgaagggcagtgatgctggccagctgtatgccatgaaggtgctgaagaaggccaccctgaaggtgcgggacagagtgcgcagcaagatggagcgggacatcctggccgaggtgaaccaccccttcatcgtgaagctgcactacgccttccagacagagggcaagctgtacctgatcctggacttcctgcggggcggggacctcttcacccggctgagcaaggaggtgatgttcacagaagaagatgtgaagttctacctggccgagctggccctggccctggaccacctgcacagcctgggcatcatctacagagacctgaagccagagaacatcctgctggatgaggagggccacatcaagatcacagactttggcctgagcaaggaggccatcgaccatgacaagagggcctacagcttctgtggcaccatcgagtacatggcccctgaggtggtgaacagaagaggccacacccagagcgctgactggtggagctttggagtgctgatgtttgagatgctgaccggcagcctgcccttccagggcaaggacaggaaggagaccatggccctgatcctgaaggccaagctgggcatgccccagttcctgtctggagaggcccagagcctgctgcgggccctcttcaagaggaacccctgcaaccggctgggcgccggcattgatggagtggaggagatcaagaggcaccccttctttgtgaccatcgactggaacaccctgtacaggaaggagatcaagccacccttcaagccagctgtgggccggcctgaggacaccttccactttgatcctgagttcaccgcccggacccccacagacagccctggggtgccccccagcgccaatgcccaccacctgttccggggcttctcctttgtggccagcagcctcatccaggagcccagccagcaggacctgcacaaggtgcctgtgcaccccatcgtgcagcagctgcacggcaacaacatccacttcacagatggctatgagatcaaggaggacattggagtgggcagctacagcgtgtgcaagagatgtgtgcacaaggccacagacacagaatatgctgtgaagatcatcgacaagagcaagagggaccccagcgaggagattgagatcctgctgcgctatggccagcaccccaacatcatcaccctgaaggatgtgtatgatgatggcaagtttgtgtacctggtgatggagctgatgagaggaggagagctgctggaccgcatcctgcggcagcgctacttcagcgagcgggaggccagtgatgtgctgtgcaccatcaccaagaccatggactacctgcacagccagggcgtggtgcaccgggacctgaagcccagcaacatcctgtacagagatgagagcggcagccctgagagcatccgggtgtgtgactttggatttgccaagcagctgcgggctggaaatggcctgctgatgaccccctgctacacagccaactttgtggcccctgaggtgctgaagaggcagggctatgatgctgcctgtgacatctggagcctgggcatcctgctgtacaccatgctggccggcttcaccccatttgccaatggaccagatgacaccccagaggagatcctggcccgcatcggcagcggcaagtatgccctgagcggcggcaactgggacagcatcagtgatgctgccaaggatgtggtgtccaagatgctgcacgtggacccccaccagaggctgacagccatgcaggtgctgaagcacccctgggtggtgaaccgggagtacctgagccccaaccagctgagccggcaggatgtgcacctggtgaagggggccatggccgccacctactttgccctgaacagaacaccccaggccccccggctggagcctgtgctgagcagcaacctggcccagaggcggggcatgaagaggctgaccagcacccggctgtag

SEQ ID NO: 21709 - DNA, 516 bp, Artificial Sequence
  Description of Artificial Sequence: Synthetic coding sequence
atgcccatcgcccagctgctggagctgtggaagaagattgaggtggagcccatggagattgagaccacagaggaggacctgaacctggatgtggagcccaccacagaggacacagctgaggagggcaagagtgacagcgctgcctgcaagaccaaggtggccggctctgtggaggaggagggcgtggtgaaggagattgacatcagccaccacgtgaaggagggctttgagaaggctgaccccagccagtttgagctgctgaaggtgctgggccagggcagctatggcaaggtgttcctggtgaggaaggtgaagggcagtgatgctggccagctgtatgccatgaaggtgctgaagaaggccaccctgaaggtgcgggacagagtgcgcagcaagatggagcgggacatcctggccgaggtgaaccaccccttcatcgtgaagctgcactacgccttccagacagagggcaagctgtacctgatcctggacttcctgcggggcggggacctgtag

SEQ ID NO: 21710 - DNA, 2277 bp, Artificial Sequence
  Description of Artificial Sequence: Synthetic coding sequence
atgcccatcgcccagctgctggagctgtggaagaagattgaggtggagcccatggagattgagaccacagaggaggacctgaacctggatgtggagcccaccacagaggacacagctgaggagggcaagagtgacagcgctgcctgcaagaccaaggtggccggctctgtggaggaggagggcgtggtgaaggagattgacatcagccaccacgtgaaggagggctttgagaaggctgaccccagccagtttgagctgctgaaggtgctgggccagggcagctatggcaaggtgttcctggtgaggaaggtgaagggcagtgatgctggccagctgtatgccatgaaggtgctgaagaaggccaccctgaaggtgcgggacagagtgcgcagcaagatggagcgggacatcctggccgaggtgaaccaccccttcatcgtgaagctgcactacgccttccagacagagggcaagctgtacctgatcctggacttcctgcggggcggggacctcttcacccggctgagcaaggaggtgatgttcacagaggaggatgtgaagttctacctggccgagctggccctggccctggaccacctgcacagcctgggcatcatctacagagacctgaagccagagaacatcctgctggatgaggagggccacatcaagatcacagactttggcctgagcaaggaggccatcgaccatgacaagagggcctacagcttctgtggcaccatcgagtacatggcccctgaggtggtgaacagaagaggccacacccagagcgctgactggtggagctttggagtgctgatgtttgagatgctgaccggcagcctgcccttccagggcaaggacaggaaggagaccatggccctgatcctgaaggccaagctgggcatgccccagttcctgagcggggaggcccagagcctgctgcgggccctcttcaagaggaacccctgcaaccggctgggcgccggcattgatggagtggaggagatcaagaggcaccccttctttgtgaccatcgactggaacaccctgtacaggaaggagatcaagccacccttcaagccagctgtgggccggcctgaggacaccttccactttgatcctgagttcaccgcccggacccccacagacagccctggggtgcccccatctgccaatgcccaccacctgttccggggcttctcctttgtggccagcagcctcatccaggagcccagccagcaggacctgcacaaggtgcctgtgcaccccatcgtgcagcagctgcacggcaacaacatccacttcacagatggctatgagatcaaggaggacatcggcgtgggcagctacagcgtgtgcaagagatgtgtgcacaaggccacagacacagaatatgctgtgaagatcatcgacaagagcaagagggaccccagcgaggagattgagatcctgctgcgctatggccagcaccccaacatcatcaccctgaaggatgtgtatgatgatggcaagtttgtgtacctggtgatggagctgatgaggggcggggagctgctggaccgcatcctgcggcagcgctacttcagcgagcgggaggccagtgatgtgctgtgcaccatcaccaagaccatggactacctgcacagccagggcgtggtgcaccgggacctgaagcccagcaacatcctgtacagagatgaaagtggcagccctgagagcatccgggtgtgtgactttggatttgccaagcagctgcgggctggaaatggcctgctgatgaccccctgctacacagccaactttgtggcccctgaggtgctgaagaggcagggctatgatgctgcctgtgacatctggagcctgggcatcctgctgtacaccatgctggccggcttcaccccatttgccaacggcccagatgacaccccagaggagatcctggccagaattggcagcggcaagtatgccctgagcggcggcaactgggacagcatcagtgatgctgccaaggatgtggtgtccaagatgctgcacgtggacccccaccagaggctgacagccatgcaggtgctgaagcacccctgggtggtgaaccgggagtacctgagccccaaccagctgagccggcaggatgtgcacctggtgaagggggccatggccgccacctactttgccctgaacagaacaccccaggccccccggctggagcctgtgctgagcagcaacctggcccagaggcggggcatgaagaggctgaccagcacccggctgtag

SEQ ID NO: 21711 - DNA, 888 bp, Artificial Sequence
  Description of Artificial Sequence: Synthetic coding sequence
atgtctggggccctggatgtgctgcagatgaaggaggaggatgtgctgaagttcctggccgccggcacccacctgggcggcaccaacctggacttccagatggagcagtacatctacaagaggaagagtgatggcatctacatcatcaacctgaagaggacctgggagaagctgctgctggccgcccgggccatcgtggccattgaaaatccagcagatgtgtctgtcatcagcagcaggaacacaggccagagagctgtgctgaagtttgctgctgccaccggggccacccccatcgccggccgcttcaccccaggcaccttcaccaaccagatccaggccgccttccgggagccccggctgctggtggtgacagaccccagggctgaccaccagcccctgacagaggccagctatgtgaacctgcccaccatcgccctgtgcaacacagacagccccctgcgctacgtggacatcgccatcccctgcaacaacaagggggcccacagcgtgggcctgatgtggtggatgctggcccgggaggtgctgaggatgaggggcaccatcagccgggagcacccctgggaggtgatgccagacctgtacttctacagagatcctgaggagattgagaaggaggagcaggccgctgctgagaaggctgtgaccaaggaggagttccagggcgagtggacagccccagcccctgagttcaccgccacccagcctgaggtggccgactggagcgagggcgtgcaggtgcccagcgtgcccatccagcagttccccacagaggactggagcgcccagcctgccacagaggactggagcgctgcccccacagcccaggccacagagtgggtgggcgccaccacagactggagctag

SEQ ID NO: 21712 - DNA, 795 bp, Artificial Sequence
  Description of Artificial Sequence: Synthetic coding sequence
atgtctggggccctggatgtgctgcagatgaaggaggaggatgtgctgaagttcctggccgccggcacccacctgggcggcaccaacctggacttccagatggagcagtacatctacaagaggaagagtgatggcatctacatcatcaacctgaagaggacctgggagaagctgctgctggccgcccgggccatcgtggccattgaaaatccagcagatgtgtctgtcatcagcagcaggaacacaggccagagagctgtgctgaagtttgctgctgccaccggggccacccccatcgccggccgcttcaccccaggcaccttcaccaaccagatccaggccgccttccgggagccccggctgctggtggtgacagaccccagggctgaccaccagcccctgacagaggccagctatgtgaacctgcccaccatcgccctgtgcaacacagacagccccctgcgctacgtggacatcgccatcccctgcaacaacaagggggcccacagcgtgggcctgatgtggtggatgctggcccgggaggtgctgaggatgaggggcaccatcagccgggagcacccctgggaggtgatgccagacctgtacttctacagagatcctgaggagattgagaaggaggagcaggccgctgctgagaaggctgtgaccaaggaggagttccagggcgagtggacagccccagcccctgagttcaccgccacccagcctgaggtggccgactggagcgagggcgtgcaggtgcccagcgtgcccatccagcagttccccacctag

SEQ ID NO: 21713 - DNA, 1458 bp, Artificial Sequence
  Description of Artificial Sequence: Synthetic coding sequence
atgggagagcccggcttctttgtgactggagacagagctgggggccgctcctggtgcctgcggcgggtgggcatgtctgctggctggctgctgctggaggatggctgtgaggtgacagtgggccggggcttcggcgtgacctaccagctggtgtccaagatctgccccctgatgatcagcaggaaccactgtgtgctgaagcagaaccctgagggccagtggaccatcatggacaacaagagcctgaatggagtgtggctgaacagagcccggctggagcccctgcgggtgtacagcatccaccagggcgactacatccagctgggcgtgcccctggagaacaaggaaaatgcagaatatgaatatgaggtgacagaggaggactgggagaccatctacccctgcctgagccccaagaatgaccagatgattgagaagaacaaggagctgcggaccaagaggaagttcagcctggatgagctggccggccctggagctgagggccccagcaacctgaagagcaagatcaacaaggtgtcctgtgagagcggccagcctgtgaagagccagggcaagggggaggtggccagcacccccagcgacaacctggaccccaagctgacagccctggagcccagcaagaccaccggggcccccatctacccaggcttccccaaggtgacagaggtgcaccacgagcagaaggccagcaacagcagcgccagccagaggagcctgcagatgttcaaggtgaccatgagccgcatcctgcggctgaagatccagatgcaggagaagcatgaagctgtgatgaatgtgaagaagcagacccagaagggcaacagcaagaaggtggtgcagatggagcaggagctgcaggacctgcagagccagctgtgtgccgagcaggcccagcagcaggcccgggtggagcagctggagaagaccttccaggaggaggagcagcacctgcagggcctggagatcgcccagggcgagaaggacctgaagcagcagctggcccaggccctgcaggagcactgggccctgatggaggagctgaacagaagcaagaaggactttgaggccatcatccaggccaagaacaaggagctggagcagaccaaggaggagaaggagaagatgcaggcccagaaggaggaggtgctgagccacatgaatgatgtgctggagaatgagctgcagtgcatcatctgcagcgagtacttcattgaagctgtgaccctgaactgtgcccacagcttctgcagctactgcatcaatgagtggatgaagaggaagattgagtgccccatctgcaggaaggacatcaagagcaagacctacagcctggtgctggacaactgcatcaacaagatggtgaacaacctgagcagcgaggtgaaggagaggagaattgtgctgatccgggagaggaaggccaagaggctcttctag

SEQ ID NO: 21714 - DNA, 297 bp, Artificial Sequence
  Description of Artificial Sequence: Synthetic coding sequence
atgggagagcccggcttctttgtgactggagacagagctgggggccgctcctggtgcctgcggcgggtgggcatgtctgctggctggctgctgctggaggatggctgtgaggtgacagtgggccggggcttcggcgtgacctaccagctggtgtccaagatctgccccctgatgatcagcaggaaccactgtgtgctgaagcagaaccctgagggccagtggaccatcatggacaacaagagcttccccagcgagaaggccgaggacttcaccgctgctggggagcgcttcctgtag

SEQ ID NO: 21715 - DNA, 1347 bp, Artificial Sequence
  Description of Artificial Sequence: Synthetic coding sequence
atgggagagcccggcttctttgtgactggagacagagctgggggccgctcctggtgcctgcggcgggtgggcatgtctgctggctggctgctgctggaggatggctgtgaggtgacagtgggccggggcttcggcgtgacctaccagctggtgtccaagatctgccccctgatgatcagcaggaaccactgtgtgctgaagcagaaccctgagggccagtggaccatcatggacaacaagagcctgaatggagtgtggctgaacagagcccggctggagcccctgcgggtgtacagcatccaccagggcgactacatccagctgggcgtgcccctggagaacaaggaaaatgcagaatatgaatatgaggtgacagaggaggactgggagaccatctacccctgcctgagccccaagaatgaccagatgattgagaagaacaaggagctgcggaccaagaggaagttcagcctggatgagctggccggccctggagctgagggccccagcaacctgaagagcaagatcaacaaggtgtcctgtgagagcggccagcctgtgaagagccagggcaagggggaggtggccagcacccccagcgacaacctggaccccaagctgacagccctggagcccagcaagaccaccggggcccccatctacccaggcttccccaaggtgacagaggtgcaccacgagcagaaggccagcaacagcagcgccagccagaggagcctgcagatgttcaaggtgaccatgagccgcatcctgcggctgaagatccagatgcaggagaagcatgaagctgtgatgaatgtgaagaagcagacccagaagggcaacagcaagaaggtggtgcagatggagcaggagctgcaggacctgcagagccagctgtgtgccgagcaggcccagcagcaggcccgggtggagcagctggagaagaccttccaggaggaggagcagcacctgcagggcctggagatcgcccagggcgagaaggacctgaagcagcagctggcccaggccctgcaggagcactgggccctgatggaggagctgaacagaagcaagaaggactttgaggccatcatccaggccaagaacaaggagctggagcagaccaaggaggagaaggagaagatgcaggcccagaaggaggaggtgctgagccacatgaatgatgtgctggagaatgagctgcagtgcatcatctgcagcgagtacttcatcgagcagagggactgcagcgaggaccgggccctgcgggcctttgagcggctgcccggcagcgccagcctgcgctggagcggcggcttcagcctggccgtgacccccctgctgtag

SEQ ID NO: 21716 - DNA, 1593 bp, Artificial Sequence
  Description of Artificial Sequence: Synthetic coding sequence
atggctgatgacattgatattgaggccatgctggaggccccctacaagaaggatgagaacaagctgagcagcgccaacggccacgaggagaggagcaagaagaggaagaagagcaagagccgcagccgcagccatgagaggaagaggagcaagagcaaggagaggaagaggagccgggaccgggagaggaagaagagcaagagccgggagaggaagaggagccgcagcaaggagcggcggcgcagccgcagccgcagccgggaccggcgcttccggggccgctaccgcagcccctacagcggccccaagttcaacagcgccatccggggcaagattggcctgccccacagcatcaagctgagcagaagaagaagccgcagcaagagccccttcaggaaggacaagagccctgtgcgggagcccatcgacaacctgaccccagaggagagagatgccaggacagtgttctgcatgcagctggccgcccgcatccggccccgggacctggaggagttcttcagcacagtgggcaaggtgagagatgtgaggatgatcagtgacaggaacagcagaagaagcaagggcatcgcctacgtggagtttgtggatgtgtcctctgtgcccctggccatcggcctgaccggccagagggtgctgggcgtgcccatcatcgtgcaggccagccaggccgagaagaacagagctgctgccatggccaacaacctgcagaagggcagcgctggccccatgaggctgtatgtgggcagcctgcacttcaacatcacagaggacatgctgcggggcatctttgagcccttcggccgcatcgagagcatccagctgatgatggattctgaaacaggccgcagcaagggctacggcttcatcaccttcagtgacagtgaatgtgccaagaaggccctggagcagctgaatggatttgagctggccggccggcccatgaaggtgggccacgtgacagagaggacagatgccagcagcgccagcagcttcctggacagtgatgagctggagaggactggaattgacctgggcaccaccggccgcctgcagctgatggcccggctggccgagggcaccggcctgcagatccccccagctgcccagcaggccctgcagatgagcggcagcctggcctttggagctgtggccgagttctcctttgtgattgacctgcagacccggctgagccagcagacagaggccagcgccctggccgctgctgcctctgtgcagcccctggccacccagtgcttccagctgagcaacatgttcaacccccagacagaggaggaggtgggctgggacacagagatcaaggatgatgtgattgaggagtgcaacaagcatggaggagtcatccacatctacgtggacaagaacagcgcccagggcaatgtgtatgtgaagtgccccagcattgctgctgccatcgctgctgtgaatgccctgcacggccgctggtttgctgggaagatgatcacagctgcctacgtgcccctgcccacctaccacaacctcttcccagacagcatgacagccacccagctgctggtgcccagcagaagatag

SEQ ID NO: 21717 - DNA, 1272 bp, Artificial Sequence
  Description of Artificial Sequence: Synthetic coding sequence
atggctgatgacattgatattgaggccatgctggaggccccctacaagaaggatgagaacaagctgagcagcgccaacggccacgaggagaggagcaagaagaggaagaagagcaagagccgcagccgcagccatgagaggaagaggagcaagagcaaggagaggaagaggagccgggaccgggagaggaagaagagcaagagccgggagaggaagaggagccgcagcaaggagcggcggcgcagccgcagccgcagccgggaccggcgcttccggggccgctaccgcagcccctacagcggccccaagttcaacagcgccatccggggcaagattggcctgccccacagcatcaagctgagcagaagaagaagccgcagcaagagccccttcaggaaggacaagagccctgtgcgggagcccatcgacaacctgaccccagaggagagagatgccaggacagtgttctgcatgcagctggccgcccgcatccggccccgggacctggaggagttcttcagcacagtgggcaaggtgagagatgtgaggatgatcagtgacaggaacagcagaagaagcaagggcatcgcctacgtggagtttgtggatgtgtcctctgtgcccctggccatcggcctgaccggccagagggtgctgggcgtgcccatcatcgtgcaggccagccaggccgagaagaacagagctgctgccatggccaacaacctgcagaagggcagcgctggccccatgaggctgtatgtgggcagcctgcacttcaacatcacagaggacatgctgcggggcatctttgagcccttcggccgcatcgagagcatccagctgatgatggattctgaaacaggccgcagcaagggctacggcttcatcaccttcagtgacagtgaatgtgccaagaaggccctggagcagctgaatggatttgagctggccggccggcccatgaaggtgggccacgtgacagagaggacagatgccagcagcgccagcagcttcctggacagtgatgagctggagaggactggaattgacctgggcaccaccggccgcctgcagctgatggcccggctggccgagggcaccggcctgcagatccccccagctgcccagcaggccctgcagatgagcggcagcctggcctttggagctgtggccgacctgcagacccggctgagccagcagacagaggccctgtttgtgatcatgttctggaatgagatctggagcgacaacatgatcaccctgcagctgtag

SEQ ID NO: 21718 - DNA, 1575 bp, Artificial Sequence
  Description of Artificial Sequence: Synthetic coding sequence
atggctgatgacattgatattgaggccatgctggaggccccctacaagaaggatgagaacaagctgagcagcgccaacggccacgaggagaggagcaagaagaggaagaagagcaagagccgcagccgcagccatgagaggaagaggagcaagagcaaggagaggaagaggagccgggaccgggagaggaagaagagcaagagccgggagaggaagaggagccgcagcaaggagcggcggcgcagccgcagccgcagccgggaccggcgcttccggggccgctaccgcagcccctacagcggccccaagttcaacagcgccatccggggcaagattggcctgccccacagcatcaagctgagcagaagaagaagccgcagcaagagccccttcaggaaggacaagagccctgtgcgggagcccatcgacaacctgaccccagaggagagagatgccaggacagtgttctgcatgcagctggccgcccgcatccggccccgggacctggaggagttcttcagcacagtgggcaaggtgagagatgtgaggatgatcagtgacaggaacagcagaagaagcaagggcatcgcctacgtggagtttgtggatgtgtcctctgtgcccctggccatcggcctgaccggccagagggtgctgggcgtgcccatcatcgtgcaggccagccaggccgagaagaacagagctgctgccatggccaacaacctgcagaagggcagcgctggccccatgaggctgtatgtgggcagcctgcacttcaacatcacagaggacatgctgcggggcatctttgagcccttcggccgcatcgagagcatccagctgatgatggattctgaaacaggccgcagcaagggctacggcttcatcaccttcagtgacagtgaatgtgccaagaaggccctggagcagctgaatggatttgagctggccggccggcccatgaaggtgggccacgtgacagagaggacagatgccagcagcgccagcagcttcctggacagtgatgagctggagaggactggaattgacctgggcaccaccggccgcctgcagctgatggcccggctggccgagggcaccggcctgcagatccccccagctgcccagcaggccctgcagatgagcggcagcctggcctttggagctgtggccgacctgcagacccggctgagccagcagacagaggccagcgccctggccgctgctgcctctgtgcagcccctggccacccagtgcttccagctgagcaacatgttcaacccccagacagaggaggaggtgggctgggacacagagatcaaggatgatgtgattgaggagtgcaacaagcatggaggagtcatccacatctacgtggacaagaacagcgcccagggcaatgtgtatgtgaagtgccccagcattgctgctgccatcgctgctgtgaatgccctgcacggccgctggtttgctgggaagatgatcacagctgcctacgtgcccctgcccacctaccacaacctcttcccagacagcatgacagccacccagctgctggtgcccagcagaagatag

SEQ ID NO: 21719 - DNA, 696 bp, Artificial Sequence
  Description of Artificial Sequence: Synthetic coding sequence
atggctgatgacattgatattgaggccatgctggaggccccctacaagaaggatgagaacaagctgagcagcgccaacggccacgaggagaggagcaagaagaggaagaagagcaagagccgcagccgcagccatgagaggaagaggagcaagagcaaggagaggaagaggagccgggaccgggagaggaagaagagcaagagccgggagaggaagaggagccgcagcaaggagcggcggcgcagccgcagccgcagccgggaccggcgcttccggggccgctaccgcagcccctacagcggccccaagttcaacagcgccatccggggcaagattggcctgccccacagcatcaagctgcggcggcgcagccgcagcaagagccccttcaggaaggacaagagccctgtgcgggagcccatcgacaacctgaccccagaggagagagatgccaggacagtgttctgcatgcagctggccgcccgcatccggccccgggacctggaggagttcttcagcacagtgggcaaggtgagagatgtgaggatgatcagtgacaggaacagccgccgcagcaaaggaattgcctacgtggagtttgtggatgtgtcctctgtgcccctggccatcggcctgaccggccagagggtgctgggcgtgcccatcatcgtgcaggccagccaggccgagaagtag

SEQ ID NO: 21720 - DNA, 1122 bp, Artificial Sequence
  Description of Artificial Sequence: Synthetic coding sequence
atgcagctggccgcccgcatccggccccgggacctggaggagttcttcagcacagtgggcaaggtgagagatgtgaggatgatcagtgacaggaacagccgccgcagcaaaggaattgcctacgtggagtttgtggatgtgtcctctgtgcccctggccatcggcctgaccggccagagggtgctgggcgtgcccatcatcgtgcaggccagccaggccgagaagaacagagctgctgccatggccaacaacctgcagaagggcagcgctggccccatgaggctgtatgtgggcagcctgcacttcaacatcacagaggacatgctgcggggcatctttgagcccttcggcagaattgagagcatccagctgatgatggacagcgagaccggccgcagcaagggctacggcttcatcaccttcagtgacagtgaatgtgccaagaaggccctggagcagctgaatggatttgagctggccggccggcccatgaaggtgggccacgtgacagagaggacagatgccagcagcgccagcagcttcctggacagtgatgagctggagaggacaggcatcgacctgggcaccaccggccgcctgcagctgatggcccggctggccgagggcaccggcctgcagatccccccagctgcccagcaggccctgcagatgagcggcagcctggccttcggggctgtggccgagttctcctttgtgattgacctgcagacccggctgagccagcagacagaggccagcgccctggccgccgccgcctctgtgcagcccctggccacccagtgcttccagctgagcaacatgttcaacccccagacagaggaggaggtgggctgggacacagagatcaaggatgatgtgattgaggagtgcaacaagcacggcggcgtcatccacatctacgtggacaagaacagcgcccagggcaatgtgtatgtgaagtgccccagcattgctgctgccatcgctgctgtgaatgccctgcacggccgctggtttgctgggaagatgatcacagctgcctacgtgcccctgcccacctaccacaacctcttcccagacagcatgacagccacccagctgctggtgcccagcagaagatag

SEQ ID NO: 21721 - DNA, 582 bp, Artificial Sequence
  Description of Artificial Sequence: Synthetic coding sequence
atggctgatgacattgatattgaggccatgctggaggccccctacaagaaggatgagaacaagctgagcagcgccaacggccacgaggagaggagcaagaagaggaagaagagcaagagccgcagccgcagccatgagaggaagaggagcaagagcaaggagaggaagaggagccgggaccgggagaggaagaagagcaagagccgggagaggaagaggagccgcagcaaggagcggcggcgcagccgcagccgcagccgggaccggcgcttccggggccgctaccgcagcccctacagcggccccaagttcaacagcgccatccggggcaagattggcctgccccacagcatcaagctgagcagaagaagaagccgcagcaagagccccttcaggaaggacaagagccctgtgcgggagcccatcgacaacctgaccccagaggagagagatgccaggacagtgttctgcatgcagctggccgcccgcatccggccccgggacctggaggagttcttcagcacagtgggcaaggtgagagatgtgaggatgatcagtgacaggaacagcagaagaagctag

SEQ ID NO: 21722 - DNA, 1014 bp, Artificial Sequence
  Description of Artificial Sequence: Synthetic coding sequence
tgaagccccttcaggaaggacaagagccctgtgcgggagcccatcgacaacctgaccccagaggagagagatgccaggacagtgttctgcatgcagctggccgcccgcatccggccccgggacctggaggagttcttcagcacagtgggcaaggtgagagatgtgaggatgatcagtgacaggaacagccgccgcagcaaaggaattgcctacgtggagtttgtggatgtgtcctctgtgcccctggccatcggcctgaccggccagagggtgctgggcgtgcccatcatcgtgcaggccagccaggccgagaagaacagagctgctgccatggccaacaacctgcagaagggcagcgctggccccatgaggctgtatgtgggcagcctgcacttcaacatcacagaggacatgctgcggggcatctttgagcccttcggccgcttcagtgacagtgaatgtgccaagaaggccctggagcagctgaatggatttgagctggccggccggcccatgaaggtgggccacgtgacagagaggacagatgccagcagcgccagcagcttcctggacagtgatgagctggagaggacaggcatcgacctgggcaccaccggccgcctgcagctgatggcccggctggccgagggcaccggcctgcagatccccccagctgcccagcaggccctgcagatgagcggcagcctggccttcggggctgtggccgagttctcctttgtgattgacctgcagacccggctgagccagcagacagaggccagcgccctggccgccgccgcctctgtgcagcccctggccacccagtgcttccagctgagcaacatgttcaacccccagacagaggaggaggtgggctgggacacagagatcaaggatgatgtgattgaggagtgcaacaagcacggcggcgtcatccacatctacgtggacaagaacagcgcccagggcaatgtgtatgtgaagtgccccagcattgctgctgccatcgcctag

SEQ ID NO: 21723 - DNA, 1527 bp, Artificial Sequence
  Description of Artificial Sequence: Synthetic coding sequence
atggctgatgacattgatattgaggccatgctggaggccccctacaagaaggatgagaacaagctgagcagcgccaacggccacgaggagaggagcaagaagaggaagaagagcaagagccgcagccgcagccatgagaggaagaggagcaagagcaaggagaggaagaggagccgggaccgggagaggaagaagagcaagagccgggagaggaagaggagccgcagcaaggagcggcggcgcagccgcagccgcagccgggaccggcgcttccggggccgctaccgcagcccctacagaagaagaagccgcagcaagagccccttcaggaaggacaagagccctgtgcgggagcccatcgacaacctgaccccagaggagagagatgccaggacagtgttctgcatgcagctggccgcccgcatccggccccgggacctggaggagttcttcagcacagtgggcaaggtgagagatgtgaggatgatcagtgacaggaacagcagaagaagcaagggcatcgcctacgtggagtttgtggatgtgtcctctgtgcccctggccatcggcctgaccggccagagggtgctgggcgtgcccatcatcgtgcaggccagccaggccgagaagaacagagctgctgccatggccaacaacctgcagaagggcagcgctggccccatgaggctgtatgtgggcagcctgcacttcaacatcacagaggacatgctgcggggcatctttgagcccttcggccgcatcgagagcatccagctgatgatggattctgaaacaggccgcagcaagggctacggcttcatcaccttcagtgacagtgaatgtgccaagaaggccctggagcagctgaatggatttgagctggccggccggcccatgaaggtgggccacgtgacagagaggacagatgccagcagcgccagcagcttcctggacagtgatgagctggagaggactggaattgacctgggcaccaccggccgcctgcagctgatggcccggctggccgagggcaccggcctgcagatccccccagctgcccagcaggccctgcagatgagcggcagcctggcctttggagctgtggccgagttctcctttgtgattgacctgcagacccggctgagccagcagacagaggccagcgccctggccgctgctgcctctgtgcagcccctggccacccagtgcttccagctgagcaacatgttcaacccccagacagaggaggaggtgggctgggacacagagatcaaggatgatgtgattgaggagtgcaacaagcatggaggagtcatccacatctacgtggacaagaacagcgcccagggcaatgtgtatgtgaagtgccccagcattgctgctgccatcgctgctgtgaatgccctgcacggccgctggtttgctgggaagatgatcacagctgcctacgtgcccctgcccacctaccacaacctcttcccagacagcatgacagccacccagctgctggtgcccagcagaagatag

SEQ ID NO: 21724 - DNA, 1176 bp, Artificial Sequence
  Description of Artificial Sequence: Synthetic coding sequence
atggtggaggccgacaggcctgggaagctgttcatcggcggcctgaacacagagaccaatgagaaggccctggaggccgtgtttgggaagtatggccgcatcgtggaggtgctgctgatgaaggaccgggagaccaacaagagccggggctttgcctttgtgacctttgagagccctgcagatgccaaggatgctgcccgggacatgaatggcaagagcctggatggcaaggccatcaaggtggagcaggccaccaagcccagctttgaaagtggaagaagaggccccccacctccacccaggagccggggccccccccggggcctgcggggcggccggggcggcagcggcggcacccggggcccccccagccggggcggccacatggatgatggcggctacagcatgaacttcaacatgagcagcagccggggccccctgcctgtgaagaggggccccccacccaggtctgggggccccccacccaagaggtctgcccccagcggccctgtgcgcagcagcagcggcatgggcggccgggcccctgtgtcccggggccgggacagctatggaggccccccaagaagagagcccctgcccagcagaagagatgtgtacctgagccccagagatgatggctacagcaccaaggacagctacagcagccgggactaccccagcagccgggacacccgggactatgcccccccaccccgggactacacctacagagattatggccacagcagcagcagagatgactaccccagccggggctacagcgacagagatggctacggccgggaccgggactacagcgaccaccccagcggcggcagctacagagacagctatgagagctatggcaacagccgcagcgccccacccacccggggccccccacccagctatggaggcagcagccgctatgatgactacagcagcagcagagatggctacggcggcagccgggacagctacagcagcagcagaagtgacctgtacagcagcggccgggacagagtgggccggcaggagcggggcctgccccccagcatggagcggggctaccccccaccccgggacagctacagcagcagcagcagaggagccccccggggcggcggccggggcggcagcagaagtgacagaggaggcggccgcagccgctactag

SEQ ID NO: 21725 - DNA, 309 bp, Artificial Sequence
  Description of Artificial Sequence: Synthetic coding sequence
tgaatgttcatctgcccccaggagatgatgggcatcctgctgaagacagccatccaggccgagatcacccaggtgctggtgatcctggagatcatgcaccaccaccacgagatcatcctgaccgtcatcatggtgattcctgtgcacgtgatgaccatccaccaggaggacatcgccatcgagatggacatggtggtgattgtgaccatccagatcatccaggtggaggtgcccacagagatccacatgagggtgatggtgggggactttgcccactacggccggggcgtgctgattgacagccagtag

SEQ ID NO: 21726 - DNA, 591 bp, Artificial Sequence
  Description of Artificial Sequence: Synthetic coding sequence
atggtggaggccgacaggcctgggaagctgttcatcggcggcctgaacacagagaccaatgagaaggccctggaggccgtgtttgggaagtatggccgcatcgtggaggtgctgctgatgaaggaccgggagaccaacaagagccggggctttgcctttgtgacctttgagagccctgcagatgccaaggatgctgcccgggacatgaatggcaagctgctgtaccacgtggaggagatcgtgatggaggtgcacctggagggcaaccgctgccccctggtggagatgttcatctgcccccaggagatgatgggcatcctgctgaagacagccatccaggccgagatcacccaggtgctggtgatcctggagatcatgcaccaccaccacgagatcatcctgaccgtcatcatggtgattcctgtgcacgtgatgaccatccaccaggaggacatcgccatcgagatggacatggtggtgattgtgaccatccagatcatccaggtggaggtgcccacagagatccacatgagggtgatggtgggggactttgcccactacggccggggcgtgctgattgacagccagtag

SEQ ID NO: 21727 - DNA, 1137 bp, Artificial Sequence
  Description of Artificial Sequence: Synthetic coding sequence
atggtggaggccgacaggcctgggaagctgttcatcggcggcctgaacacagagaccaatgagaaggccctggaggccgtgtttgggaagtatggccgcatcgtggaggtgctgctgatgaaggaccgggagagccctgcagatgccaaggatgctgcccgggacatgaatggcaagagcctggatggcaaggccatcaaggtggagcaggccaccaagcccagctttgagagcggccggcggggccccccacctccacccaggagccggggccccccccggggcctgcggggcggccggggcggcagcggcggcacccggggcccccccagcagaggaggccacatggatgatggcggctacagcatgaacttcaacatgagcagcagccggggccccctgcctgtgaagaggggccccccacccaggtctgggggccccccacccaagaggtctgcccccagcggccctgtgcgcagcagcagcggcatgggcggccgggcccctgtgtcccggggccgggacagctatggaggccccccccggcgggagcccctgcccagcagaagagatgtgtacctgagccccagagatgatggctacagcaccaaggacagctacagcagccgggactaccccagcagccgggacacccgggactatgcccccccaccccgggactacacctacagagattatggccacagcagcagcagagatgactaccccagccggggctacagcgacagagatggctacggccgggaccgggactacagcgaccaccccagcggcggcagctacagagacagctatgagagctatggcaacagccgcagcgccccacccacccggggccccccacccagctatggaggcagcagccgctatgatgactacagcagcagcagagatggctatggaggcagccgggacagctacagcagcagcagaagtgacctgtacagcagcggccgggacagagtgggccggcaggagcggggcctgcccccatccatggagcggggctaccccccaccccgggacagctacagcagcagcagcagaggagccccccggggcggcggccggggcggcagcagaagtgaccggggcggcggccgcagccgctactag

SEQ ID NO: 21728 - DNA, 1443 bp, Artificial Sequence
  Description of Artificial Sequence: Synthetic coding sequence
atggccagtgacagcatctttgagagcttccccagctacccccagtgcttcatgagggagtgcatcctgggcatgaaccccagcagagatgtgcatgatgccagcaccagccgccgcttcaccccacccagcacagccctgagccctgggaagatgtctgaggccctgcccctgggcgccccagatgctggagctgccctggccggcaagctgcggagcggggaccgctccatggtggaggtgctggccgaccaccctggagagctggtgaggacagacagccccaacttcctgtgcagcgtgctgcccacccactggcgctgcaacaagaccctgcccatcgccttcaaggtggtggccctgggagatgtgcctgatggcaccctggtgacagtgatggctggaaatgatgagaactacagcgctgagctgagaaatgccacagctgccatgaagaaccaggtggcccgcttcaatgacctgcgctttgtgggccgcagcggccggggcaagagcttcaccctgaccatcaccgtcttcaccaaccccccccaggtggccacctaccaccgggccatcaagatcaccgtggatggcccccgggagccccggcggcaccggcagaagctggatgaccagaccaagccaggcagcctgtccttcagcgagcggctgtctgagctggagcagctgcggaggacagccatgagggtgagcccccaccacccagcccccacccccaacccccgggccagcctgaaccacagcacagccttcaacccccagccccagagccagatgcaggacacccggcagatccagcccagccccccctggagctatgaccagagctaccagtacctgggcagcatcgccagccccagcgtgcacccagccacccccatcagccctggccgggccagcggcatgaccaccctgtctgctgagctgagcagccggctgagcacagccccagacctgacagccttcagtgacccccggcagtttcctgccctgcccagcatcagtgaccccaggatgcactacccaggggccttcacctacagccccacccctgtgaccagcggcatcggcatcggcatgtctgccatgggcagcgccacccgctaccacacctacctgcccccaccctacccaggcagcagccaggcccagggcggccccttccaggccagcagccccagctaccacctgtactatggagccagcgctggcagctaccagttctccatggtgggcggggagaggagccccccacgcatcctgcccccctgcaccaatgccagcactggaagtgccctgctgaaccccagcctgcccaaccagagtgatgtggtggaggccgagggcagccacagcaacagccccaccaacatggcccccagcgcccggctggaggaggccgtgtggaggccctactag

SEQ ID NO: 21729 - DNA, 1407 bp, Artificial Sequence
  Description of Artificial Sequence: Synthetic coding sequence
atgcctgctgccccccggggccctgcccagggcgaggccgccgcccggaccaggagcagagatgccagcaccagccgccgcttcaccccacccagcacagccctgagccctgggaagatgtctgaggccctgcccctgggcgccccagatgctggagctgccctggccggcaagctgcggagcggggaccgctccatggtggaggtgctggccgaccaccctggagagctggtgaggacagacagccccaacttcctgtgcagcgtgctgcccacccactggcgctgcaacaagaccctgcccatcgccttcaaggtggtggccctgggagatgtgcctgatggcaccctggtgacagtgatggctggaaatgatgagaactacagcgctgagctgagaaatgccacagctgccatgaagaaccaggtggcccgcttcaatgacctgcgctttgtgggccgcagcggccggggcaagagcttcaccctgaccatcaccgtcttcaccaaccccccccaggtggccacctaccaccgggccatcaagatcaccgtggatggcccccgggagccccggcggcaccggcagaagctggatgaccagaccaagccaggcagcctgtccttcagcgagcggctgtctgagctggagcagctgcggaggacagccatgagggtgagcccccaccacccagcccccacccccaacccccgggccagcctgaaccacagcacagccttcaacccccagccccagagccagatgcaggacacccggcagatccagcccagccccccctggagctatgaccagagctaccagtacctgggcagcatcgccagccccagcgtgcacccagccacccccatcagccctggccgggccagcggcatgaccaccctgtctgctgagctgagcagccggctgagcacagccccagacctgacagccttcagtgacccccggcagtttcctgccctgcccagcatcagtgaccccaggatgcactacccaggggccttcacctacagccccacccctgtgaccagcggcatcggcatcggcatgtctgccatgggcagcgccacccgctaccacacctacctgcccccaccctacccaggcagcagccaggcccagggcggccccttccaggccagcagccccagctaccacctgtactatggagccagcgctggcagctaccagttctccatggtgggcggggagaggagccccccacgcatcctgcccccctgcaccaatgccagcactggaagtgccctgctgaaccccagcctgcccaaccagagtgatgtggtggaggccgagggcagccacagcaacagccccaccaacatggcccccagcgcccggctggaggaggccgtgtggaggccctactag

SEQ ID NO: 21730 - DNA, 1362 bp, Artificial Sequence
  Description of Artificial Sequence: Synthetic coding sequence
atgagaattcctgtggatgccagcaccagccgccgcttcaccccacccagcacagccctgagccctgggaagatgtctgaggccctgcccctgggcgccccagatgctggggccgccctggccggcaagctgcggagcggggaccgctccatggtggaggtgctggccgaccaccctggagagctggtgaggacagacagccccaacttcctgtgcagcgtgctgcccacccactggcgctgcaacaagaccctgcccatcgccttcaaggtggtggccctgggagatgtgcctgatggcaccctggtgacagtgatggctggaaatgatgagaactacagcgctgagctgagaaatgccacagctgccatgaagaaccaggtggcccgcttcaatgacctgcgctttgtgggccgcagcggccggggcaagagcttcaccctgaccatcaccgtcttcaccaaccccccccaggtggccacctaccaccgggccatcaagatcaccgtggatggcccccgggagcccaggaggcaccggcagaagctggatgaccagaccaagccaggcagcctgtccttcagcgagcggctgtctgagctggagcagctgcggaggacagccatgagggtgagcccccaccacccagcccccacccccaacccccgggccagcctgaaccacagcacagccttcaacccccagccccagagccagatgcaggacacccggcagatccagcccagccccccctggagctatgaccagagctaccagtacctgggcagcatcgccagccccagcgtgcacccagccacccccatcagccctggccgggccagcggcatgaccaccctgtctgctgagctgagcagccggctgagcacagccccagacctgacagccttcagtgacccccggcagtttcctgccctgcccagcatcagtgaccccaggatgcactacccaggggccttcacctacagccccacccctgtgaccagcggcattggaattggcatgtctgccatgggcagcgccacccgctaccacacctacctgcccccaccctacccaggcagcagccaggcccagggcggccccttccaggccagcagccccagctaccacctgtactacggggccagcgctggcagctaccagttctccatggtgggcggggagaggagccccccacgcatcctgcccccctgcaccaatgccagcacaggcagcgccctgctgaaccccagcctgcccaaccagagtgatgtggtggaggccgagggcagccacagcaacagccccaccaacatggcccccagcgcccggctggaggaggccgtgtggaggccctactag

SEQ ID NO: 21731 - DNA, 1428 bp, Artificial Sequence
  Description of Artificial Sequence: Synthetic coding sequence
atgaaccccagcagagatgtgcatgatgccagcaccagccgccgcttcaccccacccagcacagccctgagccctgggaagatgtctgaggccctgcccctgggcgccccagatgctggagctgccctggccggcaagctgcggagcggggaccgctccatggtggaggtgctggccgaccaccctggagagctggtgaggacagacagccccaacttcctgtgcagcgtgctgcccacccactggcgctgcaacaagaccctgcccatcgccttcaaggtggtggccctgggagatgtgcctgatggcaccctggtgacagtgatggctggaaatgatgagaactacagcgctgagctgagaaatgccacagctgccatgaagaaccaggtggcccgcttcaatgacctgcgctttgtgggccgcagcggccggggcaagagcttcaccctgaccatcaccgtcttcaccaaccccccccaggtggccacctaccaccgggccatcaagatcaccgtggatggcccccgggagccccggcggcaccggcagaagctggatgaccagaccaagccaggcagcctgtccttcagcgagcggctgtctgagctggagcagctgcggaggacagccatgagggtgagcccccaccacccagcccccacccccaacccccgggccagcctgaaccacagcacagccttcaacccccagccccagagccagatgcaggacacccggcagatccagcccagccccccctggagctatgaccagagctaccagtacctgggcagcatcgccagccccagcgtgcacccagccacccccatcagccctggccgggccagcggcatgaccaccctgtctgctgagctgagcagccggctgagcacagccccagacctgacagccttcagtgacccccggcagtttcctgccctgcccagcatcagtgaccccaggatgcactacccaggggccttcacctacagccccacccctgtgaccagcggcatcggcatcggcatgtctgccatgggcagcgccacccgctaccacacctacctgcccccaccctacccaggcagcagccaggcccagggcggccccttccaggccagcagccccagctaccacctgtactatggagccagcgctggcagctaccagttctccatggtgggcggggagaggagccccccacgcatcctgcccccctgcaccaatgccagcactggaagtgccctgctgaaccccagcctgcccaaccagagtgatgtggtggaggccgagggcagccacagcaacagccccaccaacatggcccgggccagctgcagccggcaggcccggcgggaccccggcccctgggcccggcccccatcctggggccggggccggcccacagcccgcatcagcctgtag

SEQ ID NO: 21732 - DNA, 99 bp, Artificial Sequence
  Description of Artificial Sequence: Synthetic coding sequence
atggccagtgacagcatctttgagagcttccccagctacccccagtgcttcatgagggagtgcatcctgggcatgaaccccagcagagatgtgcactag

SEQ ID NO: 21733 - DNA, 414 bp, Artificial Sequence
  Description of Artificial Sequence: Synthetic coding sequence
atgcaggacacccggcagatccagcccagccccccctggagctatgaccagagctaccagtacctgggcagcatcgccagccccagcgtgcacccagccacccccatcagccctggccgggccagcggcatgaccaccctgtctgctgagctgagcagccggctgagcacagccccagacctgacagccttcagtgacccccggcagtttcctgccctgcccagcatcagtgaccccaggatgcactacccaggggccttcacctacagccccacccctgtgaccagcggcatcggcatcggcatgtctgccatgggcagcgccacccgctaccacacctacctgcccccaccctacccaggcagcagccaggcccagggcggccccttccaggccagcagccccagctactag

SEQ ID NO: 21734 - DNA, 1443 bp, Artificial Sequence; identical to SEQ ID NO: 21728
  Description of Artificial Sequence: Synthetic coding sequence

SEQ ID NO: 21735 - DNA, 576 bp, Artificial Sequence
  Description of Artificial Sequence: Synthetic coding sequence
atgaaccccagcagagatgtgcatgatgccagcaccagccgccgcttcaccccacccagcacagccctgagccctgggaagatgtctgaggccctgcccctgggcgccccagatgctggagctgccctggccggcaagctgcggagcggggaccgctccatggtggaggtgctggccgaccaccctggagagctggtgaggacagacagccccaacttcctgtgcagcgtgctgcccacccactggcgctgcaacaagaccctgcccatcgccttcaaggtggtggccctgggagatgtgcctgatggcaccctggtgacagtgatggctggaaatgatgagaactacagcgctgagctgagaaatgccacagctgccatgaagaaccaggtggcccgcttcaatgacctgcgctttgtgggccgcagcggccggggcaagagcttcaccctgaccatcaccgtcttcaccaaccccccccaggtggccacctaccaccgggccatcaagatcaccgtggatggcccccgggagcccaggaacagcctgacctggccccgctacccccacatctag

SEQ ID NO: 21736 - DNA, 753 bp, Artificial Sequence
  Description of Artificial Sequence: Synthetic coding sequence
atgagaattcctgtggatgccagcaccagccgccgcttcaccccacccagcacagccctgagccctgggaagatgtctgaggccctgcccctgggcgccccagatgctggggccgccctggccggcaagctgcggagcggggaccgctccatggtggaggtgctggccgaccaccctggagagctggtgaggacagacagccccaacttcctgtgcagcgtgctgcccacccactggcgctgcaacaagaccctgcccatcgccttcaaggtggtggccctgggagatgtgcctgatggcaccctggtgacagtgatggctggaaatgatgagaactacagcgctgagctgagaaatgccacagctgccatgaagaaccaggtggcccgcttcaatgacctgcgctttgtgggccgcagcggccggggcaagagcttcaccctgaccatcaccgtcttcaccaaccccccccaggtggccacctaccaccgggccatcaagatcaccgtggatggcccccgggagcccaggaggcaccggcagaagctggatgaccagaccaagccaggcagcctgtccttcagcgagcggctgtctgagctggagcagctgcggaggacagccatgagggtgagcccccaccacccagcccccacccccaacccccgggccagcctgaaccacagcacagccttcaacccccagccccagagccagatgcaggaggaggacacagccccctggcgctgctag

SEQ ID NO: 21737 - DNA, 1770 bp, Artificial Sequence
  Description of Artificial Sequence: Synthetic coding sequence
atgctgcacagcccccacaagcagccccagaaccacaagtgtggggccaacttcctgcaggaggacagcaagaagagcctggtgttcaagtggctgatctctgctggccactaccagcccccccggcccacagagagcttcaaggccgccagcagcatctacaacagaggctacaagttctacctgaagaagaagggcggcaccatggccagcaacagcctcttcagcacagtgaccccctgccagcagaacttcttctgggaccccagcaccagccgccgcttcagcccccccagcagcagcctgcagcccgggaagatgtctgatgtgtcccctgtggtggccgcccagcagcagcagcagcagcagcagcagcagcagcagcagcagcagcagcagcagcagcagcagcagcaggaggccgctgctgctgctgctgctgctgctgctgctgctgctgctgctgctgctgtgccccggctgcggccccctcatgacaacagaaccatggtggagatcatcgctgaccaccctgctgagctggtgaggacagacagccccaacttcctgtgcagcgtgctgcccagccactggcgctgcaacaagaccctgcctgtggccttcaaggtggtggccctgggggaggtgcctgatggcaccgtggtgacagtgatggctggaaatgatgagaactacagcgctgagctgagaaatgccagcgctgtgatgaagaaccaggtggcccgcttcaatgacctgcgctttgtgggccgcagcggccggggcaagagcttcaccctgaccatcaccgtcttcaccaaccccccccaggtggccacctaccaccgggccatcaaggtgacagtggatggcccccgggagccccggcggcaccggcagaagctggatgacagcaagcccagcctcttcagtgaccggctgagtgacctgggccgcatcccccaccccagcatgagggtgggcgtgcccccccagaacccccggcccagcctgaacagcgcccccagccccttcaacccccagggccagagccagatcacagacccccggcaggcccagagcagccccccctggagctatgaccagagctaccccagctacctgagccagatgaccagccccagcatccacagcaccacccccctgagcagcacccggggcaccggcctgcctgccatcacagatgtgccccggcgcatcagtgatgatgacacagccaccagtgacttctgcctgtggcccagcaccctgagcaagaagagccaggccggggccagcgagctgggccccttcagtgacccccggcagttccccagcatcagcagcctgacagagagccgcttcagcaaccccaggatgcactacccagccaccttcacctacaccccacctgtgaccagcggcatgagcctgggcatgtctgccaccacccactaccacacctacctgcccccaccctacccaggcagcagccagagccagagcggccccttccagaccagcagcaccccctacctgtactacggcaccagcagcggcagctaccagttccccatggtgcctggaggagacaggagccccagcaggatgctgcccccctgcaccaccaccagcaatggcagcaccctgctgaaccccaacctgcccaaccagaatgatggagtggatgctgatggcagccacagcagcagccccaccgtgctgaacagcagcggccgcatggatgagagcgtgtggaggccctactag

SEQ ID NO: 21738 - DNA, 1524 bp, Artificial Sequence
  Description of Artificial Sequence: Synthetic coding sequence
atgagaattcctgtggaccccagcaccagccgccgcttcagcccccccagcagcagcctgcagcccgggaagatgtctgatgtgtcccctgtggtggccgcccagcagcagcagcagcagcagcagcagcagcagcagcagcagcagcagcagcagcagcagcagcagcaggaggccgctgctgctgctgctgctgctgctgctgctgctgctgctgctgctgctgtgccccggctgcggccccctcatgacaacagaaccatggtggagatcatcgctgaccaccctgctgagctggtgaggacagacagccccaacttcctgtgcagcgtgctgcccagccactggcgctgcaacaagaccctgcctgtggccttcaaggtggtggccctgggggaggtgcctgatggcaccgtggtgacagtgatggctggaaatgatgagaactacagcgctgagctgagaaatgccagcgctgtgatgaagaaccaggtggcccgcttcaatgacctgcgctttgtgggccgcagcggccggggcaagagcttcaccctgaccatcaccgtcttcaccaaccccccccaggtggccacctaccaccgggccatcaaggtgacagtggatggcccccgggagccccggcggcaccggcagaagctggatgacagcaagcccagcctcttcagtgaccggctgagtgacctgggccgcatcccccaccccagcatgagggtgggcgtgcccccccagaacccccggcccagcctgaacagcgcccccagccccttcaacccccagggccagagccagatcacagacccccggcaggcccagagcagccccccctggagctatgaccagagctaccccagctacctgagccagatgaccagccccagcatccacagcaccacccccctgagcagcacccggggcaccggcctgcctgccatcacagatgtgccccggcgcatcagtgatgatgacacagccaccagtgacttctgcctgtggcccagcaccctgagcaagaagagccaggccggggccagcgagctgggccccttcagtgacccccggcagttccccagcatcagcagcctgacagagagccgcttcagcaaccccaggatgcactacccagccaccttcacctacaccccacctgtgaccagcggcatgagcctgggcatgtctgccaccacccactaccacacctacctgcccccaccctacccaggcagcagccagagccagagcggccccttccagaccagcagcaccccctacctgtactacggcaccagcagcggcagctaccagttccccatggtgcctggaggagacaggagccccagcaggatgctgcccccctgcaccaccaccagcaatggcagcaccctgctgaaccccaacctgcccaaccagaatgatggagtggatgctgatggcagccacagcagcagccccaccgtgctgaacagcagcggccgcatggatgagagcgtgtggaggccctactag

SEQ ID NO: 21739 - DNA, 1458 bp, Artificial Sequence
  Description of Artificial Sequence: Synthetic coding sequence
atgagaattcctgtggaccccagcaccagccgccgcttcagcccccccagcagcagcctgcagcccgggaagatgtctgatgtgtcccctgtggtggccgcccagcagcagcagcagcagcagcagcagcagcagcagcagcagcagcagcagcagcagcagcagcagcaggaggccgctgctgctgctgctgctgctgctgctgctgctgctgctgctgctgctgtgccccggctgcggccccctcatgacaacagaaccatggtggagatcatcgctgaccaccctgctgagctggtgaggacagacagccccaacttcctgtgcagcgtgctgcccagccactggcgctgcaacaagaccctgcctgtggccttcaaggtggtggccctgggggaggtgcctgatggcaccgtggtgacagtgatggctggaaatgatgagaactacagcgctgagctgagaaatgccagcgctgtgatgaagaaccaggtggcccgcttcaatgacctgcgctttgtgggccgcagcggccggggcaagagcttcaccctgaccatcaccgtcttcaccaaccccccccaggtggccacctaccaccgggccatcaaggtgacagtggatggcccccgggagccccggcggcaccggcagaagctggatgacagcaagcccagcctcttcagtgaccggctgagtgacctgggccgcatcccccaccccagcatgagggtgggcgtgcccccccagaacccccggcccagcctgaacagcgcccccagccccttcaacccccagggccagagccagatcacagacccccggcaggcccagagcagccccccctggagctatgaccagagctaccccagctacctgagccagatgaccagccccagcatccacagcaccacccccctgagcagcacccggggcaccggcctgcctgccatcacagatgtgccccggcgcatcagcggggccagcgagctgggccccttcagtgacccccggcagttccccagcatcagcagcctgacagagagccgcttcagcaaccccaggatgcactacccagccaccttcacctacaccccacctgtgaccagcggcatgagcctgggcatgtctgccaccacccactaccacacctacctgcccccaccctacccaggcagcagccagagccagagcggccccttccagaccagcagcaccccctacctgtactacggcaccagcagcggcagctaccagttccccatggtgcctggaggagacaggagccccagcaggatgctgcccccctgcaccaccaccagcaatggcagcaccctgctgaaccccaacctgcccaaccagaatgatggagtggatgctgatggcagccacagcagcagccccaccgtgctgaacagcagcggccgcatggatgagagcgtgtggaggccctactag

SEQ ID NO: 21740 - DNA, 1500 bp, Artificial Sequence
  Description of Artificial Sequence: Synthetic coding sequence
atggccagcaacagcctcttcagcacagtgaccccctgccagcagaacttcttctgggaccccagcaccagccgccgcttcagcccccccagcagcagcctgcagcccgggaagatgtctgatgtgtcccctgtggtggccgcccagcagcagcagcagcagcagcagcagcagcagcagcagcagcagcagcagcagcagcagcagcagcaggaggccgctgctgctgctgctgctgctgctgctgctgctgctgctgctgctgctgtgccccggctgcggccccctcatgacaacagaaccatggtggagatcatcgctgaccaccctgctgagctggtgaggacagacagccccaacttcctgtgcagcgtgctgcccagccactggcgctgcaacaagaccctgcctgtggccttcaaggtggtggccctgggggaggtgcctgatggcaccgtggtgacagtgatggctggaaatgatgagaactacagcgctgagctgagaaatgccagcgctgtgatgaagaaccaggtggcccgcttcaatgacctgcgctttgtgggccgcagcggccggggcaagagcttcaccctgaccatcaccgtcttcaccaaccccccccaggtggccacctaccaccgggccatcaaggtgacagtggatggcccccgggagccccggcggcaccggcagaagctggatgacagcaagcccagcctcttcagtgaccggctgagtgacctgggccgcatcccccaccccagcatgagggtgggcgtgcccccccagaacccccggcccagcctgaacagcgcccccagccccttcaacccccagggccagagccagatcacagacccccggcaggcccagagcagccccccctggagctatgaccagagctaccccagctacctgagccagatgaccagccccagcatccacagcaccacccccctgagcagcacccggggcaccggcctgcctgccatcacagatgtgccccggcgcatcagcggggccagcgagctgggccccttcagtgacccccggcagttccccagcatcagcagcctgacagagagccgcttcagcaaccccaggatgcactacccagccaccttcacctacaccccacctgtgaccagcggcatgagcctgggcatgtctgccaccacccactaccacacctacctgcccccaccctacccaggcagcagccagagccagagcggccccttccagaccagcagcaccccctacctgtactacggcaccagcagcggcagctaccagttccccatggtgcctggaggagacaggagccccagcaggatgctgcccccctgcaccaccaccagcaatggcagcaccctgctgaaccccaacctgcccaaccagaatgatggagtggatgctgatggcagccacagcagcagccccaccgtgctgaacagcagcggccgcatggatgagagcgtgtggaggccctactag

SEQ ID NO: 21741 - DNA, 1566 bp, Artificial Sequence
  Description of Artificial Sequence: Synthetic coding sequence
atggccagcaacagcctcttcagcacagtgaccccctgccagcagaacttcttctgggaccccagcaccagccgccgcttcagcccccccagcagcagcctgcagcccgggaagatgtctgatgtgtcccctgtggtggccgcccagcagcagcagcagcagcagcagcagcagcagcagcagcagcagcagcagcagcagcagcagcagcaggaggccgctgctgctgctgctgctgctgctgctgctgctgctgctgctgctgctgtgccccggctgcggccccctcatgacaacagaaccatggtggagatcatcgctgaccaccctgctgagctggtgaggacagacagccccaacttcctgtgcagcgtgctgcccagccactggcgctgcaacaagaccctgcctgtggccttcaaggtggtggccctgggggaggtgcctgatggcaccgtggtgacagtgatggctggaaatgatgagaactacagcgctgagctgagaaatgccagcgctgtgatgaagaaccaggtggcccgcttcaatgacctgcgctttgtgggccgcagcggccggggcaagagcttcaccctgaccatcaccgtcttcaccaaccccccccaggtggccacctaccaccgggccatcaaggtgacagtggatggcccccgggagccccggcggcaccggcagaagctggatgacagcaagcccagcctcttcagtgaccggctgagtgacctgggccgcatcccccaccccagcatgagggtgggcgtgcccccccagaacccccggcccagcctgaacagcgcccccagccccttcaacccccagggccagagccagatcacagacccccggcaggcccagagcagccccccctggagctatgaccagagctaccccagctacctgagccagatgaccagccccagcatccacagcaccacccccctgagcagcacccggggcaccggcctgcctgccatcacagatgtgccccggcgcatcagtgatgatgacacagccaccagtgacttctgcctgtggcccagcaccctgagcaagaagagccaggccggggccagcgagctgggccccttcagtgacccccggcagttccccagcatcagcagcctgacagagagccgcttcagcaaccccaggatgcactacccagccaccttcacctacaccccacctgtgaccagcggcatgagcctgggcatgtctgccaccacccactaccacacctacctgcccccaccctacccaggcagcagccagagccagagcggccccttccagaccagcagcaccccctacctgtactacggcaccagcagcggcagctaccagttccccatggtgcctggaggagacaggagccccagcaggatgctgcccccctgcaccaccaccagcaatggcagcaccctgctgaaccccaacctgcccaaccagaatgatggagtggatgctgatggcagccacagcagcagccccaccgtgctgaacagcagcggccgcatggatgagagcgtgtggaggccctactag

SEQ ID NO: 21742 - DNA, 1566 bp, Artificial Sequence; identical to SEQ ID NO: 21741
  Description of Artificial Sequence: Synthetic coding sequence

SEQ ID NO: 21743 - DNA, 1704 bp, Artificial Sequence
  Description of Artificial Sequence: Synthetic coding sequence
atgctgcacagcccccacaagcagccccagaaccacaagtgtggggccaacttcctgcaggaggacagcaagaagagcctggtgttcaagtggctgatctctgctggccactaccagcccccccggcccacagagagcttcaaggccgccagcagcatctacaacagaggctacaagttctacctgaagaagaagggcggcaccatggccagcaacagcctcttcagcacagtgaccccctgccagcagaacttcttctgggaccccagcaccagccgccgcttcagcccccccagcagcagcctgcagcccgggaagatgtctgatgtgtcccctgtggtggccgcccagcagcagcagcagcagcagcagcagcagcagcagcagcagcagcagcagcagcagcagcagcagcaggaggccgctgctgctgctgctgctgctgctgctgctgctgctgctgctgctgctgtgccccggctgcggccccctcatgacaacagaaccatggtggagatcatcgctgaccaccctgctgagctggtgaggacagacagccccaacttcctgtgcagcgtgctgcccagccactggcgctgcaacaagaccctgcctgtggccttcaaggtggtggccctgggggaggtgcctgatggcaccgtggtgacagtgatggctggaaatgatgagaactacagcgctgagctgagaaatgccagcgctgtgatgaagaaccaggtggcccgcttcaatgacctgcgctttgtgggccgcagcggccggggcaagagcttcaccctgaccatcaccgtcttcaccaaccccccccaggtggccacctaccaccgggccatcaaggtgacagtggatggcccccgggagccccggcggcaccggcagaagctggatgacagcaagcccagcctcttcagtgaccggctgagtgacctgggccgcatcccccaccccagcatgagggtgggcgtgcccccccagaacccccggcccagcctgaacagcgcccccagccccttcaacccccagggccagagccagatcacagacccccggcaggcccagagcagccccccctggagctatgaccagagctaccccagctacctgagccagatgaccagccccagcatccacagcaccacccccctgagcagcacccggggcaccggcctgcctgccatcacagatgtgccccggcgcatcagcggggccagcgagctgggccccttcagtgacccccggcagttccccagcatcagcagcctgacagagagccgcttcagcaaccccaggatgcactacccagccaccttcacctacaccccacctgtgaccagcggcatgagcctgggcatgtctgccaccacccactaccacacctacctgcccccaccctacccaggcagcagccagagccagagcggccccttccagaccagcagcaccccctacctgtactacggcaccagcagcggcagctaccagttccccatggtgcctggaggagacaggagccccagcaggatgctgcccccctgcaccaccaccagcaatggcagcaccctgctgaaccccaacctgcccaaccagaatgatggagtggatgctgatggcagccacagcagcagccccaccgtgctgaacagcagcggccgcatggatgagagcgtgtggaggccctactag

SEQ ID NO: 21744 - DNA, 1248 bp, Artificial Sequence
  Description of Artificial Sequence: Synthetic coding sequence
atgagaattcctgtggaccccagcaccagccgccgcttcaccccacccagccctgccttcccctgtggcggcggcggcggcaagatgggagaaaattctggggccctgagcgcccaggccgctgtgggccctgggggccgggcccggcctgaggtgcgctccatggtggatgtgctggccgaccatgctggggagctggtgaggacagacagccccaacttcctgtgcagcgtgctgcccagccactggcgctgcaacaagaccctgcctgtggccttcaaggtggtggccctgggagatgtgcctgatggcaccgtggtgacagtgatggctggaaatgatgagaactacagcgctgagctgagaaatgccagcgctgtgatgaagaaccaggtggcccgcttcaatgacctgcgctttgtgggccgcagcggccggggcaagagcttcaccctgaccatcaccgtcttcaccaaccccacccaggtggccacctaccaccgggccatcaaggtgacagtggatggcccccgggagcccaggaggcaccggcagaagctggaggaccagaccaagcccttcccagacagatttggagacctggagcggctgaggatgagggtgacccccagcacccccagcccccggggcagcctgagcaccaccagccacttcagcagccagccccagacccccatccagggcaccagcgagctgaaccccttcagtgacccccggcagtttgaccgctccttccccaccctgcccaccctgacagagagccgcttcccagaccccaggatgcactacccaggggccatgtctgctgccttcccctacagcgccaccccatctggcaccagcatcagcagcctgtctgtggccggcatgcctgccaccagccgcttccaccacacctacctgcccccaccctacccaggggccccccagaaccagagcggccccttccaggccaaccccagcccctaccacctgtactacggcaccagcagcggcagctaccagttctccatggtggccggcagcagcagtggaggagacaggagccccaccaggatgctggccagctgcaccagcagcgctgcctctgtggccgccggcaacctgatgaaccccagcctgggcggccagagtgatggagtggaggctgatggcagccacagcaacagccccacagccctgagcaccccaggccgcatggatgaggccgtgtggaggccctactag

SEQ ID NO: 21745 - DNA, 1290 bp, Artificial Sequence
  Description of Artificial Sequence: Synthetic coding sequence
atggccagcaacagcatctttgacagcttccccacctacagccccaccttcatccgggaccccagcaccagccgccgcttcaccccacccagccctgccttcccctgtggcggcggcggcggcaagatgggagaaaattctggggccctgagcgcccaggccgctgtgggccctgggggccgggcccggcctgaggtgcgctccatggtggatgtgctggccgaccatgctggggagctggtgaggacagacagccccaacttcctgtgcagcgtgctgcccagccactggcgctgcaacaagaccctgcctgtggccttcaaggtggtggccctgggagatgtgcctgatggcaccgtggtgacagtgatggctggaaatgatgagaactacagcgctgagctgagaaatgccagcgctgtgatgaagaaccaggtggcccgcttcaatgacctgcgctttgtgggccgcagcggccggggcaagagcttcaccctgaccatcaccgtcttcaccaaccccacccaggtggccacctaccaccgggccatcaaggtgacagtggatggcccccgggagcccaggaggcaccggcagaagctggaggaccagaccaagcccttcccagacagatttggagacctggagcggctgaggatgagggtgacccccagcacccccagcccccggggcagcctgagcaccaccagccacttcagcagccagccccagacccccatccagggcaccagcgagctgaaccccttcagtgacccccggcagtttgaccgctccttccccaccctgcccaccctgacagagagccgcttcccagaccccaggatgcactacccaggggccatgtctgctgccttcccctacagcgccaccccatctggcaccagcatcagcagcctgtctgtggccggcatgcctgccaccagccgcttccaccacacctacctgcccccaccctacccaggggccccccagaaccagagcggccccttccaggccaaccccagcccctaccacctgtactacggcaccagcagcggcagctaccagttctccatggtggccggcagcagcagtggaggagacaggagccccaccaggatgctggccagctgcaccagcagcgctgcctctgtggccgccggcaacctgatgaaccccagcctgggcggccagagtgatggagtggaggctgatggcagccacagcaacagccccacagccctgagcaccccaggccgcatggatgaggccgtgtggaggccctactag

SEQ ID NO: 21746 - DNA, 1290 bp, Artificial Sequence; identical to SEQ ID NO: 21745
  Description of Artificial Sequence: Synthetic coding sequence

SEQ ID NO: 21747 - DNA, 1089 bp, Artificial Sequence
  Description of Artificial Sequence: Synthetic coding sequence
atgagaattcctgtggaccccagcaccagccgccgcttcaccccacccagccctgccttcccctgtggcggcggcggcggcaagatgggagaaaattctggggccctgagcgcccaggccgctgtgggccctgggggccgggcccggcctgaggtgcgctccatggtggatgtgctggccgaccatgctggggagctggtgaggacagacagccccaacttcctgtgcagcgtgctgcccagccactggcgctgcaacaagaccctgcctgtggccttcaaggtggtggccctgggagatgtgcctgatggcaccgtggtgacagtgatggctggaaatgatgagaactacagcgctgagctgagaaatgccagcgctgtgatgaagaaccaggtggcccgcttcaatgacctgcgctttgtgggccgcagcggccggggcaagagcttcaccctgaccatcaccgtcttcaccaaccccacccaggtggccacctaccaccgggccatcaaggtgacagtggatggcccccgggagcccaggaggaccagcgagctgaaccccttcagtgacccccggcagtttgacaggagcttccccaccctgcccaccctgacagagagccgcttcccagaccccaggatgcactacccaggggccatgtctgctgccttcccctacagcgccacccccagcggcaccagcatcagcagcctgtctgtggccggcatgcctgccaccagccgcttccaccacacctacctgcccccaccctacccaggggccccccagaaccagagcggccccttccaggccaaccccagcccctaccacctgtactacggcaccagcagcggcagctaccagttctccatggtggccggcagcagcagcggcggggacaggagccccaccaggatgctggccagctgcaccagcagcgctgcctctgtggccgccggcaacctgatgaaccccagcctgggcggccagagtgatggagtggaggctgatggcagccacagcaacagccccacagccctgagcaccccaggccgcatggatgaagctgtgtggaggccctactag

SEQ ID NO: 21748 - DNA, 969 bp, Artificial Sequence
  Description of Artificial Sequence: Synthetic coding sequence
atggtggtggccctgggagatgtgcctgatggcaccgtggtgacagtgatggctggaaatgatgagaactacagcgctgagctgagaaatgccagcgctgtgatgaagaaccaggtggcccgcttcaatgacctgcgctttgtgggccgcagcggccggggcaagagcttcaccctgaccatcaccgtcttcaccaaccccacccaggtggccacctaccaccgggccatcaaggtgacagtggatggcccccgggagccccggcggcaccggcagaagctggaggaccagaccaagcccttcccagacagatttggagacctggagcggctgaggatgagggtgacccccagcacccccagcccccggggcagcctgagcaccaccagccacttcagcagccagccccagacccccatccagggcaccagcgagctgaaccccttcagtgacccccggcagtttgacaggagcttccccaccctgcccaccctgacagagagccgcttcccagaccccaggatgcactacccaggggccatgtctgctgccttcccctacagcgccacccccagcggcaccagcatcagcagcctgtctgtggccggcatgcctgccaccagccgcttccaccacacctacctgcccccaccctacccaggggccccccagaaccagagcggccccttccaggccaaccccagcccctaccacctgtactacggcaccagcagcggcagctaccagttctccatggtggccggcagcagcagcggcggggacaggagccccaccaggatgctggccagctgcaccagcagcgctgcctctgtggccgccggcaacctgatgaaccccagcctgggcggccagagtgatggagtggaggctgatggcagccacagcaacagccccacagccctgagcaccccaggccgcatggatgaagctgtgtggaggccctactag

SEQ ID NO: 21749 - DNA, 2439 bp, Artificial Sequence
  Description of Artificial Sequence: Synthetic coding sequence
atggacttcagccggctgcacatgtacagccccccccagtgtgtgcctgaaaatacaggctacacctacgccctgagcagcagctacagcagtgatgccctggactttgaaacagagcacaagctggaccctgtgtttgacagccccaggatgagcagaagaagcctgcggctggccaccacagcctgcaccctgggagatggagaggccgtgggcgctgacagcggcaccagcagcgctgtgtccctgaagaacagagctgcccggaccaccaagcagaggaggagcaccaacaagagcgccttcagcatcaaccacgtgtcccggcaggtgaccagcagcggcgtgagccacggcggcaccgtgtccctgcaggatgctgtgacccggcggccccctgtgctggatgagagctggatccgggagcagaccaccgtggaccacttctggggcctggatgatgatggagacctgaagggcggcaacaaggccgccatccagggcaatggagatgtgggcgctgctgctgccacagcccacaacggcttcagctgcagcaactgcagcatgctgtctgagaggaaggatgtgctgacagcccaccctgctgcccctggccctgtgtcccgggtgtacagccgggacaggaaccagaagtgtgatgactgcaagggcaagaggcacctggatgcccaccctggccgggccggcaccctgtggcacatctgggcctgtgccggctacttcctgctgcagatcctgcggagaattggagctgtgggccaggccgtgtccaggacagcctggagcgccctgtggctggccgtggtggcccctgggaaggccgccagcggggtcttctggtggctgggcatcggctggtaccagtttgtgaccctcatctcctggctgaatgtgttcctgctgacccgctgcctgaggaacatctgcaagttcctggtgctgctgatccccctcttcctgctgctggccggcctgagcctgcggggccagggcaacttcttctccttcctgcctgtgctgaactgggcctccatgcacaggacccagagggtggatgacccccaggatgtgttcaagcccaccaccagccggctgaagcagcccctgcagggcgacagcgaggccttcccctggcactggatgtctggagtggagcagcaggtggccagcctgagcggccagtgccaccaccacggggagaacctgcgggagctgaccaccctgctgcagaagctgcaggcccgggtggaccagatggagggcggggccgccggccccagcgcctctgtgagagatgctgtgggccagcccccccgggagacagacttcatggccttccaccaggagcacgaggtgaggatgagccacctggaggacatcctgggcaagctgcgggagaagtctgaggccatccagaaggagctggagcagaccaagcagaagaccatctctgctgtgggggagcagctgctgcccaccgtggagcacctgcagctggagctggaccagctgaagtctgagctgagctcctggaggcatgtgaagacaggctgtgagaccgtggatgctgtgcaggagcgggtggatgtgcaggtgcgggagatggtgaagctgctcttcagcgaggaccagcagggcggcagcctggagcagctgctgcagcgcttcagcagccagtttgtgtccaaaggagacctgcagaccatgctgcgggacctgcagctgcagatcctgagaaatgtgacccaccacgtgtctgtgaccaagcagctgcccaccagcgaggccgtggtgtctgctgtgtctgaggccggggccagcggcatcacagaggcccaggcccgggccatcgtgaacagcgccctgaagctgtacagccaggacaagacaggcatggtggactttgccctggagagcggcggcggcagcatcctgagcacccgctgcagcgagacctatgagaccaagacagccctgatgagcctgtttggcatccccctgtggtacttcagccagagcccccgggtggtgatccagcctgacatctacccaggcaactgctgggccttcaagggcagccagggctacctggtggtgcggctgtccatgatgatccaccctgctgccttcaccctggagcacatccccaagaccctgagccccaccggcaacatcagcagcgcccccaaggactttgctgtgtatggcctggagaatgagtaccaggaggagggccagctgctgggccagttcacctatgaccaggatggagagagcctgcagatgttccaggccctgaagaggccagatgacacagccttccagatcgtggagctgcgcatcttcagcaactggggccaccctgagtacacctgcctgtaccgcttccgggtgcatggagagcctgtgaagtag

SEQ ID NO: 21750 - DNA, 2109 bp, Artificial Sequence
  Description of Artificial Sequence: Synthetic coding sequence
atgagcagaagaagcctgcggctggccaccacagcctgcaccctgggagatggagaggccgtgggcgctgacagcggcaccagcagcgctgtgtccctgaagaacagagctgcccggaccaccaagcagaggaggagcaccaacaagagcgccttcagcatcaaccacgtgtcccggcaggtgaccagcagcggcgtgagccacggcggcaccgtgtccctgcaggatgctgtgacccggcggccccctgtgctggatgagagctggatccgggagcagaccaccgtggaccacttctggggcctggatgatgatggagacctgaagggcggcaacaaggccgccatccagggcaatggagatgtgggcgctgctgctgccacagcccacaacggcttcagctgcagcaactgcagcatgctgtctgagaggaaggatgtgctgacagcccaccctgctgcccctggccctgtgtcccgggtgtacagccgggacaggaaccagaagtggaaggccgccagcggggtcttctggtggctgggcatcggctggtaccagtttgtgaccctcatctcctggctgaatgtgttcctgctgacccgctgcctgaggaacatctgcaagttcctggtgctgctgatccccctcttcctgctgctggccggcctgagcctgcggggccagggcaacttcttctccttcctgcctgtgctgaactgggcctccatgcacaggacccagagggtggatgacccccaggatgtgttcaagcccaccaccagccggctgaagcagcccctgcagggcgacagcgaggccttcccctggcactggatgtctggagtggagcagcaggtggccagcctgagcggccagtgccaccaccacggggagaacctgcgggagctgaccaccctgctgcagaagctgcaggcccgggtggaccagatggagggcggggccgccggccccagcgcctctgtgagagatgctgtgggccagcccccccgggagacagacttcatggccttccaccaggagcacgaggtgaggatgagccacctggaggacatcctgggcaagctgcgggagaagtctgaggccatccagaaggagctggagcagaccaagcagaagaccatctctgctgtgggggagcagctgctgcccaccgtggagcacctgcagctggagctggaccagctgaagtctgagctgagctcctggaggcatgtgaagacaggctgtgagaccgtggatgctgtgcaggagcgggtggatgtgcaggtgcgggagatggtgaagctgctcttcagcgaggaccagcagggcggcagcctggagcagctgctgcagcgcttcagcagccagtttgtgtccaaaggagacctgcagaccatgctgcgggacctgcagctgcagatcctgagaaatgtgacccaccacgtgtctgtgaccaagcagctgcccaccagcgaggccgtggtgtctgctgtgtctgaggccggggccagcggcatcacagaggcccaggcccgggccatcgtgaacagcgccctgaagctgtacagccaggacaagacaggcatggtggactttgccctggagagcggcggcggcagcatcctgagcacccgctgcagcgagacctatgagaccaagacagccctgatgagcctgtttggcatccccctgtggtacttcagccagagcccccgggtggtgatccagcctgacatctacccaggcaactgctgggccttcaagggcagccagggctacctggtggtgcggctgtccatgatgatccaccctgctgccttcaccctggagcacatccccaagaccctgagccccaccggcaacatcagcagcgcccccaaggactttgctgtgtatggcctggagaatgagtaccaggaggagggccagctgctgggccagttcacctatgaccaggatggagagagcctgcagatgttccaggccctgaagaggccagatgacacagccttccagatcgtggagctgcgcatcttcagcaactggggccaccctgagtacacctgcctgtaccgcttccgggtgcatggagagcctgtgaagtag

SEQ ID NO: 21751 - DNA, 2358 bp, Artificial Sequence
  Description of Artificial Sequence: Synthetic coding sequence
atggacttcagccggctgcacatgtacagccccccccagtgtgtgcctgaaaatacaggctacacctacgccctgagcagcagctacagcagtgatgccctggactttgaaacagagcacaagctggaccctgtgtttgacagccccaggatgagcagaagaagcctgcggctggccaccacagcctgcaccctgggagatggagaggccgtgggcgctgacagcggcaccagcagcgctgtgtccctgaagaacagagctgcccggaccaccaagcagaggaggagcaccaacaagagcgccttcagcatcaaccacgtgtcccggcaggtgaccagcagcggcgtgagccacggcggcaccgtgtccctgcaggatgctgtgacccggcggccccctgtgctggatgagagctggatccgggagcagaccaccgtggaccacttctggggcctggatgatgatggagacctgaagggcggcaacaaggccgccatccagggcaatggagatgtgggcgctgctgctgccacagcccacaacggcttcagctgcagcaactgcagcatgctgtctgagaggaaggatgtgctgacagcccaccctgctgcccctggccctgtgtcccgggtgtacagccgggacaggaaccagaagtgctacttcctgctgcagatcctgcggcgcatcggggctgtgggccaggccgtgtccaggacagcctggagcgccctgtggctggccgtggtggcccctgggaaggccgccagcggggtcttctggtggctgggcatcggctggtaccagtttgtgaccctcatctcctggctgaatgtgttcctgctgacccgctgcctgaggaacatctgcaagttcctggtgctgctgatccccctcttcctgctgctggccggcctgagcctgcggggccagggcaacttcttctccttcctgcctgtgctgaactgggcctccatgcacaggacccagagggtggatgacccccaggatgtgttcaagcccaccaccagccggctgaagcagcccctgcagggcgacagcgaggccttcccctggcactggatgtctggagtggagcagcaggtggccagcctgagcggccagtgccaccaccacggggagaacctgcgggagctgaccaccctgctgcagaagctgcaggcccgggtggaccagatggagggcggcgctgctggccccagcgcctctgtgagagatgctgtgggccagcccccccgggagacagacttcatggccttccaccaggagcacgaggtgaggatgagccacctggaggacatcctgggcaagctgcgggagaagtctgaggccatccagaaggagctggagcagaccaagcagaagaccatctctgctgtgggggagcagctgctgcccaccgtggagcacctgcagctggagctggaccagctgaagtctgagctgagctcctggaggcatgtgaagacaggctgtgaaacagtggatgctgtgcaggagcgggtggatgtgcaggtgcgggagatggtgaagctgctcttcagcgaggaccagcagggcggcagcctggagcagctgctgcagcgcttcagcagccagtttgtgtccaagggggacctgcagaccatgctgcgggacctgcagctgcagatcctgagaaatgtgacccaccacgtgtctgtgaccaagcagctgcccaccagcgaggccgtggtgtctgctgtgtctgaggccggggccagcggcatcacagaggcccaggcccgggccatcgtgaacagcgccctgaagctgtacagccaggacaagacaggcatggtggactttgccctggagagcggcggcggcagcatcctgagcacccgctgcagcgagacctatgagaccaagacagccctgatgagcctgtttggcatccccctgtggtacttcagccagagcccccgggtggtgatccagcctgacatctacccaggcaactgctgggccttcaagggcagccagggctacctggtggtgcggctgtccatgatgatccaccctgctgccttcaccctggagcacatccccaagaccctgagccccactggaaacatcagcagcgcccccaaggactttgctgtgtatggcctggagaatgagtaccaggaggagggccagctgctgggccagttcacctatgaccaggatggagagagcctgcagatgttccaggccctgaagaggccagatgacacagccttccagatcgtggagctgcgcatcttcagcaactggggccaccctgagtacacctgcctgtaccgcttccgggtgcacggggagcctgtgaagtag

SEQ ID NO: 21752 - DNA, 774 bp, Artificial Sequence
  Description of Artificial Sequence: Synthetic coding sequence
atggacttcagccggctgcacatgtacagccccccccagtgtgtgcctgaaaatacaggctacacctacgccctgagcagcagctacagcagtgatgccctggactttgaaacagagcacaagctggaccctgtgtttgacagccccaggatgagcagaagaagcctgcggctggccaccacagcctgcaccctgggagatggagaggccgtgggcgctgacagcggcaccagcagcgctgtgtccctgaagaacagagctgcccggaccaccaagcagaggaggagcaccaacaagagcgccttcagcatcaaccacgtgtcccggcaggtgaccagcagcggcgtgagccacggcggcaccgtgtccctgcaggatgctgtgacccggcggccccctgtgctggatgagagctggatccgggagcagaccaccgtggaccacttctggggcctggatgatgatggagacctgaagggcggcaacaaggccgccatccagggcaatggagatgtgggcgctgctgctgccacagcccacaacggcttcagctgcagcaactgcagcatgctgtctgagaggaaggatgtgctgacagcccaccctgctgcccctggccctgtgtcccgggtgtacagccgggacaggaaccagaagtgcaagagccagagcttcaagacccagaagaaggtgtgcttccccaacctgatcttccccttctgcaagagccagtgcctgcactacctgtcctggaggctgaagatcatcccctag

SEQ ID NO: 21753 - DNA, 2469 bp, Artificial Sequence
  Description of Artificial Sequence: Synthetic coding sequence
atggacttcagccggctgcacatgtacagccccccccagtgtgtgcctgaaaatacaggctacacctacgccctgagcagcagctacagcagtgatgccctggactttgaaacagagcacaagctggaccctgtgtttgacagccccaggatgagcagaagaagcctgcggctggccaccacagcctgcaccctgggagatggagaggccgtgggcgctgacagcggcaccagcagcgctgtgtccctgaagaacagagctgcccggaccaccaagcagaggaggagcaccaacaagagcgccttcagcatcaaccacgtgtcccggcaggtgaccagcagcggcgtgagccacggcggcaccgtgtccctgcaggatgctgtgacccggcggccccctgtgctggatgagagctggatccgggagcagaccaccgtggaccacttctggggcctggatgatgatggagacctgaagggcggcaacaaggccgccatccagggcaatggagatgtgggcgctgctgctgccacagcccacaacggcttcagctgcagcaactgcagcatgctgtctgagaggaaggatgtgctgacagcccaccctgctgcccctggccctgtgtcccgggtgtacagccgggacaggaaccagaagtgtgatgactgcaagggcaagaggcacctggatgcccacacagctgcccacagccagagcccccggctgcccggccgggccggcaccctgtggcacatctgggcctgtgccggctacttcctgctgcagatcctgcggagaattggagctgtgggccaggccgtgtccaggacagcctggagcgccctgtggctggccgtggtggcccctgggaaggccgccagcggggtcttctggtggctgggcatcggctggtaccagtttgtgaccctcatctcctggctgaatgtgttcctgctgacccgctgcctgaggaacatctgcaagttcctggtgctgctgatccccctcttcctgctgctggccggcctgagcctgcggggccagggcaacttcttctccttcctgcctgtgctgaactgggcctccatgcacaggacccagagggtggatgacccccaggatgtgttcaagcccaccaccagccggctgaagcagcccctgcagggcgacagcgaggccttcccctggcactggatgtctggagtggagcagcaggtggccagcctgagcggccagtgccaccaccacggggagaacctgcgggagctgaccaccctgctgcagaagctgcaggcccgggtggaccagatggagggcggggccgccggccccagcgcctctgtgagagatgctgtgggccagcccccccgggagacagacttcatggccttccaccaggagcacgaggtgaggatgagccacctggaggacatcctgggcaagctgcgggagaagtctgaggccatccagaaggagctggagcagaccaagcagaagaccatctctgctgtgggggagcagctgctgcccaccgtggagcacctgcagctggagctggaccagctgaagtctgagctgagctcctggaggcatgtgaagacaggctgtgagaccgtggatgctgtgcaggagcgggtggatgtgcaggtgcgggagatggtgaagctgctcttcagcgaggaccagcagggcggcagcctggagcagctgctgcagcgcttcagcagccagtttgtgtccaaaggagacctgcagaccatgctgcgggacctgcagctgcagatcctgagaaatgtgacccaccacgtgtctgtgaccaagcagctgcccaccagcgaggccgtggtgtctgctgtgtctgaggccggggccagcggcatcacagaggcccaggcccgggccatcgtgaacagcgccctgaagctgtacagccaggacaagacaggcatggtggactttgccctggagagcggcggcggcagcatcctgagcacccgctgcagcgagacctatgagaccaagacagccctgatgagcctgtttggcatccccctgtggtacttcagccagagcccccgggtggtgatccagcctgacatctacccaggcaactgctgggccttcaagggcagccagggctacctggtggtgcggctgtccatgatgatccaccctgctgccttcaccctggagcacatccccaagaccctgagccccaccggcaacatcagcagcgcccccaaggactttgctgtgtatggcctggagaatgagtaccaggaggagggccagctgctgggccagttcacctatgaccaggatggagagagcctgcagatgttccaggccctgaagaggccagatgacacagccttccagatcgtggagctgcgcatcttcagcaactggggccaccctgagtacacctgcctgtaccgcttccgggtgcatggagagcctgtgaagtag

SEQ ID NO: 21754 - DNA, 1752 bp, Artificial Sequence
  Description of Artificial Sequence: Synthetic coding sequence
atgaagctgtcctatgaaagtgagaactacaagctgaagacccatgagagcaaggactgtgagagcgagagctacaagagcaagagccatgagagcaaggcccacgccagctactacggccgcatgaatgtgcgggaggtgctgcgggaggatggccacctgtctgtgaatggagaggccctgtggaaggccgccagcggggtcttctggtggctgggcatcggctggtaccagtttgtgaccctcatctcctggctgaatgtgttcctgctgacccgctgcctgaggaacatctgcaagttcctggtgctgctgatccccctcttcctgctgctggccggcctgagcctgcggggccagggcaacttcttctccttcctgcctgtgctgaactgggcctccatgcacaggacccagagggtggatgacccccaggatgtgttcaagcccaccaccagccggctgaagcagcccctgcagggcgacagcgaggccttcccctggcactggatgtctggagtggagcagcaggtggccagcctgagcggccagtgccaccaccacggggagaacctgcgggagctgaccaccctgctgcagaagctgcaggcccgggtggaccagatggagggcggggccgccggccccagcgccagcacagacttcatggccttccaccaggagcacgaggtgaggatgagccacctggaggacatcctgggcaagctgcgggagaagtctgaggccatccagaaggagctggagcagaccaagcagaagaccatctctgctgtgggggagcagctgctgcccaccgtggagcacctgcagctggagctggaccagctgaagtctgagctgagctcctggaggcatgtgaagacaggctgtgaaacagtggatgctgtgcaggagcgggtggatgtgcaggtgcgggagatggtgaagctgctcttcagcgaggaccagcagggcggcagcctggagcagctgctgcagcgcttcagcagccagtttgtgtccaagggggacctgcagaccatgctgcgggacctgcagctgcagatcctgagaaatgtgacccaccacgtgtctgtgaccaagcagctgcccaccagcgaggccgtggtgtctgctgtgtctgaggccggggccagcggcatcacagaggcccaggcccgggccatcgtgaacagcgccctgaagctgtacagccaggacaagacaggcatggtggactttgccctggagagcggcggcggcagcatcctgagcacccgctgcagcgagacctatgagaccaagacagccctgatgagcctgtttggcatccccctgtggtacttcagccagagcccccgggtggtgatccagcctgacatctacccaggcaactgctgggccttcaagggcagccagggctacctggtggtgcggctgtccatgatgatccaccctgctgccttcaccctggagcacatccccaagaccctgagccccactggaaacatcagcagcgcccccaaggactttgctgtgtatggcctggagaatgagtaccaggaggagggccagctgctgggccagttcacctatgaccaggatggagagagcctgcagatgttccaggccctgaagaggccagatgacacagccttccagatcgtggagctgcgcatcttcagcaactggggccaccctgagtacacctgcctgtaccgcttccgggtgcacggggagcctgtgaagtag

SEQ ID NO: 21755 - DNA, 342 bp, Artificial Sequence
  Description of Artificial Sequence: Synthetic coding sequence
atggacttcagccggctgcacatgtacagccccccccagtgtgtgcctgaaaatacaggctacacctacgccctgagcagcagctacagcagtgatgccctggactttgaaacagagcacaagctggaccctgtgtttgacagccccaggatgagcagaagaagcctgcggctggccaccacagcctgcaccctgggagatggagaggccgtgggcgctgacagcggcaccagcagcgctgtgtccctgaagaacagagctgcccggaccaccaagcagaggaggagcaccaacaagagcgccttcagcatcaaccacgtgtcccggcaggtgaccagctag

SEQ ID NO: 21756 - DNA, 267 bp, Artificial Sequence
  Description of Artificial Sequence: Synthetic coding sequence
atggacttcagccggctgcacatgtacagccccccccagtgtgtgcctgaaaatacaggctacacctacgccctgagcagcagctacagcagtgatgccctggactttgaaacagagcacaagctggaccctgtgtttgacagccccaggatgagcagaagaagcctgcggctggccaccacagcctgcaccctgggagatggagaggccgtgggcgctgacagcggcaccagcagcgctgtgtccctgaagaacagagctgcctag

SEQ ID NO: 21757 - DNA, 2109 bp, Artificial Sequence; identical to SEQ ID NO: 21750
  Description of Artificial Sequence: Synthetic coding sequence

SEQ ID NO: 21758 - DNA, 525 bp, Artificial Sequence
  Description of Artificial Sequence: Synthetic coding sequence
atggacttcagccggctgcacatgtacagccccccccagtgtgtgcctgaaaatacaggctacacctacgccctgagcagcagctacagcagtgatgccctggactttgaaacagagcacaagctggaccctgtgtttgacagccccaggatgagcagaagaagcctgcggctggccaccacagcctgcaccctgggagatggagaggccgtgggcgctgacagcggcaccagcagcgctgtgtccctgaagaacagagctgcccggaccaccaagcagaggaggagcaccaacaagagcgccttcagcatcaaccacgtgtcccggcaggtgaccagcagcggcgtgagccacggcggcaccgtgtccctgcaggatgctgtgacccggcggccccctgtgctggatgagagctggatccgggagcagaccaccgtggaccacttctggggcctggatgatgatggagacctgaagggcggcaacaaggccgccatccagggcaatggagatgtgggcgcctag

SEQ ID NO: 21759 - DNA, 408 bp, Artificial Sequence
  Description of Artificial Sequence: Synthetic coding sequence
atggacttcagccggctgcacatgtacagccccccccagtgtgtgcctgaaaatacaggctacacctacgccctgagcagcagctacagcagtgatgccctggactttgaaacagagcacaagctggaccctgtgtttgacagccccaggatgagcagaagaagcctgcggctggccaccacagcctgcaccctgggagatggagaggccgtgggcgctgacagcggcaccagcagcgctgtgtccctgaagaacagagctgcccggaccaccaagcagaggaggagcaccaacaagagcgccttcagcatcaaccacgtgtcccggcaggtgaccagcagcggcgtgagccacggcggcaccgtgtccctgcaggatgctgtgacccggcggccccctgtgctgtag

SEQ ID NO: 21760 - DNA, 267 bp, Artificial Sequence; identical to SEQ ID NO: 21756
  Description of Artificial Sequence: Synthetic coding sequence

SEQ ID NO: 21761 - DNA, 2049 bp, Artificial Sequence
  Description of Artificial Sequence: Synthetic coding sequence
atggacttcagccggctgcacatgtacagccccccccagtgtgtgcctgaaaatacaggctacacctacgccctgagcagcagctacagcagtgatgccctggactttgaaacagagcacaagctggaccctgtgtttgacagccccaggatgagcagaagaagcctgcggctggccaccacagcctgcaccctgggagatggagaggccgtgggcgctgacagcggcaccagcagcgctgtgtccctgaagaacagagctgcccggaccaccaagcagaggaggagcaccaacaagagcgccttcagcatcaaccacgtgtcccggcaggtgaccagcagcggcgtgagccacggcggcaccgtgtccctgcaggatgctgtgacccggcggccccctgtgctggatgagagctggatccgggagcagaccaccgtggaccacttctggggcaaggccgccagcggggtcttctggtggctgggcatcggctggtaccagtttgtgaccctcatctcctggctgaatgtgttcctgctgacccgctgcctgaggaacatctgcaagttcctggtgctgctgatccccctcttcctgctgctgggcctgagcctgcggggccagggcaacttcttctccttcctgcctgtgctgaactgggcctccatgcacaggacccagagggtggatgacccccaggatgtgttcaagcccaccaccagccggctgaagcagcccctgcagggcgacagcgaggccttcccctggcactggatgtctggagtggagcagcaggtggccagcctgagcggccagtgccaccaccacggggagaacctgcgggagctgaccaccctgctgcagaagctgcaggcccgggtggaccagatggagggcggggccgccggccccagcgcctctgtgagagatgctgtgggccagcccccccgggagacagacttcatggccttccaccaggagcacgaggtgaggatgagccacctggaggacatcctgggcaagctgcgggagaagtctgaggccatccagaaggagctggagcagaccaagcagaagaccatctctgctgtgggggagcagctgctgcccaccgtggagcacctgcagctggagctggaccagctgaagtctgagctgagctcctggaggcatgtgaagacaggctgtgagaccgtggatgctgtgcaggagcgggtggatgtgcaggtgcgggagatggtgaagctgctcttcagcgaggaccagcagggcggcagcctggagcagctgctgcagcgcttcagcagccagtttgtgtccaaaggagacctgcagaccatgctgcgggacctgcagctgcagatcctgagaaatgtgacccaccacgtgtctgtgaccaagcagctgcccaccagcgaggccgtggtgtctgctgtgtctgaggccggggccagcggcatcacagaggcccaggcccgggccatcgtgaacagcgccctgaagctgtacagccaggacaagacaggcatggtggactttgccctggagagcggcggcggcagcatcctgagcacccgctgcagcgagacctatgagaccaagacagccctgatgagcctgtttggcatccccctgtggtacttcagccagagcccccgggtggtgatccagcctgacatctacccaggcaactgctgggccttcaagggcagccagggctacctggtggtgcggctgtccatgatgatccaccctgctgccttcaccctggagcacatccccaagaccctgagccccaccggcaacatcagcagcgcccccaaggactttgctgtgtatggcctggagaatgagtaccaggaggagggccagctgctgggccagttcacctatgaccaggatggagagagcctgcagatgttccaggccctgaagaggccagatgacacagccttccagatcgtggagctgcgcatcttcagcaactggggccaccctgagtacacctgcctgtaccgcttccgggtgcatggagagcctgtgaagtag

SEQ ID NO: 21762 - DNA, 2925 bp, Artificial Sequence
  Description of Artificial Sequence: Synthetic coding sequence
atgggagatgtgaggaaggccaaggaggccctggccgaggtgcagatccccccaccagatgctggccccagcccccgctgcaagcccccacctgctgagcggctgctgggccctggaagaagaagaagaggcctgcggcggcggcgggaggccgtgtggtttgaggtggtgaacatggacttcagccggctgcacatgtacagccccccccagtgtgtgcctgaaaatacaggctacacctacgccctgagcagcagctacagcagtgatgccctggactttgaaacagagcacaagctggaccctgtgtttgacagccccaggatgagcagaagaagcctgcggctggccaccacagcctgcaccctgggagatggagaggccgtgggcgctgacagcggcaccagcagcgctgtgtccctgaagaacagagctgcccggaccaccaagcagaggaggagcaccaacaagagcgccttcagcatcaaccacgtgtcccggcaggtgaccagcagcggcgtgagccacggcggcaccgtgtccctgcaggatgctgtgacccggcggccccctgtgctggatgagagctggatccgggagcagaccaccgtggaccacttctggggcctggatgatgatggagacctgaagggcggcaacaaggccgccatccagggcaatggagatgtgggcgctgctgctgccacagcccacaacggcttcagctgcagcaactgcagcatgctgtctgagaggaaggatgtgctgacagcccaccctgctgcccctggccctgtgtcccgggtgtacagccgggacaggaaccagaagtgtggggccagcttctacgtgaaccgcatcctgtggctggcccgctacacagccagcagcttcagcagcttcctggtgcagctgttccaggtggtgctgatgaagctgtcctatgaaagtgagaactacaagctgaagacccatgagagcaaggactgtgagagcgagagctacaagagcaagagccatgagagcaaggcccacgccagctactacggccgcatgaatgtgcgggaggtgctgcgggaggatggccacctgtctgtgaatggagaggccctgtgtgatgactgcaagggcaagaggcacctggatgcccacacagctgcccacagccagagcccccggctgcccggccgggccggcaccctgtggcacatctgggcctgtgccggctacttcctgctgcagatcctgcggagaattggagctgtgggccaggccgtgtccaggacagcctggagcgccctgtggctggccgtggtggcccctgggaaggccgccagcggggtcttctggtggctgggcatcggctggtaccagtttgtgaccctcatctcctggctgaatgtgttcctgctgacccgctgcctgaggaacatctgcaagttcctggtgctgctgatccccctcttcctgctgctggccggcctgagcctgcggggccagggcaacttcttctccttcctgcctgtgctgaactgggcctccatgcacaggacccagagggtggatgacccccaggatgtgttcaagcccaccaccagccggctgaagcagcccctgcagggcgacagcgaggccttcccctggcactggatgtctggagtggagcagcaggtggccagcctgagcggccagtgccaccaccacggggagaacctgcgggagctgaccaccctgctgcagaagctgcaggcccgggtggaccagatggagggcggggccgccggccccagcgcctctgtgagagatgctgtgggccagcccccccgggagacagacttcatggccttccaccaggagcacgaggtgaggatgagccacctggaggacatcctgggcaagctgcgggagaagtctgaggccatccagaaggagctggagcagaccaagcagaagaccatctctgctgtgggggagcagctgctgcccaccgtggagcacctgcagctggagctggaccagctgaagtctgagctgagctcctggaggcatgtgaagacaggctgtgagaccgtggatgctgtgcaggagcgggtggatgtgcaggtgcgggagatggtgaagctgctcttcagcgaggaccagcagggcggcagcctggagcagctgctgcagcgcttcagcagccagtttgtgtccaaaggagacctgcagaccatgctgcgggacctgcagctgcagatcctgagaaatgtgacccaccacgtgtctgtgaccaagcagctgcccaccagcgaggccgtggtgtctgctgtgtctgaggccggggccagcggcatcacagaggcccaggcccgggccatcgtgaacagcgccctgaagctgtacagccaggacaagacaggcatggtggactttgccctggagagcggcggcggcagcatcctgagcacccgctgcagcgagacctatgagaccaagacagccctgatgagcctgtttggcatccccctgtggtacttcagccagagcccccgggtggtgatccagcctgacatctacccaggcaactgctgggccttcaagggcagccagggctacctggtggtgcggctgtccatgatgatccaccctgctgccttcaccctggagcacatccccaagaccctgagccccaccggcaacatcagcagcgcccccaaggactttgctgtgtatggcctggagaatgagtaccaggaggagggccagctgctgggccagttcacctatgaccaggatggagagagcctgcagatgttccaggccctgaagaggccagatgacacagccttccagatcgtggagctgcgcatcttcagcaactggggccaccctgagtacacctgcctgtaccgcttccgggtgcatggagagcctgtgaagtag

SEQ ID NO: 21763 - DNA, 837 bp, Artificial Sequence
  Description of Artificial Sequence: Synthetic coding sequence
atgggccgcatcagccctggcagccctggcctgcccaggacagtgtggtttgaggtggtgaacatggacttcagccggctgcacatgtacagccccccccagtgtgtgcctgagaacacaggctacacctacgccctgagcagcagctacagcagtgatgccctggactttgaaacagagcacaagctggaccctgtgtttgacagccccaggatgagccgccgcagcctgcggctggccaccacagcctgcaccctgggagatggagaggccgtgggcgctgacagcggcaccagcagcgctgtgtccctgaagaacagagctgcccggaccaccaagcagaggaggagcaccaacaagagcgccttcagcatcaaccacgtgtcccggcaggtgaccagcagtggagtgtcccatggaggcaccgtgtccctgcaggatgctgtgaccaggaggcctcctgtgctggatgagagctggatccgggagcagaccaccgtggaccacttctggggcctggatgatgatggagacctgaagggcggcaacaaggccgccatccagggcaatggagatgtgggcgctgctgctgccacagcccacaacggcttcagctgcagcaactgcagcatgctgtctgagaggaaggatgtgctgacagcccaccctgctgcccctggccctgtgtcccgggtgtacagccgggacaggaaccagaagtgcaagagccagagcttcaagacccagaagaaggtgtgcttccccaacctgatcttccccttctgcaagagccagtgcctgcactacctgtcctggaggctgaagatcatcccctag

SEQ ID NO: 21764 - DNA, 360 bp, Artificial Sequence
  Description of Artificial Sequence: Synthetic coding sequence
atggacttcagccggctgcacatgtacagccccccccagtgtgtgcctgaaaatacaggctacacctacgccctgagcagcagctacagcagtgatgccctggactttgaaacagagcacaagctggaccctgtgtttgacagccccaggatgagcagaagaagcctgcggctggccaccacagcctgcaccctgggagatggagaggccgtgggcgctgacagcggcaccagcagcgctgtgtccctgaagaacagagctgcccggaccaccaagcagaggaggagcaccaacaagagcgccttcagcatcaaccacgtgtcccggcaggtgaccagcagcggcgtgagccacggctag

SEQ ID NO: 21765 - DNA, 2352 bp, Artificial Sequence
  Description of Artificial Sequence: Synthetic coding sequence
atggtgatcatgtctgagttctctgctgaccctgctggccagggccagggccagcagaagcccctgcgggtgggcttctatgacattgaaagaaccctgggcaaaggaaactttgctgtggtgaagctggcccggcaccgggtgaccaagacccaggtggccatcaagatcatcgacaagacccggctggacagcagcaacctggagaagatctaccgggaggtgcagctgatgaagctgctgaaccacccccacatcatcaagctgtaccaggtgatggagaccaaggacatgctgtacatcgtgacagaatttgccaagaatggagagatgtttgactacctgaccagcaatggccacctgtctgaaaatgaggccaggaagaagttctggcagatcctgtctgctgtggagtactgccacgaccaccacatcgtgcaccgggacctgaagacagagaacctgctgctggatggcaacatggacatcaagctggccgactttggcttcggcaacttctacaagagcggggagcccctgagcacctggtgtggcagccccccctatgctgcccctgaggtgtttgagggcaaggagtatgagggcccccagctggacatctggagcctgggcgtggtgctgtatgtgctggtgtgtggcagcctgccctttgatggccccaacctgcccaccctgcggcagagggtgctggagggccgcttccgcatccccttcttcatgagccaggactgtgagagcctcatccggaggatgctggtggtggaccctgcccggcgcatcaccatcgcccagatccggcagcaccgctggatgagagctgagccctgcctgcccggccctgcctgcccagccttcagcgcccacagctacaccagcaacctgggggactatgatgagcaggccctgggcatcatgcagaccctgggcgtggaccggcagaggacagtggagagcctgcagaacagcagctacaaccactttgctgccatctactacctgctgctggagcggctgaaggagtacagaaatgcccagtgtgcccggcccggccctgcccggcagccccggcccaggagcagtgacctgagcggcctggaggtgccccaggagggcctgagcacagaccccttccggcctgccctgctgtgcccccagccccagaccctggtgcagagcgtgctgcaggccgagatggactgtgagctgcagagcagcctgcagtggcccctcttcttccctgtggatgccagctgcagcggggtcttccggcccaggcctgtgagccccagcagcctgctggacacagccatcagcgaggaggcccggcagggccctggcctggaggaggagcaggacacccaggagagcctgcccagcagcacaggccgccgccacaccctggccgaggtgtccacccggctgagccccctgacagccccctgcatcgtggtgagccccagcaccacagccagccctgctgagggcaccagcagtgacagctgcctgaccttcagcgccagcaagagccctgctggcctgagcggcaccccagccacccagggcctgctgggcgcctgcagccctgtgcggctggccagccccttcctgggcagccagagcgccacccctgtgctgcaggcccagggcggcctgggcggcgctgtgctgctgcctgtgtccttccaggagggccggcgggccagtgacaccagcctgacccagggcctgaaggccttccggcagcagctgaggaagaccaccaggaccaagggcttcctgggcctgaacaagatcaagggcctggcccggcaggtgtgccaggccccagccagccgggccagcagaggaggcctgagccccttccacgccccagcccagagccctggcctgcacggcggggccgccggcagccgggagggctggagcctgctggaggaggtgctggagcagcagaggctgctgcagctgcagcaccaccctgctgctgcccctggctgcagccaggccccccagcctgccccagcccccttcgtcatcgccccctgtgatggccctggggccgcccccctgcccagcaccctgctgaccagcggcctgcccctgctgcccccacccctgctgcagacaggagccagccctgtggccagcgctgcccagctgctggacacccacctgcacatcggcaccggccccacagccctgcctgctgtgcccccaccccggctggcccggctggcccctggctgtgagcccctgggcctgctgcagggcgactgtgagatggaggacctgatgccctgcagcctgggcacctttgtgctggtgcagtag

SEQ ID NO: 21766 - DNA, 3744 bp, Artificial Sequence
  Description of Artificial Sequence: Synthetic coding sequence
atggaggatgctggagctgctggccctggccctgagcctgagcctgagcctgagcctgagcctgagcccgcccctgagcctgagcctgagcccaagccaggagctggcaccagcgaggccttcagccggctgtggacagatgtgatgggcatcctggatggcagcctgggcaacattgatgacctggcccagcagtatgctgactactacaacacctgcttcagtgatgtgtgtgagaggatggaggagctgaggaagagaagagtgtcccaggacctggaggtggagaagccagatgccagccccaccagcctgcagctgcggagccagatcgaggagagcctgggcttctgcagcgctgtgtccaccccagaggtggagaggaagaaccccctgcacaagagcaacagcgaggacagctctgtgggcaagggggactggaagaagaagaacaagtacttctggcagaacttcaggaagaaccagaagggcatcatgaggcagaccagcaaaggagaagatgtgggctacgtggccagcgagatcaccatgtctgatgaggagcgcatccagctgatgatgatggtgaaggagaagatgatcaccatcgaggaggccctggcccggctgaaggagtatgaggcccagcaccggcagagcgctgccctggaccctgctgactggccagatggcagctaccccacctttgatggcagcagcaactgcaacagccgggagcagagtgatgatgaaacagaggagagcgtgaagttcaagaggctgcacaagctggtgaacagcaccaggagagtgaggaagaagctgatccgggtggaggagatgaagaagcccagcacagagggcggggaggagcacgtgtttgagaacagccctgtgctggatgagaggtctgccctgtacagcggcgtgcacaagaagcccctcttctttgatggcagccctgagaagcccccagaagatgacagcgacagcctgaccaccagccccagcagcagcagcctggacacctggggcgccggcaggaagctggtgaagaccttcagcaagggggagagccggggcctcatcaagccacccaagaagatgggcaccttcttctcctacccagaggaggagaaggcccagaaggtgagccgcagcctgacagaaggagagatgaagaagggcctgggcagcctgagccacggccgcacctgcagctttggaggctttgacctgaccaacagaagcctgcacgtgggcagcaacaacagcgaccccatgggcaaggagggggactttgtgtacaaggaggtgatcaagagccccacagccagccgcatcagcctgggcaagaaggtgaagtctgtgaaggagaccatgaggaagaggatgagcaagaagtacagcagctctgtgtctgagcaggacagcggcctggatggcatgcctggcagccccccacccagccagcctgaccctgagcacctggacaagcccaagctgaaggccggcggctctgtggagagcctgcggagcagcctgagcggccagagctccatgagcggccagacagtgtccaccacagacagcagcaccagcaaccgggagagcgtgaagtcagaagatggagatgatgaggagcccccctaccggggccccttctgtggccgggcccgggtgcacacagacttcacccccagcccctatgacacagacagcctgaagctgaagaagggggacatcatcgacatcatcagcaagccacccatgggcacctggatgggcctgctgaacaacaaggtgggcaccttcaagttcatctacgtggatgtgctgtctgaagatgaggagaagcccaagaggcccaccaggagaagaaggaagggccggcccccccagcccaagtctgtggaggacctgctggaccgcatcaacctgaaggagcacatgcccaccttcctgttcaacggctatgaggacctggacaccttcaagctgctggaggaggaggacctggatgagctgaacatccgggaccctgagcacagagctgtgctgctgacagctgtggagctgctgcaggagtatgacagcaacagcgaccagagcggcagccaggagaagctgctggtggacagccagggcctgagcggctgcagcccccgggacagcggctgctatgagagcagcgagaacctggagaatggcaagaccaggaaggccagcctgctgagcgccaagagcagcacagagcccagcctgaagagcttcagcaggaaccagctgggcaactaccccaccctgcccctgatgaagtctggagatgccctgaagcagggccaggaggagggccgcctgggcggcggcctggccccagacaccagcaagagctgtgaccccccaggagtgacaggcctgaacaagaacagaagaagcctgcctgtgtccatctgccgcagctgtgagaccctggagggcccccagacagtggacacctggcccaggagccacagcctggatgacctgcaggtggagcctggagctgagcaggatgtgcccacagaggtgacagagcccccaccccagatcgtgcctgaggtgccccagaagaccacagccagcagcaccaaggcccagcccctggagcaggacagcgctgtggacaatgccctgctgctgacccagagcaagcgcttcagcgagccccagaagctgaccaccaagaagctggagggcagcattgctgccagcggccggggcctgagccccccccagtgcctgcccaggaactatgatgcccagcccccaggggccaagcacggcctggcccggacccccctggagggccacaggaaaggacatgaatttgagggcacccaccaccccctgggcaccaaggagggcgtggatgctgagcagaggatgcagcccaagatccccagccagcccccacctgtgcctgccaagaagagccgggagcggctggccaacggcctgcaccctgtgcccatgggccccagcggggccctgcccagcccagatgccccctgcctgcctgtgaagaggggcagccctgccagccccaccagccccagcgactgccccccagccctggccccccggcccctgagcggccaggcccctggcagcccccccagcacccggcccccaccctggctgtctgagctgcctgagaacaccagcctgcaggagcacggcgtgaagctgggccctgccctgaccaggaaggtgtcctgtgcccggggcgtggacctggagaccctgacagagaacaagctgcatgctgagggcatcgacctgacagaggagccctacagcgacaagcacggccgctgtggcatccctgaggccctggtgcagagatatgcagaggacctggaccagcctgagagagatgtggccgccaacatggaccagatccgggtgaagcagctgaggaagcagcacaggatggccatccccagcggcggcctgacagagatctgcaggaagcctgtgtccccaggctgcatcagctctgtgtctgactggctgatcagcatcggcctgcccatgtatgccggcaccctgagcacagctggcttcagcaccctgagccaggtgcccagcctgagccacacctgcctgcaggaggccggcatcacagaggagcggcacatcaggaagctgctgtctgctgcccggctcttcaagctgcccccaggccctgaggccatgtag

SEQ ID NO: 21767 - DNA, 255 bp, Artificial Sequence
  Description of Artificial Sequence: Synthetic coding sequence
atggaggagcaggactgcagagatggcagcctgggcaacattgatgacctggcccagcagtatgctgactactacaacacctgcttcagtgatgtgtgtgagaggatggaggagctgaggaagagaagagtgtcccaggacctggaggtggagaagccagatgccagccccaccagcctgcagctgcggagccagatcgaggagagcctgggcttctgcagcgctgtgtccaccccagaggtggagaggaagtag

SEQ ID NO: 21768 - DNA, 249 bp, Artificial Sequence
  Description of Artificial Sequence: Synthetic coding sequence
caggcccaggacttcaaggatggcagcctgggcaacattgatgacctggcccagcagtatgctgactactacaacacctgcttcagtgatgtgtgtgagaggatggaggagctgaggaagagaagagtgtcccaggacctggaggtggagaagccagatgccagccccaccagcctgcagctgcggagccagatcgaggagagcctgggcttctgcagcgctgtgtccaccccagaggtggagaggtag

SEQ ID NO: 21769 - DNA, 2091 bp, Artificial Sequence
  Description of Artificial Sequence: Synthetic coding sequence
atgcccaagcccagccgggagcagagtgatgatgaaacagaggagagcgtgaagttcaagaggctgcacaagctggtgaacagcacccggcgggtgaggaagaagctgatccgggtggaggagatgaagaagcccagcacagaaggaggagaggagcacgtgtttgagaacagccctgtgctggatgagaggtctgccctgtacagcggcgtgcacaagaagcccctcttctttgatggcagccctgagaagcccccagaagatgacagcgacagcctgaccaccagccccagcagcagcagcctggacacctggggcgccggcaggaagctggtgaagaccttcagcaaaggagagagccggggcctcatcaagccacccaagaagatgggcaccttcttctcctacccagaggaggagaaggcccagaaggtgagccgcagcctgacagaaggagagatgaagaagggcctgggcagcctgagccacggccgcacctgcagctttggaggctttgacctgaccaacagaagcctgcacgtgggcagcaacaacagcgaccccatgggcaaggagggggactttgtgtacaaggaggtgatcaagagccccacagccagccgcatcagcctgggcaagaaggtgaagtctgtgaaggagaccatgaggaagaggatgagcaagaagtacagcagctctgtgtctgagcaggacagcggcctggatggcatgcctggcagccccccacccagccagcctgaccctgagcacctggacaagcccaagctgaaggccggcggctctgtggagagcctgcggagcagcctgagcggccagagctccatgagcggccagacagtgtccaccacagacagcagcaccagcaaccgggagagcgtgaagtcagaagatggagatgatgaggagcccccctaccggggccccttctgtggccgggcccgggtgcacacagacttcacccccagcccctatgacacagacagcctgaagctgaagaagggggacatcatcgacatcatcagcaagccacccatgggcacctggatgggcctgctgaacaacaaggtgggcaccttcaagttcatctacgtggatgtgctgtctgaagatgaggagaagcccaagaggcccaccaggagaagaaggaagggccggcccccccagcccaagtctgtggaggacctgctggaccgcatcaacctgaaggagcacatgcccaccttcctgttcaacggctatgaggacctggacaccttcaagctgctggaggaggaggacctggatgagctgaacatccgggaccctgagcacagagctgtgctgctgacagctgtggagctgctgcaggagtatgacagcaacagcgaccagagcggcagccaggagaagctgctggtggacagccagggcctgagcggctgcagcccccgggacagcggctgctatgagagcagcgagaacctggagaatggcaagaccaggaaggccagcctgctgagcgccaagagcagcacagagcccagcctgaagagcttcagcaggaaccagctgggcaactaccccaccctgcccctgatgaagtctggagatgccctgaagcagggccaggaggagggccgcctgggcggcggcctggccccagacaccagcaagagctgtgaccccccaggagtgacaggcctgaacaagaacagaagaagcctgcctgtgtccatctgccgcagctgtgagaccctggagggcccccagacagtggacacctggcccaggagccacagcctggatgacctgcaggtggagcccggggctgagcaggatgtgcccacagaggtgacagagcccccaccccagatcgtgcctgaggtgccccagaagaccacagccagcagcaccaaggcccagcccctggagcaggacagcgctgtggacaatgccctgctgctgacccagagcaagcgcttcagcgagccccagaagctgaccaccaagaagctggagggcagcattgctgccagcggccggggcctgagccccccccagtgcctgcccagaaattatgatgcccagtag

SEQ ID NO: 21770 - DNA, 1974 bp, Artificial Sequence
  Description of Artificial Sequence: Synthetic coding sequence
atgggcacctggatgggcctgctgaacaacaaggtgggcaccttcaagttcatctacgtggatgtgctgtctgaagatgaggagaagcccaagaggcccaccaggagaagaaggaagggccggcccccccagcccaagtctgtggaggacctgctggaccgcatcaacctgaaggagcacatgcccaccttcctgttcaacggctatgaggacctggacaccttcaagctgctggaggaggaggacctggatgagctgaacatccgggaccctgagcacagagctgtgctgctgacagctgtggagctgctgcaggagtatgacagcaacagcgaccagagcggcagccaggagaagctgctggtggacagccagggcctgagcggctgcagcccccgggacagcggctgctatgagagcagcgagaacctggagaatggcaagaccaggaaggccagcctgctgagcgccaagagcagcacagagcccagcctgaagagcttcagcaggaaccagctgggcaactaccccaccctgcccctgatgaagtctggagatgccctgaagcagggccaggaggagggccgcctgggcggcggcctggccccagacaccagcaagagctgtgaccccccaggagtgacaggcctgaacaagaacagaagaagcctgcctgtgtccatctgccgcagctgtgagaccctggagggcccccagacagtggacacctggcccaggagccacagcctggatgacctgcaggtggagcctggagctgagcaggatgtgcccacagaggtgacagagcccccaccccagatcgtgcctgaggtgccccagaagaccacagccagcagcaccaaggcccagcccctggagcaggacagcgctgtggacaatgccctgctgctgacccagagcaagcgcttcagcgagccccagaagctgaccaccaagaagctggagggcagcattgctgccagcggccggggcctgagccccccccagtgcctgcccaggaactatgatgcccagcccccaggggccaagcacggcctggcccggacccccctggagggccacaggaaaggacatgaatttgagggcacccaccaccccctgggcaccaaggagggcgtggatgctgagcagaggatgcagcccaagatccccagccagcccccacctgtgcctgccaagaagagccgggagcggctggccaacggcctgcaccctgtgcccatgggccccagcggggccctgcccagcccagatgccccctgcctgcctgtgaagaggggcagccctgccagccccaccagccccagcgactgccccccagccctggccccccggcccctgagcggccaggcccctggcagcccccccagcacccggcccccaccctggctgtctgagctgcctgagaacaccagcctgcaggagcacggcgtgaagctgggccctgccctgaccaggaaggtgtcctgtgcccggggcgtggacctggagaccctgacagagaacaagctgcatgctgagggcatcgacctgacagaggagccctacagcgacaagcacggccgctgtggcatccctgaggccctggtgcagagatatgcagaggacctggaccagcctgagagagatgtggccgccaacatggaccagatccgggtgaagcagctgaggaagcagcacaggatggccatccccagcggcggcctgacagagatctgcaggaagcctgtgtccccaggctgcatcagctctgtgtctgactggctgatcagcatcggcctgcccatgtatgccggcaccctgagcacagctggcttcagcaccctgagccaggtgcccagcctgagccacacctgcctgcaggaggccggcatcacagaggagcggcacatcaggaagctgctgtctgctgcccggctcttcaagctgcccccaggccctgaggccatgtag

SEQ ID NO: 21771 - DNA, 621 bp, Artificial Sequence
  Description of Artificial Sequence: Synthetic coding sequence
atgctgcccccagccatccacttctacctgctgcccctggcctgcatcctgatgaagagctgcctggccttcaagaatgatgccacagagatcctgtacagccacgtggtgaagcctgtgcctgcccaccccagcagcaacagcaccctgaaccaggccagaaatggaggccgccacttcagcaacacaggcctggacaggaacaccagggtgcaggtgggctgccgggagctgcggagcaccaagtacatcagtgatggccagtgcaccagcatcagccccctgaaggagctggtgtgtgctggagaatgtctgcccctgcctgtgctgcccaactggattggaggcggctacggcaccaagtactggagcagaagaagcagccaggagtggaggtgtgtgaatgacaagaccaggacccagaggatccagctgcagtgccaggacggcagcaccaggacctacaagatcaccgtggtgacagcctgcaagtgcaagcgctacacccggcagcacaatgaaagcagccacaactttgagagcatgagccctgccaagcctgtgcagcaccaccgggagaggaagagggccagcaagagcagcaagcacagcatgtcctag

SEQ ID NO: 21772 - DNA, 693 bp, Artificial Sequence
  Description of Artificial Sequence: Synthetic coding sequence
atgctgcccccagccatccacttctacctgctgcccctggcctgcatcctgatgaagagctgcctggccttcaagaatgatgccacagagatcctgtacagccacgtggtgaagcctgtgcctgcccaccccagcagcaacagcaccctgaaccaggccagaaatggaggccgccacttcagcaacacaggcctggacaggaacagaacagagagcctgacccggcagaactacttctggctgtttcctggggccttcctgcggcagctgcaggaggcccgggtgcaggtgggctgccgggagctgcggagcaccaagtacatcagtgatggccagtgcaccagcatcagccccctgaaggagctggtgtgtgctggagaatgtctgcccctgcctgtgctgcccaactggattggaggcggctacggcaccaagtactggagcagaagaagcagccaggagtggaggtgtgtgaatgacaagaccaggacccagaggatccagctgcagtgccaggacggcagcaccaggacctacaagatcaccgtggtgacagcctgcaagtgcaagcgctacacccggcagcacaatgaaagcagccacaactttgagagcatgagccctgccaagcctgtgcagcaccaccgggagaggaagagggccagcaagagcagcaagcacagcatgtcctag

SEQ ID NO: 21773 - DNA, 2229 bp, Artificial Sequence
  Description of Artificial Sequence: Synthetic coding sequence
atgggcagcgagaacagcgccctgaagagctacaccctgcgggagccccccttcaccctgcccagcggcctggccgtgtacccagctgtgctgcaggacggcaagtttgcctctgtgtttgtgtacaagagagaaaatgaagacaaggtgaacaaggccgccaagcacctgaagaccctgcggcacccctgcctgctgcgcttcctgagctgcaccgtggaggctgatggcatccacctggtgacagagcgggtgcagcccctggaggtggccctggagaccctgagcagcgctgaggtgtgtgccggcatctatgacatcctgctggccctgatcttcctgcatgaccggggccacctgacccacaacaacgtgtgcctgagctctgtgtttgtgtctgaagatggccactggaagctgggcggcatggagaccgtgtgcaaggtgtcccaggccaccccagagttcctgcggagcatccagagcatccgggaccctgccagcatccccccagaggagatgagccctgagttcaccaccctgcctgaatgtcatggccacgccagagatgccttctcctttggcaccctggtggagagcctgctgaccatcctgaatgagcaggtgtctgcagatgtgctgagcagcttccagcagaccctgcacagcaccctgctgaaccccatccccaagtgcaggcctgccctgtgcaccctgctgagccatgacttcttcagaaatgacttcctggaggtggtgaacttcctgaagagcctgaccctgaagtctgaggaggagaagacagagttcttcaagttcctgctggacagagtgtcctgcctgtctgaggagctgattgccagccggctggtgcccctgctgctgaaccagctggtgtttgctgagcctgtggccgtgaagagcttcctgccctacctgctgggccccaagaaggaccacgcccagggcgagaccccctgcctgctgagccctgccctcttccagagcagggtcatccctgtgctgctgcagctgtttgaggtgcatgaggagcacgtgaggatggtgctgctgagccacatcgaggcctacgtggagcacttcacccaggagcagctgaagaaggtgatcctgccccaggtgctgctgggcctgcgggacaccagtgacagcatcgtggccatcaccctgcacagcctggccgtgctggtgtccctgctgggccctgaggtggtggtgggcggggagaggaccaagatcttcaagaggacagcccccagcttcaccaagaacacagacctgagcctggaggacagccccatgtgtgtggtgtgcagccaccacagccagatcagccccatcctggagaaccccttcagcagcatcttccccaagtgcttcttcagcggcagcacccccatcaacagcaagaagcacatccagagggactactacaacaccctgctgcagacaggagaccccttcagccagcccatcaagttccccatcaatggcctgagtgatgtgaagaacaccagcgaggacagcgagaacttccccagcagcagcaagaagtctgaggagtggccagactggagcgagcctgaggagcctgagaaccagacagtgaacatccagatctggccccgggagccctgtgatgatgtgaagagccagtgcaccaccctggatgtggaggagagctcctgggatgactgtgagcccagcagcctggacaccaaggtgaaccctgggggcggcatcacagccaccaagcctgtgaccagcggggagcagaagcccatcccagccctgctgagcctgacagaggagagcatgccctggaagagcagcctgccccagaagatcagcctggtgcagagaggagatgatgctgaccagatcgagccccccaaggtgagcagccaggagcggcccctgaaggtgcccagcgagctgggcctgggggaggagttcaccatccaggtgaagaagaagcctgtgaaggaccctgagatggactggtttgctgacatgatccctgagatcaagcccagcgctgccttcctgatcctgcctgagctgaggacagagatggtgcccaagaaggatgatgtgtcccctgtgatgcagttcagcagcaagtttgctgctgctgagatcacagaaggagaggccgagggctgggaggaggagggggagctgaactgggaggacaacaactggtag

SEQ ID NO: 21774 - DNA, 2067 bp, Artificial Sequence
  Description of Artificial Sequence: Synthetic coding sequence
atgggcagcgagaacagcgccctgaagagctacaccctgcgggagccccccttcaccctgcccagcggcctggccgtgtacccagctgtgctgcaggacggcaagtttgcctctgtgtttgtgtacaagagagaaaatgaagacaaggtgaacaaggccgccaagcacctgaagaccctgcggcacccctgcctgctgcgcttcctgagctgcaccgtggaggctgatggcatccacctggtgacagagcgggtgcagcccctggaggtggccctggagaccctgagcagcgctgaggtgtgtgccggcatctatgacatcctgctggccctgatcttcctgcatgaccggggccacctgacccacaacaacgtgtgcctgagctctgtgtttgtgtctgaagatggccactggaagctgggcggcatggagaccgtgtgcaaggtgtcccaggccaccccagagttcctgcggagcatccagagcatccgggaccctgccagcatccccccagaggagatgagccctgagttcaccaccctgcctgaatgtcatggccacgccagagatgccttctcctttggcaccctggtggagagcctgctgaccatcctgaatgagcaggtgtctgcagatgtgctgagcagcttccagcagaccctgcacagcaccctgctgaaccccatccccaagtgcaggcctgccctgtgcaccctgctgagccatgacttcttcagaaatgacttcctggaggtggtgaacttcctgaagagcctgaccctgaagtctgaggaggagaagacagagttcttcaagttcctgctggacagagtgtcctgcctgtctgaggagctgattgccagccggctggtgcccctgctgctgaaccagctggtgtttgctgagcctgtggccgtgaagagcttcctgccctacctgctgggccccaagaaggaccacgcccagggcgagaccccctgcctgctgagccctgccctcttccagagcagggtcatccctgtgctgctgcagctgtttgaggtgcatgaggagcacgtgaggatggtgctgctgagccacatcgaggcctacgtggagcacttcacccaggagcagctgaagaaggtgatcctgccccaggtgctgctgggcctgcgggacaccagtgacagcatcgtggccatcaccctgcacagcctggccgtgctggtgtccctgctgggccctgaggtggtggtgggcggggagaggaccaagatcttcaagaggacagcccccagcttcaccaagaacacagacctgagcctggagggggaccccttcagccagcccatcaagttccccatcaatggcctgagtgatgtgaagaacaccagcgaggacagcgagaacttccccagcagcagcaagaagtctgaggagtggccagactggagcgagcctgaggagcctgagaaccagacagtgaacatccagatctggccccgggagccctgtgatgatgtgaagagccagtgcaccaccctggatgtggaggagagctcctgggatgactgtgagcccagcagcctggacaccaaggtgaaccctgggggcggcatcacagccaccaagcctgtgaccagcggggagcagaagcccatcccagccctgctgagcctgacagaggagagcatgccctggaagagcagcctgccccagaagatcagcctggtgcagagaggagatgatgctgaccagatcgagccccccaaggtgagcagccaggagcggcccctgaaggtgcccagcgagctgggcctgggggaggagttcaccatccaggtgaagaagaagcctgtgaaggaccctgagatggactggtttgctgacatgatccctgagatcaagcccagcgctgccttcctgatcctgcctgagctgaggacagagatggtgcccaagaaggatgatgtgtcccctgtgatgcagttcagcagcaagtttgctgctgctgagatcacagaaggagaggccgagggctgggaggaggagggggagctgaactgggaggacaacaactggtag

SEQ ID NO: 21775 - DNA, 2229 bp, Artificial Sequence; identical to SEQ ID NO: 21773
  Description of Artificial Sequence: Synthetic coding sequence

SEQ ID NO: 21776 - DNA, 1767 bp, Artificial Sequence
  Description of Artificial Sequence: Synthetic coding sequence
atgggcagcgagaacagcgccctgaagagctacaccctgcgggagccccccttcaccctgcccagcggcctggccgtgtacccagctgtgctgcaggacggcaagtttgcctctgtgtttgtgtacaagagagaaaatgaagacaaggtgaacaaggccgccaagcacctgaagaccctgcggcacccctgcctgctgcgcttcctgagctgcaccgtggaggctgatggcatccacctggtgacagagcgggtgcagcccctggaggtggccctggagaccctgagcagcgctgaggtgtgtgccggcatctatgacatcctgctggccctgatcttcctgcatgaccggggccacctgacccacaacaacgtgtgcctgagctctgtgtttgtgtctgaagatggccactggaagctgggcggcatggagaccgtgtgcaaggtgtcccaggccaccccagagttcctgcggagcatccagagcatccgggaccctgccagcatccccccagaggagatgagccctgagttcaccaccctgcctgaatgtcatggccacgccagagatgccttctcctttggcaccctggtggagagcctgctgaccatcctgaatgagcaggtgtctgcagatgtgctgagcagcttccagcagaccctgcacagcaccctgctgaaccccatccccaagtgcaggcctgccctgtgcaccctgctgagccatgacttcttcagaaatgacttcctggaggtggtgaacttcctgaagagcctgaccctgaagtctgaggaggagaagacagagttcttcaagttcctgctggacagagtgtcctgcctgtctgaggagctgattgccagccggctggtgcccctgctgctgaaccagctggtgtttgctgagcctgtggccgtgaagagcttcctgccctacctgctgggccccaagaaggaccacgcccagggcgagaccccctgcctgctgagccctgccctcttccagagcagggtcatccctgtgctgctgcagctgtttgaggtgcatgaggagcacgtgaggatggtgctgctgagccacatcgaggcctacgtggagcacttcacccaggagcagctgaagaaggtgatcctgccccaggtgctgctgggcctgcgggacaccagtgacagcatcgtggccatcaccctgcacagcctggccgtgctggtgtccctgctgggccctgaggtggtggtgggcggggagaggaccaagatcttcaagaggacagcccccagcttcaccaagaacacagacctgagcctggagggggaccccttcagccagcccatcaagttccccatcaatggcctgagtgatgtgaagaacaccagcgaggacagcgagaacttccccagcagcagcaagaagtctgaggagtggccagactggagcgagcctgaggagcctgagaaccagacagtgaacatccagatctggccccgggagccctgtgatgatgtgaagagccagtgcaccaccctggatgtggaggagagctcctgggatgactgtgagcccagcagcctggacaccaaggtgaaccctgggggcggcatcacagccaccaagcctgtgaccagcggggagcagaagcccatcccagccctgctgagcctgacagaggagagcatgccctggaagagcagcctgccccagaagatcagcctggtgcagagaggagatgatgctgaccagatcgagccccccaaggtgagcagctag

SEQ ID NO: 21777 - DNA, 1008 bp, Artificial Sequence
  Description of Artificial Sequence: Synthetic coding sequence
atgaagctgcctgcccgggtcttcttcaccctgggcagccggctgccctgtggcctggccccccggcgcttcttctcctatggcaccaagatcctgtaccagaacacagaggccctgcagagcaagttcttcagccccctgcagaaggccatgctgccccccaacagcttccagggcaaggtggccttcatcactggaggcggcaccggcctgggcaagggcatgaccaccctgctgagcagcctgggcgcccagtgtgtgattgccagcaggaagatggatgtgctgaaggccacagctgagcagatcagcagccagacaggcaacaaggtgcacgccatccagtgtgatgtgcgggaccctgacatggtgcagaacacagtgtctgagctgatcaaggtggccggccaccccaacatcgtcatcaacaatgctgctggcaacttcatcagccccacagagcggctgagccccaatgcctggaagaccatcacagacatcgtgctgaatggaacagcctttgtgaccctggagatcggcaagcagctgatcaaggcccagaagggggccgccttcctgagcatcaccaccatctatgcagagaccggcagcggctttgtggtgcccagcgccagcgccaaggccggcgtggaggccatgagcaagagcctggccgctgagtggggcaagtatggcatgaggttcaacgtcatccagcccggccccatcaagaccaagggggccttcagccggctggaccccaccggcacctttgagaaggagatgattggccgcatcccctgtggccgcctgggcaccgtggaggagctggccaacctggccgccttcctgtgcagcgactatgcctcctggatcaatggagctgtgatcaagtttgatggaggagaggaggtgctgatcagcggggagttcaatgacctgaggaaggtgaccaaggagcagtgggacaccatcgaggagctgatcaggaagaccaagggcagctag

SEQ ID NO: 21778 - DNA, 945 bp, Artificial Sequence
  Description of Artificial Sequence: Synthetic coding sequence
atgggcatcggccgctctgagggcggcagaagaggagctgccctgggcgtgctgctggccctgggcgccgccctgctggccgtgggcagcgcctctgaatatgactatgtgtccttccagagcgacatcggcccctaccagagcggccgcttctacaccaagccaccccagtgtgtggacatcccagctgacctgcggctgtgccacaacgtgggctacaagaagatggtgctgcccaacctgctggagcacgagaccatggccgaggtgaagcagcaggccagctcctgggtgcccctgctgaacaagaactgccacgccggcacccaggtgttcctgtgcagcctgtttgcccctgtgtgcctggaccggcccatctacccctgccgctggctgtgtgaggccgtgcgggacagctgtgagcctgtgatgcagttcttcggcttctactggccagagatgctgaagtgtgacaagtttcctgaaggagatgtgtgcatcgccatgaccccaccaaatgccacagaggccagcaagccccagggcaccaccgtgtgccccccctgtgacaatgagctgaagtctgaggccatcatcgagcacctgtgtgccagcgagtttgccctgaggatgaagatcaaggaggtgaagaaggaaaatggagacaagaagatcgtgcccaagaagaagaagcccctgaagctgggccccatcaagaagaaggacctgaagaagctggtgctgtacctgaagaatggagctgactgcccctgccaccagctggacaacctgagccaccacttcctgatcatgggcaggaaggtgaagagccagtacctgctgacagccatccacaagtgggacaagaagaacaaggagttcaagaacttcatgaagaagatgaagaaccatgaatgtcccaccttccagagcgtcttcaagtag

SEQ ID NO: 21779 - DNA, 1041 bp, Artificial Sequence
  Description of Artificial Sequence: Synthetic coding sequence
atgttcctgagcatcctggtggccctgtgcctgtggctgcacctggccctgggcgtgcggggggccccctgtgaggccgtgcgcatccccatgtgccgccacatgccctggaacatcaccaggatgcccaaccacctgcaccacagcacccaggagaatgccatcctggccatcgagcagtatgaggagctggtggatgtgaactgcagcgctgtgctgcgcttcttcctgtgtgccatgtatgcccccatctgcaccctggagttcctgcatgaccccatcaagccctgcaagtctgtgtgccagagggccagagatgactgtgagcccctgatgaagatgtacaaccacagctggccagagagcctggcctgtgatgagctgcctgtgtatgaccggggcgtgtgcatcagccctgaggccatcgtgacagacctgcctgaagatgtgaagtggattgacatcaccccagacatgatggtgcaggagcggcccctggatgtggactgcaagaggctgagcccagaccgctgcaagtgcaagaaggtgaagcccaccctggccacctacctgagcaagaactacagctatgtgatccacgccaagatcaaggctgtgcagaggagcggctgcaatgaggtgaccaccgtggtggatgtgaaggagatcttcaagagcagcagccccatccccaggacccaggtgcccctcatcaccaacagcagctgccagtgcccccacatcctgccccaccaggatgtgctgatcatgtgctatgagtggaggagcaggatgatgctgctggagaactgcctggtggagaagtggagggaccagctgagcaagaggagcatccagtgggaggagcggctgcaggagcagaggagaacagtgcaggacaagaagaagacagctggccgcaccagccgcagcaacccccccaagcccaagggcaagcccccagcccccaagccagccagccccaagaagaacatcaagaccaggtctgcccagaagaggaccaaccccaagagggtgtag

SEQ ID NO: 21780 - DNA, 1032 bp, Artificial Sequence
  Description of Artificial Sequence: Synthetic coding sequence
atgagggtggccggccgggagggccgcttcctgtctgctggggtggccgcccgggagggcagcgccatgttcctgagcatcctggtggccctgtgcctgtggctgcacctggccctgggcgtgcggggggccccctgtgaggccgtgcgcatccccatgtgccgccacatgccctggaacatcaccaggatgcccaaccacctgcaccacagcacccaggagaatgccatgtatgcccccatctgcaccctggagttcctgcatgaccccatcaagccctgcaagtctgtgtgccagagggccagagatgactgtgagcccctgatgaagatgtacaaccacagctggccagagagcctggcctgtgatgagctgcctgtgtatgacagaggagtgtgcatcagccctgaggccatcgtgacagacctgcctgaagatgtgaagtggattgacatcaccccagacatgatggtgcaggagcggcccctggatgtggactgcaagaggctgagcccagaccgctgcaagtgcaagaaggtgaagcccaccctggccacctacctgagcaagaactacagctatgtgattcatgccaagatcaaggctgtgcagaggagcggctgcaatgaggtgaccaccgtggtggatgtgaaggagatcttcaagagcagcagccccatccccaggacccaggtgcccctcatcaccaacagcagctgccagtgcccccacatcctgccccaccaggatgtgctgatcatgtgctatgagtggaggagcaggatgatgctgctggagaactgcctggtggagaagtggagggaccagctgagcaagaggagcatccagtgggaggagcggctgcaggagcagaggagaacagtgcaggacaagaagaagacagctggccgcaccagccgcagcaacccccccaagcccaagggcaagcccccagcccccaagccagccagccccaagaagaacatcaagaccaggtctgcccagaagaggaccaaccccaagagggtgtag

SEQ ID NO: 21781 - DNA, 954 bp, Artificial Sequence
  Description of Artificial Sequence: Synthetic coding sequence
atgagagctgctgctgctgggggcggcgtgaggacagctgccctggccctgctgctgggcgccctgcactgggccccagcccgctgtgaggagtatgactactacggctggcaggccgagcccctgcacggccgcagctacagcaagccaccccagtgcctggacatcccagctgacctgcccctgtgccacacagtgggctacaagaggatgaggctgcccaacctgctggagcacgagagcctggccgaggtgaagcagcaggccagctcctggctgcccctgctggccaagcgctgccacagcgacacccaggtgttcctgtgcagcctgtttgcccctgtgtgcctggaccggcccatctacccctgccgcagcctgtgtgaggccgtgcgggccggctgtgcccccctgatggaggcctacggcttcccctggccagagatgctgcactgccacaagttccccctggacaatgacctgtgcatcgctgtgcagtttggccacctgcctgccacagcccctcctgtgaccaagatctgtgcccagtgtgagatggagcacagcgcagatggcctgatggagcagatgtgcagcagtgactttgtggtgaagatgaggatcaaggagatcaagattgaaaatggagacaggaagctgattggagcccagaagaagaagaagctgctgaagccaggccccctgaagaggaaggacaccaagaggctggtgctgcacatgaagaatggagctggctgcccctgcccccagctggacagcctggccggcagcttcctggtgatgggcaggaaggtggatggccagctgctgctgatggctgtgtaccgctgggacaagaagaacaaggagatgaagtttgctgtgaagttcatgttctcctacccctgcagcctgtactaccccttcttctatggagctgctgagccccactag

SEQ ID NO: 21782 - DNA, 903 bp, Artificial Sequence
  Description of Artificial Sequence: Synthetic coding sequence
atgagaattgctgtgatctgcttctgcctgctgggcatcacctgtgccatccctgtgaagcaggccgacagcggcagcagcgaggagaagcagctgtacaacaagtacccagatgctgtggccacctggctgaacccagaccccagccagaagcagaacctgctggccccccagaccctgcccagcaagagcaatgaaagccatgaccacatggatgacatggatgatgaagatgatgatgaccacgtggacagccaggacagcattgacagcaatgacagtgatgatgtggatgacacagatgacagccaccagagtgatgagagccaccacagtgatgaaagtgatgagctggtgacagacttccccacagacctgcctgccacagaggtgttcacccctgtggtgcccaccgtggacacctatgatggccgcggggacagcgtggtgtatggcctgcggagcaagagcaagaagttcagaagaccagacatccagtacccagatgccacagatgaggacatcaccagccacatggagagcgaggagctgaatggagcctacaaggccatccctgtggcccaggacctgaatgcccccagcgactgggacagccggggcaaggacagctatgagaccagccagctggatgaccagagcgctgagacccacagccacaagcagagccggctgtacaagaggaaggccaatgatgagagcaatgagcacagtgatgtgattgacagccaggagctgagcaaggtgtcccgggagttccacagccatgagttccacagccatgaggacatgctggtggtggaccccaagagcaaggaggaggacaagcacctgaagttccgcatcagccatgagctggacagcgccagcagcgaggtgaactag

SEQ ID NO: 21783 - DNA, 879 bp, Artificial Sequence
  Description of Artificial Sequence: Synthetic coding sequence
atgagaattgctgtgatctgcttctgcctgctgggcatcacctgtgccatccctgtgaagcaggccgacagcggcagcagcgaggagaagcagctgtacaacaagtacccagatgctgtggccacctggctgaacccagaccccagccagaagcagaacctgctggccccccagaatgctgtgtcctctgaggagaccaatgacttcaagcaggagaccctgcccagcaagagcaatgaaagccatgaccacatggatgacatggatgatgaagatgatgatgaccaccagagtgatgagagccaccacagtgatgaaagtgatgagctggtgacagacttccccacagacctgcctgccacagaggtgttcacccctgtggtgcccaccgtggacacctatgatggccgcggggacagcgtggtgtatggcctgcggagcaagagcaagaagttcagaagaccagacatccagtacccagatgccacagatgaggacatcaccagccacatggagagcgaggagctgaatggagcctacaaggccatccctgtggcccaggacctgaatgcccccagcgactgggacagccggggcaaggacagctatgagaccagccagctggatgaccagagcgctgagacccacagccacaagcagagccggctgtacaagaggaaggccaatgatgagagcaatgagcacagtgatgtgattgacagccaggagctgagcaaggtgtcccgggagttccacagccatgagttccacagccatgaggacatgctggtggtggaccccaagagcaaggaggaggacaagcacctgaagttccgcatcagccatgagctggacagcgccagcagcgaggtgaactag

SEQ ID NO: 21784 - DNA, 864 bp, Artificial Sequence
  Description of Artificial Sequence: Synthetic coding sequence
atgagaattgctgtgatctgcttctgcctgctgggcatcacctgtgccatccctgtgaagcaggccgacagcggcagcagcgaggagaagcagaatgctgtgagcagcgaggagaccaatgacttcaagcaggagaccctgcccagcaagagcaatgaaagccatgaccacatggatgacatggatgatgaagatgatgatgaccacgtggacagccaggacagcattgacagcaatgacagtgatgatgtggatgacacagatgacagccaccagagtgatgagagccaccacagtgatgaaagtgatgagctggtgacagacttccccacagacctgcctgccacagaggtgttcacccctgtggtgcccaccgtggacacctatgatggccgcggggacagcgtggtgtatggcctgcggagcaagagcaagaagttccggcggccagacatccagtacccagatgccacagatgaggacatcaccagccacatggagagcgaggagctgaatggagcctacaaggccatccctgtggcccaggacctgaatgcccccagcgactgggacagccggggcaaggacagctatgagaccagccagctggatgaccagagcgctgagacccacagccacaagcagagccggctgtacaagaggaaggccaatgatgagagcaatgagcacagtgatgtgattgacagccaggagctgagcaaggtgtcccgggagttccacagccatgagttccacagccatgaggacatgctggtggtggaccccaagagcaaggaggaggacaagcacctgaagttccgcatcagccatgagctggacagcgccagcagcgaggtgaactag

SEQ ID NO: 21785 - DNA, 945 bp, Artificial Sequence
  Description of Artificial Sequence: Synthetic coding sequence
atgagaattgctgtgatctgcttctgcctgctgggcatcacctgtgccatccctgtgaagcaggccgacagcggcagcagcgaggagaagcagctgtacaacaagtacccagatgctgtggccacctggctgaacccagaccccagccagaagcagaacctgctggccccccagaatgctgtgtcctctgaggagaccaatgacttcaagcaggagaccctgcccagcaagagcaatgaaagccatgaccacatggatgacatggatgatgaagatgatgatgaccacgtggacagccaggacagcattgacagcaatgacagtgatgatgtggatgacacagatgacagccaccagagtgatgagagccaccacagtgatgaaagtgatgagctggtgacagacttccccacagacctgcctgccacagaggtgttcacccctgtggtgcccaccgtggacacctatgatggccgcggggacagcgtggtgtatggcctgcggagcaagagcaagaagttcagaagaccagacatccagtacccagatgccacagatgaggacatcaccagccacatggagagcgaggagctgaatggagcctacaaggccatccctgtggcccaggacctgaatgcccccagcgactgggacagccggggcaaggacagctatgagaccagccagctggatgaccagagcgctgagacccacagccacaagcagagccggctgtacaagaggaaggccaatgatgagagcaatgagcacagtgatgtgattgacagccaggagctgagcaaggtgtcccgggagttccacagccatgagttccacagccatgaggacatgctggtggtggaccccaagagcaaggaggaggacaagcacctgaagttccgcatcagccatgagctggacagcgccagcagcgaggtgaactag

SEQ ID NO: 21786 - DNA, 822 bp, Artificial Sequence
  Description of Artificial Sequence: Synthetic coding sequence
atgagaattgctgtgatctgcttctgcctgctgggcatcacctgtgccatccctgtgaagcaggccgacagcggcagcagcgaggagaagcagaccctgcccagcaagagcaatgaaagccatgaccacatggatgacatggatgatgaagatgatgatgaccacgtggacagccaggacagcattgacagcaatgacagtgatgatgtggatgacacagatgacagccaccagagtgatgagagccaccacagtgatgaaagtgatgagctggtgacagacttccccacagacctgcctgccacagaggtgttcacccctgtggtgcccaccgtggacacctatgatggccgcggggacagcgtggtgtatggcctgcggagcaagagcaagaagttccggcggccagacatccagtacccagatgccacagatgaggacatcaccagccacatggagagcgaggagctgaatggagcctacaaggccatccctgtggcccaggacctgaatgcccccagcgactgggacagccggggcaaggacagctatgagaccagccagctggatgaccagagcgctgagacccacagccacaagcagagccggctgtacaagaggaaggccaatgatgagagcaatgagcacagtgatgtgattgacagccaggagctgagcaaggtgtcccgggagttccacagccatgagttccacagccatgaggacatgctggtggtggaccccaagagcaaggaggaggacaagcacctgaagttccgcatcagccatgagctggacagcgccagcagcgaggtgaactag

SEQ ID NO: 21787 - DNA, 2370 bp, Artificial Sequence
  Description of Artificial Sequence: Synthetic coding sequence
atgaggacctaccactacatccccctcttcatctggacctacatgttccacacagtggacaccatcctgctgcaggagaagcccaacagctacctgagcagcaagaagattgctggcctgaccaaggatgatggcaagatgctgcggaggaccaagaggggctggatgtggaaccagttcttcctgctggaggagtacacaggaacagacacccagtatgtgggcaagctgcacacagaccaggacaagggagatggcaacctgaagtacatcctgactggagatggagctggcagcctgtttgtgattgatgaaaatactggagacatccacgccgccaagaagctggaccgggaggagaagagcctgtacatcctgcgggccaaggccatcgacaggaagacaggccggcaggtggagcctgagagcgagttcatcatcaagatccatgacatcaatgacaatgagcccaagttcaccaaggacctgtacacagcctctgtgcctgagatgtctggagtgggcaccagcgtcatccaggtgacagccacagatgctgatgatgccaactacggcaacagcgccaaggtggtgtacagcatcctgcagggccagccctacttctctgtggaccctgagagcggcatcatcaagacagccctgcctgacatgagcagagaaaatcgggagcagtaccaggtggtgatccaggccaaggacatgggcggccagatgggcggcctgagcggcaccaccaccgtgaacatcaccctgacagatgtgaacaacaaccccccacgcttcccccagagcacctaccagttcaacagccctgagagcgtgcccctgggcacccacctgggccgcatcaaggccaatgaccctgatgtgggagaaaatgctgagatggagtacagcattgctgaaggagatggagctgacatgtttgatgtgatcacagacaaggacacccaggagggcatcatcaccgtgaagcagaacctggactttgagaaccagatgctgtacaccctgcgggtggatgccagcaacacccacccagacccccgcttcctgcacctgggccccttcaaggacacagctgtggtgaagatctctgtggaggacattgatgagccccctgtgttcaccaaggtgtcctacctgattgaggtggatgaagatgtgaaggagggcagcatcatcggccaggtgacagcctatgaccctgatgccaggaacaacctgatcaagtacagcgtggacagacacacagacatggaccgcatcttcggcatccacagtgaaaatggcagcatcttcaccctgaaggccctggaccgggagagcagcccctggcacaacatcaccgtgacagccacagagatcaacaaccccaagcagagcagccacatccctgtgttcatccgcatcctggacatcaatgaccacgcccctgagtttgccatgtactatgagacctttgtgtgtgaaaatgccaagccaggccagctgatccagacagtgtctgtgatggacaaggatgatcctccccggggccacaagttcttctttgagcctgtgcctgagttcaccctgaaccccaacttcaccatcgtggacaacaaggacaacacagctggcatcatgaccaggaaggatggctacagcaggaacaagatgagcacctacctgctgcccatcctgatctttgacaatgactaccccatccagagcagcacaggcaccctgaccatccgggtgtgtgcctgtgacaaccagggcaacatgcagagctgcacagctgaggccctgatcctgtctgctggcctgagcactggagccctggtggccatcctgctgtgtgtgctgatcctgctgatcctggtggtgctgtttgctgccctgaagaggcagaggaagaaggagcccctcatcatcagcaaggatgatgtgcgggacaacatcgtgacctacaatgatgaaggaggaggagaggaggacacccaggcctttgacatcggcaccctgaggaaccctgaggcccgggaggacagcaagctgcggagagatgtgatgcctgagaccatcttccagatcagaagaacagtgcccctgtgggagaacattgatgtgcaggacttcatccaccggcggctgaaggaaaatgatgctgaccccagcgccccaccctatgacagcctggccacctacgcctatgagggcaatgacagcattgctgacagcctgagcagcctggagagcctgacagctgactgcaaccaggactatgactacctgagtgactggggcccccgcttcaagaagctggccgacatgtatggaggagatgacagcgaccgggactag

SEQ ID NO: 21788 - DNA, 162 bp, Artificial Sequence
  Description of Artificial Sequence: Synthetic coding sequence
atgagggcctggatcttcttcctgctgtgcctggccggccgggccctggccgccccccagcaggaggccctgcctgatgaaacagaggtggtggaggagaccgtggccgaggtgacagaggtgtctgtgggcgccaaccctgtgcaggtggaggtgggctag

SEQ ID NO: 21789 - DNA, 336 bp, Artificial Sequence
  Description of Artificial Sequence: Synthetic coding sequence
atgagggcctggatcttcttcctgctgtgcctggccggccgggccctggccgccccccagcaggaggccctgcctgatgaaacagaggtggtggaggagaccgtggccgaggtgacagaggtgtctgtgggcgccaaccctgtgcaggtggaggtgggggagtttgatgatggagctgaggagacagaggaggaggtggtggccgagaacccctgccagaaccaccactgcaagcacggcaaggtgtgtgagctggatgagaacaacacccccatgtgtgtgtgccaggaccccaccagctgcccagcccccatcggggagtttgagaaggtgtag

SEQ ID NO: 21790 - DNA, 276 bp, Artificial Sequence
  Description of Artificial Sequence: Synthetic coding sequence
atgaagctggccgtgaccctgaccctggtgaccctggccctgtgctgcagcagcgccagcgctgagatctgccccagcttccagagggtgattgagaccctgctgatggacacccccagcagctatgaggccgccatggagctgttctccccagaccaggacatgagggaggccggggcccagctgaagaagctggtggacaccctgccccagaagccccgggagagcatcatcaagctgatggagaagatcgcccagagcagcctgtgcaactag

SEQ ID NO: 21791 - DNA, 1380 bp, Artificial Sequence
  Description of Artificial Sequence: Synthetic coding sequence
atgatcaagcgcttcctggaggacaccacagatgatggagagctgagcaagtttgtgaaggacttctctggaaatgccagctgccaccccccagaggccaagacctgggccagccggccccaggtgcctgagccccggccccaggccccagacctgtatgatgatgacctggagttccggccccccagccggccccagagcagtgacaaccagcagtacttctgtgccccagcccccctgagccccagcgcccggcccaggagcccctggggcaagctggacccctatgacagcagtgaagatgacaaggagtatgtgggctttgccaccctgcccaaccaggtgcacaggaagtctgtgaagaagggctttgacttcaccctgatggtggccggggagagcggcctgggcaagagcaccctggtgaacagcctcttcctgacagacctgtacagagacaggaagctgctgggcgctgaggagcgcatcatgcagacagtggagatcaccaagcatgctgtggacatcgaggagaagggcgtgcggctgcggctgaccatcgtggacaccccaggctttggagatgctgtgaacaacacagagtgctggaagcctgtggccgagtacatcgaccagcagtttgagcagtacttcagagatgagagcggcctgaacaggaagaacatccaggacaacagagtgcactgctgcctgtacttcatcagccccttcggccacggcctgcggcccctggatgtggagttcatgaaggccctgcaccagagggtgaacatcgtgcccatcctggccaaggctgacaccctgaccccacctgaggtggaccacaagaagaggaagatccgggaggagattgagcacttcggcatcaagatctaccagttcccagactgtgacagtgatgaagatgaggacttcaagctgcaggaccaggccctgaaggagagcatcccctttgctgtgattggcagcaacacagtggtggaggcccggggcagaagagtgcggggccgcctgtacccctggggcatcgtggaggtggagaaccctggccactgtgactttgtgaagctgcggaccatgctggtgaggacccacatgcaggacctgaaggatgtgacccgggagacccactatgagaactaccgggcccagtgcatccagagcatgacccggctggtggtgaaggagaggaacagaaacaagctgacccgggagagcggcacagacttccccatcccagctgtgcccccaggcacagatcctgagacagagaagctgatccgggagaaggatgaggagctgcggaggatgcaggagatgctgcacaagatccagaagcagatgaaggagaactactag

SEQ ID NO: 21792 - DNA, 1437 bp, Artificial Sequence
  Description of Artificial Sequence: Synthetic coding sequence
atggacaggagcctgggctggcagggcaacagcgtgcctgaggacagaacagaagctggcatcaagcgcttcctggaggacaccacagatgatggagagctgagcaagtttgtgaaggacttctctggaaatgccagctgccaccccccagaggccaagacctgggccagccggccccaggtgcctgagccccggccccaggccccagacctgtatgatgatgacctggagttccggccccccagccggccccagagcagtgacaaccagcagtacttctgtgccccagcccccctgagccccagcgcccggcccaggagcccctggggcaagctggacccctatgacagcagtgaagatgacaaggagtatgtgggctttgccaccctgcccaaccaggtgcacaggaagtctgtgaagaagggctttgacttcaccctgatggtggccggggagagcggcctgggcaagagcaccctggtgaacagcctcttcctgacagacctgtacagagacaggaagctgctgggcgctgaggagcgcatcatgcagacagtggagatcaccaagcatgctgtggacatcgaggagaagggcgtgcggctgcggctgaccatcgtggacaccccaggctttggagatgctgtgaacaacacagagtgctggaagcctgtggccgagtacatcgaccagcagtttgagcagtacttcagagatgaaagtggcctgaacaggaagaacatccaggacaacagagtgcactgctgcctgtacttcatcagcccctttggacatggcctgcggcccctggatgtggagttcatgaaggccctgcaccagagggtgaacatcgtgcccatcctggccaaggctgacaccctgaccccacctgaggtggaccacaagaagaggaagatccgggaggagattgagcacttcggcatcaagatctaccagttcccagactgtgacagtgatgaagatgaggacttcaagctgcaggaccaggccctgaaggagagcatcccctttgctgtgattggcagcaacacagtggtggaggcccggggccggcgggtgcggggccgcctgtacccctggggcatcgtggaggtggagaaccctggccactgtgactttgtgaagctgcggaccatgctggtgaggacccacatgcaggacctgaaggatgtgacccgggagacccactatgagaactaccgggcccagtgcatccagagcatgacccggctggtggtgaaggagaggaacagaaacaagctgacccgggagagcggcacagacttccccatcccagctgtgcccccaggcacagatcctgagacagagaagctgatccgggagaaggatgaggagctgcggaggatgcaggagatgctgcacaagatccagaagcagatgaaggagaactactag

SEQ ID NO: 21793 - DNA, 1380 bp, Artificial Sequence; identical to SEQ ID NO: 21791
  Description of Artificial Sequence: Synthetic coding sequence

SEQ ID NO: 21794 - DNA, 1413 bp, Artificial Sequence
  Description of Artificial Sequence: Synthetic coding sequence
atgcctggcttctacagcgtgatgacagatgaggagatcaagcgcttcctggaggacaccacagatgatggagagctgagcaagtttgtgaaggacttctctggaaatgccagctgccaccccccagaggccaagacctgggccagccggccccaggtgcctgagccccggccccaggccccagacctgtatgatgatgacctggagttccggccccccagccggccccagagcagtgacaaccagcagtacttctgtgccccagcccccctgagccccagcgcccggcccaggagcccctggggcaagctggacccctatgacagcagtgaagatgacaaggagtatgtgggctttgccaccctgcccaaccaggtgcacaggaagtctgtgaagaagggctttgacttcaccctgatggtggccggggagagcggcctgggcaagagcaccctggtgaacagcctcttcctgacagacctgtacagagacaggaagctgctgggcgctgaggagcgcatcatgcagacagtggagatcaccaagcatgctgtggacatcgaggagaagggcgtgcggctgcggctgaccatcgtggacaccccaggctttggagatgctgtgaacaacacagagtgctggaagcctgtggccgagtacatcgaccagcagtttgagcagtacttcagagatgaaagtggcctgaacaggaagaacatccaggacaacagagtgcactgctgcctgtacttcatcagcccctttggacatggcctgcggcccctggatgtggagttcatgaaggccctgcaccagagggtgaacatcgtgcccatcctggccaaggctgacaccctgaccccacctgaggtggaccacaagaagaggaagatccgggaggagattgagcacttcggcatcaagatctaccagttcccagactgtgacagtgatgaagatgaggacttcaagctgcaggaccaggccctgaaggagagcatcccctttgctgtgattggcagcaacacagtggtggaggcccggggccggcgggtgcggggccgcctgtacccctggggcatcgtggaggtggagaaccctggccactgtgactttgtgaagctgcggaccatgctggtgaggacccacatgcaggacctgaaggatgtgacccgggagacccactatgagaactaccgggcccagtgcatccagagcatgacccggctggtggtgaaggagaggaacagaaacaagctgacccgggagagcggcacagacttccccatcccagctgtgcccccaggcacagatcctgagacagagaagctgatccgggagaaggatgaggagctgcggaggatgcaggagatgctgcacaagatccagaagcagatgaaggagaactactag

SEQ ID NO: 21795 - DNA, 825 bp, Artificial Sequence
  Description of Artificial Sequence: Synthetic coding sequence
atgatcaagcgcttcctggaggacaccacagatgatggagagctgagcaagtttgtgaaggacttctctggaaatgccagctgccaccccccagaggccaagacctgggccagccggccccaggtgcctgagccccggccccaggccccagacctgtatgatgatgacctggagttccggccccccagccggccccagagcagtgacaaccagcagtacttctgtgccccagcccccctgagccccagcgcccggcccaggagcccctggggcaagctggacccctatgacagcagtgaagatgacaaggagtatgtgggctttgccaccctgcccaaccaggtgcacaggaagtctgtgaagaagggctttgacttcaccctgatggtggccggggagagcggcctgggcaagagcaccctggtgaacagcctcttcctgacagacctgtacagagacaggaagctgctgggcgctgaggagcgcatcatgcagacagtggagatcaccaagcatgctgtggacatcgaggagaagggcgtgcggctgcggctgaccatcgtggacaccccaggctttggagatgctgtgaacaacacagagtgctggaagcctgtggccgagtacatcgaccagcagtttgagcagtacttcagagatgagagcggcctgaacaggaagaacatccaggacaacagagtgcactgctgcctgtacttcatcagccccttcggccacggctacggccccagcctgcggctgctggcccctcctggagctgtgaagggcaccggccaggagcaccagggccagggctgccactag

SEQ ID NO: 21796 - DNA, 1479 bp, Artificial Sequence
  Description of Artificial Sequence: Synthetic coding sequence
tacagcagccctgccctcttcagcagcagagctgccccccagaagcccaggaaggagggcagccaggccgccggcctgctggtgttcagtgacagcctggagatcaagcgcttcctggaggacaccacagatgatggagagctgagcaagtttgtgaaggacttctctggaaatgccagctgccaccccccagaggccaagacctgggccagccggccccaggtgcctgagccccggccccaggccccagacctgtatgatgatgacctggagttccggccccccagccggccccagagcagtgacaaccagcagtacttctgtgccccagcccccctgagccccagcgcccggcccaggagcccctggggcaagctggacccctatgacagcagtgaagatgacaaggagtatgtgggctttgccaccctgcccaaccaggtgcacaggaagtctgtgaagaagggctttgacttcaccctgatggtggccggggagagcggcctgggcaagagcaccctggtgaacagcctcttcctgacagacctgtacagagacaggaagctgctgggcgctgaggagcgcatcatgcagacagtggagatcaccaagcatgctgtggacatcgaggagaagggcgtgcggctgcggctgaccatcgtggacaccccaggctttggagatgctgtgaacaacacagagtgctggaagcctgtggccgagtacatcgaccagcagtttgagcagtacttcagagatgaaagtggcctgaacaggaagaacatccaggacaacagagtgcactgctgcctgtacttcatcagcccctttggacatggcctgcggcccctggatgtggagttcatgaaggccctgcaccagagggtgaacatcgtgcccatcctggccaaggctgacaccctgaccccacctgaggtggaccacaagaagaggaagatccgggaggagattgagcacttcggcatcaagatctaccagttcccagactgtgacagtgatgaagatgaggacttcaagctgcaggaccaggccctgaaggagagcatcccctttgctgtgattggcagcaacacagtggtggaggcccggggccggcgggtgcggggccgcctgtacccctggggcatcgtggaggtggagaaccctggccactgtgactttgtgaagctgcggaccatgctggtgaggacccacatgcaggacctgaaggatgtgacccgggagacccactatgagaactaccgggcccagtgcatccagagcatgacccggctggtggtgaaggagaggaacagaaacaagctgacccgggagagcggcacagacttccccatcccagctgtgcccccaggcacagatcctgagacagagaagctgatccgggagaaggatgaggagctgcggaggatgcaggagatgctgcacaagatccagaagcagatgaaggagaactactag

SEQ ID NO: 21797 - DNA, 996 bp, Artificial Sequence
  Description of Artificial Sequence: Synthetic coding sequence
atggtggccggggagagcggcctgggcaagagcaccctggtgaacagcctcttcctgacagacctgtacagagacaggaagctgctgggcgctgaggagcgcatcatgcagacagtggagatcaccaagcatgctgtggacatcgaggagaagggcgtgcggctgcggctgaccatcgtggacaccccaggctttggagatgctgtgaacaacacagagtgctggaagcctgtggccgagtacatcgaccagcagtttgagcagtacttcagagatgagagcggcctgaacaggaagaacatccaggacaacagagtgcactgctgcctgtacttcatcagccccttcggccacggcctgcggcccctggatgtggagttcatgaaggccctgcaccagagggtgaacatcgtgcccatcctggccaaggctgacaccctgaccccacctgaggtggaccacaagaagaggaagatccgggaggagattgagcacttcggcatcaagatctaccagttcccagactgtgacagtgatgaagatgaggacttcaagctgcaggaccaggccctgaaggagagcatcccctttgctgtgattggcagcaacacagtggtggaggcccggggcagaagagtgcggggccgcctgtacccctggggcatcgtggaggtggagaaccctggccactgtgactttgtgaagctgcggaccatgctggtgaggacccacatgcaggacctgaaggatgtgacccgggagacccactatgagaactaccgggcccagtgcatccagagcatgacccggctggtggtgaaggagaggaacagaaacaagctgacccgggagagcggcacagacttccccatcccagctgtgcccccaggcacagatcctgagacagagaagctgatccgggagaaggatgaggagctgcggaggatgcaggagatgctgcacaagatccagaagcagatgaaggagaactactag

SEQ ID NO: 21798 - DNA, 1311 bp, Artificial Sequence
  Description of Artificial Sequence: Synthetic coding sequence
atgtctgtgtctgcccggtctgctgctgctgaggagaggtctgtgaacagcagcaccatgggccagcagaagaacctggagggctacgtgggctttgccaacctgcccaaccaggtgtacaggaagtctgtgaagaggggctttgagttcaccctgatggtggtgggggagagcggcctgggcaagagcaccctcatcaacagcctcttcctgacagacctgtacagccctgagtacccaggccccagccaccgcatcaagaagacagtgcaggtggagcagagcaaggtgctgatcaaggagggcggcgtgcagctgctgctgaccatcgtggacaccccaggctttggagatgctgtggacaacagcaactgctggcagcccgtcatcgactacatcgacagcaagtttgaggactacctgaatgctgagagccgggtgaacagacggcagatgccagacaacagagtgcagtgctgcctgtacttcatcgcccccagcggccacggcctgaagcccctggacatcgagttcatgaagaggctgcacgagaaggtgaacatcatccccctcatcgccaaggctgacaccctgaccccagaggagtgccagcagttcaagaagcagatcatgaaggagatccaggagcacaagatcaagatctatgagttccctgagacagatgatgaggaggagaacaagctggtgaagaagatcaaggaccggctgcccctggccgtggtgggcagcaacaccatcatcgaggtgaatggcaagagggtgcggggccggcagtacccctggggcgtggccgaggtggagaatggagagcactgtgacttcaccatcctgaggaacatgctgatccgcacccacatgcaggacctgaaggatgtgaccaacaacgtgcactatgagaactaccgcagcaggaagctggccgctgtgacctacaatggagtggacaacaacaagaacaagggccagctgaccaagagccccctggcccagatggaggaggagcggcgggagcacgtggccaagatgaagaagatggagatggagatggagcaggtgtttgagatgaaggtgaaggagaaggtgcagaagctgaaggacagcgaggccgagctgcagaggagacatgagcagatgaagaagaacctggaggcccagcacaaggagctggaggagaagaggcggcagtttgaagatgagaaggccaactgggaggcccagcagaggatcctggagcagcagaacagcagcaggaccctggagaagaacaagaagaagggcaagatcttctag

SEQ ID NO: 21799 - DNA, 1317 bp, Artificial Sequence
  Description of Artificial Sequence: Synthetic coding sequence
atgtctgtgtctgcccggtctgctgctgctgaggagaggtctgtgaacagcagcaccatggaggtggcccagcagaagaacctggagggctacgtgggctttgccaacctgcccaaccaggtgtacaggaagtctgtgaagaggggctttgagttcaccctgatggtggtgggggagagcggcctgggcaagagcaccctcatcaacagcctcttcctgacagacctgtacagccctgagtacccaggccccagccaccgcatcaagaagacagtgcaggtggagcagagcaaggtgctgatcaaggagggcggcgtgcagctgctgctgaccatcgtggacaccccaggctttggagatgctgtggacaacagcaactgctggcagcccgtcatcgactacatcgacagcaagtttgaggactacctgaatgctgagagccgggtgaacagacggcagatgccagacaacagagtgcagtgctgcctgtacttcatcgcccccagcggccacggcctgaagcccctggacatcgagttcatgaagaggctgcacgagaaggtgaacatcatccccctcatcgccaaggctgacaccctgaccccagaggagtgccagcagttcaagaagcagatcatgaaggagatccaggagcacaagatcaagatctatgagttccctgagacagatgatgaggaggagaacaagctggtgaagaagatcaaggaccggctgcccctggccgtggtgggcagcaacaccatcatcgaggtgaatggcaagagggtgcggggccggcagtacccctggggcgtggccgaggtggagaatggagagcactgtgacttcaccatcctgaggaacatgctgatccgcacccacatgcaggacctgaaggatgtgaccaacaacgtgcactatgagaactaccgcagcaggaagctggccgctgtgacctacaatggagtggacaacaacaagaacaagggccagctgaccaagagccccctggcccagatggaggaggagcggcgggagcacgtggccaagatgaagaagatggagatggagatggagcaggtgtttgagatgaaggtgaaggagaaggtgcagaagctgaaggacagcgaggccgagctgcagaggagacatgagcagatgaagaagaacctggaggcccagcacaaggagctggaggagaagaggcggcagtttgaagatgagaaggccaactgggaggcccagcagaggatcctggagcagcagaacagcagcaggaccctggagaagaacaagaagaagggcaagatcttctag

SEQ ID NO: 21800 - DNA, 1311 bp, Artificial Sequence
  Description of Artificial Sequence: Synthetic coding sequence
atgtctgtgtctgcccggtctgctgctgctgaggagaggtctgtgaacagcagcaccatggtgcagcagaagaacctggagggctacgtgggctttgccaacctgcccaaccaggtgtacaggaagtctgtgaagaggggctttgagttcaccctgatggtggtgggggagagcggcctgggcaagagcaccctcatcaacagcctcttcctgacagacctgtacagccctgagtacccaggccccagccaccgcatcaagaagacagtgcaggtggagcagagcaaggtgctgatcaaggagggcggcgtgcagctgctgctgaccatcgtggacaccccaggctttggagatgctgtggacaacagcaactgctggcagcccgtcatcgactacatcgacagcaagtttgaggactacctgaatgctgagagccgggtgaacagacggcagatgccagacaacagagtgcagtgctgcctgtacttcatcgcccccagcggccacggcctgaagcccctggacatcgagttcatgaagaggctgcacgagaaggtgaacatcatccccctcatcgccaaggctgacaccctgaccccagaggagtgccagcagttcaagaagcagatcatgaaggagatccaggagcacaagatcaagatctatgagttccctgagacagatgatgaggaggagaacaagctggtgaagaagatcaaggaccggctgcccctggccgtggtgggcagcaacaccatcatcgaggtgaatggcaagagggtgcggggccggcagtacccctggggcgtggccgaggtggagaatggagagcactgtgacttcaccatcctgaggaacatgctgatccgcacccacatgcaggacctgaaggatgtgaccaacaacgtgcactatgagaactaccgcagcaggaagctggccgctgtgacctacaatggagtggacaacaacaagaacaagggccagctgaccaagagccccctggcccagatggaggaggagcggcgggagcacgtggccaagatgaagaagatggagatggagatggagcaggtgtttgagatgaaggtgaaggagaaggtgcagaagctgaaggacagcgaggccgagctgcagaggagacatgagcagatgaagaagaacctggaggcccagcacaaggagctggaggagaagaggcggcagtttgaagatgagaaggccaactgggaggcccagcagaggatcctggagcagcagaacagcagcaggaccctggagaagaacaagaagaagggcaagatcttctag

SEQ ID NO: 21801 - DNA, 267 bp, Artificial Sequence
  Description of Artificial Sequence: Synthetic coding sequence
atgaagaagatggagatggagatggagcaggtgtttgagatgaaggtgaaggagaaggtgcagaagctgaaggacagcgaggccgagctgcagaggagacatgagcagatgaagaagaacctggaggcccagcacaaggagctggaggagaagaggcggcagtttgaagatgagaaggccaactgggaggcccagcagaggatcctggagcagcagaacagcagcaggaccctggagaagaacaagaagaagggcaagatcttctag

SEQ ID NO: 21802 - DNA, 1155 bp, Artificial Sequence
  Description of Artificial Sequence: Synthetic coding sequence
atggtggtgggggagagcggcctgggcaagagcaccctcatcaacagcctcttcctgacagacctgtacagccctgagtacccaggccccagccaccgcatcaagaagacagtgcaggtggagcagagcaaggtgctgatcaaggagggcggcgtgcagctgctgctgaccatcgtggacaccccaggctttggagatgctgtggacaacagcaactgctggcagcccgtcatcgactacatcgacagcaagtttgaggactacctgaatgctgagagccgggtgaacagacggcagatgccagacaacagagtgcagtgctgcctgtacttcatcgcccccagcggccacggcctgaagcccctggacatcgagttcatgaagaggctgcacgagaaggtgaacatcatccccctcatcgccaaggctgacaccctgaccccagaggagtgccagcagttcaagaagcagatcatgaaggagatccaggagcacaagatcaagatctatgagttccctgagacagatgatgaggaggagaacaagctggtgaagaagatcaaggaccggctgcccctggccgtggtgggcagcaacaccatcatcgaggtgaatggcaagagggtgcggggccggcagtacccctggggcgtggccgaggtggagaatggagagcactgtgacttcaccatcctgaggaacatgctgatccgcacccacatgcaggacctgaaggatgtgaccaacaacgtgcactatgagaactaccgcagcaggaagctggccgctgtgacctacaatggagtggacaacaacaagaacaagggccagctgaccaagagccccctggcccagatggaggaggagcggcgggagcacgtggccaagatgaagaagatggagatggagatggagcaggtgtttgagatgaaggtgaaggagaaggtgcagaagctgaaggacagcgaggccgagctgcagaggagacatgagcagatgaagaagaacctggaggcccagcacaaggagctggaggagaagaggcggcagtttgaagatgagaaggccaactgggaggcccagcagaggatcctggagcagcagaacagcagcaggaccctggagaagaacaagaagaagggcaagatcttctag

SEQ ID NO: 21803 - DNA, 708 bp, Artificial Sequence
  Description of Artificial Sequence: Synthetic coding sequence
atgtctgtgtctgcccggtctgctgctgctgaggagaggtctgtgaacagcagcaccatgggccagcagaagaacctggagggctacgtgggctttgccaacctgcccaaccaggtgtacaggaagtctgtgaagaggggctttgagttcaccctgatggtggtgggggagagcggcctgggcaagagcaccctcatcaacagcctcttcctgacagacctgtacagccctgagtacccaggccccagccaccgcatcaagaagacagtgcaggtggagcagagcaaggtgctgatcaaggagggcggcgtgcagctgctgctgaccatcgtggacaccccaggctttggagatgctgtggacaacagcaactgctggcagcccgtcatcgactacatcgacagcaagtttgaggactacctgaatgctgagagccgggtgaacagacggcagatgccagacaacagagtgcagtgctgcctgtacttcatcgcccccagcggccacggcctgaagcccctggacatcgagttcatgaagaggctgcacgagaaggtgaacatcatccccctcatcgccaaggctgacaccctgaccccagaggagtgccagcagttcaagaagcagatcatgaaggagatccaggagcacaagatcaagatctatgagttccctgagacagccaagaagaagaagaagaagaagtag

SEQ ID NO: 21804 - DNA, 1155 bp, Artificial Sequence; identical to SEQ ID NO: 21802
  Description of Artificial Sequence: Synthetic coding sequence

SEQ ID NO: 21805 - DNA, 1146 bp, Artificial Sequence
  Description of Artificial Sequence: Synthetic coding sequence
gtcacccatgagaccatcgtggagcagcagaagaacctggagggctacgtgggctttgccaacctgcccaaccaggtgtacaggaagtctgtgaagaggggctttgagttcaccctgatggtggtgggggagagcggcctgggcaagagcaccctcatcaacagcctcttcctgacagacctgtacagccctgagtacccaggccccagccaccgcatcaagaagacagtgcaggtggagcagagcaaggtgctgatcaaggagggcggcgtgcagctgctgctgaccatcgtggacaccccaggctttggagatgctgtggacaacagcaactgctggcagcctgtgattgactacatcgacagcaagtttgaggactacctgaatgctgagagccgggtgaacagacggcagatgccagacaacagagtgcagtgctgcctgtacttcatcgcccccagcggccacggcctgaagcccctggacatcgagttcatgaagaggctgcacgagaaggtgaacatcatccccctgattgccaaggctgacaccctgaccccagaggagtgccagcagttcaagaagcagatcatgaaggagatccaggagcacaagatcaagatctatgagttccctgagacagatgatgaggaggagaacaagctggtgaagaagatcaaggaccggctgcccctggccgtggtgggcagcaacaccatcatcgaggtgaatggcaagagggtgcggggccggcagtacccctggggcgtggccgaggtggagaatggagagcactgtgacttcaccatcctgaggaacatgctgatccgcacccacatgcaggacctgaaggatgtgaccaacaacgtgcactatgagaactaccgcagcaggaagctggccgctgtgacctacaacggggtggacaacaacaagaacaagggccagctgaccaagagccccctggcccagatggaggaggagcggcgggagcacgtggccaagatgaagaagatggagatggagatggagcaggtgtttgagatgaaggtgaaggagaaggtgcagaagctgaaggacagcgaggccgaggtgatcagcctcatcagccacctgctggccgacatcgtgttcctgttcaagtag

SEQ ID NO: 21806 - DNA, 1149 bp, Artificial Sequence
  Description of Artificial Sequence: Synthetic coding sequence
atgggagagagcggcctgggcaagagcaccctcatcaacagcctcttcctgacagacctgtacagccctgagtacccaggccccagccaccgcatcaagaagacagtgcaggtggagcagagcaaggtgctgatcaaggagggcggcgtgcagctgctgctgaccatcgtggacaccccaggctttggagatgctgtggacaacagcaactgctggcagcccgtcatcgactacatcgacagcaagtttgaggactacctgaatgctgagagccgggtgaacagacggcagatgccagacaacagagtgcagtgctgcctgtacttcatcgcccccagcggccacggcctgaagcccctggacatcgagttcatgaagaggctgcacgagaaggtgaacatcatccccctcatcgccaaggctgacaccctgaccccagaggagtgccagcagttcaagaagcagatcatgaaggagatccaggagcacaagatcaagatctatgagttccctgagacagatgatgaggaggagaacaagctggtgaagaagatcaaggaccggctgcccctggccgtggtgggcagcaacaccatcatcgaggtgaatggcaagagggtgcggggccggcagtacccctggggcgtggccgaggtggagaatggagagcactgtgacttcaccatcctgaggaacatgctgatccgcacccacatgcaggacctgaaggatgtgaccaacaacgtgcactatgagaactaccgcagcaggaagctggccgctgtgacctacaatggagtggacaacaacaagaacaagggccagctgaccaagagccccctggcccagatggaggaggagcggcgggagcacgtggccaagatgaagaagatggagatggagatggagcaggtgtttgagatgaaggtgaaggagaaggtgcagaagctgaaggacagcgaggccgagctgcagaggagacatgagcagatgaagaagaacctggaggcccagcacaaggagctggaggagaagaggcggcagtttgaagatgagaaggccaactgggaggcccagcagaggatcctggagcagcagaacagcagcaggaccctggagaagaacaagaagaagggcaagatcttctag

SEQ ID NO: 21807 - DNA, 1302 bp, Artificial Sequence
  Description of Artificial Sequence: Synthetic coding sequence
atggaggtggtggacccccagcagctgggcatgttcacagaaggagagctgatgtctgtgggcatggacaccttcatccacagaattgacagcacagaggtgatctaccagcccaggaggaagagggccaagctgattggcaagtacctgatgggagacctgctgggggagggcagctatggcaaggtgaaggaggtgctggacagcgagaccctgtgccggcgggctgtgaagatcctgaagaagaagaagctgcggcgcatccccaacggggaggccaacgtgaagaaggagatccagctgctgcggcggctgcggcacaagaatgtcatccagctggtggatgtgctgtacaatgaggagaagcagaagatgtacatggtgatggagtactgtgtgtgtggcatgcaggagatgctggacagcgtgcctgagaagcgcttccctgtgtgccaggcccacggctacttctgccagctgattgatggcctggagtacctgcacagccagggcatcgtgcacaaggacatcaagccaggcaacctgctgctgaccaccggcggcaccctgaagatcagtgacctgggcgtggccgaggccctgcacccctttgctgctgatgacacctgcaggaccagccagggcagccctgccttccagcccccagagatcgccaacggcctggacaccttcagcggcttcaaggtggacatctggagcgctggggtgaccctgtacaacatcaccaccggcctgtacccctttgaaggagacaacatctacaagctgtttgaaaatattggcaagggcagctatgccatccctggggactgtggcccccccctgagtgacctgctgaagggcatgctggagtatgagcccgccaagcgcttcagcatccggcagatccggcagcacagctggttcaggaagaagcaccccccagctgaggcccctgtgcccatcccccccagcccagacaccaaggaccgctggaggtccatgacagtggtgccctacctggaggacctgcatggagcagatgaagatgaggacctgtttgatattgaagatgacatcatctacacccaggacttcaccgtgcccggccaggtgcctgaggaggaggccagccacaacggccagaggcggggcctgcccaaggctgtgtgcatgaatggaacagaagctgcccagctgagcaccaagagcagagctgagggccgggcccccaacccagccaggaaggcctgcagcgccagcagcaagatccggcggctgagcgcctgcaagcagcagtag

SEQ ID NO: 21808 - DNA, 1299 bp, Artificial Sequence
  Description of Artificial Sequence: Synthetic coding sequence
atggaggtggtggacccccagcagctgggcatgttcacagaaggagagctgatgtctgtgggcatggacaccttcatccacagaattgacagcacagaggtgatctaccagcccaggaggaagagggccaagctgattggcaagtacctgatgggagacctgctgggggagggcagctatggcaaggtgaaggaggtgctggacagcgagaccctgtgccggcgggctgtgaagatcctgaagaagaagaagctgcggcgcatccccaacggggaggccaacgtgaagaaggagatccagctgctgcggcggctgcggcacaagaatgtcatccagctggtggatgtgctgtacaatgaggagaagcagaagatgtacatggtgatggagtactgtgtgtgtggcatgcaggagatgctggacagcgtgcctgagaagcgcttccctgtgtgccaggcccacggctacttctgccagctgattgatggcctggagtacctgcacagccagggcatcgtgcacaaggacatcaagccaggcaacctgctgctgaccaccggcggcaccctgaagatcagtgacctgggcgtggccgaggccctgcacccctttgctgctgatgacacctgcaggaccagccagggcagccctgccttccagcccccagagatcgccaacggcctggacaccttcagcggcttcaaggtggacatctggagcgctggggtgaccctgtacaacatcaccaccggcctgtacccctttgaaggagacaacatctacaagctgtttgaaaatattggcaagggcagctatgccatccctggggactgtggcccccccctgagtgacctgctgaagggcatgctggagtatgagcccgccaagcgcttcagcatccggcagatccggcagcacagctggttcaggaagaagcaccccccagctgaggcccctgtgcccatcccccccagcccagacaccaaggaccgctggaggtccatgacagtggtgccctacctggaggacctgcatggagcagatgaagatgaggacctgtttgatattgaagatgacatcatctacacccaggacttcaccgtgcccggccaggtgcctgaggaggaggccagccacaacggccagaggcggggcctgcccaaggctgtgtgcatgaatggaacagaagctgcccagctgagcaccaagagcagagctgaggccggcccccccaccctgcctgcccggcctgctgccagcagcaagatccggcggctgagcgcctgcaagcagcagtag

SEQ ID NO: 21809 - DNA, 1248 bp, Artificial Sequence
  Description of Artificial Sequence: Synthetic coding sequence
atggaggacctgtgtgtggccaacaccctgtttgccctgaacctcttcaagcacctggccaaggccagccccacccagaacctcttcctgagcccctggagcatcagcagcaccatggccatggtgtacatgggcagccggggcagcacagaggaccagatggccaaggtgctgcagttcaatgaggtgggcgccaatgctgtgacccccatgaccccagagaacttcaccagctgtggcttcatgcagcagatccagaagggcagctacccagatgccatcctgcaggcccaggccgctgacaagatccacagcagcttccgcagcctgagcagcgccatcaatgccagcacaggcaactacctgctggagagcgtgaacaagctgtttggagagaagagcgccagcttccgggaggagtacatccggctgtgccagaagtactacagcagcgagccccaggccgtggacttcctggagtgtgccgaggaggccaggaagaagatcaacagctgggtgaagacccagaccaagggcaagatccccaacctgctgcctgagggctctgtggatggagacaccaggatggtgctggtgaatgctgtgtacttcaagggcaagtggaagaccccatttgagaagaagctgaatggcctgtaccccttccgggtgaacagcgcccagaggacccctgtgcagatgatgtacctgcgggagaagctgaacatcggctacatcgaggacctgaaggcccagatcctggagctgccctatgctggagatgtgtccatgttcctgctgctgcctgatgaaattgctgatgtgtccacaggcctggagctgctggagagcgagatcacctatgacaagctgaacaagtggaccagcaaggacaagatggccgaggatgaggtggaggtgtacatcccccagttcaagctggaggagcactatgagctgcggagcatcctgcgctccatgggcatggaggatgccttcaacaagggccgggccaacttcagcggcatgtctgaaagaaatgacctcttcctgtctgaggtgttccaccaggccatggtggatgtgaatgaggagggcacagaagctgctgctggcactggaggagtgatgacaggccgcactggacatggaggcccccagtttgtggccgaccaccccttcctgttcctgatcatgcacaagatcaccaactgcatcctcttcttcggccgcttcagcagcccctag

SEQ ID NO: 21810 - DNA, 342 bp, Artificial Sequence
  Description of Artificial Sequence: Synthetic coding sequence
atggaggacctgtgtgtggccaacaccctgtttgccctgaacctcttcaagcacctggccaaggccagccccacccagaacctcttcctgagcccctggagcatcagcagcaccatggccatggtgtacatgggcagccggggcagcacagaggaccagatggccaaggtgctgcagttcaatgaggtgggcgccaatgctgtgacccccatgaccccagagaacttcaccagctgtggcttcatgcagcagatccagaagggcagctacccagatgccatcctgcaggcccaggccgctgacaagatccacagcagcttccgcagcctgagcagcgcctag

SEQ ID NO: 21811 - DNA, 486 bp, Artificial Sequence
  Description of Artificial Sequence: Synthetic coding sequence
atggaggacctgtgtgtggccaacaccctgtttgccctgaacctcttcaagcacctggccaaggccagccccacccagaacctcttcctgagcccctggagcatcagcagcaccatggccatggtgtacatgggcagccggggcagcacagaggaccagatggccaaggtgctgcagttcaatgaggtgggcgccaatgctgtgacccccatgaccccagagaacttcaccagctgtggcttcatgcagcagatccagaagggcagctacccagatgccatcctgcaggcccaggccgctgacaagatccacagcagcttccgcagcctgagcagcgccatcaatgccagcacaggcaactacctgctggagagcgtgaacaagctgtttggagagaagagcgccagcttccgggaggagtacatccggctgtgccagaagtactacagcagcgagccccaggccgtggacttcctggagtgctag

SEQ ID NO: 21812 - DNA, 399 bp, Artificial Sequence
  Description of Artificial Sequence: Synthetic coding sequence
atggaggacctgtgtgtggccaacaccctgtttgccctgaacctcttcaagcacctggccaaggccagccccacccagaacctcttcctgagcccctggagcatcagcagcaccatggccatggtgtacatgggcagccggggcagcacagaggaccagatggccaaggtgctgcagttcaatgaggtgggcgccaatgctgtgacccccatgaccccagagaacttcaccagctgtggcttcatgcagcagatccagaagggcagctacccagatgccatcctgcaggcccaggccgctgacaagatccacagcagcttccgcagcctgagcagcgccatcaatgccagcacaggcaactacctgctggagagcgtgaacaagctgtttggagagtag

SEQ ID NO: 21813 - DNA, 1248 bp, Artificial Sequence; identical to SEQ ID NO: 21809
  Description of Artificial Sequence: Synthetic coding sequence

SEQ ID NO: 21814 - DNA, 2280 bp, Artificial Sequence
  Description of Artificial Sequence: Synthetic coding sequence
atggccggcctgaccctgtttgtgggccgcctgccccccagcgcccggtctgagcagctggaggagctgttcagccaggtgggccctgtgaagcagtgctttgtggtgacagagaagggcagcaaggcctgccggggcttcggctacgtgaccttctccatgctggaggatgtgcagagggccctgaaggagatcaccacctttgagggctgcaagatcaacgtgacagtggccaagaagaagctgaggaacaagaccaaggagaagggcaagaatgaaaattctgagtgccccaagaaggagcccaaggccaagaaggccaaggtggccgacaagaaggcccggctcatcatccggaacctgtccttcaagtgcagtgaagatgacctgaagacagtgtttgcccagtttggagctgtgctggaggtgaacatccccaggaagccagatggcaagatgaggggcttcggctttgtgcagttcaagaacctgctggaggccggcaaggccctgaagggcatgaacatgaaggagatcaagggccgcacagtggccgtggactgggccgtggccaaggacaagtacaaggacacccagagcgtgtctgccatcggggaggagaagagccatgagagcaagcaccaggagagcgtgaagaagaagggccgggaggaggaggacatggaggaggaggagaatgatgatgatgatgatgatgatgatgaagaagatggagtgtttgatgatgaagatgaggaggaggagaacatcgagagcaaggtgaccaagcctgtgcagatccagaagagagctgtgaagaggcctgccccagccaagagcagtgaccacagcgaggaggacagcgacctggaggagagtgacagcattgatgatggagaggagctggcccagagcgacaccagcacagaggagcaggaggacaaggctgtgcaggtgagcaacaagaagaagaggaagctgcccagtgatgtgaatgaaggcaagacagtgttcatccggaacctgagctttgacagcgaggaggaggagctgggggagctgctgcagcagtttggagagctgaagtatgtgcgcatcgtgctgcacccagacacagagcacagcaagggctgtgcctttgcccagttcatgacccaggaggccgcccagaagtgcctgctggccgccagcccagaaaatgaggccggcggcctgaagctggatggccggcagctgaaggtggacctggccgtgaccagagatgaagctgccaagctgcagaccaccaaggtgaagaagcccaccggcaccaggaacctgtacctggcccgggagggcctcatccgggccggcaccaaggctgctgagggcgtgtctgctgctgacatggccaagcgggagagatttgagctgctgaagcaccagaagctgaaggaccagaacatctttgtgtccaggacccggctgtgcctgcacaacctgcccaaggctgtggatgacaagcagctgaggaagctgctgctgagcgccaccagcggggagaagggcgtgcgcatcaaggaatgtcgggtgatgagggacctgaagggcgtgcacggcaacatgaagggccagagcctgggctacgcctttgctgagttccaggagcacgagcacgccctgaaggccctgcggctcatcaacaacaaccctgagatcttcggccccctgaagaggcccatcgtggagttcagcctggaggacaggaggaagctgaagatgaaggagctgcgcatccagaggagcctgcagaagatgaggagcaagccagccactggagagccccagaagggccagcctgagcccgccaaggaccagcagcagaaggccgcccagcaccacacagaggagcagagcaaggtgcccccagagcagaagaggaaggccggcagcacctcctggacaggcttccagaccaaggccgaggtggagcaggtggagctgcctgatggcaagaagaggaggaaggtgctggccctgcccagccaccggggccccaagatccggctgcgggacaagggcaaggtgaagcctgtgcaccccaagaagcccaagccccagatcaaccagtggaagcaggagaagcagcagctgagcagcgagcaggtgtccaggaagaaggccaagggcaacaagacagagacccgcttcaaccagctggtggagcagtacaagcagaagctgctgggccccagcaagggggcccccctggccaagaggagcaagtggtttgacagctag

SEQ ID NO: 21815 - DNA, 1164 bp, Artificial Sequence
  Description of Artificial Sequence: Synthetic coding sequence
atgcagatgagccctgccctgacctgcctggtgctgggcctggccctggtgtttggagagggcagcgctgtgcaccaccccccatcctatgtggcccaggccagcaaggacagaaatgtggtgttcagcccctatggagtggcctctgtgctggccatgctgcagctgaccaccggcggggagacccagcagcagatccaggccgccatgggcttcaagattgatgacaagggcatggccccagccctgcggcacctgtacaaggagctgatgggcccctggaacaaggatgagatcagcaccacagatgccatctttgtgcagagggacctgaagctggtgcagggcttcatgccccacttcttccgcctcttccgcagcacagtgaagcaggtggacttcagcgaggtggagcgggcccgcttcatcatcaatgactgggtgaagacccacaccaagggcatgatcagcaacctgctgggcaaaggagctgtggaccagctgacccggctggtgctggtgaatgccctgtacttcaacggccagtggaagacccccttcccagacagcagcacccaccggcggctcttccacaagagtgatggcagcacagtgtctgtgcccatgatggcccagaccaacaagttcaactacacagagttcaccaccccagatggccactactatgacatcctggagctgccctaccatggagacaccctgtccatgtttattgctgccccctatgagaaggaggtgcccctgagcgccctgaccaacatcctgagcgcccagctgatcagccactggaagggcaacatgacccggctgccccggctgctggtgctgcccaagttcagcctggagacagaggtggacctgaggaagcccctggagaacctgggcatgacagacatgttccggcagttccaggccgacttcaccagcctgagtgaccaggagcccctgcacgtggcccaggccctgcagaaggtgaagattgaggtgaatgaaagtggcaccgtggccagcagcagcacagctgtgattgtgtctgccaggatggcccctgaggagatcatcatggaccggcccttcctgtttgtggtgcgccacaaccccactggaacagtgctcttcatgggccaggtgatggagccctag

SEQ ID NO: 21816 - DNA, 540 bp, Artificial Sequence
  Description of Artificial Sequence: Synthetic coding sequence
atgatggcccagaccaacaagttcaactacacagagttcaccaccccagatggccactactatgacatcctggagctgccctaccatggagacaccctgtccatgtttattgctgccccctatgagaaggaggtgcccctgagcgccctgaccaacatcctgagcgcccagctgatcagccactggaagggcaacatgacccggctgccccggctgctggtgctgcccaagttcagcctggagacagaggtggacctgaggaagcccctggagaacctgggcatgacagacatgttccggcagttccaggccgacttcaccagcctgagtgaccaggagcccctgcacgtggcccaggccctgcagaaggtgaagattgaggtgaatgaaagtggcaccgtggccagcagcagcacagctgtgattgtgtctgccaggatggcccctgaggagatcatcatggaccggcccttcctgtttgtggtgcgccacaaccccactggaacagtgctcttcatgggccaggtgatggagccctag

SEQ ID NO: 21817 - DNA, 711 bp, Artificial Sequence
  Description of Artificial Sequence: Synthetic coding sequence
atgctgagcaagggcctgaagaggaagcgggaggaggaggaggagaaggagcccctggccgtggacagctggtggctggaccccggccacacagctgtggcccaggcccctcctgctgtggccagcagcagcctgtttgacctgtctgtgctgaagctgcaccacagcctgcagcagagcgagccagacctgcggcacctggtgctggtggtgaacaccctgcggcgcatccaggcctccatggccccagctgctgccctgccccctgtgcccagccccccagctgcccccagcgtggccgacaacctgctggccagcagtgatgctgccctgagcgcctccatggccagcctgctggaggacctgagccacatcgagggcctgagccaggccccccagcccctggctgatgagggccccccaggccgcagcattggaggagctgcccccagcctgggcgccctggacctgctgggccctgccaccggctgcctgctggatgatggcctggagggcctgtttgaagatattgacacctccatgtatgacaatgagctgtgggccccagccagcgagggcctgaagccaggcccagaagatggccctgggaaggaggaggcccctgagctggatgaagctgagctggactacctgatggatgtgctggtgggcacccaggccctggagaggcctcctggccctggccgctag

SEQ ID NO: 21818 - DNA, 1527 bp, Artificial Sequence
  Description of Artificial Sequence: Synthetic coding sequence
atgctgcccacccaggccggggctgctgctgccctgggccggggcagcgccctgggcggcagcctgaacagaacacccaccggccggcctgggggcggcggcggcaccaggggggccaacggcggccgggtgcctggaaatggagctggcctgggccctggccgcctggagcgggaggccgctgctgctgctgccaccaccccagcccccacagctggggccctgtacagcggcagcgagggggacagcgagagcggggaggaggaggagctgggcgctgagcggcggggcctgaagaggagcctgtctgagatggagatcggcatggtggtgggcggccctgaggccagcgctgctgccactggaggctacggccctgtgtctggagctgtgtctggggccaagccaggcaagaagacccggggccgggtgaagatcaagatggagttcatcgacaacaagctgcggcgctacaccaccttcagcaagaggaagacaggcatcatgaagaaggcctatgagctgagcaccctgaccggcacccaggtgctgctgctggtggccagcgagactggacatgtgtacacctttgccaccaggaagctgcagcccatgatcaccagcgagaccgggaaggccctgatccagacctgcctgaacagcccagacagccccccaagaagtgaccccaccacagaccagaggatgtctgccactggatttgaggagacagacctgacctaccaggtgtctgagagtgacagcagcggggagaccaaggacaccctgaagccagccttcaccgtgaccaacctgcccggcaccaccagcaccatccagacagcccccagcaccagcaccaccatgcaggtgagcagcggccccagcttccccatcaccaactacctggcccctgtgtctgcctctgtgagccccagcgctgtgtcctctgccaatggaacagtgctgaagagcacaggcagcggccctgtgtcctctgggggcctgatgcagctgcccaccagcttcaccctgatgcctggaggagctgtggcccagcaggtgcctgtgcaggccatccaggtgcaccaggccccccagcaggccagccccagccgggacagcagcacagacctgacccagaccagcagcagcggcaccgtgaccctgcctgccaccatcatgaccagctctgtgcccaccaccgtgggcggccacatgatgtaccccagcccccatgctgtgatgtatgcccccaccagcggcctgggagatggcagcctgactgtgctgaatgccttcagccaggcccccagcaccatgcaggtgagccacagccaggtgcaggagcctggaggagtgccccaggtgttcctgacagccagcagcggcaccgtgcagatccctgtgtctgctgtgcagctgcaccagatggctgtgattggccagcaggccggcagcagcagcaacctgacagagctgcaggtggtgaacctggacacagcccacagcaccaagtctgagtag

SEQ ID NO: 21819 - DNA, 915 bp, Artificial Sequence
  Description of Artificial Sequence: Synthetic coding sequence
atgatcaccagcgagaccgggaaggccctgatccagacctgcctgaacagcccagacagccccccaagaagtgaccccaccacagaccagaggatgtctgccactggatttgaggagacagacctgacctaccaggtgtctgagagtgacagcagcggggagaccaaggacaccctgaagccagccttcaccgtgaccaacctgcccggcaccaccagcaccatccagacagcccccagcaccagcaccaccatgcaggtgagcagcggccccagcttccccatcaccaactacctggcccctgtgtctgcctctgtgagccccagcgctgtgtcctctgccaatggaacagtgctgaagagcacaggcagcggccctgtgtcctctgggggcctgatgcagctgcccaccagcttcaccctgatgcctggaggagctgtggcccagcaggtgcctgtgcaggccatccaggtgcaccaggccccccagcaggccagccccagccgggacagcagcacagacctgacccagaccagcagcagcggcaccgtgaccctgcctgccaccatcatgaccagctctgtgcccaccaccgtgggcggccacatgatgtaccccagcccccatgctgtgatgtatgcccccaccagcggcctgggagatggcagcctgactgtgctgaatgccttcagccaggcccccagcaccatgcaggtgagccacagccaggtgcaggagcctggaggagtgccccaggtgttcctgacagccagcagcggcaccgtgcagatccctgtgtctgctgtgcagctgcaccagatggctgtgattggccagcaggccggcagcagcagcaacctgacagagctgcaggtggtgaacctggacacagcccacagcaccaagtctgagtag

SEQ ID NO: 21820 - DNA, 834 bp, Artificial Sequence
  Description of Artificial Sequence: Synthetic coding sequence
atgtctgccccagctgccaaggtgtccaagaaggagctgaacagcaaccatgatggagcagatgagaccagcgagaaggagcagcaggaggccatcgagcacattgatgaggtgcagaatgaaattgaccggctgaatgagcaggccagcgaggagatcctgaaggtggagcagaagtacaacaagctgcggcagcccttcttccagaagaggtctgagctgattgccaagatccccaacttctgggtgaccacctttgtgaaccacccccaggtgtctgccctgctgggggaggaggatgaggaggccctgcactacctgaccagggtggaggtgacagaatttgaggacatcaagagcggctacagaattgacttctactttgatgagaacccctactttgagaacaaggtgctgagcaaggagttccacctgaatgaaagtggggaccccagcagcaagagcacagagatcaagtggaagagcggcaaggacctgaccaagaggagcagccagacccagaacaaggccagcaggaagaggcagcacgaggagcctgagagcttcttcacctggttcacagaccacagtgatgctggagcagatgagctgggggaggtgatcaaggatgacatctggcccaaccccctgcagtactacctggtgcctgacatggatgatgaggagggggagggggaggaggatgatgatgatgatgaggaggaggagggcctggaggacattgatgaggagggagatgaagatgaaggagaagaagatgaagatgatgatgaaggagaggagggggaggaggatgaaggagaagatgactag

SEQ ID NO: 21821 - DNA, 798 bp, Artificial Sequence
  Description of Artificial Sequence: Synthetic coding sequence
atgcccaggagccaccagcccccacctcctcctcatgagaaggagcagcaggaggccatcgagcacattgatgaggtgcagaatgaaattgaccggctgaatgagcaggccagcgaggagatcctgaaggtggagcagaagtacaacaagctgcggcagcccttcttccagaagaggtctgagctgattgccaagatccccaacttctgggtgaccacctttgtgaaccacccccaggtgtctgccctgctgggggaggaggatgaggaggccctgcactacctgaccagggtggaggtgacagaatttgaggacatcaagagcggctacagaattgacttctactttgatgagaacccctactttgagaacaaggtgctgagcaaggagttccacctgaatgaaagtggggaccccagcagcaagagcacagagatcaagtggaagagcggcaaggacctgaccaagaggagcagccagacccagaacaaggccagcaggaagaggcagcacgaggagcctgagagcttcttcacctggttcacagaccacagtgatgctggagcagatgagctgggggaggtgatcaaggatgacatctggcccaaccccctgcagtactacctggtgcctgacatggatgatgaggagggggagggggaggaggatgatgatgatgatgaggaggaggagggcctggaggacattgatgaggagggagatgaagatgaaggagaagaagatgaagatgatgatgaaggagaggagggggaggaggatgaaggagaagatgactag

SEQ ID NO: 21822 - DNA, 801 bp, Artificial Sequence
  Description of Artificial Sequence: Synthetic coding sequence
atgatgcccaggagccaccagcccccacctcctcctcatgagaaggagcagcaggaggccatcgagcacattgatgaggtgcagaatgaaattgaccggctgaatgagcaggccagcgaggagatcctgaaggtggagcagaagtacaacaagctgcggcagcccttcttccagaagaggtctgagctgattgccaagatccccaacttctgggtgaccacctttgtgaaccacccccaggtgtctgccctgctgggggaggaggatgaggaggccctgcactacctgaccagggtggaggtgacagaatttgaggacatcaagagcggctacagaattgacttctactttgatgagaacccctactttgagaacaaggtgctgagcaaggagttccacctgaatgaaagtggggaccccagcagcaagagcacagagatcaagtggaagagcggcaaggacctgaccaagaggagcagccagacccagaacaaggccagcaggaagaggcagcacgaggagcctgagagcttcttcacctggttcacagaccacagtgatgctggagcagatgagctgggggaggtgatcaaggatgacatctggcccaaccccctgcagtactacctggtgcctgacatggatgatgaggagggggagggggaggaggatgatgatgatgatgaggaggaggagggcctggaggacattgatgaggagggagatgaagatgaaggagaggaggatgaagatgatgatgaaggagaggagggggaggaggatgaaggagaagatgactag

SEQ ID NO: 21823 - DNA, 873 bp, Artificial Sequence
  Description of Artificial Sequence: Synthetic coding sequence
atggcccccaagaggcagagccccctgcccccccagaagaagaagccccggcccccaccagccctgggccctgaggagaccagcgccagcgctggcctgcccaagaagggggagaaggagcagcaggaggccatcgagcacattgatgaggtgcagaatgaaattgaccggctgaatgagcaggccagcgaggagatcctgaaggtggagcagaagtacaacaagctgcggcagcccttcttccagaagaggtctgagctgattgccaagatccccaacttctgggtgaccacctttgtgaaccacccccaggtgtctgccctgctgggggaggaggatgaggaggccctgcactacctgaccagggtggaggtgacagaatttgaggacatcaagagcggctacagaattgacttctactttgatgagaacccctactttgagaacaaggtgctgagcaaggagttccacctgaatgaaagtggggaccccagcagcaagagcacagagatcaagtggaagagcggcaaggacctgaccaagaggagcagccagacccagaacaaggccagcaggaagaggcagcacgaggagcctgagagcttcttcacctggttcacagaccacagtgatgctggagcagatgagctgggggaggtgatcaaggatgacatctggcccaaccccctgcagtactacctggtgcctgacatggatgatgaggagggggagggggaggaggatgatgatgatgatgaggaggaggagggcctggaggacattgatgaggagggagatgaagatgaaggagaggaggatgaagatgatgatgaaggagaggagggggaggaggatgaaggagaagatgactag

SEQ ID NO: 21824 - DNA, 807 bp, Artificial Sequence
  Description of Artificial Sequence: Synthetic coding sequence
atgggctgccgggacctgctgcccagcctgaagcccaccctgctggagaaggagcagcaggaggccatcgagcacattgatgaggtgcagaatgaaattgaccggctgaatgagcaggccagcgaggagatcctgaaggtggagcagaagtacaacaagctgcggcagcccttcttccagaagaggtctgagctgattgccaagatccccaacttctgggtgaccacctttgtgaaccacccccaggtgtctgccctgctgggggaggaggatgaggaggccctgcactacctgaccagggtggaggtgacagaatttgaggacatcaagagcggctacagaattgacttctactttgatgagaacccctactttgagaacaaggtgctgagcaaggagttccacctgaatgaaagtggggaccccagcagcaagagcacagagatcaagtggaagagcggcaaggacctgaccaagaggagcagccagacccagaacaaggccagcaggaagaggcagcacgaggagcctgagagcttcttcacctggttcacagaccacagtgatgctggagcagatgagctgggggaggtgatcaaggatgacatctggcccaaccccctgcagtactacctggtgcctgacatggatgatgaggagggggagggggaggaggatgatgatgatgatgaggaggaggagggcctggaggacattgatgaggagggagatgaagatgaaggagaggaggatgaagatgatgatgaaggagaggagggggaggaggatgaaggagaagatgactag

SEQ ID NO: 21825 - DNA, 99 bp, Artificial Sequence
  Description of Artificial Sequence: Synthetic coding sequence
atggcccccaagaggcagagccccctgcccccccagaagaagaagccccggcccccaccagccctgggccctgaggagaccagcgccagcgctggatag

SEQ ID NO: 21826 - DNA, 942 bp, Artificial Sequence
  Description of Artificial Sequence: Synthetic coding sequence
atgaccgggaaggccaccccacccagcctgtacagctggaggggcgtgctcttcacctgcctgcctgctgcccggaccaggaagaggaaggagatgagccggcagacagccacagccctgcccaccggcaccagcaagtgcccccccagccagagggtgcctgccctgaccggcaccacagccagcaacaatgacctggccagcctgtttgaatgtcctgtgtgctttgattatgtgctgccccccatcctgcagtgccagagcggccacctggtgtgcagcaactgccggcccaagctgacctgctgccccacctgccggggccccctgggcagcatccggaacctggccatggagaaggtggccaacagcgtgctcttcccctgcaagtatgccagcagcggctgtgagatcaccctgccccacacagagaaggctgaccacgaggagctgtgtgagttccggccctacagctgcccctgccctggggccagctgcaagtggcagggcagcctggatgctgtgatgccccacctgatgcaccagcacaagagcatcaccaccctgcagggcgaggacatcgtgttcctggccacagacatcaacctgcccggggctgtggactgggtgatgatgcagagctgcttcggcttccacttcatgctggtgctggagaagcaggagaagtatgatggccaccagcagttctttgccatcgtgcagctgattggcaccaggaagcaggccgagaactttgcctaccgcctggagctgaatggccacagaagaaggctgacctgggaggccacccccaggagcatccacgagggcatcgccacagccatcatgaacagcgactgcctggtgtttgacaccagcatcgcccagctgtttgctgaaaatggaaacctgggcatcaacgtgaccatctccatgtgctag

SEQ ID NO: 21827 - DNA, 897 bp, Artificial Sequence
  Description of Artificial Sequence: Synthetic coding sequence
atggtgatcatcatcttcctgctgcccccctacgtgttcatcagcgagatgagccggcagacagccacagccctgcccaccggcaccagcaaatgtcctcccagccagagggtgcctgccctgaccggcaccacagccagcaacaatgacctggccagcctgtttgagtgccctgtgtgctttgattatgtgctgccccccatcctgcagtgccagagcggccacctggtgtgcagcaactgccggcccaagctgacctgctgccccacctgccggggccccctgggcagcatccggaacctggccatggagaaggtggccaacagcgtgctcttcccctgcaagtatgccagcagcggctgtgagatcaccctgccccacacagagaaggctgaccacgaggagctgtgtgagttccggccctacagctgcccctgccctggggccagctgcaagtggcagggcagcctggatgctgtgatgccccacctgatgcaccagcacaagagcatcaccaccctgcagggagaagatattgtgttcctggccacagacatcaacctgcctggagctgtggactgggtgatgatgcagagctgcttcggcttccacttcatgctggtgctggagaagcaggagaagtatgatggccaccagcagttctttgccatcgtgcagctgattggcaccaggaagcaggctgaaaattttgcctaccgcctggagctgaatggccacagaagaaggctgacctgggaggccacccccaggagcatccacgagggcatcgccacagccatcatgaacagcgactgcctggtgtttgacaccagcatcgcccagctgtttgctgaaaatggaaacctgggcatcaacgtgaccatctccatgtgctag

SEQ ID NO: 21828 - DNA, 849 bp, Artificial Sequence
  Description of Artificial Sequence: Synthetic coding sequence
atgagccggcagacagccacagccctgcccaccggcaccagcaaatgtcctcccagccagagggtgcctgccctgaccggcaccacagccagcaacaatgacctggccagcctgtttgagtgccctgtgtgctttgattatgtgctgccccccatcctgcagtgccagagcggccacctggtgtgcagcaactgccggcccaagctgacctgctgccccacctgccggggccccctgggcagcatccggaacctggccatggagaaggtggccaacagcgtgctcttcccctgcaagtatgccagcagcggctgtgagatcaccctgccccacacagagaaggctgaccacgaggagctgtgtgagttccggccctacagctgcccctgccctggggccagctgcaagtggcagggcagcctggatgctgtgatgccccacctgatgcaccagcacaagagcatcaccaccctgcagggagaagatattgtgttcctggccacagacatcaacctgcctggagctgtggactgggtgatgatgcagagctgcttcggcttccacttcatgctggtgctggagaagcaggagaagtatgatggccaccagcagttctttgccatcgtgcagctgattggcaccaggaagcaggctgaaaattttgcctaccgcctggagctgaatggccacagaagaaggctgacctgggaggccacccccaggagcatccacgagggcatcgccacagccatcatgaacagcgactgcctggtgtttgacaccagcatcgcccagctgtttgctgaaaatggaaacctgggcatcaacgtgaccatctccatgtgctag

SEQ ID NO: 21829 - DNA, 708 bp, Artificial Sequence
  Description of Artificial Sequence: Synthetic coding sequence
atgacctttgacctgaccaagatcaccaagaccagcagcagctttgaggtgaggacctgggaccctgagggcgtcatcttctacggggacaccaaccccaaggatgactggttcatgctgggcctgagagatggccggcctgagatccagctgcacaaccactgggcccagctgactgtgggcgccggcccccggctggatgatggccgctggcaccaggtggaggtgaagatggagggggacagcgtgctgctggaggtggatggagaggaggtgctgcggctgcggcaggtgtctggccccctgaccagcaagaggcaccccatcatgagaattgccctgggcggcctgctcttccctgccagcaacctgcggctgcccctggtgcctgccctggatggctgcctgcggcgggacagctggctggacaagcaggccgagatcagcgccagcgcccccaccagcctgcggagctgtgatgtggagagcaaccctggcatcttcctgcccccaggcacccaggccgagttcaacctgcgggacatcccccagccccatgctgagccctgggccttcagcctggacctgggcctgaagcaggccgccggcagcggccacctgctggccctgggcaccccagagaaccccagctggctgagcctgcacctgcaggaccaggagaagaccctgccccccctgtttgcctag

SEQ ID NO: 21830 - DNA, 1209 bp, Artificial Sequence
  Description of Artificial Sequence: Synthetic coding sequence
atggagagccggggccccctggccaccagccggctgctgctgctgctgctgctgctgctgctgcggcacacccggcagggctgggccctgcggcctgtgctgcccacccagagcgcccatgaccccccagctgtgcacctgagcaatggacctggccaggagcccatcgctgtgatgacctttgacctgaccaagatcaccaagaccagcagcagctttgaggtgaggacctgggaccctgagggcgtcatcttctacggggacaccaaccccaaggatgactggttcatgctgggcctgagagatggccggcctgagatccagctgcacaaccactgggcccagctgactgtgggcgccggcccccggctggatgatggccgctggcaccaggtggaggtgaagatggagggggacagcgtgctgctggaggtggatggagaggaggtgctgcggctgcggcaggtgtctggccccctgaccagcaagaggcaccccatcatgagaattgccctgggcggcctgctcttccctgccagcaacctgcggctgcccctggtgcctgccctggatggctgcctgcggcgggacagctggctggacaagcaggccgagatcagcgccagcgcccccaccagcctgcggagctgtgatgtggagagcaaccctggcatcttcctgcccccaggcacccaggccgagttcaacctgcgggacatcccccagccccatgctgagccctgggccttcagcctggacctgggcctgaagcaggccgccggcagcggccacctgctggccctgggcaccccagagaaccccagctggctgagcctgcacctgcaggaccagaaggtggtgctgagcagcggcagcggccctggcctggacctgcccctggtgctgggcctgcccctgcagctgaagctgtccatgagccgggtggtgctgagccagggcagcaagatgaaggccctggccctgccccccctgggcctggcccccctgctgaacctgtgggccaagccccagggccgcctcttcctgggcgccctgcctggagaggacagcagcaccagcttctgcctgaatggcctgtgggcccagggccagaggctggatgtggaccaggccctgaacagaagccatgagatctggacccacagctgcccccagagccctggaaatggaacagatgccagccactag

SEQ ID NO: 21831 - DNA, 882 bp, Artificial Sequence
  Description of Artificial Sequence: Synthetic coding sequence
atggagagccggggccccctggccaccagccggctgctgctgctgctgctgctgctgctgctgcggcacacccggcagggctgggccctgcggcctgtgctgcccacccagagcgcccatgaccccccagctgtgcacctgagcaatggacctggccaggagcccatcgctgtgatgacctttgacctgaccaagatcaccaagaccagcagcagctttgaggtgaggacctgggaccctgagggcgtcatcttctacggggacaccaaccccaaggatgactggttcatgctgggcctgagagatggccggcctgagatccagctgcacaaccactgggcccagctgactgtgggcgccggcccccggctggatgatggccgctggcaccaggtggaggtgaagatggagggggacagcgtgctgctggaggtggatggagaggaggtgctgcggctgcggcaggtgtctggccccctgaccagcaagaggcaccccatcatgagaattgccctgggcggcctgctcttccctgccagcaacctgcggctgcccctggtgcctgccctggatggctgcctgcggcgggacagctggctggacaagcaggccgagatcagcgccagcgcccccaccagcctgcggagctgtgatgtggagagcaaccctggcatcttcctgcccccaggcacccaggccgagttcaacctgcgggacatcccccagccccatgctgagccctgggccttcagcctggacctgggcctgaagcaggccgccggcagcggccacctgctggccctgggcaccccagagaaccccagctggctgagcctgcacctgcaggaccaggagaagaccctgccccccctgtttgcctag

SEQ ID NO: 21832 - DNA, 720 bp, Artificial Sequence
  Description of Artificial Sequence: Synthetic coding sequence
atggagagccggggccccctggccaccagccggctgctgctgctgctgctgctgctgctgctgcggcacacccggcagggctgggccctgcggcctgtgctgcccacccagagcgcccatgaccccccagctgtgcacctgagcaatggacctggccaggagcccatcgctgtgatgacctttgacctgaccaagatcaccaagaccagcagcagctttgaggtgaggacctgggaccctgagggcgtcatcttctacggggacaccaaccccaaggatgactggttcatgctgggcctgagagatggccggcctgagatccagctgcacaaccactgggcccagctgactgtgggcgccggcccccggctggatgatggccgctggcaccagctggtgcctgccctggatggctgcctgcggcgggacagctggctggacaagcaggccgagatcagcgccagcgcccccaccagcctgcggagctgtgatgtggagagcaaccctggcatcttcctgcccccaggcacccaggccgagttcaacctgcgggacatcccccagccccatgctgagccctgggccttcagcctggacctgggcctgaagcaggccgccggcagcggccacctgctggccctgggcaccccagagaaccccagctggctgagcctgcacctgcaggaccaggagaagaccctgccccccctgtttgcctag

SEQ ID NO: 21833 - DNA, 864 bp, Artificial Sequence
  Description of Artificial Sequence: Synthetic coding sequence
atggagagccggggccccctggccaccagccggctgctgctgctgctgctgctgctgctgctgcggcacacccggcagggctgggccctgcggcctgtgctgcccacccagagcgcccatgaccccccagctgtgcacctgagcaatggacctggccaggagcccatcgctgtgatgacctttgacctgaccaagatcaccaagaccagcagcagctttgaggtgaggacctgggaccctgagggcgtcatcttctacggggacaccaaccccaaggatgactggttcatgctgggcctgagagatggccggcctgagatccagctgcacaaccactgggcccagctgactgtgggcgccggcccccggctggatgatggccgctggcaccaggtggaggtgaagatggagggggacagcgtgctgctggaggtggatggagaggaggtgctgcggctgcggcaggtgtctggccccctgaccagcaagaggcaccccatcatgagaattgccctgggcggcctgctcttccctgccagcaacctgcggctgcccctggtgcctgccctggatggctgcctgcggcgggacagctggctggacaagcaggccgagatcagcgccagcgcccccaccagcctgcggagctgtgatgtggagagcaaccctggcatcttcctgcccccaggcacccaggccgagttcaacctgcggggggaggacagcagcaccagcttctgcctgaatggcctgtgggcccagggccagaggctggatgtggaccaggccctgaacagaagccatgagatctggacccacagctgcccccagagccctggaaatggaacagatgccagccactag

SEQ ID NO: 21834 - DNA, 423 bp, Artificial Sequence
  Description of Artificial Sequence: Synthetic coding sequence
atggagagccggggccccctggccaccagccggctgctgctgctgctgctgctgctgctgctgcggcacacccggcagggctgggccctgcggcctgtgctgcccacccagagcgcccatgaccccccagctgtgcacctgagcaatggacctggccaggagcccatcgctgtgatgacctttgacctgaccaagatcaccaagaccagcagcagctttgaggtgaggacctgggaccctgagggcgtcatcttctacggggacaccaaccccaaggatgactggttcatgctgggcctgagagatggccggcctgagatccagctgcacaaccactgggcccagctgactgtgggcgccggcccccggctggatgatggccgctggcaccaggagaagaccctgccccccctgtttgcctag

SEQ ID NO: 21835 - DNA, 1155 bp, Artificial Sequence
  Description of Artificial Sequence: Synthetic coding sequence
atggagagccggggccccctggccaccagccggctgctgctgctgctgctgctgctgctgctgcggcacacccggcagggctgggccctgcggcctgtgctgcccacccagagcgcccatgaccccccagctgtgcacctgagcaatggacctggccaggagcccatcgctgtgatgacctttgacctgaccaagatcaccaagaccagcagcagctttgaggtgaggacctgggaccctgagggcgtcatcttctacggggacaccaaccccaaggatgactggttcatgctgggcctgagagatggccggcctgagatccagctgcacaaccactgggcccagctgactgtgggcgccggcccccggctggatgatggccgctggcaccaggtggaggtgaagatggagggggacagcgtgctgctggaggtggatggagaggaggtgctgcggctgcggcaggtgtctggccccctgaccagcaagaggcaccccatcatgagaattgccctgggcggcctgctcttccctgccagcaacctgcggctgcctgctgagatcagcgccagcgcccccaccagcctgcggagctgtgatgtggagagcaaccctggcatcttcctgcccccaggcacccaggccgagttcaacctgcgggacatcccccagccccatgctgagccctgggccttcagcctggacctgggcctgaagcaggccgccggcagcggccacctgctggccctgggcaccccagagaaccccagctggctgagcctgcacctgcaggaccagaaggtggtgctgagcagcggcagcggccctggcctggacctgcccctggtgctgggcctgcccctgcagctgaagctgtccatgagccgggtggtgctgagccagggcagcaagatgaaggccctggccctgccccccctgggcctggcccccctgctgaacctgtgggccaagccccagggccgcctcttcctgggcgccctgcctggagaggacagcagcaccagcttctgcctgaatggcctgtgggcccagggccagaggctggatgtggaccaggccctgaacagaagccatgagatctggacccacagctgcccccagagccctggaaatggaacagatgccagccactag

SEQ ID NO: 21836 - DNA, 1116 bp, Artificial Sequence
  Description of Artificial Sequence: Synthetic coding sequence
atgagccccagcaccttccagatcacagacatgaccaggaggagctgccagaacctgggctacacagctgccagcccccaggcccctgaggccgccagcaacacaggaaatgctgagagagctgaggaggtgcctggagagggcagcctcttcctgcaggccgagacccgggcctggttccagaagacccaggcccactggctgctgcagcacggggccgccccagcctggttccacggcttcatcacccggcgggaggccgagcggctgctggagcccaagccccagggctgctacctggtgcgcttcagcgagagcgctgtgacctttgtgctgacctaccgcagcaggacctgctgccgccacttcctgctggcccagctgagagatggaagacatgtggtgctgggggaggacagcgcccacgcccggctgcaggacctgctgctgcactacacagcccaccccctgagcccctacggggagaccctgacagagcccctggcccggcagaccccagagcccgccggcctgagcctgaggacagaggagagcaactttggcagcaagagccaggaccccaacccccagtacagccccatcatcaagcagggccaggcccctgtgcccatgcagaaggagggcgctggggagaaggagcccagccagctgctgcggcccaagccacccatcccagccaagccccagctgcccccagaggtgtacaccatccctgtgcccaggcacaggcctgccccccggcccaagcccagcaaccccatctacaatgaaccagatgagcccatcgccttctacgccatgggccggggcagccctggagaggcccccagcaacatctacgtggaggtggaggatgagggcctgcctgccaccctgggccaccctgtgctgaggaagtcctggagcaggcctgtgcctgggggccagaacacaggaggcagccagctgcacagcgagaacagcgtcatcggccagggcccccccctgccccaccagcccccaccagcctggaggcacaccctgccccacaacctgagccggcaggtgctgcaggaccggggccaggcctggctgcccctgggccccccccagtag

SEQ ID NO: 21837 - DNA, 1170 bp, Artificial Sequence
  Description of Artificial Sequence: Synthetic coding sequence
atggagttccccctggcccagatctgcccccagggcagccatgaggcccccatccccaccttcagcaccttccagatcacagacatgaccaggaggagctgccagaacctgggctacacagctgccagcccccaggcccctgaggccgccagcaacacaggaaatgctgagagagctgaggaggtgcctggagagggcagcctcttcctgcaggccgagacccgggcctggttccagaagacccaggcccactggctgctgcagcacggggccgccccagcctggttccacggcttcatcacccggcgggaggccgagcggctgctggagcccaagccccagggctgctacctggtgcgcttcagcgagagcgctgtgacctttgtgctgacctaccgcagcaggacctgctgccgccacttcctgctggcccagctgagagatggaagacatgtggtgctgggggaggacagcgcccacgcccggctgcaggacctgctgctgcactacacagcccaccccctgagcccctacggggagaccctgacagagcccctggcccggcagaccccagagcccgccggcctgagcctgaggacagaggagagcaactttggcagcaagagccaggaccccaacccccagtacagccccatcatcaagcagggccaggcccctgtgcccatgcagaaggagggcgctggggagaaggagcccagccagctgctgcggcccaagccacccatcccagccaagccccagctgcccccagaggtgtacaccatccctgtgcccaggcacaggcctgccccccggcccaagcccagcaaccccatctacaatgaaccagatgagcccatcgccttctacgccatgggccggggcagccctggagaggcccccagcaacatctacgtggaggtggaggatgagggcctgcctgccaccctgggccaccctgtgctgaggaagtcctggagcaggcctgtgcctgggggccagaacacaggaggcagccagctgcacagcgagaacagcgtcatcggccagggcccccccctgccccaccagcccccaccagcctggaggcacaccctgccccacaacctgagccggcaggtgctgcaggaccggggccaggcctggctgcccctgggccccccccagtag

SEQ ID NO: 21838 - DNA, 1200 bp, Artificial Sequence
  Description of Artificial Sequence: Synthetic coding sequence
atggagttccccctggcccagatctgcccccagggcagccatgaggcccccatccccaccttcagcaccttccagatcacagacatgaccaggaggagctgccagaacctgggctacacagctgccagcccccaggcccctgaggccgccagcaacacaggaaatgctgagagagctgaggaggtgcctggagagggcagcctcttcctgcaggccgagacccgggcctggttccagaagacccaggcccactggctgctgcagcacggggccgccccagcctggttccacggcttcatcacccggcgggtgcggccccccctgtctgtgacccaccgggaggccgagcggctgctggagcccaagccccagggctgctacctggtgcgcttcagcgagagcgctgtgacctttgtgctgacctaccgcagcaggacctgctgccgccacttcctgctggcccagctgagagatggaagacatgtggtgctgggggaggacagcgcccacgcccggctgcaggacctgctgctgcactacacagcccaccccctgagcccctacggggagaccctgacagagcccctggcccggcagaccccagagcccgccggcctgagcctgaggacagaggagagcaactttggcagcaagagccaggaccccaacccccagtacagccccatcatcaagcagggccaggcccctgtgcccatgcagaaggagggcgctggggagaaggagcccagccagctgctgcggcccaagccacccatcccagccaagccccagctgcccccagaggtgtacaccatccctgtgcccaggcacaggcctgccccccggcccaagcccagcaaccccatctacaatgaaccagatgagcccatcgccttctacgccatgggccggggcagccctggagaggcccccagcaacatctacgtggaggtggaggatgagggcctgcctgccaccctgggccaccctgtgctgaggaagtcctggagcaggcctgtgcctgggggccagaacacaggaggcagccagctgcacagcgagaacagcgtcatcggccagggcccccccctgccccaccagcccccaccagcctggaggcacaccctgccccacaacctgagccggcaggtgctgcaggaccggggccaggcctggctgcccctgggccccccccagtag

SEQ ID NO: 21839 - DNA, 2823 bp, Artificial Sequence
  Description of Artificial Sequence: Synthetic coding sequence
atgatcctggagcagtatgtggtggtgagcaactacaagaagcaggagaacagcgagctgagcctgcaggccggggaggtggtggatgtgattgagaagaatgaaagtggctggtggtttgtgtccaccagcgaggagcagggctgggtgcctgccacctacctggaggcccagaatggcaccagagatgacagcgacatcaacaccagcaagacaggagaggaggagaagtatgtgacagtgcagccctacaccagccagagcaaggatgagatcggctttgagaagggcgtgacagtggaggtgatcaggaagaacctggagggctggtggtacatccgctacctgggcaaggagggctgggccccagccagctacctgaagaaggccaaggatgacctgcccaccaggaagaagaacctggccggccctgtggagatcatcggcaacatcatggagatcagcaacctgctgaacaagaaggccagcggggacaaggagaccccacctgctgagggggagggccacgaggcccccatcgccaagaaggagatcagcctgcccatcctgtgcaatgccagcaatggatctgctgtgggcgtgcctgacagaacagtgtcccggctggcccagggcagccctgctgtggccagaattgccccccagagggcccagatcagcagccccaacctgcggacccggcccccaccccggcgggagagcagcctgggcttccagctgcccaagcccccagagcccccatctgtggaggtggagtactacaccatcgccgagttccagagctgcatcagtgatggcatctccttccggggcggccagaaggccgaggtgattgacaagaacagcggcggctggtggtacgtgcagattggagagaaggagggctgggccccagccagctacatcgacaagaggaagaagcccaacctgagcaggaggaccagcaccctgacccggcccaaggtgcccccaccagccccacccagcaagcccaaggaggccgaggagggccccaccggggccagcgagagccaggacagccccaggaagctgaagtatgaggagccagaatatgacatcccagccttcggctttgacagcgagcctgagctgtctgaggagcctgtggaggaccgggccagcggggagaggaggcctgcccagccccaccggcccagccctgccagcagcctgcagagggcccgcttcaaggtgggggagagcagtgaagatgtggccctggaggaggagaccatctatgaaaatgaaggcttccggccctatgcagaggacaccctgagcgcccggggcagcagcggggacagcgacagccctggcagcagcagcctgagcctgaccaggaagaacagccccaagagcggcagccccaagagcagcagcctgctgaagctgaaggccgagaagaatgcccaggccgagatgggcaagaaccacagcagcgccagcttcagcagcagcatcaccatcaacaccacctgctgcagcagcagcagcagcagcagcagcagcctgagcaagaccagcggggacctgaagcccaggtctgccagtgatgctggcatccggggcacccccaaggtgcgggccaagaaggatgctgatgccaatgccggcctgaccagctgcccccgggccaagcccagcgtgcggcccaagcccttcctgaacagagctgagagccagagccaggagaagatggacatcagcaccctgcggcggcagctgcggcccaccggccagctgcggggcggcctgaagggcagcaagtcagaagattctgagctgcccccccagacagccagcgaggcccccagcgagggcagcagaagaagcagcagtgacctgatcaccctgcctgccaccaccccaccctgccccaccaagaaggagtgggagggccctgccaccagctacatgacctgcagcgcctaccagaaggtgcaggacagcgagatctccttccctgctggggtggaggtgcaggtgctggagaagcaggagagcggctggtggtacgtgcgctttggagagctggagggctgggcccccagccactacctggtgctggatgaaaatgagcagcctgaccccagcggcaaggagctggacacagtgcctgccaagggccggcagaatgaaggcaagagtgacagcctggagaagattgaaagaagagtgcaggccctgaacacagtgaaccagagcaagaaggccaccccacccatccccagcaagcccccaggcggctttgggaagaccagcggcaccccagctgtgaagatgagaaatggagtgcggcaggtggccgtgcggccccagagcgtgtttgtgtccccaccacccaaggacaacaacctgagctgtgccctgcggagaaatgaaagcctgacagccacagatggcctgcggggcgtgagaagaaacagcagcttcagcacagcccggtctgctgctgctgaggccaagggccgcctggccgagagagctgccagccagggcagtgacagccccctgctgcctgcccagagaaattccatccctgtgtcccctgtgcggcccaagcccatcgagaagagccagttcatccacaacaacctgaaggatgtgtatgtgtccattgctgactatgaaggagatgaggagacagctggcttccaggagggcgtgtccatggaggtgctggagaggaaccccaacggctggtggtactgccagatcctggatggagtgaagcccttcaagggctgggtgcccagcaactacctggagaagaagaactag

SEQ ID NO: 21840 - DNA, 3318 bp, Artificial Sequence
  Description of Artificial Sequence: Synthetic coding sequence
atgctggcctactgtgtgcaggatgccaccgtggtggatgtggagaagagaagaaaccccagcaagcactacgtgtacatcatcaacgtgacctggagcgacagcaccagccagaccatctaccgccgctacagcaagttctttgacctgcagatgcagctgctggacaagttccccatcgagggcggccagaaggaccccaagcagaggatcatccccttcctgcccgggaagatcctcttccgccgcagccacatcagagatgtggccgtgaagaggctgaagcccattgatgagtactgccgggccctggtgcggctgcccccccacatcagccagtgtgatgaggtgttccgcttctttgaggcccggccagaagatgtgaacccccccaaggaggactatggcagcagcaagaggaagtctgtgtggctgagctcctgggccgagagccccaagaaggatgtgactggagcagatgccacagctgagcccatgatcctggagcagtatgtggtggtgagcaactacaagaagcaggagaacagcgagctgagcctgcaggccggggaggtggtggatgtgattgagaagaatgaaagtggctggtggtttgtgtccaccagcgaggagcagggctgggtgcctgccacctacctggaggcccagaatggcaccagagatgacagcgacatcaacaccagcaagacaggagaggaggagaagtatgtgacagtgcagccctacaccagccagagcaaggatgaaattggatttgagaagggcgtgacagtggaggtgatcaggaagaacctggagggctggtggtacatccgctacctgggcaaggagggctgggccccagccagctacctgaagaaggccaaggatgacctgcccaccaggaagaagaacctggccggccctgtggagatcatcggcaacatcatggagatcagcaacctgctgaacaagaaggccagcggggacaaggagaccccacctgctgagggggagggccacgaggcccccatcgccaagaaggagatcagcctgcccatcctgtgcaatgccagcaatggcagcgctgtgggcgtgcctgacagaacagtgtcccggctggcccagggcagccctgctgtggcccgcatcgccccccagagggcccagatcagcagccccaacctgcggacccggcccccaccaagaagagagagcagcctgggcttccagctgcccaagcccccagagccccccagcgtggaggtggagtactacaccatcgccgagttccagagctgcatcagtgatggcatctccttccggggcggccagaaggccgaggtgattgacaagaacagcggcggctggtggtacgtgcagatcggggagaaggagggctgggccccagccagctacatcgacaagaggaagaagcccaacctgagcaggaggaccagcaccctgacccggcccaaggtgcccccaccagccccacccagcaagcccaaggaggccgaggagggccccactggagccagcgagagccaggacagccccaggaagctgaagtatgaggagccagaatatgacatcccagcctttggatttgattctgagcctgagctgtctgaggagcctgtggaggaccgggccagcggggagcggcggcctgcccagccccaccggcccagccctgccagcagcctgcagagggcccgcttcaaggtgggggagagcagtgaagatgtggccctggaggaggagaccatctatgaaaatgaaggcttccggccctatgcagaggacaccctgagcgcccggggcagcagcggggacagcgacagccctggcagcagcagcctgagcctgaccaggaagaacagccccaagagcggcagccccaagagcagcagcctgctgaagctgaaggccgagaagaatgcccaggccgagatgggcaagaaccacagcagcgccagcttcagcagcagcatcaccatcaacaccacctgctgcagcagcagcagcagcagcagcagcagcctgagcaagaccagcggggacctgaagcccaggtctgccagtgatgctggcatccggggcacccccaaggtgcgggccaagaaggatgctgatgccaatgccggcctgaccagctgcccccgggccaagcccagcgtgcggcccaagcccttcctgaacagagctgagagccagagccaggagaagatggacatcagcaccctgcggcggcagctgcggcccaccggccagctgcggggcggcctgaagggcagcaagtctgaggacagcgagctgcccccccagacagccagcgaggcccccagcgagggcagccgccgcagcagcagtgacctgatcaccctgcctgccaccaccccaccctgccccaccaagaaggagtgggagggccctgccaccagctacatgacctgcagcgcctaccagaaggtgcaggacagcgagatctccttccctgctggggtggaggtgcaggtgctggagaagcaggagagcggctggtggtacgtgcgctttggagagctggagggctgggcccccagccactacctggtgctggatgaaaatgagcagcctgaccccagcggcaaggagctggacacagtgcctgccaagggccggcagaatgaaggcaagagtgacagcctggagaagattgaaagaagagtgcaggccctgaacacagtgaaccagagcaagaaggccaccccacccatccccagcaagcccccaggcggctttgggaagaccagcggcaccccagctgtgaagatgagaaatggagtgcggcaggtggccgtgcggccccagagcgtgtttgtgagccccccacccaaggacaacaacctgagctgtgccctgcggagaaatgaaagcctgacagccacagatggcctgcggggcgtgagaagaaacagcagcttcagcacagcccggtctgctgctgctgaggccaagggccgcctggccgagcgggccgccagccagggcagtgacagccccctgctgcctgcccagaggaacagcatccctgtgtcccctgtgcggcccaagcccatcgagaagagccagttcatccacaacaacctgaaggatgtgtatgtgtccattgctgactatgaaggagatgaggagacagctggcttccaggagggcgtgtccatggaggtgctggagaggaaccccaacggctggtggtactgccagatcctggatggagtgaagcccttcaagggctgggtgcccagcaactacctggagaagaagaactag

SEQ ID NO: 21841 - DNA, 3402 bp, Artificial Sequence
  Description of Artificial Sequence: Synthetic coding sequence
atgctggcctactgtgtgcaggatgccaccgtggtggatgtggagaagagaagaaaccccagcaagcactacgtgtacatcatcaacgtgacctggagcgacagcaccagccagaccatctaccgccgctacagcaagttctttgacctgcagatgcagctgctggacaagttccccatcgagggcggccagaaggaccccaagcagaggatcatccccttcctgcccgggaagatcctcttccgccgcagccacatcagagatgtggccgtgaagaggctgaagcccattgatgagtactgccgggccctggtgcggctgcccccccacatcagccagtgtgatgaggtgttccgcttctttgaggcccggccagaagatgtgaacccccccaaggaggactatggcagcagcaagaggaagtctgtgtggctgagctcctgggccgagagccccaagaaggatgtgactggagcagatgccacagctgagcccatgatcctggagcagtatgtggtggtgagcaactacaagaagcaggagaacagcgagctgagcctgcaggccggggaggtggtggatgtgattgagaagaatgaaagtggctggtggtttgtgtccaccagcgaggagcagggctgggtgcctgccacctacctggaggcccagaatggcaccagagatgacagcgacatcaacaccagcaagacaggagaggtgtccaagaggaggaaggcccacctgcggcggctggaccggcgctggaccctgggcggcatggtgaaccggcagcacagccgggaggagaagtatgtgacagtgcagccctacaccagccagagcaaggatgaaattggatttgagaagggcgtgacagtggaggtgatcaggaagaacctggagggctggtggtacatccgctacctgggcaaggagggctgggccccagccagctacctgaagaaggccaaggatgacctgcccaccaggaagaagaacctggccggccctgtggagatcatcggcaacatcatggagatcagcaacctgctgaacaagaaggccagcggggacaaggagaccccacctgctgagggggagggccacgaggcccccatcgccaagaaggagatcagcctgcccatcctgtgcaatgccagcaatggcagcgctgtgggcgtgcctgacagaacagtgtcccggctggcccagggcagccctgctgtggcccgcatcgccccccagagggcccagatcagcagccccaacctgcggacccggcccccaccaagaagagagagcagcctgggcttccagctgcccaagcccccagagccccccagcgtggaggtggagtactacaccatcgccgagttccagagctgcatcagtgatggcatctccttccggggcggccagaaggccgaggtgattgacaagaacagcggcggctggtggtacgtgcagatcggggagaaggagggctgggccccagccagctacatcgacaagaggaagaagcccaacctgagcaggaggaccagcaccctgacccggcccaaggtgcccccaccagccccacccagcaagcccaaggaggccgaggagggccccactggagccagcgagagccaggacagccccaggaagctgaagtatgaggagccagaatatgacatcccagcctttggatttgattctgagcctgagctgtctgaggagcctgtggaggaccgggccagcggggagcggcggcctgcccagccccaccggcccagccctgccagcagcctgcagagggcccgcttcaaggtgggggagagcagtgaagatgtggccctggaggaggagaccatctatgaaaatgaaggcttccggccctatgcagaggacaccctgagcgcccggggcagcagcggggacagcgacagccctggcagcagcagcctgagcctgaccaggaagaacagccccaagagcggcagccccaagagcagcagcctgctgaagctgaaggccgagaagaatgcccaggccgagatgggcaagaaccacagcagcgccagcttcagcagcagcatcaccatcaacaccacctgctgcagcagcagcagcagcagcagcagcagcctgagcaagaccagcggggacctgaagcccaggtctgccagtgatgctggcatccggggcacccccaaggtgcgggccaagaaggatgctgatgccaatgccggcctgaccagctgcccccgggccaagcccagcgtgcggcccaagcccttcctgaacagagctgagagccagagccaggagaagatggacatcagcaccctgcggcggcagctgcggcccaccggccagctgcggggcggcctgaagggcagcaagtctgaggacagcgagctgcccccccagacagccagcgaggcccccagcgagggcagccgccgcagcagcagtgacctgatcaccctgcctgccaccaccccaccctgccccaccaagaaggagtgggagggccctgccaccagctacatgacctgcagcgcctaccagaaggtgcaggacagcgagatctccttccctgctggggtggaggtgcaggtgctggagaagcaggagagcggctggtggtacgtgcgctttggagagctggagggctgggcccccagccactacctggtgctggatgaaaatgagcagcctgaccccagcggcaaggagctggacacagtgcctgccaagggccggcagaatgaaggcaagagtgacagcctggagaagattgaaagaagagtgcaggccctgaacacagtgaaccagagcaagaaggccaccccacccatccccagcaagcccccaggcggctttgggaagaccagcggcaccccagctgtgaagatgagaaatggagtgcggcaggtggccgtgcggccccagagcgtgtttgtgagccccccacccaaggacaacaacctgagctgtgccctgcggagaaatgaaagcctgacagccacagatggcctgcggggcgtgagaagaaacagcagcttcagcacagcccggtctgctgctgctgaggccaagggccgcctggccgagcgggccgccagccagggcagtgacagccccctgctgcctgcccagaggaacagcatccctgtgtcccctgtgcggcccaagcccatcgagaagagccagttcatccacaacaacctgaaggatgtgtatgtgtccattgctgactatgaaggagatgaggagacagctggcttccaggagggcgtgtccatggaggtgctggagaggaaccccaacggctggtggtactgccagatcctggatggagtgaagcccttcaagggctgggtgcccagcaactacctggagaagaagaactag

SEQ ID NO: 21842 - DNA, 3183 bp, Artificial Sequence
  Description of Artificial Sequence: Synthetic coding sequence
tgattctttgacctgcagatgcagctgctggacaagttccccattgaaggaggccagaaggaccccaagcagaggatcatccccttcctgcccgggaagatcctcttcagaagaagccacatcagagatgtggccgtgaagaggctgaagcccattgatgagtactgccgggccctggtgcggctgcccccccacatcagccagtgtgatgaggtgttccgcttctttgaggcccggccagaagatgtgaacccccccaaggaggactatggcagcagcaagaggaagtctgtgtggctgagctcctgggccgagagccccaagaaggatgtgactggagcagatgccacagctgagcccatgatcctggagcagtatgtggtggtgagcaactacaagaagcaggagaacagcgagctgagcctgcaggccggggaggtggtggatgtgattgagaagaatgaaagtggctggtggtttgtgtccaccagcgaggagcagggctgggtgcctgccacctacctggaggcccagaatggcaccagagatgacagcgacatcaacaccagcaagacaggagaggaggagaagtatgtgacagtgcagccctacaccagccagagcaaggatgagatcggctttgagaagggcgtgacagtggaggtgatcaggaagaacctggagggctggtggtacatccgctacctgggcaaggagggctgggccccagccagctacctgaagaaggccaaggatgacctgcccaccaggaagaagaacctggccggccctgtggagatcatcggcaacatcatggagatcagcaacctgctgaacaagaaggccagcggggacaaggagaccccacctgctgagggggagggccacgaggcccccatcgccaagaaggagatcagcctgcccatcctgtgcaatgccagcaatggatctgctgtgggcgtgcctgacagaacagtgtcccggctggcccagggcagccctgctgtggccagaattgccccccagagggcccagatcagcagccccaacctgcggacccggcccccaccccggcgggagagcagcctgggcttccagctgcccaagcccccagagcccccatctgtggaggtggagtactacaccatcgccgagttccagagctgcatcagtgatggcatctccttccggggcggccagaaggccgaggtgattgacaagaacagcggcggctggtggtacgtgcagattggagagaaggagggctgggccccagccagctacatcgacaagaggaagaagcccaacctgagcaggaggaccagcaccctgacccggcccaaggtgcccccaccagccccacccagcaagcccaaggaggccgaggagggccccaccggggccagcgagagccaggacagccccaggaagctgaagtatgaggagccagaatatgacatcccagccttcggctttgacagcgagcctgagctgtctgaggagcctgtggaggaccgggccagcggggagaggaggcctgcccagccccaccggcccagccctgccagcagcctgcagagggcccgcttcaaggtgggggagagcagtgaagatgtggccctggaggaggagaccatctatgaaaatgaaggcttccggccctatgcagaggacaccctgagcgcccggggcagcagcggggacagcgacagccctggcagcagcagcctgagcctgaccaggaagaacagccccaagagcggcagccccaagagcagcagcctgctgaagctgaaggccgagaagaatgcccaggccgagatgggcaagaaccacagcagcgccagcttcagcagcagcatcaccatcaacaccacctgctgcagcagcagcagcagcagcagcagcagcctgagcaagaccagcggggacctgaagcccaggtctgccagtgatgctggcatccggggcacccccaaggtgcgggccaagaaggatgctgatgccaatgccggcctgaccagctgcccccgggccaagcccagcgtgcggcccaagcccttcctgaacagagctgagagccagagccaggagaagatggacatcagcaccctgcggcggcagctgcggcccaccggccagctgcggggcggcctgaagggcagcaagtcagaagattctgagctgcccccccagacagccagcgaggcccccagcgagggcagcagaagaagcagcagtgacctgatcaccctgcctgccaccaccccaccctgccccaccaagaaggagtgggagggccctgccaccagctacatgacctgcagcgcctaccagaaggtgcaggacagcgagatctccttccctgctggggtggaggtgcaggtgctggagaagcaggagagcggctggtggtacgtgcgctttggagagctggagggctgggcccccagccactacctggtgctggatgaaaatgagcagcctgaccccagcggcaaggagctggacacagtgcctgccaagggccggcagaatgaaggcaagagtgacagcctggagaagattgaaagaagagtgcaggccctgaacacagtgaaccagagcaagaaggccaccccacccatccccagcaagcccccaggcggctttgggaagaccagcggcaccccagctgtgaagatgagaaatggagtgcggcaggtggccgtgcggccccagagcgtgtttgtgtccccaccacccaaggacaacaacctgagctgtgccctgcggagaaatgaaagcctgacagccacagatggcctgcggggcgtgagaagaaacagcagcttcagcacagcccggtctgctgctgctgaggccaagggccgcctggccgagagagctgccagccagggcagtgacagccccctgctgcctgcccagagaaattccatccctgtgtcccctgtgcggcccaagcccatcgagaagagccagttcatccacaacaacctgaaggatgtgtatgtgtccattgctgactatgaaggagatgaggagacagctggcttccaggagggcgtgtccatggaggtgctggagaggaaccccaacggctggtggtactgccagatcctggatggagtgaagcccttcaagggctgggtgcccagcaactacctggagaagaagaactag

SEQ ID NO: 21843 - DNA, 1110 bp, Artificial Sequence
  Description of Artificial Sequence: Synthetic coding sequence
atgagcatctgctgctgcttcttcttccgggactatggcagcagcaagaggaagtctggagcagatgccacagctgagcccatgatcctggagcagtatgtggtggtgagcaactacaagaagcaggagaacagcgagctgagcctgcaggccggggaggtggtggatgtgattgagaagaatgaaagtggctggtggtttgtgtccaccagcgaggagcagggctgggtgcctgccacctacctggaggcccagaatggcaccagagatgacagcgacatcaacaccagcaagacaggagaggtgtccaagaggaggaaggcccacctgcggcggctggaccggcgctggaccctgggcggcatggtgaaccggcagcacagccgggaggagaagtatgtgacagtgcagccctacaccagccagagcaaggatgaaattggatttgagaagggcgtgacagtggaggtgatcaggaagaacctggagggctggtggtacatccgctacctgggcaaggagggctgggccccagccagctacctgaagaaggccaaggatgacctgcccaccaggaagaagaacctggccggccctgtggagatcatcggcaacatcatggagatcagcaacctgctgaacaagaaggccagcggggacaaggagaccccacctgctgagggggagggccacgaggcccccatcgccaagaaggagatcagcctgcccatcctgtgcaatgccagcaatggcagcgctgtgggcgtgcctgacagaacagtgtcccggctggcccagggcagccctgctgtggcccgcatcgccccccagagggcccagatcagcagccccaacctgcggacccggcccccaccaagaagagagagcagcctgacagagagccgctgccggcaggccggcgtgcagtggcatgacctgggcagcctgcagagcccccacccccgcttcaagcgcttcagctgcctgagcctgctgagctcctgggaccaccgccacatgccaccccacccagccaacttcctgatcttcctgattgagaccggcttccaccacgtgggccaggacggcctgcacctgctgaccagctag

SEQ ID NO: 21844 - DNA, 2898 bp, Artificial Sequence
  Description of Artificial Sequence: Synthetic coding sequence
atgcctgtgacagccaccgggaagatcctcttccgccgcagccacatcagagatgtggccgtgaagaggctgaagcccattgatgagtactgccgggccctggtgcggctgcccccccacatcagccagtgtgatgaggtgttccgcttctttgaggcccggccagaagatgtgaacccccccaaggaggactatggcagcagcaagaggaagagcggggctgatgccacagctgagcccatgatcctggagcagtatgtggtggtgagcaactacaagaagcaggagaacagcgagctgagcctgcaggccggggaggtggtggatgtgattgagaagaatgaaagtggctggtggtttgtgtccaccagcgaggagcagggctgggtgcctgccacctacctggaggcccagaatggcaccagagatgacagcgacatcaacaccagcaagacaggagaggtgtccaagaggaggaaggcccacctgcggcggctggaccggcgctggaccctgggcggcatggtgaaccggcagcacagccgggaggagaagtatgtgacagtgcagccctacaccagccagagcaaggatgagatcggctttgagaagggcgtgacagtggaggtgatcaggaagaacctggagggctggtggtacatccgctacctgggcaaggagggctgggccccagccagctacctgaagaaggccaaggatgacctgcccaccaggaagaagaacctggccggccctgtggagatcatcggcaacatcatggagatcagcaacctgctgaacaagaaggccagcggggacaaggagaccccacctgctgagggggagggccacgaggcccccatcgccaagaaggagatcagcctgcccatcctgtgcaatgccagcaatggatctgctgtgggcgtgcctgacagaacagtgtcccggctggcccagggcagccctgctgtggccagaattgccccccagagggcccagatcagcagccccaacctgcggacccggcccccaccccggcgggagagcagcctgggcttccagctgcccaagcccccagagcccccatctgtggaggtggagtactacaccatcgccgagttccagagctgcatcagtgatggcatctccttccggggcggccagaaggccgaggtgattgacaagaacagcggcggctggtggtacgtgcagattggagagaaggagggctgggccccagccagctacatcgacaagaggaagaagcccaacctgagcaggaggaccagcaccctgacccggcccaaggtgcccccaccagccccacccagcaagcccaaggaggccgaggagggccccaccggggccagcgagagccaggacagccccaggaagctgaagtatgaggagccagaatatgacatcccagccttcggctttgacagcgagcctgagctgtctgaggagcctgtggaggaccgggccagcggggagaggaggcctgcccagccccaccggcccagccctgccagcagcctgcagagggcccgcttcaaggtgggggagagcagtgaagatgtggccctggaggaggagaccatctatgaaaatgaaggcttccggccctatgcagaggacaccctgagcgcccggggcagcagcggggacagcgacagccctggcagcagcagcctgagcctgaccaggaagaacagccccaagagcggcagccccaagagcagcagcctgctgaagctgaaggccgagaagaatgcccaggccgagatgggcaagaaccacagcagcgccagcttcagcagcagcatcaccatcaacaccacctgctgcagcagcagcagcagcagcagcagcagcctgagcaagaccagcggggacctgaagcccaggtctgccagtgatgctggcatccggggcacccccaaggtgcgggccaagaaggatgctgatgccaatgccggcctgaccagctgcccccgggccaagcccagcgtgcggcccaagcccttcctgaacagagctgagagccagagccaggagaagatggacatcagcaccctgcggcggcagctgcggcccaccggccagctgcggggcggcctgaagggcagcaagtcagaagattctgagctgcccccccagacagccagcgaggcccccagcgagggcagcagaagaagcagcagtgacctgatcaccctgcctgccaccaccccaccctgccccaccaagaaggagtgggagggccctgccaccagctacatgacctgcagcgcctaccagaaggtgcaggacagcgagatctccttccctgctggggtggaggtgcaggtgctggagaagcaggagagcggctggtggtacgtgcgctttggagagctggagggctgggcccccagccactacctggtgctggatgaaaatgagcagcctgaccccagcggcaaggagctggacacagtgcctgccaagggccggcagaatgaaggcaagagtgacagcctggagaagattgaaagaagagtgcaggccctgaacacagtgaaccagagcaagaaggccaccccacccatccccagcaagcccccaggcggctttgggaagaccagcggcaccccagctgtgaagatgagaaatggagtgcggcaggtggccgtgcggcccatcgagaagagccagttcatccacaacaacctgaaggatgtgtatgtgtccattgctgactatgaaggagatgaggagacagctggcttccaggagggcgtgtccatggaggtgctggagaggaaccccaacggctggtggtactgccagatcctggatggagtgaagcccttcaagggctgggtgcccagcaactacctggagaagaagaactag

SEQ ID NO: 21845 - DNA, 2907 bp, Artificial Sequence
  Description of Artificial Sequence: Synthetic coding sequence
atgatcctggagcagtatgtggtggtgagcaactacaagaagcaggagaacagcgagctgagcctgcaggccggggaggtggtggatgtgattgagaagaatgaaagtggctggtggtttgtgtccaccagcgaggagcagggctgggtgcctgccacctacctggaggcccagaatggcaccagagatgacagcgacatcaacaccagcaagacaggagaggtgtccaagaggaggaaggcccacctgcggcggctggaccggcgctggaccctgggcggcatggtgaaccggcagcacagccgggaggagaagtatgtgacagtgcagccctacaccagccagagcaaggatgagatcggctttgagaagggcgtgacagtggaggtgatcaggaagaacctggagggctggtggtacatccgctacctgggcaaggagggctgggccccagccagctacctgaagaaggccaaggatgacctgcccaccaggaagaagaacctggccggccctgtggagatcatcggcaacatcatggagatcagcaacctgctgaacaagaaggccagcggggacaaggagaccccacctgctgagggggagggccacgaggcccccatcgccaagaaggagatcagcctgcccatcctgtgcaatgccagcaatggatctgctgtgggcgtgcctgacagaacagtgtcccggctggcccagggcagccctgctgtggccagaattgccccccagagggcccagatcagcagccccaacctgcggacccggcccccaccccggcgggagagcagcctgggcttccagctgcccaagcccccagagcccccatctgtggaggtggagtactacaccatcgccgagttccagagctgcatcagtgatggcatctccttccggggcggccagaaggccgaggtgattgacaagaacagcggcggctggtggtacgtgcagattggagagaaggagggctgggccccagccagctacatcgacaagaggaagaagcccaacctgagcaggaggaccagcaccctgacccggcccaaggtgcccccaccagccccacccagcaagcccaaggaggccgaggagggccccaccggggccagcgagagccaggacagccccaggaagctgaagtatgaggagccagaatatgacatcccagccttcggctttgacagcgagcctgagctgtctgaggagcctgtggaggaccgggccagcggggagaggaggcctgcccagccccaccggcccagccctgccagcagcctgcagagggcccgcttcaaggtgggggagagcagtgaagatgtggccctggaggaggagaccatctatgaaaatgaaggcttccggccctatgcagaggacaccctgagcgcccggggcagcagcggggacagcgacagccctggcagcagcagcctgagcctgaccaggaagaacagccccaagagcggcagccccaagagcagcagcctgctgaagctgaaggccgagaagaatgcccaggccgagatgggcaagaaccacagcagcgccagcttcagcagcagcatcaccatcaacaccacctgctgcagcagcagcagcagcagcagcagcagcctgagcaagaccagcggggacctgaagcccaggtctgccagtgatgctggcatccggggcacccccaaggtgcgggccaagaaggatgctgatgccaatgccggcctgaccagctgcccccgggccaagcccagcgtgcggcccaagcccttcctgaacagagctgagagccagagccaggagaagatggacatcagcaccctgcggcggcagctgcggcccaccggccagctgcggggcggcctgaagggcagcaagtcagaagattctgagctgcccccccagacagccagcgaggcccccagcgagggcagcagaagaagcagcagtgacctgatcaccctgcctgccaccaccccaccctgccccaccaagaaggagtgggagggccctgccaccagctacatgacctgcagcgcctaccagaaggtgcaggacagcgagatctccttccctgctggggtggaggtgcaggtgctggagaagcaggagagcggctggtggtacgtgcgctttggagagctggagggctgggcccccagccactacctggtgctggatgaaaatgagcagcctgaccccagcggcaaggagctggacacagtgcctgccaagggccggcagaatgaaggcaagagtgacagcctggagaagattgaaagaagagtgcaggccctgaacacagtgaaccagagcaagaaggccaccccacccatccccagcaagcccccaggcggctttgggaagaccagcggcaccccagctgtgaagatgagaaatggagtgcggcaggtggccgtgcggccccagagcgtgtttgtgtccccaccacccaaggacaacaacctgagctgtgccctgcggagaaatgaaagcctgacagccacagatggcctgcggggcgtgagaagaaacagcagcttcagcacagcccggtctgctgctgctgaggccaagggccgcctggccgagagagctgccagccagggcagtgacagccccctgctgcctgcccagagaaattccatccctgtgtcccctgtgcggcccaagcccatcgagaagagccagttcatccacaacaacctgaaggatgtgtatgtgtccattgctgactatgaaggagatgaggagacagctggcttccaggagggcgtgtccatggaggtgctggagaggaaccccaacggctggtggtactgccagatcctggatggagtgaagcccttcaagggctgggtgcccagcaactacctggagaagaagaactag

SEQ ID NO: 21846 - DNA, 3003 bp, Artificial Sequence
  Description of Artificial Sequence: Synthetic coding sequence
atgaatggcagcttcctgctgcggctgctcttccctgtggccagcatcctgcctgagaccgtgctgctgcggggagcagatgccacagctgagcccatgatcctggagcagtatgtggtggtgagcaactacaagaagcaggagaacagcgagctgagcctgcaggccggggaggtggtggatgtgattgagaagaatgaaagtggctggtggtttgtgtccaccagcgaggagcagggctgggtgcctgccacctacctggaggcccagaatggcaccagagatgacagcgacatcaacaccagcaagacaggagaggtgtccaagaggaggaaggcccacctgcggcggctggaccggcgctggaccctgggcggcatggtgaaccggcagcacagccgggaggagaagtatgtgacagtgcagccctacaccagccagagcaaggatgagatcggctttgagaagggcgtgacagtggaggtgatcaggaagaacctggagggctggtggtacatccgctacctgggcaaggagggctgggccccagccagctacctgaagaaggccaaggatgacctgcccaccaggaagaagaacctggccggccctgtggagatcatcggcaacatcatggagatcagcaacctgctgaacaagaaggccagcggggacaaggagaccccacctgctgagggggagggccacgaggcccccatcgccaagaaggagatcagcctgcccatcctgtgcaatgccagcaatggatctgctgtgggcgtgcctgacagaacagtgtcccggctggcccagggcagccctgctgtggccagaattgccccccagagggcccagatcagcagccccaacctgcggacccggcccccaccccggcgggagagcagcctgggcttccagctgcccaagcccccagagcccccatctgtggaggtggagtactacaccatcgccgagttccagagctgcatcagtgatggcatctccttccggggcggccagaaggccgaggtgattgacaagaacagcggcggctggtggtacgtgcagattggagagaaggagggctgggccccagccagctacatcgacaagaggaagaagcccaacctgagcaggaggaccagcaccctgacccggcccaaggtgcccccaccagccccacccagcaagcccaaggaggccgaggagggccccaccggggccagcgagagccaggacagccccaggaagctgaagtatgaggagccagaatatgacatcccagccttcggctttgacagcgagcctgagctgtctgaggagcctgtggaggaccgggccagcggggagaggaggcctgcccagccccaccggcccagccctgccagcagcctgcagagggcccgcttcaaggtgggggagagcagtgaagatgtggccctggaggaggagaccatctatgaaaatgaaggcttccggccctatgcagaggacaccctgagcgcccggggcagcagcggggacagcgacagccctggcagcagcagcctgagcctgaccaggaagaacagccccaagagcggcagccccaagagcagcagcctgctgaagctgaaggccgagaagaatgcccaggccgagatgggcaagaaccacagcagcgccagcttcagcagcagcatcaccatcaacaccacctgctgcagcagcagcagcagcagcagcagcagcctgagcaagaccagcggggacctgaagcccaggtctgccagtgatgctggcatccggggcacccccaaggtgcgggccaagaaggatgctgatgccaatgccggcctgaccagctgcccccgggccaagcccagcgtgcggcccaagcccttcctgaacagagctgagagccagagccaggagaagatggacatcagcaccctgcggcggcagctgcggcccaccggccagctgcggggcggcctgaagggcagcaagtcagaagattctgagctgcccccccagacagccagcgaggcccccagcgagggcagcagaagaagcagcagtgacctgatcaccctgcctgccaccaccccaccctgccccaccaagaaggagtgggagggccctgccaccagctacatgacctgcagcgcctaccagaaggtgcaggacagcgagatctccttccctgctggggtggaggtgcaggtgctggagaagcaggagagcggctggtggtacgtgcgctttggagagctggagggctgggcccccagccactacctggtgctggatgaaaatgagcagcctgaccccagcggcaaggagctggacacagtgcctgccaagggccggcagaatgaaggcaagagtgacagcctggagaagattgaaagaagagtgcaggccctgaacacagtgaaccagagcaagaaggccaccccacccatccccagcaagcccccaggcggctttgggaagaccagcggcaccccagctgtgaagatgagaaatggagtgcggcaggtggccgtgcggccccagagcgtgtttgtgtccccaccacccaaggacaacaacctgagctgtgccctgcggagaaatgaaagcctgacagccacagatggcctgcggggcgtgagaagaaacagcagcttcagcacagcccggtctgctgctgctgaggccaagggccgcctggccgagagagctgccagccagggcagtgacagccccctgctgcctgcccagagaaattccatccctgtgtcccctgtgcggcccaagcccatcgagaagagccagttcatccacaacaacctgaaggatgtgtatgtgtccattgctgactatgaaggagatgaggagacagctggcttccaggagggcgtgtccatggaggtgctggagaggaaccccaacggctggtggtactgccagatcctggatggagtgaagcccttcaagggctgggtgcccagcaactacctggagaagaagaactag

SEQ ID NO: 21847 - DNA, 414 bp, Artificial Sequence
  Description of Artificial Sequence: Synthetic coding sequence
atgaacaagctgagcggcggcggcggccgccgcaccagggtggagggcggccagctgggcggggaggagtggaccaggcatggcagctttgtgaacaagcccacccggggctggctgcaccccaatgacaaggtgatgggccctggggtgtcctacctggtgcgctacatgggctgtgtggaggtgctgcagagcatgagggccctggacttcaacaccaggacccaggtgacccgggaggccatcagcctggtgtgtgaggccgtgcctggggccaagggggccaccaggaggaggaagccctgcagccggcccctgagcagcatcctgggccgcagcaacctgaagtttgctggcatgcccatcaccctgactgtgtccaccagcagcctgaacctgatggctgctgactag

SEQ ID NO: 21848 - DNA, 918 bp, Artificial Sequence
  Description of Artificial Sequence: Synthetic coding sequence
atggccggctttgatggcagcgcctgggatgaggaggaggaggagcccccagaccaccagtactacaatgacttccctgggaaggagccccccctgggcggcgtggtggacatgaggctgcgggagggcgccgcccctggggccgcccggcccacagccccaaatgcccagacccccagccacctgggcgccaccctgcctgtgggccagcctgtgggcggggaccctgaggtgaggaagcagatgcctcctcctccaccctgccccggccgggagctgtttgatgaccccagctatgtgaatgtgcagaacctggacaaggcccggcaggccgtgggcggggccggcccccccaacccagccatcaatggaagtgccccccgggacctgtttgacatgaagccctttgaagatgccctgcgggtgcccccaccaccccagagcgtgtccatggccgagcagctgcggggggagccctggttccacggcaagctgagcagaagagaggccgaggccctgctgcagctgaatggagacttcctggtgcgggagagcaccaccaccccaggccagtatgtgctgaccggcctgcagagcggccagcccaagcacctgctgctggtggaccctgagggcgtgcgctggggctttgccatgctgcccaagctgttcctgaacagccgggcccaggtgatccggctgcccaggcctccccgggtgctgggcctgcaggcccggaccaccatgcccagcctgcacatcttcttctgcaccgtgtacaccctgctgcggcatgccaacttcctgcaggtgaagaagggcgtgtacagcagccagctgcacagcttccgggcagatgtggcctttgccttcagccacttcacagacctgagcatccccaccaccgtgtccttctag

SEQ ID NO: 21849 - DNA, 1563 bp, Artificial Sequence
  Description of Artificial Sequence: Synthetic coding sequence
atgagcaacctgcggctggccaacccagctgggggccggcccggcagcaaaggagagcccggccgggcagcagatgatggagagggcatcgtgggcgccgccatgccagacagcggccccctgcccctgctgcaggacatgaacaagctgagcggcggcggcggccgccgcaccagggtggagggcggccagctgggcggggaggagtggaccaggcatggcagctttgtgaacaagcccacccggggctggctgcaccccaatgacaaggtgatgggccctggggtgtcctacctggtgcgctacatgggctgtgtggaggtgctgcagagcatgagggccctggacttcaacaccaggacccaggtgacccgggaggccatcagcctggtgtgtgaggccgtgcctggggccaagggggccaccaggaggaggaagccctgcagccggcccctgagcagcatcctgggccgcagcaacctgaagtttgctggcatgcccatcaccctgactgtgtccaccagcagcctgaacctgatggctgctgactgcaagcagatcatcgccaaccaccacatgcagagcatcagctttgccagcggcggggaccctgacacagcagaatatgtggcctacgtggccaaggaccctgtgaaccagagggcctgccacatcctggagtgcccagagggcctggcccaggatgtgatcagcaccatcggccaggcctttgagctgcgcttcaagcagtacctgagaaatccacccaagctggtgacccctcatgacaggatggccggctttgatggcagcgcctgggatgaggaggaggaggagcccccagaccaccagtactacaatgacttccctgggaaggagccccccctgggcggcgtggtggacatgaggctgcgggagggcgccgcccctggggccgcccggcccacagccccaaatgcccagacccccagccacctgggcgccaccctgcctgtgggccagcctgtgggcggggaccctgaggtgaggaagcagatgcctcctcctccaccctgcccagctggccgggagctgtttgatgaccccagctatgtgaatgtgcagaacctggacaaggcccggcaggccgtgggcggggccggcccccccaacccagccatcaatggcagcgccccccgggacctgtttgacatgaagccctttgaagatgccctgcgggtgcccccaccaccccagagcgtgtccatggccgagcagctgcggggggagccctggttccacggcaagctgagccggcgggaggccgaggccctgctgcagctgaatggagacttcctggtgcgggagagcaccaccaccccaggccagtatgtgctgaccggcctgcagagcggccagcccaagcacctgctgctggtggaccctgagggcgtggtgaggaccaaggaccacagatttgagagcgtgagccacctgatctcctaccacatggacaaccacctgcccatcatctctgctggcagcgagctgtgcctgcagcagcctgtggagaggaagctgtag

SEQ ID NO: 21850 - DNA, 1752 bp, Artificial Sequence
  Description of Artificial Sequence: Synthetic coding sequence
atggacctgctgccccccaagcccaagtacaaccccctgagaaatgaaagcctgagcagcctggaggagggcgccagcggcagcaccccacctgaggagctgcccagccccagcgccagcagcctgggccccatcctgccccccctgcctggagatgacagccccaccaccctgtgcagcttcttccccaggatgagcaacctgcggctggccaacccagctgggggccggcccggcagcaaaggagagcccggccgggcagcagatgatggagagggcatcgtgggcgccgccatgccagacagcggccccctgcccctgctgcaggacatgaacaagctgagcggcggcggcggccgccgcaccagggtggagggcggccagctgggcggggaggagtggaccaggcatggcagctttgtgaacaagcccacccggggctggctgcaccccaatgacaaggtgatgggccctggggtgtcctacctggtgcgctacatgggctgtgtggaggtgctgcagagcatgagggccctggacttcaacaccaggacccaggtgacccgggaggccatcagcctggtgtgtgaggccgtgcctggggccaagggggccaccaggaggaggaagccctgcagccggcccctgagcagcatcctgggccgcagcaacctgaagtttgctggcatgcccatcaccctgactgtgtccaccagcagcctgaacctgatggctgctgactgcaagcagatcatcgccaaccaccacatgcagagcatcagctttgccagcggcggggaccctgacacagcagaatatgtggcctacgtggccaaggaccctgtgaaccagagggcctgccacatcctggagtgcccagagggcctggcccaggatgtgatcagcaccatcggccaggcctttgagctgcgcttcaagcagtacctgagaaatccacccaagctggtgacccctcatgacaggatggccggctttgatggcagcgcctgggatgaggaggaggaggagcccccagaccaccagtactacaatgacttccctgggaaggagccccccctgggcggcgtggtggacatgaggctgcgggagggcgccgcccctggggccgcccggcccacagccccaaatgcccagacccccagccacctgggcgccaccctgcctgtgggccagcctgtgggcggggaccctgaggtgaggaagcagatgcctcctcctccaccctgccccggccgggagctgtttgatgaccccagctatgtgaatgtgcagaacctggacaaggcccggcaggccgtgggcggggccggcccccccaacccagccatcaatggaagtgccccccgggacctgtttgacatgaagccctttgaagatgccctgcgggtgcccccaccaccccagagcgtgtccatggccgagcagctgcggggggagccctggttccacggcaagctgagcagaagagaggccgaggccctgctgcagctgaatggagacttcctggtgcgggagagcaccaccaccccaggccagtatgtgctgaccggcctgcagagcggccagcccaagcacctgctgctggtggaccctgagggcgtggtgaggaccaaggaccacagatttgaatctgtgagccacctgatctcctaccacatggacaaccacctgcccatcatctctgctggcagcgagctgtgcctgcagcagcctgtggagaggaagctgtag

SEQ ID NO: 21851 - DNA, 1155 bp, Artificial Sequence
  Description of Artificial Sequence: Synthetic coding sequence
atggacctgctgccccccaagcccaagtacaaccccctgagaaatgaaagcctgagcatcctgggccgcagcaacctgaagtttgctggcatgcccatcaccctgactgtgtccaccagcagcctgaacctgatggctgctgactgcaagcagatcatcgccaaccaccacatgcagagcatcagctttgccagcggcggggaccctgacacagcagaatatgtggcctacgtggccaaggaccctgtgaaccagagggcctgccacatcctggagtgcccagagggcctggcccaggacgtcatcagcaccatcggccaggcctttgagctgcgcttcaagcagtacctgaggaacccccccaagctggtgacccctcatgacaggatggccggctttgatggcagcgcctgggatgaggaggaggaggagcccccagaccaccagtactacaatgacttccctgggaaggagccccccctgggcggcgtggtggacatgaggctgcgggagggcgccgcccctggagctgcccggcccacagccccaaatgcccagacccccagccacctgggcgccaccctgcctgtgggccagcctgtgggcggggaccctgaggtgaggaagcagatgcctcctcctccaccctgccccggccgggagctgtttgatgaccccagctatgtgaatgtgcagaacctggacaaggcccggcaggccgtgggcggggccggcccccccaacccagccatcaatggcagcgccccccgggacctgtttgacatgaagccctttgaagatgccctgcgggtgcccccaccaccccagagcgtgtccatggccgagcagctgcggggggagccctggttccacggcaagctgagccggcgggaggccgaggccctgctgcagctgaatggagacttcctggtgcgggagagcaccaccaccccaggccagtatgtgctgaccggcctgcagagcggccagcccaagcacctgctgctggtggaccctgagggcgtggtgaggaccaaggaccacagatttgagagcgtgagccacctgatctcctaccacatggacaaccacctgcccatcatctctgctggcagcgagctgtgcctgcagcagcctgtggagaggaagctgtag

SEQ ID NO: 21852 - DNA, 1422 bp, Artificial Sequence
  Description of Artificial Sequence: Synthetic coding sequence
atgaacaagctgagcggcggcggcggccgccgcaccagggtggagggcggccagctgggcggggaggagtggaccaggcatggcagctttgtgaacaagcccacccggggctggctgcaccccaatgacaaggtgatgggccctggggtgtcctacctggtgcgctacatgggctgtgtggaggtgctgcagagcatgagggccctggacttcaacaccaggacccaggtgacccgggaggccatcagcctggtgtgtgaggccgtgcctggggccaagggggccaccaggaggaggaagccctgcagccggcccctgagcagcatcctgggccgcagcaacctgaagtttgctggcatgcccatcaccctgactgtgtccaccagcagcctgaacctgatggctgctgactgcaagcagatcatcgccaaccaccacatgcagagcatcagctttgccagcggcggggaccctgacacagcagaatatgtggcctacgtggccaaggaccctgtgaaccagagggcctgccacatcctggagtgcccagagggcctggcccaggatgtgatcagcaccatcggccaggcctttgagctgcgcttcaagcagtacctgagaaatccacccaagctggtgacccctcatgacaggatggccggctttgatggcagcgcctgggatgaggaggaggaggagcccccagaccaccagtactacaatgacttccctgggaaggagccccccctgggcggcgtggtggacatgaggctgcgggagggcgccgcccctggggccgcccggcccacagccccaaatgcccagacccccagccacctgggcgccaccctgcctgtgggccagcctgtgggcggggaccctgaggtgaggaagcagatgcctcctcctccaccctgccccggccgggagctgtttgatgaccccagctatgtgaatgtgcagaacctggacaaggcccggcaggccgtgggcggggccggcccccccaacccagccatcaatggaagtgccccccgggacctgtttgacatgaagccctttgaagatgccctgcgggtgcccccaccaccccagagcgtgtccatggccgagcagctgcggggggagccctggttccacggcaagctgagcagaagagaggccgaggccctgctgcagctgaatggagacttcctggtgcgggagagcaccaccaccccaggccagtatgtgctgaccggcctgcagagcggccagcccaagcacctgctgctggtggaccctgagggcgtggtgaggaccaaggaccacagatttgaatctgtgagccacctgatctcctaccacatggacaaccacctgcccatcatctctgctggcagcgagctgtgcctgcagcagcctgtggagaggaagctgtag

SEQ ID NO: 21853 - DNA, 1425 bp, Artificial Sequence
  Description of Artificial Sequence: Synthetic coding sequence
atgaacaagctgagcggcggcggcggccgccgcaccagggtggagggcggccagctgggcggggaggagtggaccaggcatggcagctttgtgaacaagcccacccggggctggctgcaccccaatgacaaggtgatgggccctggggtgtcctacctggtgcgctacatgggctgtgtggaggtgctgcagagcatgagggccctggacttcaacaccaggacccaggtgacccgggaggccatcagcctggtgtgtgaggccgtgcctggggccaagggggccaccaggaggaggaagccctgcagccggcccctgagcagcatcctgggccgcagcaacctgaagtttgctggcatgcccatcaccctgactgtgtccaccagcagcctgaacctgatggctgctgactgcaagcagatcatcgccaaccaccacatgcagagcatcagctttgccagcggcggggaccctgacacagcagaatatgtggcctacgtggccaaggaccctgtgaaccagagggcctgccacatcctggagtgcccagagggcctggcccaggatgtgatcagcaccatcggccaggcctttgagctgcgcttcaagcagtacctgagaaatccacccaagctggtgacccctcatgacaggatggccggctttgatggcagcgcctgggatgaggaggaggaggagcccccagaccaccagtactacaatgacttccctgggaaggagccccccctgggcggcgtggtggacatgaggctgcgggagggcgccgcccctggggccgcccggcccacagccccaaatgcccagacccccagccacctgggcgccaccctgcctgtgggccagcctgtgggcggggaccctgaggtgaggaagcagatgcctcctcctccaccctgcccagctggccgggagctgtttgatgaccccagctatgtgaatgtgcagaacctggacaaggcccggcaggccgtgggcggggccggcccccccaacccagccatcaatggcagcgccccccgggacctgtttgacatgaagccctttgaagatgccctgcgggtgcccccaccaccccagagcgtgtccatggccgagcagctgcggggggagccctggttccacggcaagctgagccggcgggaggccgaggccctgctgcagctgaatggagacttcctggtgcgggagagcaccaccaccccaggccagtatgtgctgaccggcctgcagagcggccagcccaagcacctgctgctggtggaccctgagggcgtggtgaggaccaaggaccacagatttgagagcgtgagccacctgatctcctaccacatggacaaccacctgcccatcatctctgctggcagcgagctgtgcctgcagcagcctgtggagaggaagctgtag

SEQ ID NO: 21854 - DNA, 603 bp, Artificial Sequence
  Description of Artificial Sequence: Synthetic coding sequence
atgaacaagctgagcggcggcggcggccgccgcaccagggtggagggcggccagctgggcggggaggagtggaccaggcatggcagctttgtgaacaagcccacccggggctggctgcaccccaatgacaaggtgatgggccctggggtgtcctacctggtgcgctacatgggctgtgtggaggtgctgcagagcatgagggccctggacttcaacaccaggacccaggtgacccgggaggccatcagcctggtgtgtgaggccgtgcctggggccaagggggccaccaggaggaggaagccctgcagccggcccctgagcagcatcctgggccgcagcaacctgaagtttgctggcatgcccatcaccctgactgtgtccaccagcagcctgaacctgatggctgctgactgcaagcaggacacagcagaatatgtggcctacgtggccaaggaccctgtgaaccagagggcctgccacatcctggagtgcccagagggcctggcccaggatgtgatcagcaccatcggccaggcctttgagctgcgcttcaagcagtacctgagaaatccacccaagctggtgacccctcatgacagatag

SEQ ID NO: 21855 - DNA, 603 bp, Artificial Sequence
  Description of Artificial Sequence: Synthetic coding sequence
atgcccatcaccctgactgtgtccaccagcagcctgaacctgatggctgctgactgcaagcaggacacagcagaatatgtggcctacgtggccaaggaccctgtgaaccagagggcctgccacatcctggagtgcccagagggcctggcccaggacgtcatcagcaccatcggccaggcctttgagctgcgcttcaagcagtacctgaggaacccccccaagctggtgacccctcatgacaggatggccggctttgatggcagcgcctgggatgaggaggaggaggagcccccagaccaccagtactacaatgacttccctgggaaggagccccccctgggcggcgtggtggacatgaggctgcgggagggcgccgcccctggagctgcccggcccacagccccaaatgcccagacccccagccacctgggcgccaccctgcctgtgggccagcctgtgggcggggaccctgaggtgaggaagcagatgcctcctcctccaccctgcccagctggccgggagctgtttgatgaccccagctatgtgaatgtgcagaacctggacaaggcccggcaggccgtgggcggggccggccccccatag

SEQ ID NO: 21856 - DNA, 393 bp, Artificial Sequence
  Description of Artificial Sequence: Synthetic coding sequence
atgcccatcaccctgactgtgtccaccagcagcctgaacctgatggctgctgactgcaagcagatcatcgccaaccaccacatgcagagcatcagctttgccagcggcggggaccctgacacagcagaatatgtggcctacgtggccaaggaccctgtgaaccagagggcctgccacatcctggagtgcccagagggcctggcccaggacgtcatcagcaccatcggccaggcctttgagctgcgcttcaagcagtacctgaggaacccccccaagctggtgacccctcatgacaggatggccggctttgatggcagcgcctgggatgaggaggaggaggagcccccagaccaccagtactacaatgacttccctgggaaggagcccccatag

SEQ ID NO: 21857 - DNA, 894 bp, Artificial Sequence
  Description of Artificial Sequence: Synthetic coding sequence
tgagatgaggaggaggaggagcccccagaccaccagtactacaatgacttccctgggaaggagccccccctgggcggcgtggtggacatgaggctgcgggagggcgccgcccctggggccgcccggcccacagccccaaatgcccagacccccagccacctgggcgccaccctgcctgtgggccagcctgtgggcggggaccctgaggtgaggaagcagatgcctcctcctccaccctgccccggccgggagctgtttgatgaccccagctatgtgaatgtgcagaacctggacaaggcccggcaggccgtgggcggggccggcccccccaacccagccatcaatggaagtgccccccgggacctgtttgacatgaagccctttgaagatgccctgcgggtgcccccaccaccccagagcgtgtccatggccgagcagctgcggggggagccctggttccacggcaagctgagcagaagagaggccgaggccctgctgcagctgaatggagacttcctggtgcgggagagcaccaccaccccaggccagtatgtgctgaccggcctgcagagcggccagcccaagcacctgctgctggtggaccctgagggcgtgcgctggggctttgccatgctgcccaagctgttcctgaacagccgggcccaggtgatccggctgcccaggcctccccgggtgctgggcctgcaggcccggaccaccatgcccagcctgcacatcttcttctgcaccgtgtacaccctgctgcggcatgccaacttcctgcaggtgaagaagggcgtgtacagcagccagctgcacagcttccgggcagatgtggcctttgccttcagccacttcacagacctgagcatccccaccaccgtgtccttctag

SEQ ID NO: 21858 - DNA, 1755 bp, Artificial Sequence
  Description of Artificial Sequence: Synthetic coding sequence
atggacctgctgccccccaagcccaagtacaaccccctgagaaatgaaagcctgagcagcctggaggagggcgccagcggcagcaccccacctgaggagctgcccagccccagcgccagcagcctgggccccatcctgccccccctgcctggagatgacagccccaccaccctgtgcagcttcttccccaggatgagcaacctgcggctggccaacccagctgggggccggcccggcagcaaaggagagcccggccgggcagcagatgatggagagggcatcgtgggcgccgccatgccagacagcggccccctgcccctgctgcaggacatgaacaagctgagcggcggcggcggccgccgcaccagggtggagggcggccagctgggcggggaggagtggaccaggcatggcagctttgtgaacaagcccacccggggctggctgcaccccaatgacaaggtgatgggccctggggtgtcctacctggtgcgctacatgggctgtgtggaggtgctgcagagcatgagggccctggacttcaacaccaggacccaggtgacccgggaggccatcagcctggtgtgtgaggccgtgcctggggccaagggggccaccaggaggaggaagccctgcagccggcccctgagcagcatcctgggccgcagcaacctgaagtttgctggcatgcccatcaccctgactgtgtccaccagcagcctgaacctgatggctgctgactgcaagcagatcatcgccaaccaccacatgcagagcatcagctttgccagcggcggggaccctgacacagcagaatatgtggcctacgtggccaaggaccctgtgaaccagagggcctgccacatcctggagtgcccagagggcctggcccaggatgtgatcagcaccatcggccaggcctttgagctgcgcttcaagcagtacctgagaaatccacccaagctggtgacccctcatgacaggatggccggctttgatggcagcgcctgggatgaggaggaggaggagcccccagaccaccagtactacaatgacttccctgggaaggagccccccctgggcggcgtggtggacatgaggctgcgggagggcgccgcccctggggccgcccggcccacagccccaaatgcccagacccccagccacctgggcgccaccctgcctgtgggccagcctgtgggcggggaccctgaggtgaggaagcagatgcctcctcctccaccctgcccagctggccgggagctgtttgatgaccccagctatgtgaatgtgcagaacctggacaaggcccggcaggccgtgggcggggccggcccccccaacccagccatcaatggcagcgccccccgggacctgtttgacatgaagccctttgaagatgccctgcgggtgcccccaccaccccagagcgtgtccatggccgagcagctgcggggggagccctggttccacggcaagctgagccggcgggaggccgaggccctgctgcagctgaatggagacttcctggtgcgggagagcaccaccaccccaggccagtatgtgctgaccggcctgcagagcggccagcccaagcacctgctgctggtggaccctgagggcgtggtgaggaccaaggaccacagatttgagagcgtgagccacctgatctcctaccacatggacaaccacctgcccatcatctctgctggcagcgagctgtgcctgcagcagcctgtggagaggaagctgtag

SEQ ID NO: 21859 - DNA, 1749 bp, Artificial Sequence
  Description of Artificial Sequence: Synthetic coding sequence
atgacccagggccctgggggccgggcccccccagcccccccagcccctcctgagcctgaggcccccaccaccttctgtgccctgctgcccaggatgccccagtggaagtttgctgcccctgggggcttcctgggccggggccctgctgctgcccgggccgccggggccagcggcggcgctgacccccagcctgagcctgctggccctggaggagtgcctgccctggccgctgctgtgctgggcgcctgtgagccccgctgtgccgccccctgccccctgcctgccctgagccgctgccgcggggccggcagccggggcagcagaggaggaagaggagctgctggcagcggagatgctgctgctgctgctgagtggatcaggaagggcagcttcatccacaagccagcccacggctggctgcacccagatgcccgggtgctgggccctggggtgtcctatgtggtgcgctacatgggctgcatcgaggtgctgcgctccatgaggagcctggacttcaacaccaggacccaggtgacccgggaggccatcaaccggctgcatgaagctgtgcctggggtgcggggctcctggaagaagaaggcccccaacaaggccctggcctctgtgctgggcaagagcaacctgcgctttgctggcatgagcatcagcatccacatcagcacagatggcctgagcctgtctgtgcctgccacccggcaggtgattgccaaccaccacatgcccagcatcagctttgccagcggcggggacacagacatgacagattatgtggcctacgtggccaaggaccccatcaaccagagggcctgccacatcctggagtgctgtgagggcctggcccagagcatcatcagcacagtgggccaggcctttgagctgcgcttcaagcagtacctgcacagcccccccaaggtggccctgcccccagagcggctggccggccctgaggagagcgcctggggagatgaggaggacagcctggagcacaactactacaacagcatccctgggaaggagccccccctgggcggcctggtggacagccggctggccctgacccagccctgtgccctgacagccctggaccagggccccagccccagcctgagagatgcctgcagcctgccctgggatgtgggcagcactggaacagcccctcctggagatggctacgtgcaggctgatgcccggggccccccagaccacgaggagcacctgtatgtgaacacccagggcctggatgcccctgagcctgaggacagccccaagaaggacctgtttgacatgaggccctttgaagatgccctgaagctgcatgaatgttctgtggccgccggcgtgacagctgcccccctgcccctggaggaccagtggcccagcccccccacccggcgggcccctgtggcccccacagaggagcagctgcggcaggagccctggtaccacggccgcatgagccggcgggctgctgagaggatgctgcgggcagatggagacttcctggtgcgggacagcgtgaccaaccctggccagtatgtgctgaccggcatgcacgccggccagcccaagcacctgctgctggtggaccctgagggcgtggtgaggaccaaggatgtgctgtttgagagcatcagccacctgattgaccaccacctgcagaatggccagcccatcgtggccgctgagagcgagctgcacctgcggggcgtggtgtcccgggagccctag

SEQ ID NO: 21860 - DNA, 1833 bp, Artificial Sequence
  Description of Artificial Sequence: Synthetic coding sequence
atgctggacttcttcaccatcttcagcaagggcggcctggtgctgtggtgcttccagggcgtgtctgacagctgcaccggccctgtgaatgccctgatccgctctgtgctgctgcaggtgggcttccagaagatcctgaccctgacctacgtggacaagctgattgatgatgtgcacaggctcttccgggacaagtacagaacagagatccagcagcagagcgccctgagcctgctgaatggcacctttgacttccagaatgacttcctgcggctgctgcgggaggccgaggagagcagcaagatccgggcccccaccaccatgaagaagtttgaggacagcgagaaggccaagaagcctgtgcgctccatgattgagaccagaggagagaagcccaaggagaaggccaagaacagcaagaagaagggggccaagaaggagggcagtgatggccccctggccaccagcaagcctgtgcctgctgagaagagcggcctgcctgtgggcccagaaaatggagtggagctgagcaaggaggagctgatccggaggaagcgggaggagttcatccagaagcacggccggggcatggagaagagcaacaagagcaccaagagtgatgcccccaaggagaagggcaagaaggccccccgggtgtgggagctgggcggctgtgccaacaaggaggtgctggactacagcacccccaccaccaacggcaccccagaggccgccctgtctgaggacatcaacctgatccggggcaccggcagcggcggccagctgcaggacctggactgcagcagcagtgatgatgagggcgccgcccagaacagcaccaagcccagcgccaccaagggcaccctgggcggcatgtttggcatgctgaagggcctggtgggcagcaagagcctgagccgggaggacatggagagcgtgctggacaagatgagggaccacctgattgccaagaatgtggccgctgacattgctgtgcagctgtgtgagagcgtggccaacaagctggagggcaaggtgatgggcaccttcagcacagtgaccagcacagtgaagcaggccctgcaggagagcctggtgcagatcctgcagccccagaggagagtggacatgctgcgggacatcatggatgcccagaggcggcagaggccctacgtggtgaccttctgtggggtgaatggagtgggcaagagcaccaacctggccaagatctccttctggctgctggagaatggcttctctgtgctgattgctgcctgtgacaccttccgggccggggctgtggagcagctgcggacccacacccggcggctgagcgccctgcaccccccagagaagcatggaggccgcaccatggtgcagctgtttgagaagggctacggcaaggatgctgctggcatcgccatggaggccatcgcctttgccaggaaccagggctttgatgtggtgctggtggacacagctggccgcatgcaggacaatgcccccctgatgacagccctggccaagctgatcaccgtgaacaccccagacctggtgctgtttgtgggggaggccctggtgggcaatgaagctgtggaccagctggtgaagttcaacagagccctggccgaccacagcatggcccagaccccccggctgattgatggcatcgtgctgaccaagtttgacaccattgatgacaaggtgggcgccgccatctccatgacctacatcaccagcaagcccatcgtgtttgtgggcaccggccagacctactgtgacctgcggagcctgaatgccaaggctgtggtggccgccctgatgaaggcctag

SEQ ID NO: 21861 - DNA, 2253 bp, Artificial Sequence
  Description of Artificial Sequence: Synthetic coding sequence
atgagccagtggtatgagctgcagcagctggacagcaagttcctggagcaggtgcaccagctgtatgatgacagcttccccatggagatccggcagtacctggcccagtggctggagaagcaggactgggagcacgccgccaatgatgtgtcctttgccaccatccgcttccatgacctgctgagccagctggatgaccagtacagccgcttcagcctggagaacaacttcctgctgcagcacaacatcaggaagagcaagaggaacctgcaggacaacttccaggaggaccccatccagatgtccatgatcatctacagctgcctgaaggaggagaggaagatcctggagaatgcccagcgcttcaaccaggcccagagcggcaacatccagagcacagtgatgctggacaagcagaaggagctggacagcaaggtgagaaatgtgaaggacaaggtgatgtgcatcgagcacgagatcaagagcctggaggacctgcaggatgaatatgacttcaagtgcaagaccctgcagaaccgggagcacgagaccaatggagtggccaagagtgaccagaagcaggagcagctgctgctgaagaagatgtacctgatgctggacaacaagaggaaggaggtggtgcacaagatcatcgagctgctgaatgtgacagagctgacccagaatgccctgatcaatgatgagctggtggagtggaagaggcggcagcagagcgcctgcatcggcggccccccaaatgcctgcctggaccagctgcagaactggttcaccatcgtggccgagagcctgcagcaggtgcggcagcagctgaagaagctggaggagctggagcagaagtacacctatgaacatgaccccatcaccaagaacaagcaggtgctgtgggacaggaccttcagcctcttccagcagctgatccagagcagctttgtggtggagcggcagccctgcatgcccacccacccccagaggcccctggtgctgaagacaggagtgcagttcaccgtgaagctgcggctgctggtgaagctgcaggagctgaactacaacctgaaggtgaaggtgctgtttgacaaggatgtgaatgaaagaaacacagtgaagggcttcaggaagttcaacatcctgggcacccacaccaaggtgatgaacatggaggagagcaccaacggcagcctggccgctgagttccgccacctgcagctgaaggagcagaagaatgccggcaccaggaccaatgaaggccccctgattgtgacagaggagctgcacagcctgagctttgagacccagctgtgccagcccggcctggtgattgacctggagaccaccagcctgcctgtggtggtgatcagcaatgtgtcccagctgcccagcggctgggccagcatcctgtggtacaacatgctggtggccgagcccaggaacctgtccttcttcctgaccccaccctgtgcccgctgggcccagctgtctgaggtgctgtcctggcagttcagctctgtgaccaagaggggcctgaatgtggaccagctgaacatgctgggggagaagctgctgggccccaatgccagcccagatggcctcatcccctggacccgcttctgcaaggagaacatcaatgacaagaacttccccttctggctgtggattgagagcatcctggagctgatcaagaagcacctgctgcccctgtggaatgatggctgcatcatgggcttcatcagcaaggagcgggagcgggccctgctgaaggaccagcagcccggcaccttcctgctgcgcttcagcgagagcagccgggagggcgccatcaccttcacctgggtggagaggagccagaatggaggagagccagacttccacgctgtggagccctacaccaagaaggagctgtctgctgtgaccttcccagacatcatccggaactacaaggtgatggctgctgagaacatccctgagaaccccctgaagtacctgtaccccaacatcgacaaggaccacgccttcggcaagtactacagccggcccaaggaggcccctgagcccatggagctggatggccccaagggcaccggctacatcaagacagagctgatctctgtgtctgaggtgcaccccagccggctgcagaccacagacaacctgctgcccatgagccctgaggagtttgatgaggtgtccagaattgtgggctctgtggagtttgacagcatgatgaacacagtgtag

SEQ ID NO: 21862 - DNA, 2139 bp, Artificial Sequence
  Description of Artificial Sequence: Synthetic coding sequence
atgagccagtggtatgagctgcagcagctggacagcaagttcctggagcaggtgcaccagctgtatgatgacagcttccccatggagatccggcagtacctggcccagtggctggagaagcaggactgggagcacgccgccaatgatgtgtcctttgccaccatccgcttccatgacctgctgagccagctggatgaccagtacagccgcttcagcctggagaacaacttcctgctgcagcacaacatcaggaagagcaagaggaacctgcaggacaacttccaggaggaccccatccagatgtccatgatcatctacagctgcctgaaggaggagaggaagatcctggagaatgcccagcgcttcaaccaggcccagagcggcaacatccagagcacagtgatgctggacaagcagaaggagctggacagcaaggtgagaaatgtgaaggacaaggtgatgtgcatcgagcacgagatcaagagcctggaggacctgcaggatgaatatgacttcaagtgcaagaccctgcagaaccgggagcacgagaccaatggagtggccaagagtgaccagaagcaggagcagctgctgctgaagaagatgtacctgatgctggacaacaagaggaaggaggtggtgcacaagatcatcgagctgctgaatgtgacagagctgacccagaatgccctgatcaatgatgagctggtggagtggaagaggcggcagcagagcgcctgcatcggcggccccccaaatgcctgcctggaccagctgcagaactggttcaccatcgtggccgagagcctgcagcaggtgcggcagcagctgaagaagctggaggagctggagcagaagtacacctatgaacatgaccccatcaccaagaacaagcaggtgctgtgggacaggaccttcagcctcttccagcagctgatccagagcagctttgtggtggagcggcagccctgcatgcccacccacccccagaggcccctggtgctgaagacaggagtgcagttcaccgtgaagctgcggctgctggtgaagctgcaggagctgaactacaacctgaaggtgaaggtgctgtttgacaaggatgtgaatgaaagaaacacagtgaagggcttcaggaagttcaacatcctgggcacccacaccaaggtgatgaacatggaggagagcaccaacggcagcctggccgctgagttccgccacctgcagctgaaggagcagaagaatgccggcaccaggaccaatgaaggccccctgattgtgacagaggagctgcacagcctgagctttgagacccagctgtgccagcccggcctggtgattgacctggagaccaccagcctgcctgtggtggtgatcagcaatgtgtcccagctgcccagcggctgggccagcatcctgtggtacaacatgctggtggccgagcccaggaacctgtccttcttcctgaccccaccctgtgcccgctgggcccagctgtctgaggtgctgtcctggcagttcagctctgtgaccaagaggggcctgaatgtggaccagctgaacatgctgggggagaagctgctgggccccaatgccagcccagatggcctcatcccctggacccgcttctgcaaggagaacatcaatgacaagaacttccccttctggctgtggattgagagcatcctggagctgatcaagaagcacctgctgcccctgtggaatgatggctgcatcatgggcttcatcagcaaggagcgggagcgggccctgctgaaggaccagcagcccggcaccttcctgctgcgcttcagcgagagcagccgggagggcgccatcaccttcacctgggtggagaggagccagaatggaggagagccagacttccacgctgtggagccctacaccaagaaggagctgtctgctgtgaccttcccagacatcatccggaactacaaggtgatggctgctgagaacatccctgagaaccccctgaagtacctgtaccccaacatcgacaaggaccacgccttcggcaagtactacagccggcccaaggaggcccctgagcccatggagctggatggccccaagggcaccggctacatcaagacagagctgatctctgtgtctgaggtgtag

SEQ ID NO: 21863 - DNA, 2145 bp, Artificial Sequence
  Description of Artificial Sequence: Synthetic coding sequence
atgtggatgagccagtggtatgagctgcagcagctggacagcaagttcctggagcaggtgcaccagctgtatgatgacagcttccccatggagatccggcagtacctggcccagtggctggagaagcaggactgggagcacgccgccaatgatgtgtcctttgccaccatccgcttccatgacctgctgagccagctggatgaccagtacagccgcttcagcctggagaacaacttcctgctgcagcacaacatcaggaagagcaagaggaacctgcaggacaacttccaggaggaccccatccagatgtccatgatcatctacagctgcctgaaggaggagaggaagatcctggagaatgcccagcgcttcaaccaggcccagagcggcaacatccagagcacagtgatgctggacaagcagaaggagctggacagcaaggtgagaaatgtgaaggacaaggtgatgtgcatcgagcacgagatcaagagcctggaggacctgcaggatgaatatgacttcaagtgcaagaccctgcagaaccgggagcacgagaccaatggagtggccaagagtgaccagaagcaggagcagctgctgctgaagaagatgtacctgatgctggacaacaagaggaaggaggtggtgcacaagatcatcgagctgctgaatgtgacagagctgacccagaatgccctgatcaatgatgagctggtggagtggaagaggcggcagcagagcgcctgcatcggcggccccccaaatgcctgcctggaccagctgcagaactggttcaccatcgtggccgagagcctgcagcaggtgcggcagcagctgaagaagctggaggagctggagcagaagtacacctatgaacatgaccccatcaccaagaacaagcaggtgctgtgggacaggaccttcagcctcttccagcagctgatccagagcagctttgtggtggagcggcagccctgcatgcccacccacccccagaggcccctggtgctgaagacaggagtgcagttcaccgtgaagctgcggctgctggtgaagctgcaggagctgaactacaacctgaaggtgaaggtgctgtttgacaaggatgtgaatgaaagaaacacagtgaagggcttcaggaagttcaacatcctgggcacccacaccaaggtgatgaacatggaggagagcaccaacggcagcctggccgctgagttccgccacctgcagctgaaggagcagaagaatgccggcaccaggaccaatgaaggccccctgattgtgacagaggagctgcacagcctgagctttgagacccagctgtgccagcccggcctggtgattgacctggagaccaccagcctgcctgtggtggtgatcagcaatgtgtcccagctgcccagcggctgggccagcatcctgtggtacaacatgctggtggccgagcccaggaacctgtccttcttcctgaccccaccctgtgcccgctgggcccagctgtctgaggtgctgtcctggcagttcagctctgtgaccaagaggggcctgaatgtggaccagctgaacatgctgggggagaagctgctgggccccaatgccagcccagatggcctcatcccctggacccgcttctgcaaggagaacatcaatgacaagaacttccccttctggctgtggattgagagcatcctggagctgatcaagaagcacctgctgcccctgtggaatgatggctgcatcatgggcttcatcagcaaggagcgggagcgggccctgctgaaggaccagcagcccggcaccttcctgctgcgcttcagcgagagcagccgggagggcgccatcaccttcacctgggtggagaggagccagaatggaggagagccagacttccacgctgtggagccctacaccaagaaggagctgtctgctgtgaccttcccagacatcatccggaactacaaggtgatggctgctgagaacatccctgagaaccccctgaagtacctgtaccccaacatcgacaaggaccacgccttcggcaagtactacagccggcccaaggaggcccctgagcccatggagctggatggccccaagggcaccggctacatcaagacagagctgatctctgtgtctgaggtgtag

SEQ ID NO: 21864 - DNA, 2253 bp, Artificial Sequence; identical to SEQ ID NO: 21861
  Description of Artificial Sequence: Synthetic coding sequence

SEQ ID NO: 21865 - DNA, 543 bp, Artificial Sequence
  Description of Artificial Sequence: Synthetic coding sequence
atgagccagtggtatgagctgcagcagctggacagcaagttcctggagcaggtgcaccagctgtatgatgacagcttccccatggagatccggcagtacctggcccagtggctggagaagcaggactgggagcacgccgccaatgatgtgtcctttgccaccatccgcttccatgacctgctgagccagctggatgaccagtacagccgcttcagcctggagaacaacttcctgctgcagcacaacatcaggaagagcaagaggaacctgcaggacaacttccaggaggaccccatccagatgtccatgatcatctacagctgcctgaaggaggagaggaagatcctggagaatgcccagcgcttcaaccaggcccagagcggcaacatccagagcacagtgatgctggacaagcagaaggagctggacagcaaggtgagaaatgtgaaggacaaggtgatgtgcatcgagcacgagatcaagagcctggaggacctgcaggatgaatatgacttcaagtgcaagaccctgcagaacagatag

SEQ ID NO: 21866 - DNA, 213 bp, Artificial Sequence
  Description of Artificial Sequence: Synthetic coding sequence
atgagccagtggtatgagctgcagcagctggacagcaagttcctggagcaggtgcaccagctgtatgatgacagcttccccatggagatccggcagtacctggcccagtggctggagaagcaggactgggagcacgccgccaatgatgtgtcctttgccaccatccgcttccatgacctgctgagccagctggatgaccagtacagcaggtag

SEQ ID NO: 21867 - DNA, 582 bp, Artificial Sequence
  Description of Artificial Sequence: Synthetic coding sequence
atgagccagtggtatgagctgcagcagctggacagcaagttcctggagcaggtgcaccagctgtatgatgacagcttccccatggagatccggcagtacctggcccagtggctggagaagcaggactgggagcacgccgccaatgatgtgtcctttgccaccatccgcttccatgacctgctgagccagctggatgaccagtacagccgcttcagcctggagaacaacttcctgctgcagcacaacatcaggaagagcaagaggaacctgcaggacaacttccaggaggaccccatccagatgtccatgatcatctacagctgcctgaaggaggagaggaagatcctggagaatgcccagcgcttcaaccaggcccagagcggcaacatccagagcacagtgatgctggacaagcagaaggagctggacagcaaggtgagaaatgtgaaggacaaggtgatgtgcatcgagcacgagatcaagagcctggaggacctgcaggatgaatatgacttcaagtgcaagaccctgcagaacagaggcagcagcagccagaacaacagagtggccgagtgccactag

SEQ ID NO: 21868 - DNA, 453 bp, Artificial Sequence
  Description of Artificial Sequence: Synthetic coding sequence
atgagccagtggtatgagctgcagcagctggacagcaagttcctggagcaggtgcaccagctgtatgatgacagcttccccatggagatccggcagtacctggcccagtggctggagaagcaggactgggagcacgccgccaatgatgtgtcctttgccaccatccgcttccatgacctgctgagccagctggatgaccagtacagccgcttcagcctggagaacaacttcctgctgcagcacaacatcaggaagagcaagaggaacctgcaggacaacttccaggaggaccccatccagatgtccatgatcatctacagctgcctgaaggaggagaggaagatcctggagaatgcccagcgcttcaaccaggcccagagcggcaacatccagagcacagtgatgctggacaagcagaaggagctggacagcaaggtgagaaatgtgaagtag

SEQ ID NO: 21869 - DNA, 582 bp, Artificial Sequence; identical to SEQ ID NO: 21867
  Description of Artificial Sequence: Synthetic coding sequence

SEQ ID NO: 21870 - DNA, 483 bp, Artificial Sequence
  Description of Artificial Sequence: Synthetic coding sequence
gaatgtcatgaggaccccatccagatgtccatgatcatctacagctgcctgaaggaggagaggaagatcctggagaatgcccagcgcttcaaccaggcccagagcggcaacatccagagcacagtgatgctggacaagcagaaggagctggacagcaaggtgagaaatgtgaaggacaaggtgatgtgcatcgagcacgagatcaagagcctggaggacctgcaggatgaatatgacttcaagtgcaagaccctgcagaaccgggagcacgagaccaatggagtggccaagagtgaccagaagcaggagcagctgctgctgaagaagatgtacctgatgctggacaacaagaggaaggaggtggtgcacaagatcatcgagctgctgaatgtgacagagctgacccagaatgccctgatcaatgatgagctggtggagtggaagaggcggcagcagagcgcctgcatcggcggccccccatag

SEQ ID NO: 21871 - DNA, 2556 bp, Artificial Sequence
  Description of Artificial Sequence: Synthetic coding sequence
atggcccagtgggagatgctgcagaacctggacagccccttccaggaccagctgcaccagctgtacagccacagcctgctgcctgtggacatccggcagtacctggccgtgtggattgaggaccagaactggcaggaggccgccctgggcagtgatgacagcaaggccaccatgctgttcttccacttcctggaccagctgaactatgaatgtggccgctgcagccaggaccctgagagcctgctgctgcagcacaacctgaggaagttctgccgggacatccagcccttcagccaggaccccacccagctggccgagatgatcttcaacctgctgctggaggagaagaggatcctgatccaggcccagagggcccagctggagcagggcgagcctgtgctggagacccctgtggagagccagcagcatgaaattgagagccgcatcctggacctgcgggccatgatggagaagctggtgaagagcatcagccagctgaaggaccagcaggatgtgttctgcttccgctacaagatccaggccaagggcaagacccccagcctggacccccaccagaccaaggagcagaagatcctgcaggagaccctgaatgagctggacaagaggaggaaggaggtgctggatgccagcaaggccctgctgggccgcctgaccaccctcatcgagctgctgctgcccaagctggaggagtggaaggcccagcagcagaaggcctgcatccgggcccccatcgaccacggcctggagcagctggagacctggttcaccgctggggccaagctgctcttccacctgcggcagctgctgaaggagctgaagggcctgagctgcctggtgtcctaccaggatgaccccctgaccaagggcgtggacctgagaaatgcccaggtgacagagctgctgcagaggctgctgcaccgggcctttgtggtggagacccagccctgcatgccccagaccccccaccggcccctcatcctgaagacaggcagcaagttcaccgtgaggacccggctgctggtgcggctgcaggagggcaatgaaagcctgactgtggaggtgtccattgacagaaatccaccccagctgcagggcttcaggaagttcaacatcctgaccagcaaccagaagaccctgaccccagagaagggccagagccagggcctcatctgggactttggctacctgaccctggtggagcagaggtctgggggcagcggcaagggcagcaacaagggccccctgggcgtgacagaggagctgcacatcatctccttcaccgtgaagtacacctaccagggcctgaagcaggagctgaagacagacaccctgcctgtggtgatcatcagcaacatgaaccagctgagcatcgcctgggcctctgtgctgtggttcaacctgctgagccccaacctgcagaaccagcagttcttcagcaacccccccaaggccccctggagcctgctgggccctgccctgtcctggcagttcagcagctatgtgggccggggcctgaacagcgaccagctgtccatgctgaggaacaagctgtttggccagaactgcaggacagaggaccccctgctgtcctgggccgacttcaccaagcgggagagccccccaggcaagctgcccttctggacctggctggacaagatcctggagctggtgcatgaccacctgaaggacctgtggaatgatggccgcatcatgggctttgtgagccgcagccaggagcggcggctgctgaagaagaccatgagcggcaccttcctgctgcgcttcagcgagagcagcgagggcggcatcacctgctcctgggtggagcaccaggatgatgacaaggtgctgatctacagcgtgcagccctacaccaaggaggtgctgcagagcctgcccctgacagagatcatccgccactaccagctgctgacagaggagaacatccctgagaaccccctgcgcttcctgtacccccgcatccccagagatgaggccttcggctgctactaccaggagaaggtgaacctgcaggagaggaggaagtacctgaagcacaggctcatcgtggtgagcaaccggcaggtggatgagctgcagcagcccctggagctgaagccagagcctgagctggagagcctggagctggagctgggcctggtgcctgagcctgagctgagcctggacctggagcccctgctgaaggccggcctggacctgggccctgagctggagagcgtgctggagagcaccctggagcctgtgattgagcccaccctgtgcatggtgtcccagacagtgcctgagccagaccagggccctgtgtcccagcctgtgcctgagccagacctgccctgtgacctgcggcacctgaacacagagcccatggagatcttcaggaactgtgtgaagattgaggagatcatgcccaacggggaccccctgctggccggccagaacacagtggatgaggtgtatgtgtcccggcccagccacttctacacagatggccccctgatgcccagcgacttctag

SEQ ID NO: 21872 - DNA, 1383 bp, Artificial Sequence
  Description of Artificial Sequence: Synthetic coding sequence
atggcccagtgggagatgctgcagaacctggacagccccttccaggaccagctgcaccagctgtacagccacagcctgctgcctgtggacatccggcagtacctggccgtgtggattgaggaccagaactggcaggaggccgccctgggcagtgatgacagcaaggccaccatgctgttcttccacttcctggaccagctgaactatgaatgtggccgctgcagccaggaccctgagagcctgctgctgcagcacaacctgaggaagttctgccgggacatccaggaccccacccagctggccgagatgatcttcaacctgctgctggaggagaagaggatcctgatccaggcccagagggcccagctggagcagggcgagcctgtgctggagacccctgtggagagccagcagcatgaaattgagagccgcatcctggacctgcgggccatgatggagaagctggtgaagagcatcagccagctgaaggaccagcaggatgtgttctgcttccgctacaagatccaggccaagggcaagacccccagcctggacccccaccagaccaaggagcagaagatcctgcaggagaccctgaatgagctggacaagaggaggaaggaggtgctggatgccagcaaggccctgctgggccgcctgaccaccctcatcgagctgctgctgcccaagctggaggagtggaaggcccagcagcagaaggcctgcatccgggcccccatcgaccacggcctggagcagctggagacctggttcaccgctggggccaagctgctcttccacctgcggcagctgctgaaggagctgaagggcctgagctgcctggtgtcctaccaggatgaccccctgaccaagggcgtggacctgagaaatgcccaggtgacagagctgctgcagaggctgctgcaccgggcctttgtggtggagacccagccctgcatgccccagaccccccaccggcccctcatcctgaagacaggcagcaagttcaccgtgaggacccggctgctggtgcggctgcaggagggcaatgaaagcctgactgtggaggtgtccattgacagaaatccaccccagctgcagggcttcaggaagttcaacatcctgaccagcaaccagaagaccctgaccccagagaagggccagagccagggcctcatctgggactttggctacctgaccctggtggagcagaggtctgggggcagcggcaagggcagcaacaagggccccctgggcgtgacagaggagctgcacatcatctccttcaccgtgaagtacacctaccagggcctgaagcaggagctgaaggtgtctgaaaatggaggccagggcgagaggaagcagctgtggaagaaggcctag

SEQ ID NO: 21873 - DNA, 2544 bp, Artificial Sequence
  Description of Artificial Sequence: Synthetic coding sequence
atggcccagtgggagatgctgcagaacctggacagccccttccaggaccagctgcaccagctgtacagccacagcctgctgcctgtggacatccggcagtacctggccgtgtggattgaggaccagaactggcaggaggccgccctgggcagtgatgacagcaaggccaccatgctgttcttccacttcctggaccagctgaactatgaatgtggccgctgcagccaggaccctgagagcctgctgctgcagcacaacctgaggaagttctgccgggacatccaggaccccacccagctggccgagatgatcttcaacctgctgctggaggagaagaggatcctgatccaggcccagagggcccagctggagcagggcgagcctgtgctggagacccctgtggagagccagcagcatgaaattgagagccgcatcctggacctgcgggccatgatggagaagctggtgaagagcatcagccagctgaaggaccagcaggatgtgttctgcttccgctacaagatccaggccaagggcaagacccccagcctggacccccaccagaccaaggagcagaagatcctgcaggagaccctgaatgagctggacaagaggaggaaggaggtgctggatgccagcaaggccctgctgggccgcctgaccaccctcatcgagctgctgctgcccaagctggaggagtggaaggcccagcagcagaaggcctgcatccgggcccccatcgaccacggcctggagcagctggagacctggttcaccgctggggccaagctgctcttccacctgcggcagctgctgaaggagctgaagggcctgagctgcctggtgtcctaccaggatgaccccctgaccaagggcgtggacctgagaaatgcccaggtgacagagctgctgcagaggctgctgcaccgggcctttgtggtggagacccagccctgcatgccccagaccccccaccggcccctcatcctgaagacaggcagcaagttcaccgtgaggacccggctgctggtgcggctgcaggagggcaatgaaagcctgactgtggaggtgtccattgacagaaatccaccccagctgcagggcttcaggaagttcaacatcctgaccagcaaccagaagaccctgaccccagagaagggccagagccagggcctcatctgggactttggctacctgaccctggtggagcagaggtctgggggcagcggcaagggcagcaacaagggccccctgggcgtgacagaggagctgcacatcatctccttcaccgtgaagtacacctaccagggcctgaagcaggagctgaagacagacaccctgcctgtggtgatcatcagcaacatgaaccagctgagcatcgcctgggcctctgtgctgtggttcaacctgctgagccccaacctgcagaaccagcagttcttcagcaacccccccaaggccccctggagcctgctgggccctgccctgtcctggcagttcagcagctatgtgggccggggcctgaacagcgaccagctgtccatgctgaggaacaagctgtttggccagaactgcaggacagaggaccccctgctgtcctgggccgacttcaccaagcgggagagccccccaggcaagctgcccttctggacctggctggacaagatcctggagctggtgcatgaccacctgaaggacctgtggaatgatggccgcatcatgggctttgtgagccgcagccaggagcggcggctgctgaagaagaccatgagcggcaccttcctgctgcgcttcagcgagagcagcgagggcggcatcacctgctcctgggtggagcaccaggatgatgacaaggtgctgatctacagcgtgcagccctacaccaaggaggtgctgcagagcctgcccctgacagagatcatccgccactaccagctgctgacagaggagaacatccctgagaaccccctgcgcttcctgtacccccgcatccccagagatgaggccttcggctgctactaccaggagaaggtgaacctgcaggagaggaggaagtacctgaagcacaggctcatcgtggtgagcaaccggcaggtggatgagctgcagcagcccctggagctgaagccagagcctgagctggagagcctggagctggagctgggcctggtgcctgagcctgagctgagcctggacctggagcccctgctgaaggccggcctggacctgggccctgagctggagagcgtgctggagagcaccctggagcctgtgattgagcccaccctgtgcatggtgtcccagacagtgcctgagccagaccagggccctgtgtcccagcctgtgcctgagccagacctgccctgtgacctgcggcacctgaacacagagcccatggagatcttcaggaactgtgtgaagattgaggagatcatgcccaacggggaccccctgctggccggccagaacacagtggatgaggtgtatgtgtcccggcccagccacttctacacagatggccccctgatgcccagcgacttctag

SEQ ID NO: 21874 - DNA, 2313 bp, Artificial Sequence
  Description of Artificial Sequence: Synthetic coding sequence
atggcccagtggaaccagctgcagcagctggacacccgctacctggagcagctgcaccagctgtacagcgacagcttccccatggagctgcggcagttcctggccccctggattgagagccaggactgggcctatgctgccagcaaggagagccacgccaccctggtgttccacaacctgctgggggagattgaccagcagtacagccgcttcctgcaggagagcaatgtgctgtaccagcacaacctgcggcgcatcaagcagttcctgcagagccgctacctggagaagcccatggagatcgcccgcatcgtggcccgctgcctgtgggaggagagccggctgctgcagacagctgccacagctgcccagcagggcggccaggccaaccaccccacagctgctgtggtgacagagaagcagcagatgctggagcagcacctgcaggatgtgaggaagagggtgcaggacctggagcagaagatgaaggtggtggagaacctgcaggatgactttgacttcaactacaagaccctgaagagccagggcgacatgcaggacctgaatggaaacaaccagagcgtgacccggcagaagatgcagcagctggagcagatgctgacagccctggaccagatgaggaggagcatcgtgtctgagctggccggcctgctgagcgccatggagtatgtgcagaagaccctgacagatgaggagctggccgactggaagaggcggcagcagatcgcctgcatcggcggcccccccaacatctgcctggaccggctggagaactggatcaccagcctggccgagagccagctgcagacccggcagcagatcaagaagctggaggagctgcagcagaaggtgtcctacaagggggaccccatcgtgcagcaccggcccatgctggaggagagaattgtggagctgttcaggaacctgatgaagagcgcctttgtggtggagcggcagccctgcatgcccatgcacccagaccggcccctggtgatcaagacaggagtgcagttcaccaccaaggtgcggctgctggtgaagtttcctgagctgaactaccagctgaagatcaaggtgtgcatcgacaaggacagcggagatgtggccgccctgcggggcagcaggaagttcaacatcctgggcaccaacaccaaggtgatgaacatggaggagagcaacaacggcagcctgtctgctgagttcaagcacctgaccctgcgggagcagagatgtggaaatggaggccgggccaactgtgatgccagcctgattgtgacagaggagctgcacctgatcacctttgaaacagaggtgtaccaccagggcctgaagattgacctggagacccacagcctgcctgtggtggtgatcagcaacatctgccagatgcccaatgcctgggccagcatcctgtggtacaacatgctgaccaacaaccccaagaatgtgaacttcttcaccaagccacccatcggcacctgggaccaggtggccgaggtgctgtcctggcagttcagcagcaccaccaagaggggcctgagcattgagcagctgaccaccctggccgagaagctgctgggccctggggtgaactacagcggctgccagatcacctgggccaagttctgcaaggagaacatggccggcaagggcttctccttctgggtgtggctggacaacatcatcgacctggtgaagaagtacatcctggccctgtggaatgaaggctacatcatgggcttcatcagcaaggagcgggagcgggccatcctgagcaccaagcccccaggcaccttcctgctgcgcttcagcgagagcagcaaggagggcggcgtgaccttcacctgggtggagaaggacatcagcggcaagacccagatccagagcgtggagccctacaccaagcagcagctgaacaacatgagctttgctgagatcatcatgggctacaagatcatggatgccaccaacatcctggtgagccccctggtgtacctgtacccagacatccccaaggaggaggccttcggcaagtactgcaggcctgagagccaggagcaccctgaggccgaccccggcagcgctgccccctacctgaagaccaagttcatctgtgtgacccccaccacctgcagcaacaccatcgacctgcccatgagccccaggaccctggacagcctgatgcagtttggaaacaacggggagggcgctgagcccagcgctgggggccagtttgagagcctgacctttgacatggagctgaccagtgaatgtgccaccagccccatgtag

SEQ ID NO: 21875 - DNA, 2019 bp, Artificial Sequence
  Description of Artificial Sequence: Synthetic coding sequence
atggagatcgcccgcatcgtggcccgctgcctgtgggaggagagccggctgctgcagacagctgccacagctgcccagcagggcggccaggccaaccaccccacagctgctgtggtgacagagaagcagcagatgctggagcagcacctgcaggatgtgaggaagagggtgcaggacctggagcagaagatgaaggtggtggagaacctgcaggatgactttgacttcaactacaagaccctgaagagccagggcgacatgcaggacctgaatggaaacaaccagagcgtgacccggcagaagatgcagcagctggagcagatgctgacagccctggaccagatgaggaggagcatcgtgtctgagctggccggcctgctgagcgccatggagtatgtgcagaagaccctgacagatgaggagctggccgactggaagaggcggcagcagatcgcctgcatcggcggcccccccaacatctgcctggaccggctggagaactggatcaccagcctggccgagagccagctgcagacccggcagcagatcaagaagctggaggagctgcagcagaaggtgtcctacaagggggaccccatcgtgcagcaccggcccatgctggaggagagaattgtggagctgttcaggaacctgatgaagagcgcctttgtggtggagcggcagccctgcatgcccatgcacccagaccggcccctggtgatcaagacaggagtgcagttcaccaccaaggtgcggctgctggtgaagtttcctgagctgaactaccagctgaagatcaaggtgtgcatcgacaaggacagcggagatgtggccgccctgcggggcagcaggaagttcaacatcctgggcaccaacaccaaggtgatgaacatggaggagagcaacaacggcagcctgtctgctgagttcaagcacctgaccctgcgggagcagagatgtggaaatggaggccgggccaactgtgatgccagcctgattgtgacagaggagctgcacctgatcacctttgaaacagaggtgtaccaccagggcctgaagattgacctggagacccacagcctgcctgtggtggtgatcagcaacatctgccagatgcccaatgcctgggccagcatcctgtggtacaacatgctgaccaacaaccccaagaatgtgaacttcttcaccaagccacccatcggcacctgggaccaggtggccgaggtgctgtcctggcagttcagcagcaccaccaagaggggcctgagcattgagcagctgaccaccctggccgagaagctgctgggccctggggtgaactacagcggctgccagatcacctgggccaagttctgcaaggagaacatggccggcaagggcttctccttctgggtgtggctggacaacatcatcgacctggtgaagaagtacatcctggccctgtggaatgaaggctacatcatgggcttcatcagcaaggagcgggagcgggccatcctgagcaccaagcccccaggcaccttcctgctgcgcttcagcgagagcagcaaggagggcggcgtgaccttcacctgggtggagaaggacatcagcggcaagacccagatccagagcgtggagccctacaccaagcagcagctgaacaacatgagctttgctgagatcatcatgggctacaagatcatggatgccaccaacatcctggtgagccccctggtgtacctgtacccagacatccccaaggaggaggccttcggcaagtactgcaggcctgagagccaggagcaccctgaggccgaccccggcagcgctgccccctacctgaagaccaagttcatctgtgtgacccccaccacctgcagcaacaccatcgacctgcccatgagccccaggaccctggacagcctgatgcagtttggaaacaacggggagggcgctgagcccagcgctgggggccagtttgagagcctgacctttgacatggagctgaccagtgaatgtgccaccagccccatgtag

SEQ ID NO: 21876 - DNA, 2310 bp, Artificial Sequence
  Description of Artificial Sequence: Synthetic coding sequence
atggcccagtggaaccagctgcagcagctggacacccgctacctggagcagctgcaccagctgtacagcgacagcttccccatggagctgcggcagttcctggccccctggattgagagccaggactgggcctatgctgccagcaaggagagccacgccaccctggtgttccacaacctgctgggggagattgaccagcagtacagccgcttcctgcaggagagcaatgtgctgtaccagcacaacctgcggcgcatcaagcagttcctgcagagccgctacctggagaagcccatggagatcgcccgcatcgtggcccgctgcctgtgggaggagagccggctgctgcagacagctgccacagctgcccagcagggcggccaggccaaccaccccacagctgctgtggtgacagagaagcagcagatgctggagcagcacctgcaggatgtgaggaagagggtgcaggacctggagcagaagatgaaggtggtggagaacctgcaggatgactttgacttcaactacaagaccctgaagagccagggcgacatgcaggacctgaatggaaacaaccagagcgtgacccggcagaagatgcagcagctggagcagatgctgacagccctggaccagatgaggaggagcatcgtgtctgagctggccggcctgctgagcgccatggagtatgtgcagaagaccctgacagatgaggagctggccgactggaagaggcggcagcagatcgcctgcatcggcggcccccccaacatctgcctggaccggctggagaactggatcaccagcctggccgagagccagctgcagacccggcagcagatcaagaagctggaggagctgcagcagaaggtgtcctacaagggggaccccatcgtgcagcaccggcccatgctggaggagagaattgtggagctgttcaggaacctgatgaagagcgcctttgtggtggagcggcagccctgcatgcccatgcacccagaccggcccctggtgatcaagacaggagtgcagttcaccaccaaggtgcggctgctggtgaagtttcctgagctgaactaccagctgaagatcaaggtgtgcatcgacaaggacagcggagatgtggccgccctgcggggcagcaggaagttcaacatcctgggcaccaacaccaaggtgatgaacatggaggagagcaacaacggcagcctgtctgctgagttcaagcacctgaccctgcgggagcagagatgtggaaatggaggccgggccaactgtgatgccagcctgattgtgacagaggagctgcacctgatcacctttgaaacagaggtgtaccaccagggcctgaagattgacctggagacccacagcctgcctgtggtggtgatcagcaacatctgccagatgcccaatgcctgggccagcatcctgtggtacaacatgctgaccaacaaccccaagaatgtgaacttcttcaccaagccacccatcggcacctgggaccaggtggccgaggtgctgtcctggcagttcagcagcaccaccaagaggggcctgagcattgagcagctgaccaccctggccgagaagctgctgggccctggggtgaactacagcggctgccagatcacctgggccaagttctgcaaggagaacatggccggcaagggcttctccttctgggtgtggctggacaacatcatcgacctggtgaagaagtacatcctggccctgtggaatgaaggctacatcatgggcttcatcagcaaggagcgggagcgggccatcctgagcaccaagcccccaggcaccttcctgctgcgcttcagcgagagcagcaaggagggcggcgtgaccttcacctgggtggagaaggacatcagcggcaagacccagatccagagcgtggagccctacaccaagcagcagctgaacaacatgagctttgctgagatcatcatgggctacaagatcatggatgccaccaacatcctggtgagccccctggtgtacctgtacccagacatccccaaggaggaggccttcggcaagtactgcaggcctgagagccaggagcaccctgaggccgaccctggagctgccccctacctgaagaccaagttcatctgtgtgacccccaccacctgcagcaacaccatcgacctgcccatgagccccaggaccctggacagcctgatgcagtttggaaataatggagagggcgctgagcccagcgctgggggccagtttgagagcctgacctttgacatggagctgaccagtgaatgtgccaccagccccatgtag

SEQ ID NO: 21877 - DNA, 2169 bp, Artificial Sequence
  Description of Artificial Sequence: Synthetic coding sequence
atggcccagtggaaccagctgcagcagctggacacccgctacctggagcagctgcaccagctgtacagcgacagcttccccatggagctgcggcagttcctggccccctggattgagagccaggactgggcctatgctgccagcaaggagagccacgccaccctggtgttccacaacctgctgggggagattgaccagcagtacagccgcttcctgcaggagagcaatgtgctgtaccagcacaacctgcggcgcatcaagcagttcctgcagagccgctacctggagaagcccatggagatcgcccgcatcgtggcccgctgcctgtgggaggagagccggctgctgcagacagctgccacagctgcccagcagggcggccaggccaaccaccccacagctgctgtggtgacagagaagcagcagatgctggagcagcacctgcaggatgtgaggaagagggtgcaggacctggagcagaagatgaaggtggtggagaacctgcaggatgactttgacttcaactacaagaccctgaagagccagggcgacatgcaggacctgaatggaaacaaccagagcgtgacccggcagaagatgcagcagctggagcagatgctgacagccctggaccagatgaggaggagcatcgtgtctgagctggccggcctgctgagcgccatggagtatgtgcagaagaccctgacagatgaggagctggccgactggaagaggcggcagcagatcgcctgcatcggcggcccccccaacatctgcctggaccggctggagaactggatcaccagcctggccgagagccagctgcagacccggcagcagatcaagaagctggaggagctgcagcagaaggtgtcctacaagggggaccccatcgtgcagcaccggcccatgctggaggagagaattgtggagctgttcaggaacctgatgaagagcgcctttgtggtggagcggcagccctgcatgcccatgcacccagaccggcccctggtgatcaagacaggagtgcagttcaccaccaaggtgcggctgctggtgaagtttcctgagctgaactaccagctgaagatcaaggtgtgcatcgacaaggacagcggagatgtggccgccctgcggggcagcaggaagttcaacatcctgggcaccaacaccaaggtgatgaacatggaggagagcaacaacggcagcctgtctgctgagttcaagcacctgaccctgcgggagcagagatgtggaaatggaggccgggccaactgtgatgccagcctgattgtgacagaggagctgcacctgatcacctttgaaacagaggtgtaccaccagggcctgaagattgacctggagacccacagcctgcctgtggtggtgatcagcaacatctgccagatgcccaatgcctgggccagcatcctgtggtacaacatgctgaccaacaaccccaagaatgtgaacttcttcaccaagccacccatcggcacctgggaccaggtggccgaggtgctgtcctggcagttcagcagcaccaccaagaggggcctgagcattgagcagctgaccaccctggccgagaagctgctgggccctggggtgaactacagcggctgccagatcacctgggccaagttctgcaaggagaacatggccggcaagggcttctccttctgggtgtggctggacaacatcatcgacctggtgaagaagtacatcctggccctgtggaatgaaggctacatcatgggcttcatcagcaaggagcgggagcgggccatcctgagcaccaagcccccaggcaccttcctgctgcgcttcagcgagagcagcaaggagggcggcgtgaccttcacctgggtggagaaggacatcagcggcaagacccagatccagagcgtggagccctacaccaagcagcagctgaacaacatgagctttgctgagatcatcatgggctacaagatcatggatgccaccaacatcctggtgagccccctggtgtacctgtacccagacatccccaaggaggaggccttcggcaagtactgcaggcctgagagccaggagcaccctgaggccgaccccggcagcgctgccccctacctgaagaccaagttcatctgtgtgacccccttcattgatgctgtgtggaagtag

SEQ ID NO: 21878 - DNA, 2247 bp, Artificial Sequence
  Description of Artificial Sequence: Synthetic coding sequence
atgagccagtggaaccaggtgcagcagctggagatcaagttcctggagcaggtggaccagttctatgatgacaacttccccatggagatccgccacctgctggcccagtggattgagaaccaggactgggaggccgccagcaacaatgagaccatggccaccatcctgctgcagaacctgctgatccagctggatgagcagctgggccgggtgtccaaggagaagaacctgctgctgatccacaacctgaagaggatcaggaaggtgctgcagggcaagttccacggcaaccccatgcacgtggccgtggtgatcagcaactgcctgcgggaggagcggcgcatcctggccgccgccaacatgcctgtgcagggccccctggagaagagcctgcagagcagctctgtgtctgagcggcagagaaatgtggagcacaaggtggccgccatcaagaacagcgtgcagatgacagagcaggacaccaagtacctggaggacctgcaggatgaatttgactaccgctacaagaccatccagaccatggaccagagcgacaagaacagcgccatggtgaaccaggaggtgctgaccctgcaggagatgctgaacagcctggacttcaagaggaaggaggccctgagcaagatgacccagatcatccatgaaacagacctgctgatgaacaccatgctgattgaggagctgcaggactggaagaggcggcagcagatcgcctgcattggaggccccctgcacaacggcctggaccagctgcagaactgcttcaccctgctggccgagagcctcttccagctgcggcggcagctggagaagctggaggagcagagcaccaagatgacctatgaaggagaccccatccccatgcagaggacccacatgctggagcgggtgaccttcctgatctacaacctcttcaagaacagctttgtggtggagcggcagccctgcatgcccacccacccccagaggcccctggtgctgaagaccctcatccagttcaccgtgaagctgcggctgctgatcaagctgcctgagctgaactaccaggtgaaggtgaaggccagcattgacaagaatgtgtccaccctgagcaacagaagatttgtgctgtgtggcaccaacgtgaaggccatgagcattgaggagagcagcaatggcagcctgtctgtggagttccgccacctgcagcccaaggagatgaagagcagcgctgggggcaaaggaaatgaaggctgccacatggtgacagaggagctgcacagcatcacctttgagacccagatctgcctgtatggcctgaccatcgacctggagaccagcagcctgcctgtggtgatgatcagcaatgtgtcccagctgcccaatgcctgggccagcatcatctggtacaacgtgtccaccaatgacagccagaacctggtgttcttcaacaaccccccaccagccaccctgagccagctgctggaggtgatgtcctggcagttcagcagctatgtgggccggggcctgaacagcgaccagctgcacatgctggccgagaagctgactgtgcagagcagctacagtgatggccacctgacctgggccaagttctgcaaggagcacctgcccgggaagagcttcaccttctggacctggctggaggccatcctggacctgatcaagaagcacatcctgcccctgtggattgatggctacgtgatgggctttgtgtccaaggagaaggagcggctgctgctgaaggacaagatgcctggcaccttcctgctgcgcttcagcgagagccacctgggcggcatcaccttcacctgggtggaccacagcgagagcggggaggtgcgcttccacagcgtggagccctacaacaagggccgcctgagcgccctgccctttgctgacatcctgcgggactacaaggtgatcatggccgagaacatccctgagaaccccctgaagtacctgtacccagacatccccaaggacaaggccttcggcaagcactacagcagccagccctgtgaggtgtcccggcccacagagcggggggacaagggctacgtgcccagcgtcttcatccccatcagcaccatccgcagtgacagcacagagccccacagccccagcgacctgctgcccatgagccccagcgtgtatgctgtgctgcgggagaacctgagccccaccaccattgaaacagccatgaagagcccctacagcgctgagtag

SEQ ID NO: 21879 - DNA, 2247 bp, Artificial Sequence; identical to SEQ ID NO: 21878
  Description of Artificial Sequence: Synthetic coding sequence

SEQ ID NO: 21880 - DNA, 354 bp, Artificial Sequence
  Description of Artificial Sequence: Synthetic coding sequence
atgagccagtggaaccaggtgcagcagctggagatcaagttcctggagcaggtggaccagttctatgatgacaacttccccatggagatccgccacctgctggcccagtggattgagaaccaggactgggaggccgccagcaacaatgagaccatggccaccatcctgctgcagaacctgctgatccagctggatgagcagctgggccgggtgtccaaggagaagaacctgctgctgatccacaacctgaagaggatcaggaaggtgctgcagagccctggcctggccacagcccagctgcccctggacagacatggagagacctgcatccagaggagcaagagctgcccctag

SEQ ID NO: 21881 - DNA, 78 bp, Artificial Sequence
  Description of Artificial Sequence: Synthetic coding sequence
atgagccagtggaaccaggtgcagcagctggagatcaagttcctggagcaggtggaccagttctatgatgacaactag

SEQ ID NO: 21882 - DNA, 240 bp, Artificial Sequence
  Description of Artificial Sequence: Synthetic coding sequence
atgagccagtggaaccaggtgcagcagctggagatcaagttcctggagcaggtggaccagttctatgatgacaacttccccatggagatccgccacctgctggcccagtggattgagaaccaggactgggaggccgccagcaacaatgagaccatggccaccatcctgctgcagaacctgctgatccagctggatgagcagctgggccgggtgtccaaggagaagaacctgctgctgtag

SEQ ID NO: 21883 - DNA, 2385 bp, Artificial Sequence
  Description of Artificial Sequence: Synthetic coding sequence
atggccggctggatccaggcccagcagctgcagggagatgccctgcggcagatgcaggtgctgtatggccagcacttccccatcgaggtgcgccactacctggcccagtggattgagagccagccctgggatgccatcgacctggacaacccccaggaccgggcccaggccacccagctgctggagggcctggtgcaggagctgcagaagaaggccgagcaccaggtgggggaggatggcttcctgctgaagatcaagctgggccactacgccacccagctgcagaagacctatgaccgctgccccctggagctggtgcgctgcatccgccacatcctgtacaatgagcagaggctggtgcgggaggccaacaactgcagcagccctgctggcatcctggtggatgccatgagccagaagcacctgcagatcaaccagacctttgaggagctgcggctggtgacccaggacacagaaaatgagctgaagaagctgcagcagacccaggagtacttcatcatccagtaccaggagagcctgcgcatccaggcccagtttgcccagctggcccagctgagcccccaggagcggctgagccgggagacagccctgcagcagaagcaggtgtccctggaggcctggctgcagcgggaggcccagaccctgcagcagtacagagtggagctggccgagaagcaccagaagaccctgcagctgctgaggaagcagcagaccatcatcctggatgatgagctgatccagtggaagaggcggcagcagctggccggaaatggaggccccccagagggcagcctggatgtgctgcagagctggtgtgagaagctggccgagatcatctggcagaaccggcagcagatccggcgggcagagcacctgtgccagcagctgcccatccctggccctgtggaggagatgctggccgaggtgaatgccaccatcacagacatcatcagcgccctggtgaccagcaccttcatcatcgagaagcagcccccccaggtgctgaagacccagaccaagtttgctgccaccgtgcggctgctggtgggcggcaagctgaatgtgcacatgaaccccccccaggtgaaggccaccatcatcagcgagcagcaggccaagagcctgctgaagaatgaaaacaccagaaatgaatgttctggagagatcctgaacaactgctgcgtgatggagtaccaccaggccaccggcaccctgagcgcccacttcaggaacatgagcctgaagaggatcaagagagctgacagaagaggagctgagagcgtgacagaggagaagttcaccgtgctgtttgagagccagttctctgtgggcagcaatgagctggtgttccaggtgaagaccctgagcctgcctgtggtggtgattgtgcacggcagccaggaccacaatgccacagccaccgtgctgtgggacaatgcctttgctgagcccggccgggtgccctttgctgtgcctgacaaggtgctgtggccccagctgtgtgaggccctgaacatgaagttcaaggccgaggtgcagagcaacagaggcctgaccaaggagaacctggtgttcctggcccagaagctgttcaacaacagcagcagccacctggaggactacagcggcctgtctgtgtcctggagccagttcaaccgggagaacctgcccggctggaactacaccttctggcagtggtttgatggagtgatggaggtgctgaagaagcaccacaagccccactggaatgatggagccatcctgggctttgtgaacaagcagcaggcccatgacctgctgatcaacaagccagatggcaccttcctgctgcgcttcagtgacagcgagatcggcggcatcaccatcgcctggaagtttgacagccctgagaggaacctgtggaacctgaagcccttcaccacccgggacttcagcatccgcagcctggccgaccggctgggggacctgagctacctgatctacgtgtttcctgaccggcccaaggatgaggtgttcagcaagtactacacccctgtgctggccaaggctgtggatggctacgtgaagccccagatcaagcaggtggtgcctgagtttgtgaatgccagcgcagatgctgggggcagcagcgccacctacatggaccaggcccccagccctgctgtgtgcccccaggccccctacaacatgtacccccagaacccagaccacgtgctggaccaggatggagaatttgacctggatgagaccatggatgtggcccggcacgtggaggagctgctgcggcggcccatggacagcctggacagccggctgagccccccagctggcctcttcaccagcgcccggggcagcctgtcctag

SEQ ID NO: 21884 - DNA, 378 bp, Artificial Sequence
  Description of Artificial Sequence: Synthetic coding sequence
atggccggctggatccaggcccagcagctgcagggagatgccctgcggcagatgcaggtgctgtatggccagcacttccccatcgaggtgcgccactacctggcccagtggattgagagccagccctgggatgccatcgacctggacaacccccaggaccgggcccaggccacccagctgctggagggcctggtgcaggagctgcagaagaaggccgagcaccaggtgggggaggatggcttcctgctgaagatcaagctgggccactacgccacccagctgcagaagacctatgaccgctgccccctggagctggtgcgctgcatccgccacatcctgtacaatgagcagaggctggtgcgggaggccaacaactag

SEQ ID NO: 21885 - DNA, 2376 bp, Artificial Sequence
  Description of Artificial Sequence: Synthetic coding sequence
atggccggctggatccaggcccagcagctgcagggagatgccctgcggcagatgcaggtgctgtatggccagcacttccccatcgaggtgcgccactacctggcccagtggattgagagccagccctgggatgccatcgacctggacaacccccaggaccgggcccaggccacccagctgctggagggcctggtgcaggagctgcagaagaaggccgagcaccaggtgggggaggatggcttcctgctgaagatcaagctgggccactacgccacccagctgcagaagacctatgaccgctgccccctggagctggtgcgctgcatccgccacatcctgtacaatgagcagaggctggtgcgggaggccaacaactgcagcagccctgctggcatcctggtggatgccatgagccagaagcacctgcagatcaaccagacctttgaggagctgcggctggtgacccaggacacagaaaatgagctgaagaagctgcagcagacccaggagtacttcatcatccagtaccaggagagcctgcgcatccaggcccagtttgcccagctggcccagctgagcccccaggagcggctgagccgggagacagccctgcagcagaagcaggtgtccctggaggcctggctgcagcgggaggcccagaccctgcagcagtacagagtggagctggccgagaagcaccagaagaccctgcagctgctgaggaagcagcagaccatcatcctggatgatgagctgatccagtggaagaggcggcagcagctggccggaaatggaggccccccagagggcagcctggatgtgctgcagagctggtgtgagaagctggccgagatcatctggcagaaccggcagcagatccggcgggcagagcacctgtgccagcagctgcccatccctggccctgtggaggagatgctggccgaggtgaatgccaccatcacagacatcatcagcgccctggtgaccagcaccttcatcatcgagaagcagcccccccaggtgctgaagacccagaccaagtttgctgccaccgtgcggctgctggtgggcggcaagctgaatgtgcacatgaaccccccccaggtgaaggccaccatcatcagcgagcagcaggccaagagcctgctgaagaatgaaaacaccagaaatgaatgttctggagagatcctgaacaactgctgcgtgatggagtaccaccaggccaccggcaccctgagcgcccacttcaggaacatgagcctgaagaggatcaagagagctgacagaagaggagctgagagcgtgacagaggagaagttcaccgtgctgtttgagagccagttctctgtgggcagcaatgagctggtgttccaggtgaagaccctgagcctgcctgtggtggtgattgtgcacggcagccaggaccacaatgccacagccaccgtgctgtgggacaatgcctttgctgagcccggccgggtgccctttgctgtgcctgacaaggtgctgtggccccagctgtgtgaggccctgaacatgaagttcaaggccgaggtgcagagcaacagaggcctgaccaaggagaacctggtgttcctggcccagaagctgttcaacaacagcagcagccacctggaggactacagcggcctgtctgtgtcctggagccagttcaaccgggagaacctgcccggctggaactacaccttctggcagtggtttgatggagtgatggaggtgctgaagaagcaccacaagccccactggaatgatggcggctttgtgaacaagcagcaggcccatgacctgctgatcaacaagccagatggcaccttcctgctgcgcttcagtgacagcgagattggaggcatcaccatcgcctggaagtttgacagccctgagaggaacctgtggaacctgaagcccttcaccacccgggacttcagcatccgcagcctggccgaccggctgggggacctgagctacctgatctacgtgtttcctgaccggcccaaggatgaggtgttcagcaagtactacacccctgtgctggccaaggctgtggatggctacgtgaagccccagatcaagcaggtggtgcctgagtttgtgaatgccagcgcagatgctgggggcagcagcgccacctacatggaccaggcccccagccctgctgtgtgcccccaggccccctacaacatgtacccccagaacccagaccacgtgctggaccaggatggagaatttgacctggatgagaccatggatgtggcccggcacgtggaggagctgctgcggcggcccatggacagcctggacagccggctgagccccccagctggcctcttcaccagcgcccggggcagcctgtcctag

SEQ ID NO: 21886 - DNA, 2298 bp, Artificial Sequence
  Description of Artificial Sequence: Synthetic coding sequence
acagccatggccggctggatccaggcccagcagctgcagggagatgccctgcggcagatgcaggtgctgtatggccagcacttccccatcgaggtgcgccactacctggcccagtggattgagagccagccctgggatgccatcgacctggacaacccccaggaccgggcccaggccacccagctgctggagggcctggtgcaggagctgcagaagaaggccgagcaccaggtgggggaggatggcttcctgctgaagatcaagctgggccactacgccacccagctgcagaagacctatgaccgctgccccctggagctggtgcgctgcatccgccacatcctgtacaatgagcagaggctggtgcgggaggccaacaactgcagcagccctgctggcatcctggtggatgccatgagccagaagcacctgcagatcaaccagacctttgaggagctgcggctggtgacccaggacacagaaaatgagctgaagaagctgcagcagacccaggagtacttcatcatccagtaccaggagagcctgcgcatccaggcccagtttgcccagctggcccagctgagcccccaggagcggctgagccgggagacagccctgcagcagaagcaggtgtccctggaggcctggctgcagcgggaggcccagaccctgcagcagtacagagtggagctggccgagaagcaccagaagaccctgcagctgctgaggaagcagcagaccatcatcctggatgatgagctgatccagtggaagaggcggcagcagctggccggaaatggaggccccccagagggcagcctggatgtgctgcagagctggtgtgagaagctggccgagatcatctggcagaaccggcagcagatccggcgggcagagcacctgtgccagcagctgcccatccctggccctgtggaggagatgctggccgaggtgaatgccaccatcacagacatcatcagcgccctggtgaccagcaccttcatcatcgagaagcagcccccccaggtgctgaagacccagaccaagtttgctgccaccgtgcggctgctggtgggcggcaagctgaatgtgcacatgaaccccccccaggtgaaggccaccatcatcagcgagcagcaggccaagagcctgctgaagaatgaaaacaccagaaatgaatgttctggagagatcctgaacaactgctgcgtgatggagtaccaccaggccaccggcaccctgagcgcccacttcaggaacatgagcctgaagaggatcaagagagctgacagaagaggagctgagagcgtgacagaggagaagttcaccgtgctgtttgagagccagttctctgtgggcagcaatgagctggtgttccaggtgaagggccgggtgccctttgctgtgcctgacaaggtgctgtggccccagctgtgtgaggccctgaacatgaagttcaaggccgaggtgcagagcaacagaggcctgaccaaggagaacctggtgttcctggcccagaagctgttcaacaacagcagcagccacctggaggactacagcggcctgtctgtgtcctggagccagttcaaccgggagaacctgcccggctggaactacaccttctggcagtggtttgatggagtgatggaggtgctgaagaagcaccacaagccccactggaatgatggagccatcctgggctttgtgaacaagcagcaggcccatgacctgctgatcaacaagccagatggcaccttcctgctgcgcttcagtgacagcgagattggaggcatcaccatcgcctggaagtttgacagccctgagaggaacctgtggaacctgaagcccttcaccacccgggacttcagcatccgcagcctggccgaccggctgggggacctgagctacctgatctacgtgtttcctgaccggcccaaggatgaggtgttcagcaagtactacacccctgtgctggccaaggctgtggatggctacgtgaagccccagatcaagcaggtggtgcctgagtttgtgaatgccagcgcagatgctgggggcagcagcgccacctacatggaccaggcccccagccctgctgtgtgcccccaggccccctacaacatgtacccccagaacccagaccacgtgctggaccaggatggagaatttgacctggatgagaccatggatgtggcccggcacgtggaggagctgctgcggcggcccatggacagcctggacagccggctgagccccccagctggcctcttcaccagcgcccggggcagcctgtcctag

SEQ ID NO: 21887 - DNA, 2295 bp, Artificial Sequence
  Description of Artificial Sequence: Synthetic coding sequence
atggccggctggatccaggcccagcagctgcagggagatgccctgcggcagatgcaggtgctgtatggccagcacttccccatcgaggtgcgccactacctggcccagtggattgagagccagccctgggatgccatcgacctggacaacccccaggaccgggcccaggccacccagctgctggagggcctggtgcaggagctgcagaagaaggccgagcaccaggtgggggaggatggcttcctgctgaagatcaagctgggccactacgccacccagctgcagtgcagcagccctgctggcatcctggtggatgccatgagccagaagcacctgcagatcaaccagacctttgaggagctgcggctggtgacccaggacacagaaaatgagctgaagaagctgcagcagacccaggagtacttcatcatccagtaccaggagagcctgcgcatccaggcccagtttgcccagctggcccagctgagcccccaggagcggctgagccgggagacagccctgcagcagaagcaggtgtccctggaggcctggctgcagcgggaggcccagaccctgcagcagtacagagtggagctggccgagaagcaccagaagaccctgcagctgctgaggaagcagcagaccatcatcctggatgatgagctgatccagtggaagaggcggcagcagctggccggaaatggaggccccccagagggcagcctggatgtgctgcagagctggtgtgagaagctggccgagatcatctggcagaaccggcagcagatccggcgggcagagcacctgtgccagcagctgcccatccctggccctgtggaggagatgctggccgaggtgaatgccaccatcacagacatcatcagcgccctggtgaccagcaccttcatcatcgagaagcagcccccccaggtgctgaagacccagaccaagtttgctgccaccgtgcggctgctggtgggcggcaagctgaatgtgcacatgaaccccccccaggtgaaggccaccatcatcagcgagcagcaggccaagagcctgctgaagaatgaaaacaccagaaatgaatgttctggagagatcctgaacaactgctgcgtgatggagtaccaccaggccaccggcaccctgagcgcccacttcaggaacatgagcctgaagaggatcaagagagctgacagaagaggagctgagagcgtgacagaggagaagttcaccgtgctgtttgagagccagttctctgtgggcagcaatgagctggtgttccaggtgaagaccctgagcctgcctgtggtggtgattgtgcacggcagccaggaccacaatgccacagccaccgtgctgtgggacaatgcctttgctgagcccggccgggtgccctttgctgtgcctgacaaggtgctgtggccccagctgtgtgaggccctgaacatgaagttcaaggccgaggtgcagagcaacagaggcctgaccaaggagaacctggtgttcctggcccagaagctgttcaacaacagcagcagccacctggaggactacagcggcctgtctgtgtcctggagccagttcaaccgggagaacctgcccggctggaactacaccttctggcagtggtttgatggagtgatggaggtgctgaagaagcaccacaagccccactggaatgatggagccatcctgggctttgtgaacaagcagcaggcccatgacctgctgatcaacaagccagatggcaccttcctgctgcgcttcagtgacagcgagatcggcggcatcaccatcgcctggaagtttgacagccctgagaggaacctgtggaacctgaagcccttcaccacccgggacttcagcatccgcagcctggccgaccggctgggggacctgagctacctgatctacgtgtttcctgaccggcccaaggatgaggtgttcagcaagtactacacccctgtgctggccaaggctgtggatggctacgtgaagccccagatcaagcaggtggtgcctgagtttgtgaatgccagcgcagatgctgggggcagcagcgccacctacatggaccaggcccccagccctgctgtgtgcccccaggccccctacaacatgtacccccagaacccagaccacgtgctggaccaggatggagaatttgacctggatgagaccatggatgtggcccggcacgtggaggagctgctgcggcggcccatggacagcctggacagccggctgagccccccagctggcctcttcaccagcgcccggggcagcctgtcctag

SEQ ID NO: 21888 - DNA, 2295 bp, Artificial Sequence; identical to SEQ ID NO: 21887
  Description of Artificial Sequence: Synthetic coding sequence

SEQ ID NO: 21889 - DNA, 2364 bp, Artificial Sequence
  Description of Artificial Sequence: Synthetic coding sequence
atggctgtgtggatccaggcccagcagctgcagggcgaggccctgcaccagatgcaggccctgtatggccagcacttccccatcgaggtgcgccactacctgagccagtggattgagagccaggcctgggacagcgtggacctggacaacccccaggagaacatcaaggccacccagctgctggagggcctggtgcaggagctgcagaagaaggccgagcaccaggtgggggaggatggcttcctgctgaagatcaagctgggccactacgccacccagctgcagaacacctatgaccgctgccccatggagctggtgcgctgcatccgccacatcctgtacaatgagcagaggctggtgcgggaggccaacaacggcagcagccctgctggcagcctggctgatgccatgagccagaagcacctgcagatcaaccagacctttgaggagctgcggctggtgacccaggacacagaaaatgagctgaagaagctgcagcagacccaggagtacttcatcatccagtaccaggagagcctgcgcatccaggcccagtttggccccctggcccagctgagcccccaggagcggctgagccgggagacagccctgcagcagaagcaggtgtccctggaggcctggctgcagcgggaggcccagaccctgcagcagtacagagtggagctggccgagaagcaccagaagaccctgcagctgctgaggaagcagcagaccatcatcctggatgatgagctgatccagtggaagaggcggcagcagctggccggaaatggaggccccccagagggcagcctggatgtgctgcagagctggtgtgagaagctggccgagatcatctggcagaaccggcagcagatccggcgggcagagcacctgtgccagcagctgcccatccctggccctgtggaggagatgctggccgaggtgaatgccaccatcacagacatcatcagcgccctggtgaccagcaccttcatcatcgagaagcagcccccccaggtgctgaagacccagaccaagtttgctgccaccgtgcggctgctggtgggcggcaagctgaatgtgcacatgaaccccccccaggtgaaggccaccatcatcagcgagcagcaggccaagagcctgctgaagaatgaaaacaccagaaatgactacagcggggagatcctgaacaactgctgcgtgatggagtaccaccaggccaccggcaccctgagcgcccacttcaggaacatgagcctgaagaggatcaagagaagtgacagaagaggagctgagagcgtgacagaggagaagttcaccatcctgtttgagagccagttctctgtgggcggcaatgagctggtgttccaggtgaagaccctgagcctgcctgtggtggtgattgtgcacggcagccaggacaacaatgccacagccaccgtgctgtgggacaatgcctttgctgagcccggccgggtgccctttgctgtgcctgacaaggtgctgtggccccagctgtgtgaggccctgaacatgaagttcaaggccgaggtgcagagcaacagaggcctgaccaaggagaacctggtgttcctggcccagaagctgttcaacaacagcagcagccacctggaggactacagcggcctgtctgtgtcctggagccagttcaaccgggagaacctgcccggcaggaactacaccttctggcagtggtttgatggagtgatggaggtgctgaagaagcacctgaagccccactggaatgatggagccatcctgggctttgtgaacaagcagcaggcccatgacctgctgatcaacaagccagatggcaccttcctgctgcgcttcagtgacagcgagatcggcggcatcaccatcgcctggaagtttgacagccaggagaggatgttctggaacctgatgcccttcaccacccgggacttcagcatccgcagcctggccgaccggctgggggacctgaactacctgatctacgtgtttcctgaccggcccaaggatgaggtgtacagcaagtactacacccctgtgccctgtgagagcgccacagccaaggctgtggatggctacgtgaagccccagatcaagcaggtggtgcctgagtttgtgaatgccagcgcagatgctgggggcggcagcgccacctacatggaccaggcccccagccctgctgtgtgcccccaggcccactacaacatgtacccccagaacccagattctgtgctggacacagatggagactttgacctggaggacaccatggatgtggccaggagagtggaggagctgctgggccggcccatggacagccagtggatcccccacgcccagagctag

SEQ ID NO: 21890 - DNA, 471 bp, Artificial Sequence
  Description of Artificial Sequence: Synthetic coding sequence
atggctgtgtggatccaggcccagcagctgcagggcgaggccctgcaccagatgcaggccctgtatggccagcacttccccatcgaggtgcgccactacctgagccagtggattgagagccaggcctgggacagcgtggacctggacaacccccaggagaacatcaaggccacccagctgctggagggcctggtgcaggagctgcagaagaaggccgagcaccaggtgggggaggatggcttcctgctgaagatcaagctgggccactacgccacccagctgcagaacacctatgaccgctgccccatggagctggtgcgctgcatccgccacatcctgtacaatgagcagaggctggtgcgggaggccaacaacggcagcagccctgctggcagcctggctgatgccatgagccagaagcacctgcagatcaaccagacctttgaggagctgcggctggtgacccagtag

SEQ ID NO: 21891 - DNA, 534 bp, Artificial Sequence
  Description of Artificial Sequence: Synthetic coding sequence
atgccccaggccttcctgctgggcagcatccacgagcctgctggggccctgatggagccccagccctgccccggcagcctggccgagagcttcctggaggaggagctgcggctgaatgctgagctgagccagctgcagttcagcgagcctgtgggcatcatctacaaccctgtggagtatgcctgggagccccacaggaactacgtgacccgctactgccagggccccaaggaggtgctcttcctgggcatgaaccctggccccttcggcatggcccagacaggagtgccctttggagaggtgtccatggtgcgggactggctgggcatcgtgggccctgtgctgaccccaccccaggagcaccccaagaggcctgtgctgggcctggagtgcccccagagcgagggcccccggcagagcatgggccacgagatcaagtctgagctgctgatgggcggctgctcctggatccggggcaagatccagtgtgacagagtgcaggtgagaagacctggcttcagcagccagctgtag

SEQ ID NO: 21892 - DNA, 813 bp, Artificial Sequence
  Description of Artificial Sequence: Synthetic coding sequence
atgccccaggccttcctgctgggcagcatccacgagcctgctggggccctgatggagccccagccctgccccggcagcctggccgagagcttcctggaggaggagctgcggctgaatgctgagctgagccagctgcagttcagcgagcctgtgggcatcatctacaaccctgtggagtatgcctgggagccccacaggaactacgtgacccgctactgccagggccccaaggaggtgctcttcctgggcatgaaccctggccccttcggcatggcccagacaggagtgccctttggagaggtgtccatggtgcgggactggctgggcatcgtgggccctgtgctgaccccaccccaggagcaccccaagaggcctgtgctgggcctggagtgcccccagagcgaggtgtctggggcccgcttctggggcttcttcaggaacctgtgtggccagcctgaggtgttcttccaccactgctttgtgcacaacctgtgccccctgctcttcctggcccccagcggcaggaacctgaccccagctgagctgcctgccaagcagcgggagcagctgctgggcatctgtgatgctgccctgtgccggcaggtgcagctgctgggcgtgcggctggtggtgggcgtgggccgcctggccgagcagagggcccggcgggccctggccggcctgatgcctgaggtgcaggtggagggcctgctgcaccccagccccaggaacccccaggccaacaagggctgggaggccgtggccaaggagcggctgaatgagctgggcctgctgcccctgctgctgaagtag

SEQ ID NO: 21893 - DNA, 813 bp, Artificial Sequence; identical to SEQ ID NO: 21892
  Description of Artificial Sequence: Synthetic coding sequence

SEQ ID NO: 21894 - DNA, 249 bp, Artificial Sequence
  Description of Artificial Sequence: Synthetic coding sequence
atgccccaggccttcctgctgggcagcatccacgagcctgctggggccctgatggagccccagccctgccccggcagcctggccgagagcttcctggaggaggagctgcggctgaatgctgagctgagccagctgcagttcagcgagcctgtgggcatcatctacaaccctgtggagtatgcctgggagccccacaggaactacgtgacccgctactgccagggccccaaggaggtgctcttcctgtag

SEQ ID NO: 21895 - DNA, 519 bp, Artificial Sequence
  Description of Artificial Sequence: Synthetic coding sequence
atgccccaggccttcctgctgggcagcatccacgagcctgctggggccctgatggagccccagccctgccccggcagcctggccgagagcttcctggaggaggagctgcggctgaatgctgagctgagccagctgcagttcagcgagcctgtgggcatcatctacaaccctgtggagtatgcctgggagccccacaggaactacgtgacccgctactgccagggccccaaggaggtgctcttcctgggcatgaaccctggccccttcggcatggcccagacaggagtgccctttggagaggtgtccatggtgcgggactggctgggcatcgtgggccctgtgctgaccccaccccaggagcaccccaagaggcctgtgctgggcctggagtgcccccagagcgaggtgtctggggcccgcttctggggcttcttcaggaacctgtgtggccagcctgaggtgttcttccaccactgctttgtgcacaacctgtgccccctgctcttcctggccccctag

SEQ ID NO: 21896 - DNA, 291 bp, Artificial Sequence
  Description of Artificial Sequence: Synthetic coding sequence
atgccccaggccttcctgctgggcagcatccacgagcctgctggggccctgatggagccccagccctgccccggcagcctggccgagagcttcctggaggaggagctgcggctgaatgctgagctgagccagctgcagttcagcgagcctgtgggcatcatctacaaccctgtggagtatgcctgggagccccacaggaactacgtgacccgctactgccagggccccaaggaggtgctcttcctgggcatgaaccctggccccttcggcatggcccagacaggagtgtag

SEQ ID NO: 21897 - DNA, 273 bp, Artificial Sequence
  Description of Artificial Sequence: Synthetic coding sequence
atgccccaggccttcctgctgggcagcatccacgagcctgctggggccctgatggagccccagccctgccccggcagcctggccgagagcttcctggaggaggagctgcggctgaatgctgagctgagccagctgcagttcagcgagcctgtgggcatcatctacaaccctgtggagtatgcctgggagccccacaggaactacgtgacccgctactgccagggccccaaggaggtgctcttcctgggcatgaaccctggcccctttggatag

SEQ ID NO: 21898 - DNA, 534 bp, Artificial Sequence; identical to SEQ ID NO: 21891
  Description of Artificial Sequence: Synthetic coding sequence

SEQ ID NO: 21899 - DNA, 327 bp, Artificial Sequence
  Description of Artificial Sequence: Synthetic coding sequence
atgccccaggccttcctgctgggcagcatccacgagcctgctggggccctgatggagccccagccctgccccggcagcctggccgagagcttcctggaggaggagctgcggctgaatgctgagctgagccagctgcagttcagcgagcctgtgggcatcatctacaaccctgtggagtatgcctgggagccccacaggaactacgtgacccgctactgccagggccccaaggaggtgctcttcctgggcatgaaccctggccccttcggcatggcccagacaggagtgccctttggagaggtgtccatggtgcgggactggctgtag

SEQ ID NO: 21900 - DNA, 813 bp, Artificial Sequence; identical to SEQ ID NO: 21892
  Description of Artificial Sequence: Synthetic coding sequence

SEQ ID NO: 21901 - DNA, 534 bp, Artificial Sequence; identical to SEQ ID NO: 21891
  Description of Artificial Sequence: Synthetic coding sequence

SEQ ID NO: 21902 - DNA, 534 bp, Artificial Sequence; identical to SEQ ID NO: 21891
  Description of Artificial Sequence: Synthetic coding sequence

SEQ ID NO: 21903 - DNA, 1170 bp, Artificial Sequence
  Description of Artificial Sequence: Synthetic coding sequence
atggccgagccagaccccagccaccccctggagacccaggccggcaaggtgcaggaggcccaggacagcgacagcgacagcgagggcggggccgccggcggggaggccgacatggacttcctgaggaacctcttcagccagaccctgagcctgggcagccagaaggagcggctgctggatgagctgaccctggagggcgtggcccgctacatgcagagcgagcgctgcagaagagtcatctgcctggtgggcgccggcatcagcaccagcgctggcatcccagacttccgcagccccagcacaggcctgtatgacaacctggagaagtaccacctgccctacccagaggccatctttgagatctcctacttcaagaagcaccctgagcccttctttgccctggccaaggagctgtacccaggccagttcaagcccaccatctgccactacttcatgaggctgctgaaggacaagggcctgctgctgcgctgctacacccagaacatcgacaccctggagagaattgctggcctggagcaggaggacctggtggaggcccacggcaccttctacaccagccactgtgtgtctgccagctgcagacatgagtaccccctgtcctggatgaaggagaagatcttcagcgaggtgacccccaagtgtgaggactgccagagcctggtgaagccagacatcgtgttctttggagagagcctgcctgcccgcttcttcagctgcatgcagagcgacttcctgaaggtggacctgctgctggtgatgggcaccagcctgcaggtgcagccctttgccagcctcatcagcaaggcccccctgagcaccccccggctgctgatcaacaaggagaaggccggccagagcgaccccttcctgggcatgatcatgggcctgggcggcggcatggactttgacagcaagaaggcctacagagatgtggcctggctgggagaatgtgaccagggctgcctggccctggccgagctgctgggctggaagaaggagctggaggacctggtgcggcgggagcacgccagcattgatgcccagagcggggccggcgtgcccaaccccagcaccagcgccagccccaagaagagccccccaccagccaaggatgaggcccggaccacagagcgggagaagccccagtag

SEQ ID NO: 21904 - DNA, 816 bp, Artificial Sequence
  Description of Artificial Sequence: Synthetic coding sequence
atggccgagccagaccccagccaccccctggagacccaggccggcaaggtgcaggaggcccaggacagcgacagcgacagcgagggcggggccgccggcggggaggccgacatggacttcctgaggaacctcttcagccagaccctgagcctgggcagccagaaggagcggctgctggatgagctgaccctggagggcgtggcccgctacatgcagagcgagcgctgcagaagagtcatctgcctggtgggcgccggcatcagcaccagcgctggcatcccagacttccgcagccccagcacaggcctgtatgacaacctggagaagtaccacctgccctacccagaggccatctttgagatctcctacttcaagaagcaccctgagcccttctttgccctggccaaggagctgtacccaggccagttcaagcccaccatctgccactacttcatgaggctgctgaaggacaagggcctgctgctgcgctgctacacccagaacatcgacaccctggagagaattgctggcctggagcaggaggacctggtggaggcccacggcaccttctacaccagccactgtgtgtctgccagctgcagacatgagtaccccctgtcctggatgaaggagaagatcttcagcgaggtgacccccaagtgtgaggactgccagagcctggtgaagccagacatcgtgttctttggagagagcctgcctgcccgcttcttcagctgcatgcagagcgacttcctgaaggtggacctgctgctggtgatgggcaccagcctgcagggccggggcctggccggctag

SEQ ID NO: 21905 - DNA, 393 bp, Artificial Sequence
  Description of Artificial Sequence: Synthetic coding sequence
atggacttcctgaggaacctcttcagccagaccctgagcctgggcagccagaaggagcggctgctggatgagctgaccctggagggcgtggcccgctacatgcagagcgagcgctgccggcgggtcatctgcctggtgggcgccggcatcagcaccagcgctggcatcccagacttccgcagccccagcacaggcctgtatgacaacctggagaagtaccacctgccctacccagaggccatctttgagatctcctacttcaagaagcaccctgagcccttctttgccctggccaaggagctgtacccaggccagttcaagcccaccatctgccactacttcatgaggctgctgaaggacaagggcctgctgctgcgctgctacacccagtag

SEQ ID NO: 21906 - DNA, 1059 bp, Artificial Sequence
  Description of Artificial Sequence: Synthetic coding sequence
atggacttcctgaggaacctcttcagccagaccctgagcctgggcagccagaaggagcggctgctggatgagctgaccctggagggcgtggcccgctacatgcagagcgagcgctgccggcgggtcatctgcctggtgggcgccggcatcagcaccagcgctggcatcccagacttccgcagccccagcacaggcctgtatgacaacctggagaagtaccacctgccctacccagaggccatctttgagatctcctacttcaagaagcaccctgagcccttctttgccctggccaaggagctgtacccaggccagttcaagcccaccatctgccactacttcatgaggctgctgaaggacaagggcctgctgctgcgctgctacacccagaacatcgacaccctggagagaattgctggcctggagcaggaggacctggtggaggcccacggcaccttctacaccagccactgtgtgtctgccagctgcagacatgagtaccccctgtcctggatgaaggagaagatcttcagcgaggtgacccccaagtgtgaggactgccagagcctggtgaagccagacatcgtgttcttcggggagagcctgcctgcccgcttcttcagctgcatgcagagcgacttcctgaaggtggacctgctgctggtgatgggcaccagcctgcaggtgcagccctttgccagcctcatcagcaaggcccccctgagcaccccccggctgctgatcaacaaggagaaggccggccagagcgaccccttcctgggcatgatcatgggcctgggcggcggcatggactttgacagcaagaaggcctacagagatgtggcctggctgggggagtgtgaccagggctgcctggccctggccgagctgctgggctggaagaaggagctggaggacctggtgagaagagagcacgccagcattgatgcccagagcggggccggcgtgcccaaccccagcaccagcgccagccccaagaagagccccccaccagccaaggatgaggcccggaccacagagcgggagaagccccagtag

SEQ ID NO: 21907 - DNA, 510 bp, Artificial Sequence
  Description of Artificial Sequence: Synthetic coding sequence
atggacttcctgaggaacctcttcagccagaccctgagcctgggcagccagaaggagcggctgctggatgagctgaccctggagggcgtggcccgctacatgcagagcgagcgctgccggcgggtcatctgcctggtgggcgccggcatcagcaccagcgctggcatcccagacttccgcagccccagcacaggcctgtatgacaacctggagaagtaccacctgccctacccagaggccatctttgagatctcctacttcaagaagcaccctgagcccttctttgccctggccaaggagctgtacccaggccagttcaagcccaccatctgccactacttcatgaggctgctgaaggacaagggcctgctgctgcgctgctacacccagaacatcgacaccctggagagaattgctggcctggagcaggaggacctggtggaggcccacggcaccttctacaccagccactgtgtgtctgccagctgcagacatgagtaccccctgtag

SEQ ID NO: 21908 - DNA, 714 bp, Artificial Sequence
  Description of Artificial Sequence: Synthetic coding sequence
atggacttcctgaggaacctcttcagccagaccctgagcctgggcagccagaaggagcggctgctggatgagctgaccctggagggcgtggcccgctacatgcagagcgagcgctgccggcgggtcatctgcctggtgggcgccggcatcagcaccagcgctggcatcccagacttccgcagccccagcacaggcctgtatgacaacctggagaagtaccacctgccctacccagaggccatctttgagatctcctacttcaagaagcaccctgagcccttctttgccctggccaaggagctgtacccaggccagttcaagcccaccatctgccactacttcatgaggctgctgaaggacaagggcctgctgctgcgctgctacacccagaacatcgacaccctggagagaattgctggcctggagcaggaggacctggtggaggcccacggcaccttctacaccagccactgtgtgtctgccagctgcagacatgagtaccccctgtcctggatgaaggagaagatcttcagcgaggtgacccccaagtgtgaggactgccagagcctggtgaagccagacatcgtgttcttcggggagagcctgcctgcccgcttcttcagctgcatgcagagcgacttcctgaaggtggacctgctgctggtgatgggcaccagcctgcaggtgcagccctttgccagcctcatctcctag

SEQ ID NO: 21909 - DNA, 237 bp, Artificial Sequence
  Description of Artificial Sequence: Synthetic coding sequence
atggacttcctgaggaacctcttcagccagaccctgagcctgggcagccagaaggagcggctgctggatgagctgaccctggagggcgtggcccgctacatgcagagcgagcgctgccggcgggtcatctgcctggtgggcgccggcatcagcaccagcgctggcatcccagacttccgcagccccagcacaggcctgtatgacaacctggagaagtaccacctgccctacccctag

SEQ ID NO: 21910 - DNA, 222 bp, Artificial Sequence
  Description of Artificial Sequence: Synthetic coding sequence
atggacttcctgaggaacctcttcagccagaccctgagcctgggcagccagaaggagcggctgctggatgagctgaccctggagggcgtggcccgctacatgcagagcgagcgctgccggcgggtcatctgcctggtgggcgccggcatcagcaccagcgctggcatcccagacttccgcagccccagcacaggcctgtatgacaacctggagaagtactag

SEQ ID NO: 21911 - DNA, 1170 bp, Artificial Sequence
  Description of Artificial Sequence: Synthetic coding sequence
atgtctgatgaagctgaggacagcgacagcgacagcgagggcggcgctgctggaggagaggccgacatggacttcctgaggaacctcttcagccagaccctgagcctgggcagccagaaggagcggctgctggatgagctgaccctggagggcgtggcccgctacatgcagagcgagcgctgccggcgggtcatctgcctggtgggcgccggcatcagcaccagcgctggcatcccagacttccgcagccccagcacaggcctgtatgacaacctggagaagtaccacctgccctacccagaggccatctttgagatctcctacttcaagaagcaccctgagcccttctttgccctggccaaggagctgtacccaggccagttcaagcccaccatctgccactacttcatgaggctgctgaaggacaagggcctgctgctgcgctgctacacccagaacatcgacaccctggagagaattgctggcctggagcaggaggacctggtggaggcccacggcaccttctacaccagccactgtgtgtctgccagctgcagacatgagtaccccctgtcctggatgaaggagaagatcttcagcgaggtgacccccaagtgtgaggactgccagagcctggtgaagccagacatcgtgttcttcggggagagcctgcctgcccgcttcttcagctgcatgcagagcgacttcctgaaggtggacctgctgctggtgatgggcaccagcctgcaggtgcagccctttgccagcctcatcagcaaggcccccctgagcaccccccggctgctgatcaacaaggagaaggccggccagagcgaccccttcctgggcatgatcatgggcctgggcggcggcatggactttgacagcaagaaggcctacagagatgtggcctggctgggggagtgtgaccagggctgcctggccctggccgagctgctgggctggaagaaggagctggaggacctggtgagaagagagcacgccagcattgatgcccagggcggcggcggcccccagccccagcacttctccttcccccaggaggtgcctgccacctgccagggccggggccaggacaaccgggagggggagacccctgtgacagctgccagccccaggagagatgctgagctgctgcgggacagctag

SEQ ID NO: 21912 - DNA, 1227 bp, Artificial Sequence
  Description of Artificial Sequence: Synthetic coding sequence
atggctgaaaatggagacaatgagaagatggccgccctggaggccaagatctgccaccagatcgagtactactttggagacttcaacctgccccgggacaagttcctgaaggagcagatcaagctggatgagggctgggtgcccctggagatcatgatcaagttcaaccggctgaaccggctgaccacagacttcaacgtcatcgtggaggccctgagcaagagcaaggccgagctgatggagatcagcgaggacaagaccaagatccgccgcagccccagcaagcccctgcctgaggtgacagatgagtacaagaatgatgtgaagaacagatctgtgtacatcaagggcttccccacagatgccaccctggatgacatcaaggagtggctggaggacaagggccaggtgctgaacatccagatgaggaggaccctgcacaaggccttcaagggcagcatctttgtggtgtttgacagcattgaaagtgccaagaagtttgtggagaccccaggccagaagtacaaggagacagacctgctgatcctcttcaaggatgactactttgccaagaagaatgaggagaggaagcagaacaaggtggaggccaagctgcgggccaagcaggagcaggaggccaagcagaagctggaggaggatgctgagatgaagagcctggaggagaagattggctgcctgctgaagttcagcggggacctggatgaccagacctgccgggaggacctgcacatcctcttcagcaaccacggggagatcaagtggattgactttgtgcggggggccaaggagggcatcatcctcttcaaggagaaggccaaggaggccctgggcaaggccaaggatgccaacaatggaaacctgcagctgaggaacaaggaggtgacctgggaggtgctggagggggaggtggagaaggaggccctgaagaagatcatcgaggaccagcaggagagcctgaacaagtggaagagcaagggccgccgcttcaagggcaaaggaaaaggaaacaaggccgcccagcccggcagcggcaagggcaaggtgcagttccagggcaagaagaccaagtttgccagtgatgatgaacatgatgaacatgatgaaaatggagccactggacctgtgaagagggcccgggaggagacagacaaggaggagcccgccagcaagcagcagaagacagaaaatggagctggggaccagtag

SEQ ID NO: 21913 - DNA, 1086 bp, Artificial Sequence
  Description of Artificial Sequence: Synthetic coding sequence
atggctgaaaatggagacaatgagaagatggccgccctggaggccaagatctgccaccagatcgagtactactttggagacttcaacctgccccgggacaagttcctgaaggagcagatcaagctggatgagggctgggtgcccctggagatcatgatcaagttcaaccggctgaaccggctgaccacagacttcaacgtcatcgtggaggccctgagcaagagcaaggccgagctgatggagatcagcgaggacaagaccaagatccgccgcagccccagcaagcccctgcctgaggtgacagatgagtacaagaatgatgtgaagaacagatctgtgtacatcaagggcttccccacagatgccaccctggatgacatcaaggagtggctggaggacaagggccaggtgctgaacatccagatgaggaggaccctgcacaaggccttcaagggcagcatctttgtggtgtttgacagcattgaaagtgccaagaagtttgtggagaccccaggccagaagtacaaggagacagacctgctgatcctcttcaaggatgactactttgccaagaagaatgaggagaggaagcagaacaaggtggaggccaagctgcgggccaagcaggagcaggaggccaagcagaagctggaggaggatgctgagatgaagagcctggaggagaagattggctgcctgctgaagttcagcggggacctggatgaccagacctgccgggaggacctgcacatcctcttcagcaaccacggggagatcaagtggattgactttgtgcggggggccaaggagggcatcatcctcttcaaggagaaggccaaggaggccctgggcaaggccaaggatgccaacaatggaaacctgcagctgaggaacaaggaggtgacctgggaggtgctggagggggaggtggagaaggaggccctgaagaagatcatcgaggaccagcaggagagcctgaacaagtggaagagcaagggccctgtgaagagggcccgggaggagacagacaaggaggagcccgccagcaagcagcagaagacagaaaatggagctggggaccagtag

SEQ ID NO: 21914 - DNA, 1227 bp, Artificial Sequence; identical to SEQ ID NO: 21912
  Description of Artificial Sequence: Synthetic coding sequence

SEQ ID NO: 21915 - DNA, 405 bp, Artificial Sequence
  Description of Artificial Sequence: Synthetic coding sequence
atggctgaaaatggagacaatgagaagatggccgccctggaggccaagatctgccaccagatcgagtactactttggagacttcaacctgccccgggacaagttcctgaaggagcagatcaagctggatgagggctgggtgcccctggagatcatgatcaagttcaaccggctgaaccggctgaccacagacttcaacgtcatcgtggaggccctgagcaagagcaaggccgagctgatggagatcagcgaggacaagaccaagatccgccgcagccccagcaagcccctgcctgaggtgacagatgagtacaagaatgatgtgaagaacagatctgtgtacatcagccaccctgtggcccacgtgggcgtgcagtggtgtgaccacggccccctgcagagctag

SEQ ID NO: 21916 - DNA, 363 bp, Artificial Sequence
  Description of Artificial Sequence: Synthetic coding sequence
atgatcaagttcaaccggctgaaccggctgaccacagacttcaacgtgattgtggaggccctgagcaagagcaaggccgagctgatggagatcagcgaggacaagaccaagatcagaagaagccccagcaagcccctgcctgaggtgacagatgagtacaagaatgatgtgaagaacagatctgtgtacatcaagggcttccccacagatgccaccctggatgacatcaaggagtggctggaggacaagggccaggtgctgaacatccagatgaggaggaccctgcacaaggccttcaagggcagcatctttgtggtgtttgacagcattgagagcgccaagaagtttgtggagaccccctag

SEQ ID NO: 21917 - DNA, 555 bp, Artificial Sequence
  Description of Artificial Sequence: Synthetic coding sequence
atggctgaaaatggagacaatgagaagatggccgccctggaggccaagatctgccaccagatcgagtactactttggagacttcaacctgccccgggacaagttcctgaaggagcagatcaagctggatgagggctgggtgcccctggagatcatgatcaagttcaaccggctgaaccggctgaccacagacttcaacgtcatcgtggaggccctgagcaagagcaaggccgagctgatggagatcagcgaggacaagaccaagatccgccgcagccccagcaagcccctgcctgaggtgacagatgagtacaagaatgatgtgaagaacagatctgtgtacatcaagggcttccccacagatgccaccctggatgacatcaaggagtggctggaggacaagggccaggtgctgaacatccagatgaggaggaccctgcacaaggccttcaagggcagcatctttgtggtgtttgacagcattgaaagtgccaagaagtttgtggagaccccaggccagaagtacaaggagacagacctgctgatcctcttctag

SEQ ID NO: 21918 - DNA, 252 bp, Artificial Sequence
  Description of Artificial Sequence: Synthetic coding sequence
atgaggaggaccctgcacaaggccttcaagggcagcatctttgtggtgtttgacagcattgagagcgccaagaagtttgtggagaccccaggccagaagtacaaggagacagacctgctgatcctcttcaaggatgactactttgccaagaagaatgaggagaggaagcagaacaaggtggaggccaagctgcgggccaagcaggagcaggaggccaagcagaagctggaggaggatgctgagatgaagtag

SEQ ID NO: 21919 - DNA, 5505 bp, Artificial Sequence
  Description of Artificial Sequence: Synthetic coding sequence
atgaagctgtctgtgaatgaggcccagctgggcttctacctgggcagcctgagccacctgagcgcctgccccggcatcgaccccaggagcagcgaggaccagcctgagagcctgaagacaggccagatgatggatgaaagtgatgaggacttcaaggagctgtgtgccagcttcttccagagggtgaagaagcacggcatcaaggaggtgtctggagagaggaagacccagaaggccgccagcaatggcacccagatccgcagcaagctgaagaggaccaagcagacagccaccaagaccaagaccctgcagggccctgctgagaagaagcccccatctggcagccaggcccccaggaccaagaagcagagggtgaccaagtggcaggccagcgagcccgcccacagcgtgaatggagagggcggcgtgctggccagcgccccagacccccctgtgctgcgggagacagcccagaacacccagacaggcaaccagcaggagcccagccccaacctgagccgggagaagaccagagaaaatgtgcccaacagcgacagccagcccccacccagctgcctgaccacagctgtgcccagccccagcaagcccaggacagcccagctggtgctgcagaggatgcagcagttcaagagagctgaccctgagcggctgcggcatgccagcgaggagtgcagcctggaggccgcccgggaggagaatgtgcccaaggacccccaggaggagatgatggctggaaatgtgtatggcctgggccccccagcccctgagagtgatgctgctgtggccctgaccctgcagcaggagtttgcccgggtgggcgccagcgcccatgatgacagcctggaggagaagggcctcttcttctgccagatctgccagaagaacctgagcgccatgaatgtgacccggcgggagcagcacgtgaaccgctgcctggatgaggccgagaagaccctgcggcccagcgtgccccagatcccagaatgtcccatctgtgggaagcccttcctgaccctgaagagcaggaccagccacctgaagcagtgtgctgtgaagatggaggtgggcccccagctgctgctgcaggccgtgcggctgcagacagcccagcctgagggcagcagcagcccccccatgttctccttcagtgaccacagccggggcctgaagaggcggggccccaccagcaagaaggagcccaggaagaggaggaaggtggatgaggcccccagcgaggacctgctggtggccatggccctgagccgctctgagatggagcccggggctgctgtgcctgccctgcggctggagagcgccttcagcgagcgcatccggcctgaggccgagaacaagagcaggaagaagaagccccctgtgagcccccccctgctgctggtgcaggacagcgagaccaccggccggcagatcgaggacagagtggccctgctgctgtctgaggaggtggagctgagcagcaccccacccctgcctgccagccgcatcctgaaggagggctgggagcgggccggccagtgccccccacctcctgagaggaagcagagcttcctgtgggagggcagcgccctgactggagcctgggccatggaggacttctacacagcccggctggtgccccccctggtgccccagaggcctgcccagggcctgatgcaggagcctgtgccccccctggtgcccccagagcacagcgagctgtctgagcggcgcagccctgccctgcacggcacccccacagctggctgcggcagccggggccccagccccagcgccagccagcgggagcaccaggccctgcaggacctggtggacctggcccgggagggcctgagcgccagcccctggccaggcagcggcggcctggccggcagcgagggcacagctggcctggatgtggtgcctgggggcctgcccctgactggatttgtggtgcccagccaggacaagcacccagacagaggaggccgcaccctgctgagcctgggcctgctggtggccgactttggagccatggtgaacaacccccacctgagtgatgtgcagttccagacagattctggagaggtgctgtatgcccacaagtttgtgctgtatgcccgctgccccctgctgatccagtatgtgaacaatgaaggcttctctgctgtggaggatggagtgctgacccagagggtgctgctgggagatgtgtccacagaagctgcccggaccttcctgcactacctgtacacagctgacaccggcctgcccccaggcctgagcagcgagctgagcagcctggcccacagatttggagtgtctgagctggtgcacctgtgtgagcaggtgcccatcgccacagattctgagggcaagccctgggaggagaaggaggccgagaactgtgagagcagagctgagaacttccaggagctgctgcgctccatgtgggcagatgaggaggaggaggccgagaccctgctgaagagcaaggaccacgaggaggaccaggagaatgtgaatgaagctgagatggaggagatctatgaatttgctgccacccagaggaagctgctgcaggaggagagagctgctggagctggagaagatgctgactggctggagggcggcagccctgtgtctggccagctgctggccggcgtgcaggtgcagaagcagtgggacaaggtggaggagatggagcccctggagcccggcagagatgaggccgccaccacctgggagaagatgggccagtgtgccctgcccccaccccagggccagcacagcggggcccggggagctgaggcccctgagcaggaggcccctgaggaggccctgggccacagcagctgcagcagccccagccgggactgccaggccgagaggaaggagggcagcctgccccacagtgatgatgctggggactatgagcagctgttcagcagcacccagggcgagatcagcgagcccagccagatcaccagcgagcctgaggagcagagcggggctgtgcgggagcggggcctggaggtgagccaccggctggccccctggcaggccagccccccccacccctgccgcttcctgctgggccccccccagggcggcagcccccggggcagccaccacaccagcggcagcagcctgagcacccccaggagcagaggaggcaccagccaggtgggcagccccaccctgctgagccctgctgtgcccagcaagcagaagagggacaggagcatcctgaccctgagcaaggagcccggccaccagaagggcaaggagaggagatctgtgctggagtgcaggaacaagggcgtgctgatgtttcctgagaagagccccagcattgacctgacccagagcaacccagaccacagcagcagccgcagccagaagagcagcagcaagctgaatgaggaggatgaagtcatcctgctgctggacagtgatgaggagctggagctggagcagaccaagatgaagagcatcagcagtgaccccctggaggagaagaaggccctggagatcagccccaggagctgtgagctgttcagcatcattgatgtggatgctgaccaggagcccagccagagccccccaagaagtgaggccgtgctgcagcaggaggatgagggcgccctgcctgagaacagaggcagcctgggcagaagaggagccccctggctgttctgtgaccgggagagcagccccagcgaggccagcaccacagacacctcctggctggtgcctgccacccccctggccagccgcagccgggactgcagcagccagacccagatcagcagcctgcggagcggcctggccgtgcaggccgtgacccagcacaccccccgggcctctgtgggcaaccgggagggcaatgaggtggcccagaagttcagcgtcatccggccccagaccccaccaccccagacccccagcagctgcctgacccctgtgtccccaggcaccagtgatggccggcggcagggccacaggagccccagccggccccaccctgggggccacccccacagcagccccctggccccccaccccatcagcggggaccgggcccacttcagccgccgcttcctgaagcacagccccccaggccccagcttcctgaaccagaccccagctggggaggtggtggaggtgggggacagtgatgatgagcaggaggtggccagccaccaggccaacagaagcccccccctggacagcgacccccccatccccattgatgactgctgctggcacatggagcccctgagccccatccccatcgaccactggaacctggagaggacaggccccctgagcaccagcagccccagcaggaggatgaatgaagctgctgacagccgggactgccgcagccctggcctgctggacaccacccccatccggggcagctgcaccacccagaggaagctgcaggagaagagcagtggagctggcagcctgggcaacagccggcccagcttcctgaacagcgccctgtgggatgtgtgggatggagaggagcagaggcctcctgagaccccacctccagcccagatgcccagcgctggaggagcccagaagccagagggcctggagacccccaagggggccaacaggaagaagaacctgccccccaaggtgcccatcacccccatgccccagtacagcatcatggagacccctgtgctgaagaaggagctggacagatttggagtgcggcccctgcccaagaggcagatggtgctgaagctgaaggagatcttccagtacacccaccagaccctggacagcgacagtgaagatgagagccagagcagccagcccctgctgcaggccccccactgccagaccctggccagccagacctacaagcccagcagagctggggtgcacgcccagcaggaggccaccactggacctggggcccaccggcccaagggccctgccaagaccaagggccccaggcaccagaggaagcaccacgagagcatcaccccacccagccgcagccccaccaaggaggcccctcctggcctgaatgatgatgcccagatcccagccagccaggagagcgtggccacctctgtggatggcagtgacagcagcctgagcagccagagcagcagcagctgtgaatttggagctgcctttgagagcgctggggaggaggagggggagggggaggtgtctgccagccaggccgctgtgcaggccgctgacacagatgaggccctgcgctgctacatccgcagcaagccagccctgtaccagaaggtgctgctgtaccagccctttgagctgcgggagctgcaggccgagctgcggcagaatggcctgcgggtgagcagccggcggctgctggacttcctggacacccactgcatcaccttcaccacagctgccacccggcgggagaagctgcagggcagaagacggcagccccggggcaagaagaaggtggagagaaattag

SEQ ID NO: 21920 - DNA, 1404 bp, Artificial Sequence
  Description of Artificial Sequence: Synthetic coding sequence
atgagcagcatcctgcccttcaccccacctgtggtgaagaggctgctgggctggaagaagtctgctgggggcagcggcggggccggcggcggggagcagaatggccaggaggagaagtggtgtgagaaggctgtgaagagcctggtgaagaagctgaagaagacaggccgcctggatgagctggagaaggccatcaccacccagaactgcaacaccaagtgtgtgaccatccccagcacctgcagcgagatctggggcctgagcacccccaacaccatcgaccagtgggacaccaccggcctgtacagcttcagcgagcagaccaggagcctggatggccgcctgcaggtgagccacaggaagggcctgccccacgtgatctactgccgcctgtggcgctggccagacctgcacagccaccacgagctgaaggccatcgagaactgtgaatatgccttcaacctgaagaaggatgaggtgtgtgtgaacccctaccactaccagagggtggagacccctgtgctgccccctgtgctggtgcccaggcacacagagatcctgacagagctgccccccctggatgactacacccacagcatccctgagaacaccaacttccctgctggcatcgagccccagagcaactacatccctgagaccccacctcctggctacatcagtgaagatggagagaccagtgaccagcagctgaaccagagcatggacaccggcagccctgctgagctgagccccaccaccctgagccctgtgaaccacagcctggacctgcagcctgtgacctacagcgagcccgccttctggtgcagcatcgcctactatgagctgaaccagagggtgggggagaccttccacgccagccagcccagcctgactgtggatggcttcacagaccccagcaacagcgagcgcttctgcctgggcctgctgagcaatgtgaacagaaatgccaccgtggagatgaccaggaggcacatcggccggggcgtgcggctgtactacatcggcggggaggtgtttgctgagtgcctgagtgacagcgccatctttgtgcagagccccaactgcaaccagagatatggctggcacccagccaccgtgtgcaagatccccccaggctgcaacctgaagatcttcaacaaccaggagtttgctgccctgctggcccagagcgtgaaccagggctttgaggccgtgtaccagctgaccaggatgtgcaccatccgcatgagctttgtgaagggctggggcgctgagtaccgccggcagacagtgaccagcaccccctgctggattgagctgcacctgaatggccccctgcagtggctggacaaggtgctgacccagatgggcagccccagcgtgcgctgcagctccatgtcctag

SEQ ID NO: 21921 - DNA, 1314 bp, Artificial Sequence
  Description of Artificial Sequence: Synthetic coding sequence
atgagcagcatcctgcccttcaccccacctgtggtgaagaggctgctgggctggaagaagtctgctgggggcagcggcggggccggcggcggggagcagaatggccaggaggagaagtggtgtgagaaggctgtgaagagcctggtgaagaagctgaagaagacaggccgcctggatgagctggagaaggccatcaccacccagaactgcaacaccaagtgtgtgaccatccccaggagcctggatggccgcctgcaggtgagccacaggaagggcctgccccacgtgatctactgccgcctgtggcgctggccagacctgcacagccaccacgagctgaaggccatcgagaactgtgaatatgccttcaacctgaagaaggatgaggtgtgtgtgaacccctaccactaccagagggtggagacccctgtgctgccccctgtgctggtgcccaggcacacagagatcctgacagagctgccccccctggatgactacacccacagcatccctgagaacaccaacttccctgctggcatcgagccccagagcaactacatccctgagaccccacctcctggctacatcagtgaagatggagagaccagtgaccagcagctgaaccagagcatggacaccggcagccctgctgagctgagccccaccaccctgagccctgtgaaccacagcctggacctgcagcctgtgacctacagcgagcccgccttctggtgcagcatcgcctactatgagctgaaccagagggtgggggagaccttccacgccagccagcccagcctgactgtggatggcttcacagaccccagcaacagcgagcgcttctgcctgggcctgctgagcaatgtgaacagaaatgccaccgtggagatgaccaggaggcacatcggccggggcgtgcggctgtactacatcggcggggaggtgtttgctgagtgcctgagtgacagcgccatctttgtgcagagccccaactgcaaccagagatatggctggcacccagccaccgtgtgcaagatccccccaggctgcaacctgaagatcttcaacaaccaggagtttgctgccctgctggcccagagcgtgaaccagggctttgaggccgtgtaccagctgaccaggatgtgcaccatccgcatgagctttgtgaagggctggggcgctgagtaccgccggcagacagtgaccagcaccccctgctggattgagctgcacctgaatggccccctgcagtggctggacaaggtgctgacccagatgggcagccccagcgtgcgctgcagctccatgtcctag

SEQ ID NO: 21922 - DNA, 1404 bp, Artificial Sequence; identical to SEQ ID NO: 21920
  Description of Artificial Sequence: Synthetic coding sequence

SEQ ID NO: 21923 - DNA, 1278 bp, Artificial Sequence
  Description of Artificial Sequence: Synthetic coding sequence
atgagcagcatcctgcccttcaccccacccatcgtgaagaggctgctgggctggaagaagggggagcagaatggccaggaggagaagtggtgtgagaaggctgtgaagagcctggtgaagaagctgaagaagacaggccagctggatgagctggagaaggccatcaccacccagaatgtgaacaccaagtgcatcaccatccccaggagcctggatggccgcctgcaggtgagccacaggaagggcctgccccacgtgatctactgccgcctgtggcgctggccagacctgcacagccaccacgagctgcgggccatggagctgtgtgaatttgccttcaacatgaagaaggatgaggtgtgtgtgaacccctaccactaccagagggtggagacccctgtgctgccccctgtgctggtgcccaggcacacagagatcccagctgagttcccccccctggatgactacagccacagcatccctgagaacaccaacttccctgctggcatcgagccccagagcaacatccctgagaccccacctcctggctacctgtctgaagatggagagaccagtgaccaccagatgaaccacagcatggatgctggcagccccaacctgagccccaaccccatgagccctgcccacaacaacctggacctgcagcctgtgacctactgtgagcccgccttctggtgcagcatctcctactatgagctgaaccagagggtgggggagaccttccacgccagccagcccagcatgacagtggatggcttcacagaccccagcaacagcgagcgcttctgcctgggcctgctgagcaatgtgaacagaaatgctgctgtggagctgaccaggaggcacatcggccggggcgtgcggctgtactacatcggcggggaggtgtttgctgagtgcctgagtgacagcgccatctttgtgcagagccccaactgcaaccagagatatggctggcacccagccaccgtgtgcaagatccccccaggctgcaacctgaagatcttcaacaaccaggagtttgctgccctgctggcccagagcgtgaaccagggctttgaggccgtgtaccagctgaccaggatgtgcaccatccgcatgagctttgtgaagggctggggcgctgagtaccgccggcagacagtgaccagcaccccctgctggattgagctgcacctgaatggccccctgcagtggctggacaaggtgctgacccagatgggcagccccagcatccgctgcagctctgtgtcctag

SEQ ID NO: 21924 - DNA, 1146 bp, Artificial Sequence
  Description of Artificial Sequence: Synthetic coding sequence
atgagctgcctgcacccccggcagacctggaagggagctgccctggtgcacaggaaggcctggtggatgggccgcagcctggatggccgcctgcaggtgagccacaggaagggcctgccccacgtgatctactgccgcctgtggcgctggccagacctgcacagccaccacgagctgcgggccatggagctgtgtgaatttgccttcaacatgaagaaggatgaggtgtgtgtgaacccctaccactaccagagggtggagacccctgtgctgccccctgtgctggtgcccaggcacacagagatcccagctgagttcccccccctggatgactacagccacagcatccctgagaacaccaacttccctgctggcatcgagccccagagcaacatccctgagaccccacctcctggctacctgtctgaagatggagagaccagtgaccaccagatgaaccacagcatggatgctggcagccccaacctgagccccaaccccatgagccctgcccacaacaacctggacctgcagcctgtgacctactgtgagcccgccttctggtgcagcatctcctactatgagctgaaccagagggtgggggagaccttccacgccagccagcccagcatgacagtggatggcttcacagaccccagcaacagcgagcgcttctgcctgggcctgctgagcaatgtgaacagaaatgctgctgtggagctgaccaggaggcacatcggccggggcgtgcggctgtactacatcggcggggaggtgtttgctgagtgcctgagtgacagcgccatctttgtgcagagccccaactgcaaccagagatatggctggcacccagccaccgtgtgcaagatccccccaggctgcaacctgaagatcttcaacaaccaggagtttgctgccctgctggcccagagcgtgaaccagggctttgaggccgtgtaccagctgaccaggatgtgcaccatccgcatgagctttgtgaagggctggggcgctgagtaccgccggcagacagtgaccagcaccccctgctggattgagctgcacctgaatggccccctgcagtggctggacaaggtgctgacccagatgggcagccccagcatccgctgcagctctgtgtcctag

SEQ ID NO: 21925 - DNA, 1278 bp, Artificial Sequence; identical to SEQ ID NO: 21923
  Description of Artificial Sequence: Synthetic coding sequence

SEQ ID NO: 21926 - DNA, 693 bp, Artificial Sequence
  Description of Artificial Sequence: Synthetic coding sequence
atgaaccacagcatggatgctggcagccccaacctgagccccaaccccatgagccctgcccacaacaacctggacctgcagcctgtgacctactgtgagcccgccttctggtgcagcatctcctactatgagctgaaccagagggtgggggagaccttccacgccagccagcccagcatgacagtggatggcttcacagaccccagcaacagcgagcgcttctgcctgggcctgctgagcaatgtgaacagaaatgctgctgtggagctgacccggcggcacatcggccggggcgtgcggctgtactacatcggcggggaggtgtttgctgaatgtctgagtgacagcgccatctttgtgcagagccccaactgcaaccagagatatggctggcacccagccaccgtgtgcaagatccccccaggctgcaacctgaagatcttcaacaaccaggagtttgctgccctgctggcccagagcgtgaaccagggctttgaagctgtgtaccagctgaccaggatgtgcaccatccgcatgagctttgtgaagggctggggcgctgagtaccgccggcagacagtgaccagcaccccctgctggattgagctgcacctgaatggccccctgcagtggctggacaaggtgctgacccagatgggcagccccagcatccgctgcagctctgtgtcctag

SEQ ID NO: 21927 - DNA, 963 bp, Artificial Sequence
  Description of Artificial Sequence: Synthetic coding sequence
atggagctgtgtgaatttgccttcaacatgaagaaggatgaggtgtgtgtgaacccctaccactaccagagggtggagacccctgtgctgccccctgtgctggtgcccaggcacacagagatcccagctgagttcccccccctggatgactacagccacagcatccctgagaacaccaacttccctgctggcatcgagccccagagcaacatccctgagaccccacctcctggctacctgtctgaagatggagagaccagtgaccaccagatgaaccacagcatggatgctggcagccccaacctgagccccaaccccatgagccctgcccacaacaacctggacctgcagcctgtgacctactgtgagcccgccttctggtgcagcatctcctactatgagctgaaccagagggtgggggagaccttccacgccagccagcccagcatgacagtggatggcttcacagaccccagcaacagcgagcgcttctgcctgggcctgctgagcaatgtgaacagaaatgctgctgtggagctgacccggcggcacatcggccggggcgtgcggctgtactacatcggcggggaggtgtttgctgaatgtctgagtgacagcgccatctttgtgcagagccccaactgcaaccagagatatggctggcacccagccaccgtgtgcaagatccccccaggctgcaacctgaagatcttcaacaaccaggagtttgctgccctgctggcccagagcgtgaaccagggctttgaagctgtgtaccagctgaccaggatgtgcaccatccgcatgagctttgtgaagggctggggcgctgagtaccgccggcagacagtgaccagcaccccctgctggattgagctgcacctgaatggccccctgcagtggctggacaaggtgctgacccagatgggcagccccagcatccgctgcagctctgtgtcctag

SEQ ID NO: 21928 - DNA, 1281 bp, Artificial Sequence
  Description of Artificial Sequence: Synthetic coding sequence
atgttccgcaccaagaggtctgccctggtgcggcggctgtggaggagccgggcccctggaggagaagatgaggaggagggcgctgggggcggcggcggcggcggggagctgcggggggagggcgccacagacagccgggcccacggggccggcggcggcggccctggccgggccggctgctgcctgggcaaggctgtgcggggggccaagggccaccaccacccccaccccccagctgctggggccggggctgctggaggagctgaggccgacctgaaggccctgacccacagcgtgctgaagaagctgaaggagcggcagctggagctgctgctgcaggccgtggagagcagaggaggcaccaggacagcctgcctgctgctgcccggccgcctggactgccgcctgggccctggggccccagctggggcccagcctgcccagccccccagcagctacagcctgcccctgctgctgtgcaaggtgttccgctggccagacctgcggcacagcagcgaggtgaagaggctgtgctgctgtgagagctatggcaagatcaaccctgagctggtgtgctgcaacccccaccacctgagccggctgtgtgagctggagagccccccaccaccctacagccgctaccccatggacttcctgaagcccacagctgactgcccagatgctgtgcccagcagcgctgagactggaggcaccaactacctggcccctgggggcctgagtgacagccagctgctgctggagcccggggacaggagccactggtgtgtggtggcctactgggaggagaagaccagggtgggccgcctgtactgtgtgcaggagcccagcctggacatcttctatgacctgccccagggcaatggcttctgcctgggccagctgaacagcgacaacaagagccagctggtgcagaaggtgcgcagcaagattggctgcggcatccagctgacccgggaggtggatggagtgtgggtgtacaacagaagcagctaccccatcttcatcaagagcgccaccctggacaacccagacagcaggaccctgctggtgcacaaggtgtttcctggcttcagcatcaaggcctttgattatgagaaggcctacagcctgcagaggcccaatgaccacgagttcatgcagcagccctggacaggcttcaccgtgcagatcagctttgtgaagggctggggccagtgctacacccggcagttcatcagcagctgcccctgctggctggaggtgatcttcaacagcaggtag

SEQ ID NO: 21929 - DNA, 636 bp, Artificial Sequence
  Description of Artificial Sequence: Synthetic coding sequence
atggacttcctgaagcccacagctgactgcccagatgctgtgcccagcagcgctgagaccggcggcaccaactacctggcccctgggggcctgagtgacagccagctgctgctggagcccggggacaggagccactggtgtgtggtggcctactgggaggagaagaccagggtgggccgcctgtactgtgtgcaggagcccagcctggacatcttctatgacctgccccagggcaatggcttctgcctgggccagctgaacagcgacaacaagagccagctggtgcagaaggtgcgcagcaagattggctgcggcatccagctgacccgggaggtggatggagtgtgggtgtacaacagaagcagctaccccatcttcatcaagagcgccaccctggacaacccagacagcaggaccctgctggtgcacaaggtgtttcctggcttcagcatcaaggcctttgattatgagaaggcctacagcctgcagaggcccaatgaccacgagttcatgcagcagccctggacaggcttcaccgtgcagatcagctttgtgaagggctggggccagtgctacacccggcagttcatcagcagctgcccctgctggctggaggtgatcttcaacagcaggtag

SEQ ID NO: 21930 - DNA, 636 bp, Artificial Sequence; identical to SEQ ID NO: 21929
  Description of Artificial Sequence: Synthetic coding sequence

SEQ ID NO: 21931 - DNA, 270 bp, Artificial Sequence
  Description of Artificial Sequence: Synthetic coding sequence
atgaacagccagcagcagaagcagccctgcaccccaccaccccagccccagcagcagcaggtgaagcagccctgccagcccccaccccaggagccctgcatccccaagaccaaggagccctgccaccccaaggtgcctgagccctgccaccccaaggtgcctgagccctgccagcccaaggtgcctgagccctgccagcccaaggtgcctgagccctgccccagcacagtgaccccagccccagcccagcagaagaccaagcagaagtag

SEQ ID NO: 21932 - DNA, 270 bp, Artificial Sequence; identical to SEQ ID NO: 21931
  Description of Artificial Sequence: Synthetic coding sequence

SEQ ID NO: 21933 - DNA, 4260 bp, Artificial Sequence
  Description of Artificial Sequence: Synthetic coding sequence
atggccgagggcctggagcgggtgcgcatcagcgccagcgagctgcggggcatcctggccaccctggccccccaggccggcagccgggagaacatgaaggagctgaaggaggcccggcccaggaaggacaacagaagaccagacctggagatctacaagccaggcctgagccggctgaggaacaagcccaagatcaaggagcccccaggcagcgaggagttcaaggatgagatcgtgaatgaccgggactgcagcgctgtggagaatggcacccagcctgtgaaggatgtgtgcaaggagctgaacaaccaggagcagaatggccccatcgaccctgagaacaacagaggccaggagagcttccccaggacagctggccaggaggacaggagcctgaagatcatcaagaggaccaagaagccagacctgcagatctaccagcccggccggcggctgcagacagtgtccaaggagagcgccagccgggtggaggaggaggaggtgctgaaccaggtggagcagctgcgggtggaggaggatgaatgtagaggaaatgtggccaaggaggaggtggccaacaagccagacagagctgagattgagaagagccctgggggcggccgggtgggcgccgccaagggggagaagggcaagaggatgggcaagggggagggcgtgcgggagacccatgatgatcctgcccggggccggcccggcagcgccaagcgctacagcagaagtgacaagagaagaaaccgctaccgcaccaggagcaccagcagcgctggcagcaacaacagcgctgagggcgccggcctgacagacaatggctgcagaagaagacggcaggacaggaccaaggagcggccccggctgaagaagcaggtgtctgtgagcagcacagacagcctggatgaggacagaattgatgagccagatggcctgggcccccggcgcagcagcgagaggaagaggcacctggagaggaactggagcggccgcggggagggggagcagaagaacagcgccaaggagtaccggggcaccctgcgggtgacctttgatgctgaggccatgaacaaggagagccccatggtgcgcagcgccagagatgacatggaccggggcaagccagacaagggcctgagcagcggcggcaaaggaagtgagaagcaggagagcaagaaccccaagcaggagctgcggggccggggccggggcatcctgatcctgcctgcccacaccaccctgtctgtgaacagcgctggcagccctgagagcgcccccctgggcccccggctgctgtttggcagcggcagcaagggcagccgctcctggggccggggcggcaccacccggcggctgtgggaccccaacaacccagaccagaagccagccctgaagacccagaccccccagctgcacttcctggacacagatgatgaggtgagccccacctcctggggagacagccggcaggcccaggccagctactacaagttccagaacagcgacaacccctactactaccccaggaccccaggccctgccagccagtacccctacacaggctacaaccccctgcagtaccctgtgggccccaccaacggggtgtacccaggcccctactacccaggctaccccaccccatctggccagtatgtgtgcagccccctgcccaccagcaccatgagccctgaggaggtggagcagcacatgaggaacctgcagcagcaggagctgcaccggctgctgcgggtggccgacaaccaggagctgcagctgagcaacctgctgagccgggaccgcatcagccctgagggcctggagaagatggcccagctgcgggcagagctgctgcagctgtatgagcgctgcatcctgctggacatcgagttcagtgacaaccagaatgtggaccagatcctgtggaagaatgccttctaccaggtgattgagaagttccggcagctggtgaaggaccccaacgtggagaaccctgagcagatccggaaccggctgctggagctgctggatgagggcagtgacttctttgacagcctgctgcagaagctgcaggtgacctacaagttcaagctggaggactacatggatggcctggccatccgcagcaagcccctgaggaagacagtgaagtatgccctgatcagcgcccagcgctgcatgatctgccagggcgacatcgcccgctaccgggagcaggccagtgacacagccaactacggcaaggcccgctcctggtacctgaaggcccagcacatcgcccccaagaatggccggccctacaaccagctggccctgctggccgtgtacaccaggaggaagctggatgctgtgtactactacatgaggagcctggccgccagcaaccccatcctgacagccaaggagagcctgatgagcctgtttgaggagaccaagaggaaggccgagcagatggagaagaagcagcacgaggagtttgacctgagcccagaccagtggaggaagggcaagaagagcaccttcagacatgtgggagatgacaccacccggctggagatctggatccaccccagccaccccaggagcagccagggcacagagagcggcaaggacagcgagcaggagaatggcctgggcagcctgagccccagcgacctgaacaagcgcttcatcctgtccttcctgcacgcccacggcaagctgttcaccagaattggcatggagaccttccctgctgtggccgagaaggtgctgaaggagttccaggtgctgctgcagcacagccccagccccatcggcagcaccaggatgctgcagctgatgaccatcaacatgtttgctgtgcacaacagccagctgaaggactgcttcagcgaggagtgccgcagcgtcatccaggagcaggccgccgccctgggcctggccatgttcagcctgctggtgcggcgctgcacctgcctgctgaaggagagcgccaaggcccagctgagcagccctgaggaccaggatgaccaggatgacatcaaggtgagcagctttgtgcctgacctgaaggagctgctgcccagcgtgaaggtgtggagcgactggatgctgggctacccagacacctggaaccccccacccaccagcctggacctgcccagccacgtggccgtggatgtgtggagcaccctggccgacttctgcaacatcctgacagctgtgaaccagagcgaggtgcccctgtacaaggaccctgatgatgacctgaccctgctgatcctggaggaggaccggctgctgagcggctttgtgcccctgctggccgccccccaggacccctgctacgtggagaagaccagtgacaaggtgattgctgctgactgcaagagggtgacagtgctgaagtacttcctggaggccctgtgtggccaggaggagcccctgctggccttcaagggcggcaagtatgtgtctgtggcccctgtgcctgacaccatgggcaaggagatgggcagccaggagggcacccggctggaggatgaggaggaggatgtggtgattgaagattttgaagaagattctgaggccgagggcagcggaggagaagatgacatccgggagctgcgggccaagaagctggccctggccaggaagattgctgagcagcagaggcggcaggagaagatccaggccgtgctggaggaccacagccagatgaggcagatggagctggagatccggcccctcttcctggtgcctgacaccaacggcttcatcgaccacctggccagcctggcccggctgctggagagcaggaagtacatcctggtggtgcccctcatcgtcatcaatgagctggatggcctggccaagggccaggagacagaccaccgggccggcggctacgcccgggtggtgcaggagaaggccaggaagagcattgagttcctggagcagagatttgagagccgggacagctgcctgcgggccctgaccagcagaggaaatgagctggagagcatcgccttccgctctgaggacatcaccggccagctgggcaacaatgatgacctgatcctgagctgctgcctgcactactgcaaggacaaggccaaggacttcatgcctgccagcaaggaggagcccatccggctgctgcgggaggtggtgctgctgacagatgacaggaacctgcgggtgaaggccctgaccagaaatgtgcctgtgcgggacatcccagccttcctgacctgggcccaggtgggctag

SEQ ID NO: 21934 - DNA, 993 bp, Artificial Sequence
  Description of Artificial Sequence: Synthetic coding sequence
atgaggttccggctgtgccaccagaggggctgctgcccccatgaaagagagaacacctgcacctgcaagatgatcatcagcagcctgcaggtgattgctgctgactgcaagagggtgacagtgctgaagtacttcctggaggccctgtgtggccaggaggagcccctgctggccttcaagggcggcaagtatgtgtctgtggcccctgtgcctgacaccatgggcaaggagatgggcagccaggagggcacccggctggaggatgaggaggaggatgtggtgattgaggactttgaggaggacagcgaggccgagggcagcggcggggaggatgacatccgggagctgcgggccaagaagctggccctggccaggaagattgctgagcagcagaggcggcaggagaagatccaggccgtgctggaggaccacagccagatgaggcagatggagctggagatccggcccctcttcctggtgcctgacaccaacggcttcatcgaccacctggccagcctggcccggctgctggagagcaggaagtacatcctggtggtgcccctgattgtcatcaatgagctggatggcctggccaagggccaggagacagaccacagagctgggggctacgcccgggtggtgcaggagaaggccaggaagagcattgagttcctggagcagagatttgagagccgggacagctgcctgcgggccctgaccagcagaggaaatgagctggagagcatcgccttccgctctgaggacatcaccggccagctgggcaacaatgatgacctgatcctgagctgctgcctgcactactgcaaggacaaggccaaggacttcatgcctgccagcaaggaggagcccatccggctgctgcgggaggtggtgctgctgacagatgacaggaacctgcgggtgaaggccctgaccagaaatgtgcctgtgcgggacatcccagccttcctgacctgggcccaggtgggctag

SEQ ID NO: 21935 - DNA, 1536 bp, Artificial Sequence
  Description of Artificial Sequence: Synthetic coding sequence
atggagaccttccctgctgtggccgagaaggtgctgaaggagttccaggtgctgctgcagcacagccccagccccatcggcagcaccaggatgctgcagctgatgaccatcaacatgtttgctgtgcacaacagccagctgaaggactgcttcagcgaggagtgccgcagcgtcatccaggagcaggccgccgccctgggcctggccatgttcagcctgctggtgcggcgctgcacctgcctgctgaaggagagcgccaaggcccagctgagcagccctgaggaccaggatgaccaggatgacatcaaggtgagcagctttgtgcctgacctgaaggagctgctgcccagcgtgaaggtgtggagcgactggatgctgggctacccagacacctggaaccccccacccaccagcctggacctgcccagccacgtggccgtggatgtgtggagcaccctggccgacttctgcaacatcctgacagctgtgaaccagagcgaggtgcccctgtacaaggaccctgatgatgacctgaccctgctgatcctggaggaggaccggctgctgagcggctttgtgcccctgctggccgccccccaggacccctgctacgtggagaagaccagtgacaaggtgattgctgctgactgcaagagggtgacagtgctgaagtacttcctggaggccctgtgtggccaggaggagcccctgctggccttcaagggcggcaagtatgtgtctgtggcccctgtgcctgacaccatgggcaaggagatgggcagccaggagggcacccggctggaggatgaggaggaggatgtggtgattgaagattttgaagaagattctgaggccgagggcagcggaggagaagatgacatccgggagctgcgggccaagaagctggccctggccaggaagattgctgagcagcagaggcggcaggagaagatccaggccgtgctggaggaccacagccagatgaggcagatggagctggagatccggcccctcttcctggtgcctgacaccaacggcttcatcgaccacctggccagcctggcccggctgctggagagcaggaagtacatcctggtggtgcccctcatcgtcatcaatgagctggatggcctggccaagggccaggagacagaccaccgggccggcggctacgcccgggtggtgcaggagaaggccaggaagagcattgagttcctggagcagagatttgagagccgggacagctgcctgcgggccctgaccagcagaggaaatgagctggagagcatcgccttccgctctgaggacatcaccggccagctgggcaacaatgatgacctgatcctgagctgctgcctgcactactgcaaggacaaggccaaggacttcatgcctgccagcaaggaggagcccatccggctgctgcgggaggtggtgctgctgacagatgacaggaacctgcgggtgaaggccctgaccagaaatgtgcctgtgcgggacatcccagccttcctgacctgggcccaggtgggctag

SEQ ID NO: 21936 - DNA, 4167 bp, Artificial Sequence
  Description of Artificial Sequence: Synthetic coding sequence
atgaaggagctgaaggaggcccggcccaggaaggacaacagaagaccagacctggagatctacaagccaggcctgagccggctgaggaacaagcccaagatcaaggagcccccaggcagcgaggagttcaaggatgaaattgtgaatgaccgggactgcagcgctgtggagaatggcacccagcctgtgaaggatgtgtgcaaggagctgaacaaccaggagcagaatggccccattgatcctgagaacaacagaggccaggagagcttccccaggacagctggccaggaggacaggagcctgaagatcatcaagaggaccaagaagccagacctgcagatctaccagcctggaagaaggctgcagacagtgtccaaggagagcgccagccgggtggaggaggaggaggtgctgaaccaggtggagcagctgcgggtggaggaggatgagtgcagaggaaatgtggccaaggaggaggtggccaacaagccagacagagctgagattgagaagagccctgggggcggccgggtgggcgccgccaagggggagaagggcaagaggatgggcaaaggagagggcgtgcgggagacccatgatgatcctgcccggggccggcccggcagcgccaagcgctacagcagaagtgacaagagaagaaaccgctaccgcaccaggagcaccagcagcgctggcagcaacaacagcgctgagggcgccggcctgacagacaatggctgcagaagaagacggcaggacaggaccaaggagcggccccggctgaagaagcaggtgtctgtgagcagcacagacagcctggatgaagatagaattgatgagccagatggcctgggccccaggaggagcagcgagaggaagaggcacctggagaggaactggagcggccgcggggagggggagcagaagaacagcgccaaggagtaccggggcaccctgcgggtgacctttgatgctgaggccatgaacaaggagagccccatggtgcgcagcgccagagatgacatggaccggggcaagccagacaagggcctgagcagcggcggcaagggcagcgagaagcaggagagcaagaaccccaagcaggagctgcggggccggggccggggcatcctgatcctgcctgcccacaccaccctgtctgtgaacagcgctggcagccctgagagcgcccccctgggcccccggctgctgtttggaagtggcagcaagggcagccgctcctggggccggggcggcaccacccggcggctgtgggaccccaacaacccagaccagaagccagccctgaagacccagaccccccagctgcacttcctggacacagatgatgaggtgagccccacctcctggggagacagccggcaggcccaggccagctactacaagttccagaacagcgacaacccctactactaccccaggaccccaggccctgccagccagtacccctacacaggctacaaccccctgcagtaccctgtgggccccaccaatggagtgtacccaggcccctactacccaggctaccccacccccagcggccagtatgtgtgcagccccctgcccaccagcaccatgagccctgaggaggtggagcagcacatgaggaacctgcagcagcaggagctgcaccggctgctgcgggtggccgacaaccaggagctgcagctgagcaacctgctgagccgggaccgcatcagccctgagggcctggagaagatggcccagctgcgggcagagctgctgcagctgtatgagcgctgcatcctgctggacatcgagttcagtgacaaccagaatgtggaccagatcctgtggaagaatgccttctaccaggtgattgagaagttccggcagctggtgaaggaccccaacgtggagaaccctgagcagatccggaaccggctgctggagctgctggatgagggcagtgacttctttgacagcctgctgcagaagctgcaggtgacctacaagttcaagctggaggactacatggatggcctggccatccgcagcaagcccctgaggaagacagtgaagtatgccctgatcagcgcccagcgctgcatgatctgccagggcgacatcgcccgctaccgggagcaggccagtgacacagccaactacggcaaggcccgctcctggtacctgaaggcccagcacatcgcccccaagaatggccggccctacaaccagctggccctgctggccgtgtacaccaggaggaagctggatgctgtgtactactacatgaggagcctggccgccagcaaccccatcctgacagccaaggagagcctgatgagcctgtttgaggagaccaagaggaaggccgagcagatggagaagaagcagcacgaggagtttgacctgagcccagaccagtggaggaagggcaagaagagcaccttccgccacgtgggagatgacaccacccggctggagatctggatccaccccagccaccccaggagcagccagggcacagaaagtggcaaggacagcgagcaggagaatggcctgggcagcctgagccccagcgacctgaacaagcgcttcatcctgtccttcctgcacgcccacggcaagctgttcacccgcatcggcatggagaccttccctgctgtggccgagaaggtgctgaaggagttccaggtgctgctgcagcacagccccagccccatcggcagcaccaggatgctgcagctgatgaccatcaacatgtttgctgtgcacaacagccagctgaaggactgcttctctgaagaatgtcgcagcgtcatccaggagcaggccgccgccctgggcctggccatgttcagcctgctggtgcggcgctgcacctgcctgctgaaggagagcgccaaggcccagctgagcagccctgaggaccaggatgaccaggatgacatcaaggtgtcctcctttgtgcctgacctgaaggagctgctgcccagcgtgaaggtgtggagcgactggatgctgggctacccagacacctggaaccccccacccaccagcctggacctgcccagccacgtggccgtggatgtgtggagcaccctggccgacttctgcaacatcctgacagctgtgaaccagagcgaggtgcccctgtacaaggaccctgatgatgacctgaccctgctgatcctggaggaggaccggctgctgagcggctttgtgcccctgctggccgccccccaggacccctgctacgtggagaagaccagtgacaaggtgattgctgctgactgcaagagggtgacagtgctgaagtacttcctggaggccctgtgtggccaggaggagcccctgctggccttcaagggcggcaagtatgtgtctgtggcccctgtgcctgacaccatgggcaaggagatgggcagccaggagggcacccggctggaggatgaggaggaggatgtggtgattgaggactttgaggaggacagcgaggccgagggcagcggcggggaggatgacatccgggagctgcgggccaagaagctggccctggccaggaagattgctgagcagcagaggcggcaggagaagatccaggccgtgctggaggaccacagccagatgaggcagatggagctggagatccggcccctcttcctggtgcctgacaccaacggcttcatcgaccacctggccagcctggcccggctgctggagagcaggaagtacatcctggtggtgcccctgattgtcatcaatgagctggatggcctggccaagggccaggagacagaccacagagctgggggctacgcccgggtggtgcaggagaaggccaggaagagcattgagttcctggagcagagatttgagagccgggacagctgcctgcgggccctgaccagcagaggaaatgagctggagagcatcgccttccgctctgaggacatcaccggccagctgggcaacaatgatgacctgatcctgagctgctgcctgcactactgcaaggacaaggccaaggacttcatgcctgccagcaaggaggagcccatccggctgctgcgggaggtggtgctgctgacagatgacaggaacctgcgggtgaaggccctgaccagaaatgtgcctgtgcgggacatcccagccttcctgacctgggcccaggtgggctag

SEQ ID NO: 21937 - DNA, 2364 bp, Artificial Sequence
  Description of Artificial Sequence: Synthetic coding sequence
atggctgctgcccggcctgcccggggccctgagctgcccctgctgggcctgctgctgctgctgctgctgggggaccccggccgcggggccgccagcagtggaaatgccactggacctggccccaggtctgctgggggcagcgccaggagatctgctgctgtgactggacctcctccacccctgagccactgcggccgggccgccccctgtgagcccctgcgctacaacgtgtgcctgggctctgtgctgccctatggagccaccagcaccctgctggccggggacagcgacagccaggaggaggcccacggcaagctggtgctgtggagcggcctgagaaatgccccccgctgctgggccgtcatccagcccctgctgtgtgctgtgtacatgcccaagtgtgaaaatgacagagtggagctgcccagcaggaccctgtgccaggccacccggggcccctgtgccatcgtggagcgggagcggggctggccagacttcctgcgctgcaccccagaccgcttccctgagggctgcaccaatgaggtgcagaacatcaagttcaacagcagcggccagtgtgaggtgcccctggtgaggacagacaaccccaagtcctggtatgaagatgtggagggctgcggcatccagtgccagaaccccctcttcacagaagctgagcaccaggacatgcacagctacatcgccgcctttggagctgtgacaggcctgtgcaccctcttcaccctggccacctttgtggccgactggaggaacagcaaccgctacccagctgtgatcctcttctacgtgaatgcctgcttctttgtgggcagcatcggctggctggcccagttcatggatggagcccggcgggagatcgtgtgcagagcagatggcaccatgaggctgggggagcccaccagcaatgagaccctgagctgtgtgatcatcttcgtcatcgtgtactatgccctgatggccggcgtggtgtggtttgtggtgctgacctacgcctggcacaccagcttcaaggccctgggcaccacctaccagcccctgagcggcaagaccagctacttccacctgctgacctggagcctgccctttgtgctgactgtggccatcctggccgtggcccaggtggatggagacagcgtgtctggcatctgctttgtgggctacaagaactaccgctacagagctggctttgtgctggcccccatcggcctggtgctgattgtgggcggctacttcctgatccggggcgtgatgaccctcttcagcatcaagagcaaccaccctggcctgctgtctgagaaggccgccagcaagatcaatgagaccatgctgcggctgggcatcttcggcttcctggccttcggctttgtgctgatcaccttcagctgccacttctatgacttcttcaaccaggccgagtgggagaggagcttccgggactatgtgctgtgccaggccaacgtgaccatcggcctgcccaccaagcagcccatcccagactgtgagatcaagaaccggcccagcctgctggtggagaagatcaacctgtttgccatgtttggcaccggcatcgccatgagcacctgggtgtggaccaaggccaccctgctgatctggaggaggacctggtgccgcctgaccggccagagtgatgatgagcccaagaggatcaagaagagcaagatgattgccaaggccttcagcaagagacatgagctgctgcagaaccctggccaggagctgtccttctccatgcacacagtgtcccatgatggccctgtggccggcctggcctttgacctgaatgagcccagcgcagatgtgagcagcgcctgggcccagcacgtgaccaagatggtggcccggcggggggccatcctgccccaggacatctctgtgacccctgtggccacccctgtgcccccagaggagcaggccaacctgtggctggtggaggccgagatcagccctgagctgcagaagaggctgggcaggaagaagaagaggaggaagaggaagaaggaggtgtgccccctggcccctcctcctgagctgcaccccccagccccagcccccagcaccatcccccggctgccccagctgccccggcagaagtgcctggtggccgccggggcctggggcgctggggacagctgccggcagggcgcctggaccctggtgagcaaccccttctgcccagagcccagccccccccaggaccccttcctgcccagcgccccagcccctgtggcctgggcccacggccggcggcagggcctgggccccatccacagcaggaccaacctgatggacacagagctgatggatgctgacagcgacttctag

SEQ ID NO: 21938 - DNA, 231 bp, Artificial Sequence
  Description of Artificial Sequence: Synthetic coding sequence
atgtctgaccaggacagcagcgagatccacttcaaggtgaagatgaccacccacctgaagaagctgaaggagagctactgccagaggcagggcgtgcccatgaacagcctgcgcttcctgtttgagggccagagaattgctgacaaccacacccccaaggagctgggcatggaggaggaggatgtgattgaggtgtaccaggagcagacaggaggccacagcacagtgtag

SEQ ID NO: 21939 - DNA, 306 bp, Artificial Sequence
  Description of Artificial Sequence: Synthetic coding sequence
atgtctgaccaggaggccaagcccagcacagaggacctgggggacaagaaggagggggagtacatcaagctgaaggtgattggccaggacagcagcgagatccacttcaaggtgaagatgaccacccacctgaagaagctgaaggagagctactgccagaggcagggcgtgcccatgaacagcctgcgcttcctgtttgagggccagagaattgctgacaaccacacccccaaggagctgggcatggaggaggaggatgtgattgaggtgtaccaggagcagacaggaggccacagcacagtgtag

SEQ ID NO: 21940 - DNA, 306 bp, Artificial Sequence; identical to SEQ ID NO: 21939
  Description of Artificial Sequence: Synthetic coding sequence

SEQ ID NO: 21941 - DNA, 189 bp, Artificial Sequence
  Description of Artificial Sequence: Synthetic coding sequence
atgaccacccacctgaagaagctgaaggagagctactgccagaggcagggcgtgcccatgaacagcctgcgcttcctgtttgagggccagagaattgctgacaaccacacccccaaggagctgggcatggaggaggaggatgtgattgaggtgtaccaggagcagacaggaggccacagcacagtgtag

SEQ ID NO: 21942 - DNA, 189 bp, Artificial Sequence; identical to SEQ ID NO: 21941
  Description of Artificial Sequence: Synthetic coding sequence

SEQ ID NO: 21943 - DNA, 795 bp, Artificial Sequence
  Description of Artificial Sequence: Synthetic coding sequence
atgcccaggagcttcctggtgaggaagcccagcgaccccaacaggaagcccaactacagcgagctgcaggacagcaaccctgagttcaccttccagcagccctatgaccaggcccacctgctggccgccatccccccacctgagatcctgaaccccacagccagcctgcccatgctgatctgggacagcgtgctggccccccaggcccagcccatcgcctgggccagcctgcggctgcaggagagcccccgggtggccgagctgaccagcctgagtgatgaggacagcggcaagggcagccagccccccagcccccccagccctgcccccagcagcttcagcagcacctctgtgagcagcctggaggccgaggcctatgctgccttccctggcctgggccaggtgcccaagcagctggcccagctgtctgaggccaaggacctgcaggccaggaaggccttcaactgcaagtactgcaacaaggagtacctgagcctgggcgccctgaagatgcacatccgcagccacaccctgccctgtgtgtgtggcacctgtgggaaggccttcagccggccctggctgctgcagggccacgtgaggacccacactggagagaagcccttcagctgcccccactgcagccgggcctttgctgacaggagcaacctgcgggcccacctgcagacccacagtgatgtgaagaagtaccagtgccaggcctgtgcccggaccttcagcaggatgagcctgctgcacaagcaccaggagagcggctgcagcggctgccccaggtag

SEQ ID NO: 21944 - DNA, 807 bp, Artificial Sequence
  Description of Artificial Sequence: Synthetic coding sequence
atgcccaggagcttcctggtgaagaagcacttcaatgccagcaagaagcccaactacagcgagctggacacccacacagtcatcatcagcccctacctgtatgagagctacagcatgcctgtgatcccccagcctgagatcctgagcagcggggcctacagccccatcaccgtgtggaccacagctgcccccttccacgcccagctgcccaacggcctgagccccctgagcggctacagcagcagcctgggccgggtgagccccccaccacccagcgacaccagcagcaaggaccacagcggcagcgagagccccatcagtgatgaggaggagcggctgcagagcaagctgagtgacccccacgccattgaagctgagaagttccagtgcaacctgtgcaacaagacctacagcaccttcagcggcctggccaagcacaagcagctgcactgtgatgcccagagcaggaagagcttcagctgcaagtactgtgacaaggagtatgtgtccctgggcgccctgaagatgcacatccgcacccacaccctgccctgtgtgtgcaagatctgtgggaaggccttcagccggccctggctgctgcagggccacatccgcacccacactggagagaagcccttcagctgcccccactgcaacagagcctttgctgacaggagcaacctgcgggcccacctgcagacccacagtgatgtgaagaagtaccagtgcaagaactgcagcaagaccttcagcaggatgagcctgctgcacaagcatgaggagagcggctgctgcgtggcccactag

SEQ ID NO: 21945 - DNA, 807 bp, Artificial Sequence; identical to SEQ ID NO: 21944
  Description of Artificial Sequence: Synthetic coding sequence

SEQ ID NO: 21946 - DNA, 879 bp, Artificial Sequence
  Description of Artificial Sequence: Synthetic coding sequence
atgcccaggagcttcctggtgaagacccacagcagccaccgggtgcccaactacagaaggctggagacccagcgggagatcaacggggcctgcagcgcctgtggcggcctggtggtgcccctgctgccccgggacaaggaggcccccagcgtgcctggggacctgccccagccctgggacaggagcagcgctgtggcctgcatcagcctgcccctgctgccccgcatcgaggaggccctgggcgccagcggcctggatgccctggaggtgtctgaggtggacccccgggccagccgggccgccatcgtgcccctgaaggacagcctgaaccacctgaacctgccccccctgctggtgctgcccacccgctggagccccaccctgggccctgacagacatggagcccctgagaagctgctgggcgctgagaggatgccccgggcccctgggggctttgagtgcttccactgccacaagccctaccacaccctggccggcctggcccggcaccggcagctgcactgccacctgcaggtgggccgggtcttcacctgcaagtactgtgacaaggagtacaccagcctgggcgccctgaagatgcacatccgcacccacaccctgccctgcacctgcaagatctgtgggaaggccttcagccggccctggctgctgcagggccacgtgaggacccacactggagagaagccctatgcctgcagccactgcagccgggcctttgctgacaggagcaacctgcgggcccacctgcagacccacagtgatgccaagaagtaccgctgccgccgctgcaccaagaccttcagcaggatgagcctgctggcccggcatgaggagagcggctgctgccccggcccctag

SEQ ID NO: 21947 - DNA, 1398 bp, Artificial Sequence
  Description of Artificial Sequence: Synthetic coding sequence
atgggcggcgctgtggtggatgagggccccactggagtgaaggccccagatggcggctggggctgggccgtgctgtttggctgctttgtgatcaccggcttctcctatgccttccccaaggctgtgtctgtgttcttcaaggagctgatccaggagtttggaattggctacagcgacacagcctggatcagcagcatcctgctggccatgctgtatggcaccggccccctgtgcagcgtgtgtgtgaacagatttggctgcaggcctgtgatgctggtgggcggcctgtttgccagcctgggcatggtggccgccagcttctgccgcagcatcatccaggtgtacctgaccaccggggtcatcaccggcctgggcctggccctgaacttccagcccagcctcatcatgctgaaccgctacttcagcaagaggcggcccatggccaacggcctggccgccgccggcagccctgtgttcctgtgtgccctgagccccctgggccagctgctgcaggacagatatggctggaggggcggcttcctgatcctgggcggcctgctgctgaactgctgcgtgtgtgccgccctgatgaggcccctggtggtgacagcccagcccggcagcggccccccccggcccagccggcggctgctggacctgtctgtgttccgggaccggggctttgtgctgtatgctgtggccgcctctgtgatggtgctgggcctgtttgtgccccctgtgtttgtggtgtcctatgccaaggacctgggcgtgcctgacaccaaggccgccttcctgctgaccatcctgggcttcatcgacatctttgcccggcctgctgctggctttgtggccggcctgggcaaggtgcggccctacagcgtgtacctgttctccttctccatgttcttcaacggcctggccgacctggccggcagcacagctggggactatggaggcctggtggtgttctgcatcttcttcggcatctcctatggcatggtgggcgccctgcagtttgaggtgctgatggccatcgtgggcacccacaagttcagcagcgccatcggcctggtgctgctgatggaggccgtggccgtgctggtgggccccccatctgggggcaagctgctggatgccacccacgtgtacatgtatgtgttcatcctggccggggctgaggtgctgaccagcagcctcatcctgctgctgggcaacttcttctgcatcaggaagaagcccaaggagccccagcctgaggtggccgctgctgaggaggagaagctgcacaagcccccagctgacagcggcgtggacctgcgggaggtggagcacttcctgaaggccgagcctgagaagaatggagaggtggtgcacaccccagagacctctgtgtag

SEQ ID NO: 21948 - DNA, 1398 bp, Artificial Sequence; identical to SEQ ID NO: 21947
  Description of Artificial Sequence: Synthetic coding sequence

SEQ ID NO: 21949 - DNA, 1398 bp, Artificial Sequence; identical to SEQ ID NO: 21947
  Description of Artificial Sequence: Synthetic coding sequence

SEQ ID NO: 21950 - DNA, 1398 bp, Artificial Sequence; identical to SEQ ID NO: 21947
  Description of Artificial Sequence: Synthetic coding sequence

SEQ ID NO: 21951 - DNA, 1470 bp, Artificial Sequence
  Description of Artificial Sequence: Synthetic coding sequence
atggtgcccagcagccctgctgtggagaagcaggtgcctgtggagcccggccctgaccctgagctgcgctcctggaggcacctggtgtgctacctgtgcttctacggcttcatggcccagatccggcctggagagagcttcatcaccccctacctgctgggccctgacaagaacttcacccgggagcaggtgaccaatgagatcacccctgtgctgagctacagctacctggccgtgctggtgcctgtgttcctgctgacagactacctgcgctacacccctgtgctgctgctgcagggcctgagctttgtgtctgtgtggctgctgctgctgctgggccacagcgtggcccacatgcagctgatggagctgttctacagcgtgaccatggccgcccgcatcgcctacagcagctacatcttcagcctggtgcggcctgcccgctaccagagggtggccggctacagcagagctgctgtgctgctgggcgtcttcaccagctctgtgctgggccagctgctggtgacagtgggccgggtgtccttcagcaccctgaactacatcagcctggccttcctgaccttctctgtggtgctggccctcttcctgaagaggcccaagaggagcctcttcttcaacagagatgaccggggccgctgtgagaccagcgccagcgagctggagaggatgaaccctggccctgggggcaagctgggccacgccctgcgggtggcctgtggggacagcgtgctggccaggatgctgcgggagctgggggacagcctgcggcggccccagctgcggctgtggagcctgtggtgggtgttcaacagcgctggctactacctggtggtgtactacgtgcacatcctgtggaatgaggtggaccccaccaccaacagcgcccgggtgtacaacggggctgctgatgctgccagcaccctgctgggcgccatcaccagctttgctgctggctttgtgaagatccgctgggcccgctggagcaagctgctgattgctggggtgacagccacccaggccggcctggtgttcctgctggcccacaccaggcaccccagcagcatctggctgtgctatgctgcctttgtgctcttccggggcagctaccagttcctggtgcccatcgccaccttccagatcgccagcagcctgagcaaggagctgtgtgccctggtgtttggagtgaacaccttctttgccaccatcgtgaagaccatcatcaccttcatcgtgtctgatgtgcggggcctgggcctgcctgtgaggaagcagaatgaggagctgcacgtggccagcctgagcctgtggaagagccacctgcggctggccgctgacaccctgagcagcgagggcagcagcggcagcggccccaggtcctggttcctgagccccaccctgcgggccgccctgcacggccctgtgtgccccagcgaggtgtgccccagctag

SEQ ID NO: 21952 - DNA, 1776 bp, Artificial Sequence
  Description of Artificial Sequence: Synthetic coding sequence
atggtgcccagcagccctgctgtggagaagcaggtgcctgtggagcccggccctgaccctgagctgcgctcctggaggcacctggtgtgctacctgtgcttctacggcttcatggcccagatccggcctggagagagcttcatcaccccctacctgctgggccctgacaagaacttcacccgggagcaggtgaccaatgagatcacccctgtgctgagctacagctacctggccgtgctggtgcctgtgttcctgctgacagactacctgcgctacacccctgtgctgctgctgcagggcctgagctttgtgtctgtgtggctgctgctgctgctgggccacagcgtggcccacatgcagctgatggagctgttctacagcgtgaccatggccgcccgcatcgcctacagcagctacatcttcagcctggtgcggcctgcccgctaccagagggtggccggctacagcagagctgctgtgctgctgggcgtcttcaccagctctgtgctgggccagctgctggtgacagtgggccgggtgtccttcagcaccctgaactacatcagcctggccttcctgaccttctctgtggtgctggccctcttcctgaagaggcccaagaggagcctcttcttcaacagagatgaccggggccgctgtgagaccagcgccagcgagctggagaggatgaaccctggccctgggggcaagctgggccacgccctgcgggtggcctgtggggacagcgtgctggccaggatgctgcgggagctgggggacagcctgcggcggccccagctgcggctgtggagcctgtggtgggtgttcaacagcgctggctactacctggtggtgtactacgtgcacatcctgtggaatgaggtggaccccaccaccaacagcgcccgggtgtacaacggggctgctgatgctgccagcaccctgctgggcgccatcaccagctttgctgctggctttgtgaagatccgctgggcccgctggagcaagctgctgattgctggggtgacagccacccaggccggcctggtgttcctgctggcccacaccaggcaccccagcagcatctggctgtgctatgctgcctttgtgctcttccggggcagctaccagttcctggtgcccatcgccaccttccagatcgccagcagcctgagcaaggagctgtgtgccctggtgtttggagtgaacaccttctttgccaccatcgtgaagaccatcatcaccttcatcgtgtctgatgtgcggggcctgggcctgcctgtgaggaagcagttccagctgtacagcgtgtacttcctgatcctgagcatcatctacttcctgggcgccatgctggatggcctgcggcactgccagaggggccaccacccccggcagcccccagcccagggcctgcggtctgctgctgaggagaaggccgcccaggccctgtctgtgcaggacaagggcctgggcggcctgcagcctgcccagagcccccccctgagccctgaggacagcctgggcgctgtgggccctgccagcctggagcagaggcagagcgacccctacctggcccaggccccagccccccaggccgctgagttcctgagccctgtgaccacccccagcccctgcaccctgtgcagcgcccaggccagcggccctgaggccgcagatgagacctgcccccagctggccgtgcaccccccaggagtgtccaagctgggcctgcagtgcctgcccagtgatggagtgcagaatgtgaaccagtag

SEQ ID NO: 21953 - DNA, 846 bp, Artificial Sequence
  Description of Artificial Sequence: Synthetic coding sequence
atgctgcgggagctgggggacagcctgcggcggccccagctgcggctgtggagcctgtggtgggtgttcaacagcgctggctactacctggtggtgtactacgtgcacatcctgtggaatgaggtggaccccaccaccaacagcgcccgggtgtacaatggagctgctgatgctgccagcaccctgctgggcgccatcaccagctttgctgctggctttgtgaagatccgctgggcccgctggagcaagctgctgattgctggggtgacagccacccaggccggcctggtgttcctgctggcccacaccaggcaccccagcagcatctggctgtgctacgccgcctttgtgctcttccggggcagctaccagttcctggtgcccatcgccaccttccagatcgccagcagcctgagcaaggagctgtgtgccctggtgtttggagtgaacaccttctttgccaccatcgtgaagaccatcatcaccttcatcgtgtctgatgtgcggggcctgggcctgcctgtgaggaagcaggccctgaggatgagccggccccggctgggcctgtgcctgcccggccccttccccccccagagcgctgccccagcccgggccggcatggccgccagcagcgcagaagatcctggcagcgagcggggcccctggaggagagctggcaccgtggccgcccggggggaccccggcggggagcggggcccctggaggcgggagggcaccctggccgcccggggggaccctggaggagagcggggcccctggtggagggagggcaccctggccgccaagcccaggatgcagtgggtgacccgggccacagccccctag

SEQ ID NO: 21954 - DNA, 810 bp, Artificial Sequence
  Description of Artificial Sequence: Synthetic coding sequence
tgactgcggctgtggagcctgtggtgggtgttcaacagcgctggctactacctggtggtgtactacgtgcacatcctgtggaatgaggtggaccccaccaccaacagcgcccgggtgtacaatggagctgctgatgctgccagcaccctgctgggcgccatcaccagctttgctgctggctttgtgaagatccgctgggcccgctggagcaagctgctgattgctggggtgacagccacccaggccggcctggtgttcctgctggcccacaccaggcaccccagcagcatctggctgtgctacgccgcctttgtgctcttccggggcagctaccagttcctggtgcccatcgccaccttccagatcgccagcagcctgagcaaggagctgtgtgccctggtgtttggagtgaacaccttctttgccaccatcgtgaagaccatcatcaccttcatcgtgtctgatgtgcggggcctgggcctgcctgtgaggaagcaggccctgaggatgagccggccccggctgggcctgtgcctgcccggccccttccccccccagagcgctgccccagcccgggccggcatggccgccagcagcgcagaagatcctggcagcgagcggggcccctggaggagagctggcaccgtggccgcccggggggaccccggcggggagcggggcccctggaggcgggagggcaccctggccgcccggggggaccctggaggagagcggggcccctggtggagggagggcaccctggccgccaagcccaggatgcagtgggtgacccgggccacagccccctag

SEQ ID NO: 21955 - DNA, 549 bp, Artificial Sequence
  Description of Artificial Sequence: Synthetic coding sequence
atggtgcccagcagccctgctgtggagaagcaggtgcctgtggagcccggccctgaccctgagctgcgctcctggaggcacctggtgtgctacctgtgcttctacggcttcatggcccagatccggcctggagagagcttcatcaccccctacctgctgggccctgacaagaacttcacccgggagcaggtgaccaatgagatcacccctgtgctgagctacagctacctggccgtgctggtgcctgtgttcctgctgacagactacctgcgctacacccctgtgctgctgctgcagggcctgagctttgtgtctgtgtggctgctgctgctgctgggccacagcgtggcccacatgcagctgatggagctgttctacagcgtgaccatggccgcccgcatcgcctacagcagctacatcttcagcctggtgcggcctgcccgctaccagagggtggccggctacagcagagctgctgtgctgctgggcgtcttcaccagctctgtgctgggccagctgctggtgacagtgggccgggtgtccttctag

SEQ ID NO: 21956 - DNA, 465 bp, Artificial Sequence
  Description of Artificial Sequence: Synthetic coding sequence
atggtgcccagcagccctgctgtggagaagcaggtgcctgtggagcccggccctgaccctgagctgcgctcctggaggcacctggtgtgctacctgtgcttctacggcttcatggcccagatccggcctggagagagcttcatcaccccctacctgctgggccctgacaagaacttcacccgggagcaggtgaccaatgagatcacccctgtgctgagctacagctacctggccgtgctggtgcctgtgttcctgctgacagactacctgcgctacacccctgtgctgctgctgcagggcctgagctttgtgtctgtgtggctgctgctgctgctgggccacagcgtggcccacatgcagctgatggagctgttctacagcgtgaccatggccgcccgcatcgcctacagcagctacatcttcagcctggtgcggcctgcccgctaccagagggtggccggctag

SEQ ID NO: 21957 - DNA, 1656 bp, Artificial Sequence
  Description of Artificial Sequence: Synthetic coding sequence
atgaggccccagcctgctgagcccgcccctgggggcagaggaaatgaggcctgcagcatccacagcgaggtgaccaatgagatcacccctgtgctgagctacagctacctggccgtgctggtgcctgtgttcctgctgacagactacctgcgctacacccctgtgctgctgctgcagggcctgagctttgtgtctgtgtggctgctgctgctgctgggccacagcgtggcccacatgcagctgatggagctgttctacagcgtgaccatggccgcccgcatcgcctacagcagctacatcttcagcctggtgcggcctgcccgctaccagagggtggccggctacagcagagctgctgtgctgctgggcgtcttcaccagctctgtgctgggccagctgctggtgacagtgggccgggtgtccttcagcaccctgaactacatcagcctggccttcctgaccttctctgtggtgctggccctcttcctgaagaggcccaagaggagcctcttcttcaacagagatgaccggggccgctgtgagaccagcgccagcgagctggagaggatgaaccctggccctgggggcaagctgggccacgccctgcgggtggcctgtggggacagcgtgctggccaggatgctgcgggagctgggggacagcctgcggcggccccagctgcggctgtggagcctgtggtgggtgttcaacagcgctggctactacctggtggtgtactacgtgcacatcctgtggaatgaggtggaccccaccaccaacagcgcccgggtgtacaacggggctgctgatgctgccagcaccctgctgggcgccatcaccagctttgctgctggctttgtgaagatccgctgggcccgctggagcaagctgctgattgctggggtgacagccacccaggccggcctggtgttcctgctggcccacaccaggcaccccagcagcatctggctgtgctatgctgcctttgtgctcttccggggcagctaccagttcctggtgcccatcgccaccttccagatcgccagcagcctgagcaaggagctgtgtgccctggtgtttggagtgaacaccttctttgccaccatcgtgaagaccatcatcaccttcatcgtgtctgatgtgcggggcctgggcctgcctgtgaggaagcagttccagctgtacagcgtgtacttcctgatcctgagcatcatctacttcctgggcgccatgctggatggcctgcggcactgccagaggggccaccacccccggcagcccccagcccagggcctgcggtctgctgctgaggagaaggccgcccaggccctgtctgtgcaggacaagggcctgggcggcctgcagcctgcccagagcccccccctgagccctgaggacagcctgggcgctgtgggccctgccagcctggagcagaggcagagcgacccctacctggcccaggccccagccccccaggccgctgagttcctgagccctgtgaccacccccagcccctgcaccctgtgcagcgcccaggccagcggccctgaggccgcagatgagacctgcccccagctggccgtgcaccccccaggagtgtccaagctgggcctgcagtgcctgcccagtgatggagtgcagaatgtgaaccagtag

SEQ ID NO: 21958 - DNA, 186 bp, Artificial Sequence
  Description of Artificial Sequence: Synthetic coding sequence
atggtgcccagcagccctgctgtggagaagcaggtgcctgtggagcccggccctgaccctgagctgcgctcctggaggcacctggtgtgctacctgtgcttctacggcttcatggcccagatccggcctggagagagcttcatcaccccctacctgctgggccctgacaagaacttcaccaggtag

SEQ ID NO: 21959 - DNA, 705 bp, Artificial Sequence
  Description of Artificial Sequence: Synthetic coding sequence
atggagcccagcagcaagaagctgaccggccgcctgatgctggccgtgggcggcgctgtgctgggcagcctgcagtttggctacaacacaggagtcatcaatgccccccagaaggtgattgaggagttctacaaccagacctgggtgcaccgctacggggagagcatcctgcccaccaccctgaccaccctgtggagcctgtctgtggccatcttctctgtgggcggcatgattggcagcttctctgtgggcctgtttgtgaaccgcttcggcagaagaaattccatgctgatgatgaacctgctggcctttgtgtctgctgtgctgatgggcttcagcaagctgggcaagagctttgagatgctgatcctgggccgcttcatcattggagtgtactgcggcctgaccactggatttgtgcccatgtatgtgggggaggtgagccccacagccctgcggggggccctgggcaccctgcaccagctgggcatcgtggtgggcatcctgattgcccaggtgtcctggggccgcatctacctgcctggaacagccccagcccacagcttcagcggcagccgcatctgtgcccagcagggccgggtgtccctgccccccagcccccacagcctggccgaggacaactacggcacccaggtgcagaggacccagcaccacggcctgcctgtggacagcaagatgacctag

SEQ ID NO: 21960 - DNA, 1377 bp, Artificial Sequence
  Description of Artificial Sequence: Synthetic coding sequence
atggagcccagcagcaagaagctgaccggccgcctgatgctggccgtgggcggcgctgtgctgggcagcctgcagtttggctacaacacaggagtcatcaatgccccccagaaggtgattgaggagttctacaaccagacctgggtgcaccgctacggggagagcatcctgcccaccaccctgaccaccctgtggagcctgtctgtggccatcttctctgtgggcggcatgattggcagcttctctgtgggcctgtttgtgaaccgcttcggcagaagaaattccatgctgatgatgaacctgctggcctttgtgtctgctgtgctgatgggcttcagcaagctgggcaagagctttgagatgctgatcctgggccgcttcatcattggagtgtactgcggcctgaccactggatttgtgcccatgtatgtgggggaggtgagccccacagccctgcggggggccctgggcaccctgcaccagctgggcatcgtggtgggcatcctgattgcccaggtgtttggcctggacagcatcatgggcaacaaggacctgtggcccctgctgctgagcatcatcttcatcccagccctgctgcagtgcatcgtgctgcccttctgcccagagagcccccgcttcctgctgatcaacagaaatgaagaaaatagagccaagtctgtgctgaagaagctgcggggcacagcagatgtgacccatgacctgcaggagatgaaggaggagagccggcagatgatgagggagaagaaggtgaccatcctggagctgttccgcagccctgcctaccggcagcccatcctgattgctgtggtgctgcagctgagccagcagctgagcggcatcaatgctgtgttctactacagcaccagcatctttgagaaggccggcgtgcagcagcctgtgtatgccaccatcggcagcggcatcgtgaacacagccttcaccgtggtgtccctgtttgtggtggagagagctggaagaaggaccctgcacctgattggcctggccggcatggccggctgtgccatcctgatgaccatcgccctggccctgctggagcagctgccctggatgagctacctgagcatcgtggccatctttggatttgtggccttctttgaggtgggccctggccccatcccctggttcatcgtggccgagctgttcagccagggccccaggcctgctgccatcgctgtggccggcttcagcaactggaccagcaacttcatcgtgggcatgtgcttccagtatgtggagcagctgtgtggcccctacgtgttcatcatcttcaccgtgctgctggtgctcttcttcatcttcaccctgaatggctccatgcctgagggcggggactag

SEQ ID NO: 21961 - DNA, 1305 bp, Artificial Sequence
  Description of Artificial Sequence: Synthetic coding sequence
atggagcccagcagcaagaagctgaccggccgcctgatgctggccgtgggcggcgctgtgctgggcagcctgcagtttggctacaacacaggagtcatcaatgccccccagaaggtgattgaggagttctacaaccagacctgggtgcaccgctacggggagagcatcctgcccaccaccctgaccaccctgtggagcctgtctgtggccatcttctctgtgggcggcatgattggcagcttctctgtgggcctgtttgtgaaccgcttcggcagaagaaattccatgctgatgatgaacctgctggcctttgtgcccatgtatgtgggggaggtgagccccacagccctgcggggggccctgggcaccctgcaccagctgggcatcgtggtgggcatcatcatcttcatcccagccctgctgcagtgcatcgtgctgcccttctgcccagagagcccccgcttcctgctgatcaacagaaatgaagaaaatagagccaagtctgtgctgaagaagctgcggggcacagcagatgtgacccatgacctgcaggagatgaaggaggagagccggcagatgatgagggagaagaaggtgaccatcctggagctgttccgcagccctgcctaccggcagcccatcctgattgctgtggtgctgcagctgagccagcagctgagcggcatcaatgctgtgttctactacagcaccagcatctttgagaaggccggcgtgcagcagcctgtgtatgccaccatcggcagcggcatcgtgaacacagccttcaccgtggtgtccctgtttgtggtggagagagctggaagaaggaccctgcacctgattggcctggccggcatggccggctgtgccatcctgatgaccatcgccctggccctgctggagcagctgccctggatgagctacctgagcatcgtggccatctttggatttgtggccttctttgaggtgggccctggccccatcccctggttcatcgtggccgagctgttcagccagggccccaggcctgctgccatcgctgtggccggcttcagcaactggaccagcaacttcatcgtgggcatgtgcttccagtatgtggagcagctgtgtggcccctacgtgttcatcatcttcaccgtgctgctggtgctcttcttcatcttcacctacttcaaggtgcctgagaccaagggccgcacctttgatgaaattgccagcggcttccggcagggcggggccagccagagcgacaagaccccagaggagctgttccaccccctgggcgctgacagccaggtgtag

SEQ ID NO: 21962 - DNA, 528 bp, Artificial Sequence
  Description of Artificial Sequence: Synthetic coding sequence
atggagcccagcagcaagaagctgaccggccgcctgatgctggccgtgggcggcgctgtgctgggcagcctgcagtttggctacaacacaggagtcatcaatgccccccagaaggtgattgaggagttctacaaccagacctgggtgcaccgctacggggagagcatcctgcccaccaccctgaccaccctgtggagcctgtctgtggccatcttctctgtgggcggcatgattggcagcttctctgtgggcctgtttgtgaaccgcttcggcagaagaaattccatgctgatgatgaacctgctggcctttgtgtctgctgtgctgatgggcttcagcaagctgggcaaccccaagctggagaccacagacacccccctgcccaagaagttccccttccggccccaggccaggaaggtgacagctgtgcagtgccccttctgcctgagcatctgccccctgcacagcctgctgatcctgggccccaccagcacagccacagaagctgggaagggccacaacgtgtag

SEQ ID NO: 21963 - DNA, 1479 bp, Artificial Sequence
  Description of Artificial Sequence: Synthetic coding sequence
atggagcccagcagcaagaagctgaccggccgcctgatgctggccgtgggcggcgctgtgctgggcagcctgcagtttggctacaacacaggagtcatcaatgccccccagaaggtgattgaggagttctacaaccagacctgggtgcaccgctacggggagagcatcctgcccaccaccctgaccaccctgtggagcctgtctgtggccatcttctctgtgggcggcatgattggcagcttctctgtgggcctgtttgtgaaccgcttcggcagaagaaattccatgctgatgatgaacctgctggcctttgtgtctgctgtgctgatgggcttcagcaagctgggcaagagctttgagatgctgatcctgggccgcttcatcattggagtgtactgcggcctgaccactggatttgtgcccatgtatgtgggggaggtgagccccacagccctgcggggggccctgggcaccctgcaccagctgggcatcgtggtgggcatcctgattgcccaggtgtttggcctggacagcatcatgggcaacaaggacctgtggcccctgctgctgagcatcatcttcatcccagccctgctgcagtgcatcgtgctgcccttctgcccagagagcccccgcttcctgctgatcaacagaaatgaagaaaatagagccaagtctgtgctgaagaagctgcggggcacagcagatgtgacccatgacctgcaggagatgaaggaggagagccggcagatgatgagggagaagaaggtgaccatcctggagctgttccgcagccctgcctaccggcagcccatcctgattgctgtggtgctgcagctgagccagcagctgagcggcatcaatgctgtgttctactacagcaccagcatctttgagaaggccggcgtgcagcagcctgtgtatgccaccatcggcagcggcatcgtgaacacagccttcaccgtggtgtccctgtttgtggtggagagagctggaagaaggaccctgcacctgattggcctggccggcatggccggctgtgccatcctgatgaccatcgccctggccctgctggagcagctgccctggatgagctacctgagcatcgtggccatctttggatttgtggccttctttgaggtgggccctggccccatcccctggttcatcgtggccgagctgttcagccagggccccaggcctgctgccatcgctgtggccggcttcagcaactggaccagcaacttcatcgtgggcatgtgcttccagtatgtggagcagctgtgtggcccctacgtgttcatcatcttcaccgtgctgctggtgctcttcttcatcttcacctacttcaaggtgcctgagaccaagggccgcacctttgatgaaattgccagcggcttccggcagggcggggccagccagagcgacaagaccccagaggagctgttccaccccctgggcgctgacagccaggtgtag

SEQ ID NO: 21964 - DNA, 753 bp, Artificial Sequence
  Description of Artificial Sequence: Synthetic coding sequence
atgctgatgatgaacctgctggcctttgtgtctgctgtgctgatgggcttcagcaagctgggcaagagctttgagatgctgatcctgggccgcttcatcatcggcgtgtactgcggcctgaccaccggctttgtgcccatgtatgtgggggaggtgagccccacagccctgcggggggccctgggcaccctgcaccagctgggcatcgtggtgggcatcctgattgcccaggtgtttggcctggacagcatcatgggcaacaaggacctgtggcccctgctgctgagcatcatcttcatcccagccctgctgcagtgcatcgtgctgcccttctgcccagagagcccccgcttcctgctgatcaacagaaatgaggagaacagagccaagtctgtgctgaagaagctgcggggcacagcagatgtgacccatgacctgcaggagatgaaggaggagagccggcagatgatgagggagaagaaggtgaccatcctggagctgttccgcagccctgcctaccggcagcccatcctgattgctgtggtgctgcagctgagccagcagctgagcggcatcaatgctgtgttctactacagcaccagcatctttgagaaggccggcgtgcagcagcctgtgtatgccaccatcggcagcggcatcgtgaacacagccttcaccgtggtgtctgtgtccctgtgcctgctggcccccccagccaagccccagggcggcggcagcgccatcttcccctag

SEQ ID NO: 21965 - DNA, 1671 bp, Artificial Sequence
  Description of Artificial Sequence: Synthetic coding sequence
atgcccagctttgatgaggccctgcagagggtgggggagtttggccgcttccagaggagggtcttcctgctgctgtgcctgactggagtgacctttgccttcctgtttgtgggcgtggtgttcctgggcacccagcctgaccactactggtgccggggccccagcgctgctgccctggccgagcgctgtggctggagccctgaggaggagtggaacagaacagccccagccagccggggccctgagcccccagagcggcggggccgctgccagcgctacctgctggaggccgccaatgattctgccagcgccaccagcgccctgagctgtgccgaccccctggccgccttccccaacagaagtgcccccctggtgccctgccggggcggctggaggtatgcccaggcccacagcaccatcgtgtctgaatttgacctggtgtgtgtgaatgcctggatgctggacctgacccaggccatcctgaacctgggcttcctgactggagccttcaccctgggctatgctgctgacagatatggccgcatcgtcatctacctgctgagctgcctgggcgtgggcgtgactggagtggtggtggcctttgcccccaacttccctgtgtttgtgatcttccgcttcctgcagggcgtgtttgggaagggcacctggatgacctgctacgtgattgtgacagaaattgtgggcagcaagcagaggagaattgtgggcatcgtcatccagatgttcttcaccctgggcatcatcatcctgcccggcatcgcctacttcatccccaactggcagggcatccagctggccatcaccctgcccagcttcctgttcctgctgtactactgggtggtgcctgagagcccccgctggctgatcaccaggaagaagggggacaaggccctgcagatcctgcggagaattgccaagtgcaatggcaagtacctgagcagcaactacagcgagatcaccgtgacagatgaggaggtgagcaaccccagcttcctggacctggtgaggaccccccagatgaggaagtgcaccctcatcctgatgtttgcctggttcaccagcgctgtggtgtaccagggcctggtgatgaggctgggcatcattggaggcaacctgtacatcgacttcttcatcagcggcgtggtggagctgcccggggccctgctgatcctgctgaccatcgagcggctgggccggcggctgccctttgctgccagcaacatcgtggccggcgtggcctgcctggtgacagccttcctgcctgagggcatcgcctggctgcggaccaccgtggccaccctgggccgcctgggcatcaccatggcctttgagatcgtgtacctggtgaacagcgagctgtaccccaccaccctgaggaactttggagtgtccctgtgcagcggcctgtgtgactttggaggcatcatcgcccccttcctgctcttccggctggccgctgtgtggctggagctgcccctcatcatcttcggcatcctggccagcatctgtggcggcctggtgatgctgctgcctgagaccaagggcatcgccctgcctgagaccgtggatgatgtggagaagctgggcagcccccacagctgcaagtgtggcaggaacaagaagacccctgtgagccgcagccacctgtag

SEQ ID NO: 21966 - DNA, 1674 bp, Artificial Sequence
  Description of Artificial Sequence: Synthetic coding sequence
atgcccagctttgatgaggccctgcagagggtgggggagtttggccgcttccagaggagggtcttcctgctgctgtgcctgactggagtgacctttgccttcctgtttgtgggcgtggtgttcctgggcacccagcctgaccactactggtgccggggccccagcgctgctgccctggccgagcgctgtggctggagccctgaggaggagtggaacagaacagccccagccagccggggccctgagcccccagagcggcggggccgctgccagcgctacctgctggaggccgccaatgattctgccagcgccaccagcgccctgagctgtgccgaccccctggccgccttccccaacagaagtgcccccctggtgccctgccggggcggctggaggtatgcccaggcccacagcaccatcgtgtctgaatttgacctggtgtgtgtgaatgcctggatgctggacctgacccaggccatcctgaacctgggcttcctgactggagccttcaccctgggctatgctgctgacagatatggccgcatcgtcatctacctgctgagctgcctgggcgtgggcgtgactggagtggtggtggcctttgcccccaacttccctgtgtttgtgatcttccgcttcctgcagggcgtgtttgggaagggcacctggatgacctgctacgtgattgtgacagaaattgtgggcagcaagcagaggagaattgtgggcatcgtcatccagatgttcttcaccctgggcatcatcatcctgcccggcatcgcctacttcatccccaactggcagggcatccagctggccatcaccctgcccagcttcctgttcctgctgtactactgggtggtgcctgagagcccccgctggctgatcaccaggaagaagggggacaaggccctgcagatcctgcggagaattgccaagtgcaatggcaagtacctgagcagcaactacagcgagatcaccgtgacagatgaggaggtgagcaaccccagcttcctggacctggtgaggaccccccagatgaggaagtgcaccctcatcctgatgtttgcctggttcaccagcgctgtggtgtaccagggcctggtgatgaggctgggcatcattggaggcaacctgtacatcgacttcttcatcagcggcgtggtggagctgcccggggccctgctgatcctgctgaccatcgagcggctgggccggcggctgccctttgctgccagcaacatcgtggccggcgtggcctgcctggtgacagccttcctgcctgaggccggcatcgcctggctgcggaccaccgtggccaccctgggccgcctgggcatcaccatggcctttgaaattgtgtacctggtgaacagcgagctgtaccccaccaccctgaggaactttggagtgtccctgtgcagcggcctgtgtgactttggaggcatcatcgcccccttcctgctcttccggctggccgctgtgtggctggagctgcccctcatcatcttcggcatcctggccagcatctgtggcggcctggtgatgctgctgcctgagaccaagggcatcgccctgcctgagaccgtggatgatgtggagaagctgggcagcccccacagctgcaagtgtggcaggaacaagaagacccctgtgagccgcagccacctgtag

SEQ ID NO: 21967 - DNA, 1017 bp, Artificial Sequence
  Description of Artificial Sequence: Synthetic coding sequence
atggagctgcggagcggctctgtgggcagccaggccgtggcccggaggatggatggagacagcagagatggcggcggcggcaaggatgccactggaagtgaggactatgagaacctgcccaccagcgcctctgtgtccacccacatgacagctggggccatggccggcatcctggagcacagcgtgatgtaccctgtggacagcgtgaagaccaggatgcagagcctgagcccagaccccaaggcccagtacaccagcatctacggggccctgaagaagatcatgaggacagagggcttctggaggcccctgcggggcgtgaatgtgatgatcatgggcgccggccctgcccacgccatgtactttgcctgctatgagaacatgaagaggaccctgaatgatgtgttccaccaccagggcaacagccacctggccaacggcattgctggctccatggccaccctgctgcatgatgctgtgatgaacccagctgaggtggtgaagcagaggctgcagatgtacaacagccagcacaggtctgccatcagctgcatcagaacagtgtggaggacagagggcctgggcgccttctaccgcagctacaccacccagctgaccatgaacatccccttccagagcatccacttcatcacctatgagttcctgcaggagcaggtgaacccccacaggacctacaacccccagagccacatcatcagcggcggcctggccggggccctggccgccgccgccaccacccccctggatgtgtgcaagaccctgctgaacacccaggagaatgtggccctgagcctggccaacatcagcggccgcctgagcggcatggccaatgccttcagaacagtgtaccagctgaatggcctggccggctacttcaagggcatccaggcccgggtcatctaccagatgcccagcacagccatctcctggagcgtgtatgagttcttcaagtacttcctgaccaagaggcagctggagaacagagccccctactag

SEQ ID NO: 21968 - DNA, 2268 bp, Artificial Sequence
  Description of Artificial Sequence: Synthetic coding sequence
atggccaggaagctgagcgtcatcctgatcctgacctttgccctgtctgtgaccaaccccctgcacgagctgaaggctgctgccttcccccagaccacagagaagatcagccccaactgggagagcggcatcaacgtggacctggccatcagcacccggcagtaccacctgcagcagctgttctaccgctacggggagaacaacagcctgtctgtggagggcttcaggaagctgctgcagaacatcggcatcgacaagatcaagaggatccacatccaccacgaccatgaccaccacagcgaccacgagcaccacagcgaccacgagcggcacagcgaccacgagcaccacagcgagcacgagcaccacagcgaccatgaccaccacagccaccacaaccacgccgccagcggcaagaacaagaggaaggccctgtgcccagaccatgacagcgacagcagcggcaaggaccccaggaacagccagggcaagggggcccacaggcctgagcacgccagcggcagaagaaatgtgaaggacagcgtgtctgccagcgaggtgaccagcacagtgtacaacacagtgtctgagggcacccacttcctggagaccatcgagacccccaggcctgggaagctgttccccaaggatgtgagcagcagcaccccaccttctgtgaccagcaagagccgggtgtcccggctggccggcaggaagaccaatgaatctgtgtctgagcccaggaagggcttcatgtacagcaggaacaccaatgaaaacccccaggagtgcttcaatgccagcaagctgctgaccagccacggcatgggcatccaggtgcccctgaatgccacagagttcaactacctgtgcccagccatcatcaaccagattgatgcccggagctgcctgatccacaccagcgagaagaaggccgagatcccccccaagacctacagcctgcagatcgcctgggtgggcggcttcatcgccatcagcatcatctccttcctgagcctgctgggcgtcatcctggtgcccctgatgaacagagtcttcttcaagttcctgctgtccttcctggtggccctggccgtgggcaccctgtctggagatgccttcctgcacctgctgccccacagccacgccagccaccaccacagccacagccatgaggagcccgccatggagatgaagaggggccccctcttcagccacctgagcagccagaacatcgaggagagcgcctactttgacagcacctggaagggcctgacagccctgggcggcctgtacttcatgttcctggtggagcacgtgctgaccctcatcaagcagttcaaggacaagaagaagaagaaccagaagaagccagaaaatgatgatgatgtggagatcaagaagcagctgagcaaatatgagagccagctgagcaccaatgaggagaaggtggacacagatgacagaacagagggctacctgcgggctgacagccaggagcccagccactttgacagccagcagcctgctgtgctggaggaggaggaggtgatgattgcccacgcccacccccaggaggtgtacaatgaatatgtgccccggggctgcaagaacaagtgccacagccacttccatgacaccctgggccagagtgatgacctgatccaccaccaccacgactaccaccacatcctgcaccaccaccaccaccagaaccaccacccccacagccacagccagcgctacagccgggaggagctgaaggatgctggggtggccaccctggcctggatggtgatcatgggagatggcctgcacaacttcagtgatggcctggccatcggggccgccttcacagagggcctgagcagcggcctgagcacctctgtggccgtgttctgccacgagctgccccatgagctgggggactttgctgtgctgctgaaggccggcatgacagtgaagcaggccgtgctgtacaatgccctgagcgccatgctggcctacctgggcatggccaccggcatcttcatcggccactatgcagaaaatgtgtccatgtggatctttgccctgacagctggcctcttcatgtatgtggccctggtggacatggtgcctgagatgctgcacaatgatgccagtgaccacggctgcagccgctggggctacttcttcctgcagaatgccggcatgctgctgggcttcggcatcatgctgctgatcagcatctttgagcacaagatcgtgttccgcatcaacttctag

SEQ ID NO: 21969 - DNA, 1302 bp, Artificial Sequence
  Description of Artificial Sequence: Synthetic coding sequence
atgggcatccaggtgcccctgaatgccacagagttcaactacctgtgcccagccatcatcaaccagattgatgcccggagctgcctgatccacaccagcgagaagaaggccgagatcccccccaagacctacagcctgcagatcgcctgggtgggcggcttcatcgccatcagcatcatctccttcctgagcctgctgggcgtcatcctggtgcccctgatgaacagagtcttcttcaagttcctgctgtccttcctggtggccctggccgtgggcaccctgtctggagatgccttcctgcacctgctgccccacagccacgccagccaccaccacagccacagccatgaggagcccgccatggagatgaagaggggccccctcttcagccacctgagcagccagaacatcgaggagagcgcctactttgacagcacctggaagggcctgacagccctgggcggcctgtacttcatgttcctggtggagcacgtgctgaccctcatcaagcagttcaaggacaagaagaagaagaaccagaagaagccagaaaatgatgatgatgtggagatcaagaagcagctgagcaaatatgagagccagctgagcaccaatgaggagaaggtggacacagatgacagaacagagggctacctgcgggctgacagccaggagcccagccactttgacagccagcagcctgctgtgctggaggaggaggaggtgatgattgcccacgcccacccccaggaggtgtacaatgaatatgtgccccggggctgcaagaacaagtgccacagccacttccatgacaccctgggccagagtgatgacctgatccaccaccaccacgactaccaccacatcctgcaccaccaccaccaccagaaccaccacccccacagccacagccagcgctacagccgggaggagctgaaggatgctggggtggccaccctggcctggatggtgatcatgggagatggcctgcacaacttcagtgatggcctggccatcggggccgccttcacagagggcctgagcagcggcctgagcacctctgtggccgtgttctgccacgagctgccccatgagctgggggactttgctgtgctgctgaaggccggcatgacagtgaagcaggccgtgctgtacaatgccctgagcgccatgctggcctacctgggcatggccaccggcatcttcatcggccactatgcagaaaatgtgtccatgtggatctttgccctgacagctggcctcttcatgtatgtggccctggtggacatggtgtccttctag

SEQ ID NO: 21970 - DNA, 1233 bp, Artificial Sequence
  Description of Artificial Sequence: Synthetic coding sequence
atgggcatccaggtgcccctgaatgccacagagttcaactacctgtgcccagccatcatcaaccagattgatgcccggagctgcctgatccacaccagcgagaagaaggccgagatcccccccaagacctacagcctgcagatcgcctgggtgggcggcttcatcgccatcagcatcatctccttcctgagcctgctgggcgtcatcctggtgcccctgatgaacagagtcttcttcaagttcctgctgtccttcctggtggccctggccgtgggcaccctgtctggagatgccttcctgcacctgctgccccacagccacgccagccaccaccacagccacagccatgaggagcccgccatggagatgaagaggggccccctcttcagccacctgagcagccagaacatcgaggagagcgcctactttgacagcacctggaagggcctgacagccctgggcggcctgtacttcatgttcctggtggagcacgtgctgaccctcatcaagcagttcaaggacaagaagaagaagaaccagaagaagccagaaaatgatgatgatgtggagatcaagaagcagctgagcaaatatgagagccagctgagcaccaatgaggagaaggtggacacagatgacagaacagagggctacctgcgggctgacagccaggagcccagccactttgacagccagcagcctgctgtgctggaggaggaggaggtgatgattgcccacgcccacccccaggaggtgtacaatgaatatgtgccccggggctgcaagaacaagtgccacagccacttccatgacaccctgggccagagtgatgacctgatccaccaccaccacgactaccaccacatcctgcaccaccaccaccaccagaaccaccacccccacagccacagccagcgctacagccgggaggagctgaaggatgctggggtggccaccctggcctggatggtgatcatgggagatggcctgcacaacttcagtgatggcctggccatcggggccgccttcacagagggcctgagcagcggcctgagcacctctgtggccctggtggacatggtgcctgagatgctgcacaatgatgccagtgaccacggctgcagccgctggggctacttcttcctgcagaatgccggcatgctgctgggcttcggcatcatgctgctgatcagcatctttgagcacaagatcgtgttccgcatcaacttctag

SEQ ID NO: 21971 - DNA, 1833 bp, Artificial Sequence
  Description of Artificial Sequence: Synthetic coding sequence
atggacaccccccggggcatcggcacctttgtggtgtgggactatgtggtgtttgctggcatgctggtgatctctgctgccatcggcatctactatgcctttgctgggggcggccagcagaccagcaaggacttcctgatgggcggccgcaggatgacagctgtgcctgtggccctgagcctgacagccagcttcatgtctgctgtgacagtgctgggcacccccagcgaggtgtacagatttggagccatcttcagcatctttgccttcacctacttctttgtggtggtgatctctgctgaggtgttcctgcctgtgttctacaagctgggcatcaccagcacctatgagtacctggagctgcgcttcaacaagtgtgtgcggctgtgtggcaccgtgctcttcatcgtgcagaccatcctgtacacaggaattgtcatctatgccccagccctggccctgaaccaggtgacaggctttgacctgtggggcgctgtggtggccactggagtggtgtgcaccttctactgcaccctgggcggcctgaaggccgtcatctggacagatgtgttccaggtgggcatcatggtggccggctttgccagcgtcatcatccaggccgtggtgatgcagggcggcatcagcaccatcctgaatgatgcctatgatggcggccgcctgaacttctggaacttcaaccccaaccccctgcagaggcacaccttctggaccatcatcattggaggcaccttcacctggaccagcatctatggagtgaaccagagccaggtgcagcgctacatcagctgcaagagccgcttccaggccaagctgagcctgtacatcaacctggtgggcctgtgggccatcctgacctgcagcgtcttctgtggcctggccctgtacagccgctaccatgactgtgacccctggacagccaagaaggtgtctgccccagaccagctgatgccctacctggtgctggacatcctgcaggactacccaggcctgcccggcctgtttgtggcctgtgcctacagcggcaccctgagcacagtgagcagcagcatcaatgccctggccgctgtgacagtggaggacctgatcaagccctacttccgcagcctgtctgagaggagcctgtcctggatcagccagggcatgtctgtggtgtatggagccctgtgcatcggcatggccgccctggccagcctgatgggcgccctgctgcaggccgccctgtctgtgtttggcatggtgggcggccccctgatgggcctgtttgccctgggcatcctggtgccctttgccaacagcatcggggccctggtgggcctgatggccggctttgccatcagcctgtgggtgggcatcggggcccagatctacccacccctgcctgagaggaccctgcccctgcacctggacatccagggctgcaacagcacctacaatgagaccaacctgatgaccaccacagagatgcccttcaccaccagcgtcttccagatctacaacgtgcagaggacccccctgatggacaactggtacagcctgagctacctgtacttcagcacagtgggcaccctggtgaccctgctggtgggcatcctggtgtccctgagcactggaggcaggaagcagaacctggacccccgctacatcctgaccaaggaggacttcctgagcaactttgacatcttcaagaagaagaagcacgtgctgagctacaagagccaccctgtggaggatggcggcacagacaacccagccttcaaccacatcgagctgaacagcgaccagagcggcaagagcaatggcacccggctgtag

SEQ ID NO: 21972 - DNA, 1071 bp, Artificial Sequence
  Description of Artificial Sequence: Synthetic coding sequence
atggacatggctgatgagcccctgaatggcagccacacctggctgagcatcccctttgacctgaatggatctgtggtgtccaccaacaccagcaaccagacagagccctactatgacctgaccagcaatgctgtgctgaccttcatctactttgtggtgtgcatcatcggcctgtgtggcaacaccctggtgatctacgtgatcctgcgctatgccaagatgaagaccatcaccaacatctacatcctgaacctggccatcgcagatgagctgttcatgctgggcctgcccttcctggccatgcaggtggccctggtgcactggccctttgggaaggccatctgccgggtggtgatgacagtggatggcatcaaccagttcaccagcatcttctgcctgactgtgatgagcattgaccgctacctggccgtggtgcaccccatcaagagcgccaagtggaggcggcccaggacagccaagatgatcaccatggctgtgtggggcgtgtccctgctggtgatcctgcccatcatgatctatgccggcctgcggagcaaccagtggggccgcagcagctgcaccatcaactggccaggagagagcggggcctggtacacaggcttcatcatctacaccttcatcctgggcttcctggtgcccctgaccatcatctgcctgtgctacctgttcatcatcatcaaggtgaagagcagcggcatccgggtgggcagcagcaagaggaagaagtctgagaagaaggtgaccaggatggtgtccatcgtggtggccgtgttcatcttctgctggctgcccttctacatcttcaacgtgtcctctgtgtccatggccatcagccccaccccagccctgaagggcatgtttgattttgtggtggtgctgacctacgccaacagctgtgccaaccccatcctgtatgccttcctgagtgacaacttcaagaagagcttccagaatgtgctgtgcctggtgaaggtggacaacagcaagtctggagaggagggcagctgcctggacatgatcttcaggaacaacaagaacaggaagaagtag

SEQ ID NO: 21973 - DNA, 1110 bp, Artificial Sequence
  Description of Artificial Sequence: Synthetic coding sequence
atggacatggctgatgagcccctgaatggcagccacacctggctgagcatcccctttgacctgaatggatctgtggtgtccaccaacaccagcaaccagacagagccctactatgacctgaccagcaatgctgtgctgaccttcatctactttgtggtgtgcatcatcggcctgtgtggcaacaccctggtgatctacgtgatcctgcgctatgccaagatgaagaccatcaccaacatctacatcctgaacctggccatcgcagatgagctgttcatgctgggcctgcccttcctggccatgcaggtggccctggtgcactggccctttgggaaggccatctgccgggtggtgatgacagtggatggcatcaaccagttcaccagcatcttctgcctgactgtgatgagcattgaccgctacctggccgtggtgcaccccatcaagagcgccaagtggaggcggcccaggacagccaagatgatcaccatggctgtgtggggcgtgtccctgctggtgatcctgcccatcatgatctatgccggcctgcggagcaaccagtggggccgcagcagctgcaccatcaactggccaggagagagcggggcctggtacacaggcttcatcatctacaccttcatcctgggcttcctggtgcccctgaccatcatctgcctgtgctacctgttcatcatcatcaaggtgaagagcagcggcatccgggtgggcagcagcaagaggaagaagtctgagaagaaggtgaccaggatggtgtccatcgtggtggccgtgttcatcttctgctggctgcccttctacatcttcaacgtgtcctctgtgtccatggccatcagccccaccccagccctgaagggcatgtttgattttgtggtggtgctgacctacgccaacagctgtgccaaccccatcctgtatgccttcctgagtgacaacttcaagaagagcttccagaatgtgctgtgcctggtgaaggtgtctggaacagatgatggagagaggagtgacagcaagcaggacaagagccggctgaatgagaccacagagacccagaggaccctgctgaatggagacctgcagaccagcatctag

SEQ ID NO: 21974 - DNA, 3315 bp, Artificial Sequence
  Description of Artificial Sequence: Synthetic coding sequence
atgcaggcccagcagctgccctatgagttcttcagcgaggagaatgcccccaagtggaggggcctgctggtgcctgccctgaagaaggtgcagggccaggtgcaccccaccctggagagcaatgatgatgccctgcagtatgtggaggagctgatcctgcagctgctgaacatgctgtgccaggcccagcccaggtctgccagtgatgtggaggagcgggtgcagaagagcttcccccaccccatcgacaagtgggccatcgcagatgcccagagcgccatcgagaagaggaagagaagaaaccccctgagcctgcctgtggagaagatccaccccctgctgaaggaggtgctgggctacaagattgaccaccaggtgtctgtgtacatcgtggccgtgctggagtacatctctgctgacatcctgaagctggtgggcaactacgtgaggaacatccgccactatgagatcaccaagcaggacatcaaggtggccatgtgtgccgacaaggtgctgatggacatgttccaccaggatgtggaggacatcaacatcctgagcctgacagatgaggagcccagcaccagcggggagcagacctactatgacctggtgaaggccttcatggccgagatccggcagtacatccgggagctgaacctgatcatcaaggtgttccgggagccctttgtgagcaacagcaagctgttcagcgccaatgatgtggagaacatcttcagcagaattgtggacatccacgagctgtctgtgaagctgctgggccacatcgaggacacagtggagatgacagatgagggcagcccccaccccctggtgggcagctgctttgaggacctggccgaggagctggcctttgacccctatgagagctatgcccgggacatcctgcggcccggcttccatgaccgcttcctgagccagctgagcaagccaggggccgccctgtacctgcagagcattggagagggcttcaaggaggccgtgcagtatgtgctgccccggctgctgctggcccctgtgtaccactgcctgcactactttgagctgctgaagcagctggaggagaagtctgaggaccaggaggacaaggaatgtctgaagcaggccatcacagccctgctgaatgtgcagagcggcatggagaagatctgcagcaagagcctggccaagaggcggctgtctgagagcgcctgccgcttctacagccagcagatgaagggcaagcagctggccatcaagaagatgaatgagatccagaagaacattgatggctgggagggcaaggacatcggccagtgctgcaatgagttcatcatggagggcaccctgaccagggtgggcgccaagcatgagcggcacatcttcctgtttgatggcctgatgatctgctgcaagagcaaccacggccagccccggctgcccggggccagcaatgctgagtaccgcctgaaggagaagttcttcatgaggaaggtgcagatcaatgacaaggatgacaccaatgagtacaagcacgcctttgagatcatcctgaaggatgaaaattctgtcatcttcagcgccaagtctgctgaggagaagaacaactggatggccgccctgatcagcctgcagtaccgcagcaccctggagaggatgctggatgtgaccatgctgcaggaggagaaggaggagcagatgaggctgcccagcgcagatgtgtacagatttgctgagccagacagcgaggagaacatcatctttgaggagaacatgcagcccaaggccggcatccccatcatcaaggccggcaccgtcatcaagctgattgaaaggctgacctaccacatgtatgctgaccccaactttgtgaggaccttcctgaccacctaccgctccttctgcaagccccaggagctgctgagcctcatcatcgagagatttgagatccctgagcctgagcccacagaggccgacagaattgccattgaaaatggagaccagcccctgtctgctgagctgaagcgcttcaggaaggagtacatccagcctgtgcagctgcgggtgctgaatgtgtgccgccactgggtggagcaccacttctatgactttgaaagagatgcctacctgctgcagaggatggaggagttcatcggcaccgtgcggggcaaggccatgaagaagtgggtggagagcatcaccaagatcatccagaggaagaagatcgcccgggacaatggacctggccacaacatcaccttccagagcagcccccccaccgtggagtggcacatcagccggcccggccacatcgagacctttgacctgctgaccctgcaccccatcgagatcgcccggcagctgaccctgctggagagtgacctgtacagagctgtgcagcccagcgagctggtgggctctgtgtggaccaaggaggacaaggagatcaacagccccaacctgctgaagatgatccgccacaccaccaacctgaccctgtggtttgagaagtgcatcgtggagacagagaacctggaggagcgggtggccgtggtgagccgcatcatcgagatcctgcaggtgttccaggagctgaacaacttcaatggagtgctggaggtggtgtctgccatgaacagcagccctgtgtaccgcctggaccacacctttgagcagatccccagccggcagaagaagatcctggaggaggcccacgagctgtctgaggaccactacaagaagtacctggccaagctgcggagcatcaaccccccctgtgtgcccttcttcggcatctacctgaccaacatcctgaagacagaggagggcaaccctgaggtgctgaagagacatggcaaggagctgatcaacttcagcaagaggaggaaggtggccgagatcaccggggagatccagcagtaccagaaccagccctactgcctgcgggtggagagtgacatcaagcgcttctttgagaacctgaaccccatgggcaacagcatggagaaggagttcacagactacctgttcaacaagagcctggagattgagcccaggaaccccaagcccctgccccgcttccccaagaagtacagctaccccctgaagagccctggggtgcggcccagcaaccccaggcctggcaccatgaggcaccccacccccctgcagcaggagcccaggaagatctcctacagccgcatccctgagagcgagacagagagcacagccagcgcccccaacagccccaacacagtgaacaccagcgcctgcttctggtgcttccagtaccaccgctgcctgcagtgcatctag

SEQ ID NO: 21975 - DNA, 3957 bp, Artificial Sequence
  Description of Artificial Sequence: Synthetic coding sequence
atgcaggcccagcagctgccctatgagttcttcagcgaggagaatgcccccaagtggaggggcctgctggtgcctgccctgaagaaggtgcagggccaggtgcaccccaccctggagagcaatgatgatgccctgcagtatgtggaggagctgatcctgcagctgctgaacatgctgtgccaggcccagcccaggtctgccagtgatgtggaggagcgggtgcagaagagcttcccccaccccatcgacaagtgggccatcgcagatgcccagagcgccatcgagaagaggaagagaagaaaccccctgagcctgcctgtggagaagatccaccccctgctgaaggaggtgctgggctacaagattgaccaccaggtgtctgtgtacatcgtggccgtgctggagtacatctctgctgacatcctgaagctggtgggcaactacgtgaggaacatccgccactatgagatcaccaagcaggacatcaaggtggccatgtgtgccgacaaggtgctgatggacatgttccaccaggatgtggaggacatcaacatcctgagcctgacagatgaggagcccagcaccagcggggagcagacctactatgacctggtgaaggccttcatggccgagatccggcagtacatccgggagctgaacctgatcatcaaggtgttccgggagccctttgtgagcaacagcaagctgttcagcgccaatgatgtggagaacatcttcagcagaattgtggacatccacgagctgtctgtgaagctgctgggccacatcgaggacacagtggagatgacagatgagggcagcccccaccccctggtgggcagctgctttgaggacctggccgaggagctggcctttgacccctatgagagctatgcccgggacatcctgcggcccggcttccatgaccgcttcctgagccagctgagcaagccaggggccgccctgtacctgcagagcattggagagggcttcaaggaggccgtgcagtatgtgctgccccggctgctgctggcccctgtgtaccactgcctgcactactttgagctgctgaagcagctggaggagaagtctgaggaccaggaggacaaggaatgtctgaagcaggccatcacagccctgctgaatgtgcagagcggcatggagaagatctgcagcaagagcctggccaagaggcggctgtctgagagcgcctgccgcttctacagccagcagatgaagggcaagcagctggccatcaagaagatgaatgagatccagaagaacattgatggctgggagggcaaggacatcggccagtgctgcaatgagttcatcatggagggcaccctgaccagggtgggcgccaagcatgagcggcacatcttcctgtttgatggcctgatgatctgctgcaagagcaaccacggccagccccggctgcccggggccagcaatgctgagtaccgcctgaaggagaagttcttcatgaggaaggtgcagatcaatgacaaggatgacaccaatgagtacaagcacgcctttgagatcatcctgaaggatgaaaattctgtcatcttcagcgccaagtctgctgaggagaagaacaactggatggccgccctgatcagcctgcagtaccgcagcaccctggagaggatgctggatgtgaccatgctgcaggaggagaaggaggagcagatgaggctgcccagcgcagatgtgtacagatttgctgagccagacagcgaggagaacatcatctttgaggagaacatgcagcccaaggccggcatccccatcatcaaggccggcaccgtcatcaagctgattgaaaggctgacctaccacatgtatgctgaccccaactttgtgaggaccttcctgaccacctaccgctccttctgcaagccccaggagctgctgagcctcatcatcgagagatttgagatccctgagcctgagcccacagaggccgacagaattgccattgaaaatggagaccagcccctgtctgctgagctgaagcgcttcaggaaggagtacatccagcctgtgcagctgcgggtgctgaatgtgtgccgccactgggtggagcaccacttctatgactttgaaagagatgcctacctgctgcagaggatggaggagttcatcggcaccgtgcggggcaaggccatgaagaagtgggtggagagcatcaccaagatcatccagaggaagaagatcgcccgggacaatggacctggccacaacatcaccttccagagcagcccccccaccgtggagtggcacatcagccggcccggccacatcgagacctttgacctgctgaccctgcaccccatcgagatcgcccggcagctgaccctgctggagagtgacctgtacagagctgtgcagcccagcgagctggtgggctctgtgtggaccaaggaggacaaggagatcaacagccccaacctgctgaagatgatccgccacaccaccaacctgaccctgtggtttgagaagtgcatcgtggagacagagaacctggaggagcgggtggccgtggtgagccgcatcatcgagatcctgcaggtgttccaggagctgaacaacttcaatggagtgctggaggtggtgtctgccatgaacagcagccctgtgtaccgcctggaccacacctttgagcagatccccagccggcagaagaagatcctggaggaggcccacgagctgtctgaggaccactacaagaagtacctggccaagctgcggagcatcaaccccccctgtgtgcccttcttcggcatctacctgaccaacatcctgaagacagaggagggcaaccctgaggtgctgaagagacatggcaaggagctgatcaacttcagcaagaggaggaaggtggccgagatcaccggggagatccagcagtaccagaaccagccctactgcctgcgggtggagagtgacatcaagcgcttctttgagaacctgaaccccatgggcaacagcatggagaaggagttcacagactacctgttcaacaagagcctggagattgagcccaggaaccccaagcccctgccccgcttccccaagaagtacagctaccccctgaagagccctggggtgcggcccagcaaccccaggcctggcaccatgaggcaccccacccccctgcagcaggagcccaggaagatctcctacagccgcatccctgagagcgagacagagagcacagccagcgcccccaacagccccaggacccccctgaccccacctccagccagcggggccagcagcaccacagatgtgtgcagcgtgtttgacagcgaccacagcagccccttccacagccgcagcgcctctgtgagcagcatcagcctgaccaagggcacagatgaggtgcctgtgcccccacctgtgcccccaagaagaagacctgagagcgccccagctgagagcagccccagcaagatcatgagcaagcacctggacagccccccagccatccccccccggcagcccaccagcaaggcctacagcccccgctacagcatcagtgacaggaccagcatcagtgaccccccagagagcccccccctgctgcccccccgggagcctgtgaggaccccagatgtgttcagcagcagccccctgcacctgcagcccccacccctgggcaagaagagtgaccatggaaatgccttcttccccaacagccccagccccttcaccccacctccaccccagacccccagcccccacggcaccaggaggcacctgcccagcccccccctgacccaggaggtggacctgcacagcattgctggcccccctgtgcccccccggcagagcaccagccagcacatccccaagctgccccccaagacctacaagcgggagcacacccaccccagcatgcacagagatggcccccccctgctggagaatgcccacagcagctag

SEQ ID NO: 21976 - DNA, 4002 bp, Artificial Sequence
  Description of Artificial Sequence: Synthetic coding sequence
atgcaggcccagcagctgccctatgagttcttcagcgaggagaatgcccccaagtggaggggcctgctggtgcctgccctgaagaaggtgcagggccaggtgcaccccaccctggagagcaatgatgatgccctgcagtatgtggaggagctgatcctgcagctgctgaacatgctgtgccaggcccagcccaggtctgccagtgatgtggaggagcgggtgcagaagagcttcccccaccccatcgacaagtgggccatcgcagatgcccagagcgccatcgagaagaggaagagaagaaaccccctgagcctgcctgtggagaagatccaccccctgctgaaggaggtgctgggctacaagattgaccaccaggtgtctgtgtacatcgtggccgtgctggagtacatctctgctgacatcctgaagctggtgggcaactacgtgaggaacatccgccactatgagatcaccaagcaggacatcaaggtggccatgtgtgccgacaaggtgctgatggacatgttccaccaggatgtggaggacatcaacatcctgagcctgacagatgaggagcccagcaccagcggggagcagacctactatgacctggtgaaggccttcatggccgagatccggcagtacatccgggagctgaacctgatcatcaaggtgttccgggagccctttgtgagcaacagcaagctgttcagcgccaatgatgtggagaacatcttcagcagaattgtggacatccacgagctgtctgtgaagctgctgggccacatcgaggacacagtggagatgacagatgagggcagcccccaccccctggtgggcagctgctttgaggacctggccgaggagctggcctttgacccctatgagagctatgcccgggacatcctgcggcccggcttccatgaccgcttcctgagccagctgagcaagccaggggccgccctgtacctgcagagcattggagagggcttcaaggaggccgtgcagtatgtgctgccccggctgctgctggcccctgtgtaccactgcctgcactactttgagctgctgaagcagctggaggagaagtctgaggaccaggaggacaaggaatgtctgaagcaggccatcacagccctgctgaatgtgcagagcggcatggagaagatctgcagcaagagcctggccaagaggcggctgtctgagagcgcctgccgcttctacagccagcagatgaagggcaagcagctggccatcaagaagatgaatgagatccagaagaacattgatggctgggagggcaaggacatcggccagtgctgcaatgagttcatcatggagggcaccctgaccagggtgggcgccaagcatgagcggcacatcttcctgtttgatggcctgatgatctgctgcaagagcaaccacggccagccccggctgcccggggccagcaatgctgagtaccgcctgaaggagaagttcttcatgaggaaggtgcagatcaatgacaaggatgacaccaatgagtacaagcacgcctttgagatcatcctgaaggatgaaaattctgtcatcttcagcgccaagtctgctgaggagaagaacaactggatggccgccctgatcagcctgcagtaccgcagcaccctggagaggatgctggatgtgaccatgctgcaggaggagaaggaggagcagatgaggctgcccagcgcagatgtgtacagatttgctgagccagacagcgaggagaacatcatctttgaggagaacatgcagcccaaggccggcatccccatcatcaaggccggcaccgtcatcaagctgattgaaaggctgacctaccacatgtatgctgaccccaactttgtgaggaccttcctgaccacctaccgctccttctgcaagccccaggagctgctgagcctcatcatcgagagatttgagatccctgagcctgagcccacagaggccgacagaattgccattgaaaatggagaccagcccctgtctgctgagctgaagcgcttcaggaaggagtacatccagcctgtgcagctgcgggtgctgaatgtgtgccgccactgggtggagcaccacttctatgactttgaaagagatgcctacctgctgcagaggatggaggagttcatcggcaccgtgcggggcaaggccatgaagaagtgggtggagagcatcaccaagatcatccagaggaagaagatcgcccgggacaatggacctggccacaacatcaccttccagagcagcccccccaccgtggagtggcacatcagccggcccggccacatcgagacctttgacctgctgaccctgcaccccatcgagatcgcccggcagctgaccctgctggagagtgacctgtacagagctgtgcagcccagcgagctggtgggctctgtgtggaccaaggaggacaaggagatcaacagccccaacctgctgaagatgatccgccacaccaccaacctgaccctgtggtttgagaagtgcatcgtggagacagagaacctggaggagcgggtggccgtggtgagccgcatcatcgagatcctgcaggtgttccaggagctgaacaacttcaatggagtgctggaggtggtgtctgccatgaacagcagccctgtgtaccgcctggaccacacctttgagcagatccccagccggcagaagaagatcctggaggaggcccacgagctgtctgaggaccactacaagaagtacctggccaagctgcggagcatcaaccccccctgtgtgcccttcttcggcatctacctgaccaacatcctgaagacagaggagggcaaccctgaggtgctgaagagacatggcaaggagctgatcaacttcagcaagaggaggaaggtggccgagatcaccggggagatccagcagtaccagaaccagccctactgcctgcgggtggagagtgacatcaagcgcttctttgagaacctgaaccccatgggcaacagcatggagaaggagttcacagactacctgttcaacaagagcctggagattgagcccaggaaccccaagcccctgccccgcttccccaagaagtacagctaccccctgaagagccctggggtgcggcccagcaaccccaggcctggcaccatgaggcaccccacccccctgcagcaggagcccaggaagatctcctacagccgcatccctgagagcgagacagagagcacagccagcgcccccaacagccccaggacccccctgaccccacctccagccagcggggccagcagcaccacagatgtgtgcagcgtgtttgacagcgaccacagcagccccttccacagcagcaatgacacagtgttcatccaggtgaccctgccccacggccccaggtctgcctctgtgagcagcatcagcctgaccaagggcacagatgaggtgcctgtgcccccacctgtgccccccaggagaagacctgagagcgccccagctgagagcagccccagcaagatcatgagcaagcacctggacagccccccagccatccccccccggcagcccaccagcaaggcctacagcccccgctacagcatcagtgacaggaccagcatcagtgaccccccagagagcccccccctgctgcccccccgggagcctgtgaggaccccagatgtgttcagcagcagccccctgcacctgcagcccccacccctgggcaagaagagtgaccacggcaatgccttcttccccaacagccccagccccttcaccccacctccaccccagacccccagcccccacggcacccggcggcacctgcccagcccccccctgacccaggaggtggacctgcacagcattgctggcccccctgtgcccccccggcagagcaccagccagcacatccccaagctgccccccaagacctacaagcgggagcacacccaccccagcatgcacagagatggcccccccctgctggagaatgcccacagcagctag

SEQ ID NO: 21977 - DNA, 4002 bp, Artificial Sequence; identical to SEQ ID NO: 21976
  Description of Artificial Sequence: Synthetic coding sequence

SEQ ID NO: 21978 - DNA, 945 bp, Artificial Sequence
  Description of Artificial Sequence: Synthetic coding sequence
atgctgtgccaggcccagcccaggtctgccagtgatgtggaggagcgggtgcagaagagcttcccccaccccatcgacaagtgggccatcgcagatgcccagagcgccatcgagaagaggaagagaagaaaccccctgagcctgcctgtggagaagatccaccccctgctgaaggaggtgctgggctacaagattgaccaccaggtgtctgtgtacatcgtggccgtgctggagtacatctctgctgacatcctgaagctggtgggcaactacgtgaggaacatccgccactatgagatcaccaagcaggacatcaaggtggccatgtgtgccgacaaggtgctgatggacatgttccaccaggatgtggaggacatcaacatcctgagcctgacagatgaggagcccagcaccagcggggagcagacctactatgacctggtgaaggccttcatggccgagatccggcagtacatccgggagctgaacctgatcatcaaggtgttccgggagccctttgtgagcaacagcaagctgttcagcgccaatgatgtggagaacatcttcagccgcatcgtggacatccacgagctgtctgtgaagctgctgggccacattgaagatactgtggagatgacagatgagggcagcccccaccccctggtgggcagctgctttgaggacctggccgaggagctggcctttgacccctatgagagctatgcccgggacatcctgcggcccggcttccatgaccgcttcctgagccagctgagcaagccaggagctgccctgtacctgcagagcatcggggagggcttcaaggaggccgtgcagtatgtgctgccccggctgctgctggcccctgtgtaccactgcctgcactactttgagctgctgaagttcccctttggagacctgagccggctgcgggacagcgtgtag

SEQ ID NO: 21979 - DNA, 3153 bp, Artificial Sequence
  Description of Artificial Sequence: Synthetic coding sequence
atgacagatgagggcagcccccaccccctggtgggcagctgctttgaggacctggccgaggagctggcctttgacccctatgagagctatgcccgggacatcctgcggcccggcttccatgaccgcttcctgagccagctgagcaagccaggggccgccctgtacctgcagagcattggagagggcttcaaggaggccgtgcagtatgtgctgccccggctgctgctggcccctgtgtaccactgcctgcactactttgagctgctgaagcagctggaggagaagtctgaggaccaggaggacaaggaatgtctgaagcaggccatcacagccctgctgaatgtgcagagcggcatggagaagatctgcagcaagagcctggccaagaggcggctgtctgagagcgcctgccgcttctacagccagcagatgaagggcaagcagctggccatcaagaagatgaatgagatccagaagaacattgatggctgggagggcaaggacatcggccagtgctgcaatgagttcatcatggagggcaccctgaccagggtgggcgccaagcatgagcggcacatcttcctgtttgatggcctgatgatctgctgcaagagcaaccacggccagccccggctgcccggggccagcaatgctgagtaccgcctgaaggagaagttcttcatgaggaaggtgcagatcaatgacaaggatgacaccaatgagtacaagcacgcctttgagatcatcctgaaggatgaaaattctgtcatcttcagcgccaagtctgctgaggagaagaacaactggatggccgccctgatcagcctgcagtaccgcagcaccctggagaggatgctggatgtgaccatgctgcaggaggagaaggaggagcagatgaggctgcccagcgcagatgtgtacagatttgctgagccagacagcgaggagaacatcatctttgaggagaacatgcagcccaaggccggcatccccatcatcaaggccggcaccgtcatcaagctgattgaaaggctgacctaccacatgtatgctgaccccaactttgtgaggaccttcctgaccacctaccgctccttctgcaagccccaggagctgctgagcctcatcatcgagagatttgagatccctgagcctgagcccacagaggccgacagaattgccattgaaaatggagaccagcccctgtctgctgagctgaagcgcttcaggaaggagtacatccagcctgtgcagctgcgggtgctgaatgtgtgccgccactgggtggagcaccacttctatgactttgaaagagatgcctacctgctgcagaggatggaggagttcatcggcaccgtgcggggcaaggccatgaagaagtgggtggagagcatcaccaagatcatccagaggaagaagatcgcccgggacaatggacctggccacaacatcaccttccagagcagcccccccaccgtggagtggcacatcagccggcccggccacatcgagacctttgacctgctgaccctgcaccccatcgagatcgcccggcagctgaccctgctggagagtgacctgtacagagctgtgcagcccagcgagctggtgggctctgtgtggaccaaggaggacaaggagatcaacagccccaacctgctgaagatgatccgccacaccaccaacctgaccctgtggtttgagaagtgcatcgtggagacagagaacctggaggagcgggtggccgtggtgagccgcatcatcgagatcctgcaggtgttccaggagctgaacaacttcaatggagtgctggaggtggtgtctgccatgaacagcagccctgtgtaccgcctggaccacacctttgagcagatccccagccggcagaagaagatcctggaggaggcccacgagctgtctgaggaccactacaagaagtacctggccaagctgcggagcatcaaccccccctgtgtgcccttcttcggcatctacctgaccaacatcctgaagacagaggagggcaaccctgaggtgctgaagagacatggcaaggagctgatcaacttcagcaagaggaggaaggtggccgagatcaccggggagatccagcagtaccagaaccagccctactgcctgcgggtggagagtgacatcaagcgcttctttgagaacctgaaccccatgggcaacagcatggagaaggagttcacagactacctgttcaacaagagcctggagattgagcccaggaaccccaagcccctgccccgcttccccaagaagtacagctaccccctgaagagccctggggtgcggcccagcaaccccaggcctggcaccatgaggcaccccacccccctgcagcaggagcccaggaagatctcctacagccgcatccctgagagcgagacagagagcacagccagcgcccccaacagccccaggacccccctgaccccacctccagccagcggggccagcagcaccacagatgtgtgcagcgtgtttgacagcgaccacagcagccccttccacagccgcagcgcctctgtgagcagcatcagcctgaccaagggcacagatgaggtgcctgtgcccccacctgtgcccccaagaagaagacctgagagcgccccagctgagagcagccccagcaagatcatgagcaagcacctggacagccccccagccatccccccccggcagcccaccagcaaggcctacagcccccgctacagcatcagtgacaggaccagcatcagtgaccccccagagagcccccccctgctgcccccccgggagcctgtgaggaccccagatgtgttcagcagcagccccctgcacctgcagcccccacccctgggcaagaagagtgaccatggaaatgccttcttccccaacagccccagccccttcaccccacctccaccccagacccccagcccccacggcaccaggaggcacctgcccagcccccccctgacccaggaggtggacctgcacagcattgctggcccccctgtgcccccccggcagagcaccagccagcacatccccaagctgccccccaagacctacaagcgggagcacacccaccccagcatgcacagagatggcccccccctgctggagaatgcccacagcagctag

SEQ ID NO: 21980 - DNA, 2358 bp, Artificial Sequence
  Description of Artificial Sequence: Synthetic coding sequence
atgtctgaccaggaccacagcatggatgagatgacagctgtggtgaagattgaaaaaggagtgggcggcaacaatggaggaaatggaaatggaggaggagccttcagccaggcccggagcagcagcacaggcagcagcagcagcactggaggcggcggccaggagagccagcccagccccctggccctgctggccgccacctgcagcagaattgagagccccaatgaaaacagcaacaacagccagggccccagccagagcggcggcaccggggagctggacctgacagccacccagctgagccagggcgccaacggctggcagatcatcagcagcagcagcggggccacccccaccagcaaggagcagagcggcagcagcaccaacggcagcaatggcagcgagagcagcaagaacagaacagtgtctgggggccagtatgtggtggccgccgcccccaacctgcagaaccagcaggtgctgaccggcctgcccggggtgatgcccaacatccagtaccaggtgatcccccagttccagacagtggatggccagcagctgcagtttgctgccaccggggcccaggtgcagcaggacggcagcggccagatccagatcatccctggggccaaccagcagatcatcaccaacagaggcagcggcggcaacatcatcgccgccatgcccaacctgctgcagcaggccgtgcccctgcagggcctggccaacaacgtgctgagcggccagacccagtatgtgaccaacgtgcctgtggccctgaatggaaacatcaccctgctgcctgtgaacagcgtgtctgctgccaccctgacccccagcagccaggccgtgaccatcagcagcagcggcagccaggagagcggcagccagcctgtgaccagcggcaccaccatcagcagcgccagcctggtgagcagccaggccagcagcagcagcttcttcaccaatgccaacagctacagcaccaccaccaccaccagcaacatgggcatcatgaacttcaccaccagcggcagcagcggcaccaacagccagggccagaccccccagagggtgtctggcctgcagggcagtgatgccctgaacatccagcagaaccagaccagcggcggcagcctgcaggccggccagcagaaggagggggagcagaaccagcagacccagcagcagcagatcctgatccagccccagctggtgcagggcggccaggccctgcaggccctgcaggccgcccccctgagcggccagaccttcaccacccaggccatcagccaggagaccctgcagaacctgcagctgcaggccgtgcccaacagcggccccatcatcatccgcacccccaccgtgggccccaacggccaggtgtcctggcagaccctgcagctgcagaacctgcaggtgcagaacccccaggcccagaccatcaccctggcccccatgcagggcgtgtccctgggccagaccagcagcagcaacaccaccctgacccccatcgccagcgctgccagcatcccagctggcaccgtgacagtgaatgctgcccagctgagctccatgcctggcctgcagaccatcaacctgagcgccctgggcaccagcggcatccaggtgcaccccatccagggcctgcccctggccatcgccaatgcccctggggaccatggagcccagctgggcctgcacggggctggaggagatggcatccatgatgacacagctggaggagaggagggggagaacagcccagatgcccagccccaggccggccgccgcacccggcgggaggcctgcacctgcccctactgcaaggacagcgagggccggggcagcggggaccccgggaagaagaagcagcacatctgccacatccagggctgcggcaaggtgtatggcaagaccagccacctgcgggcccacctgcgctggcacactggagagcggcccttcatgtgcacctggagctactgcggcaagcgcttcaccaggagtgatgagctgcagaggcacaagaggacccacactggagagaagaagtttgcctgcccagagtgccccaagcgcttcatgagaagtgaccacctgagcaagcacatcaagacccaccagaacaagaagggcggccctggggtggccctgtctgtgggcaccctgcccctggacagcggggccggcagcgagggcagcggcacagccaccccatctgccctgatcaccaccaacatggtggccatggaggccatctgcccagagggcatcgcccggctggccaacagcggcatcaacgtgatgcaggtggccgacctgcagagcatcaacatctctggaaatggcttctag

SEQ ID NO: 21981 - DNA, 2337 bp, Artificial Sequence
  Description of Artificial Sequence: Synthetic coding sequence
atggatgagatgacagctgtggtgaagattgagaagggcgtgggcggcaacaacggcggcaatggaaatggaggaggagccttcagccaggcccggagcagcagcacaggcagcagcagcagcactggaggcggcggccaggagagccagcccagccccctggccctgctggccgccacctgcagccgcatcgagagccccaatgaaaacagcaacaacagccagggccccagccagagcggcggcactggagagctggacctgacagccacccagctgagccagggcgccaacggctggcagatcatcagcagcagcagcggggccacccccaccagcaaggagcagagcggcagcagcaccaacggcagcaatggaagtgagagcagcaagaacagaacagtgtctgggggccagtatgtggtggccgccgcccccaacctgcagaaccagcaggtgctgaccggcctgcccggggtgatgcccaacatccagtaccaggtgatcccccagttccagacagtggatggccagcagctgcagtttgctgccactggagcccaggtgcagcaggacggcagcggccagatccagatcatccctggggccaaccagcagatcatcaccaacagaggcagcggcggcaacatcatcgccgccatgcccaacctgctgcagcaggccgtgcccctgcagggcctggccaacaacgtgctgagcggccagacccagtatgtgaccaacgtgcctgtggccctgaatggaaacatcaccctgctgcctgtgaacagcgtgtctgctgccaccctgacccccagcagccaggccgtgaccatcagcagcagcggcagccaggagagcggcagccagcctgtgaccagcggcaccaccatcagcagcgccagcctggtgagcagccaggccagcagcagcagcttcttcaccaatgccaacagctacagcaccaccaccaccaccagcaacatgggcatcatgaacttcaccaccagcggcagcagcggcaccaacagccagggccagaccccccagagggtgtctggcctgcagggcagtgatgccctgaacatccagcagaaccagaccagcggcggcagcctgcaggccggccagcagaaggagggggagcagaaccagcagacccagcagcagcagatcctgatccagccccagctggtgcagggcggccaggccctgcaggccctgcaggccgcccccctgagcggccagaccttcaccacccaggccatcagccaggagaccctgcagaacctgcagctgcaggccgtgcccaacagcggccccatcatcatccgcacccccaccgtgggccccaacggccaggtgtcctggcagaccctgcagctgcagaacctgcaggtgcagaacccccaggcccagaccatcaccctggcccccatgcagggcgtgtccctgggccagaccagcagcagcaacaccaccctgacccccatcgccagcgctgccagcatcccagctggcaccgtgacagtgaatgctgcccagctgagctccatgcctggcctgcagaccatcaacctgagcgccctgggcaccagcggcatccaggtgcaccccatccagggcctgcccctggccatcgccaatgcccctggggaccacggggcccagctgggcctgcatggagctggaggagatggcatccatgatgacacagctggaggagaggagggggagaacagcccagatgcccagccccaggccggccgccgcacccggcgggaggcctgcacctgcccctactgcaaggacagcgagggccggggcagcggggaccccgggaagaagaagcagcacatctgccacatccagggctgtgggaaggtgtatggcaagaccagccacctgcgggcccacctgcgctggcacactggagagcggcccttcatgtgcacctggagctactgtgggaagcgcttcaccaggagtgatgagctgcagaggcacaagaggacccacactggagagaagaagtttgcctgcccagaatgtcccaagcgcttcatgagaagtgaccacctgagcaagcacatcaagacccaccagaacaagaagggcggccctggggtggccctgtctgtgggcaccctgcccctggacagcggggccggcagcgagggcagcggcacagccacccccagcgccctgatcaccaccaacatggtggccatggaggccatctgcccagagggcatcgcccggctggccaacagcggcatcaacgtgatgcaggtggccgacctgcagagcatcaacatctctggaaatggcttctag

SEQ ID NO: 21982 - DNA, 1413 bp, Artificial Sequence
  Description of Artificial Sequence: Synthetic coding sequence
atgtctgcccaggtgctgggcttcctgcgctcctggacccccctgcccctggccgccccccggggccctgctgctgctggaaatgatgctggggccccagctgccacagcccctggaggagagggggagccccacagccggccctgtgatgcccggctgggcagcacagacaaggagctgaaggccggggctgctgccactggaagtgcccccacagcccctggcaccccctggcagcgggagccccgggtggaggtgatggaccctgctgggggcccccggggcgtgctgccccggccctgccgggtgctggtgctgctgaacccccggggcggcaagggcaaggccctgcagctgttccgcagccacgtgcagcccctgctggccgaggccgagatctccttcaccctgatgctgacagagaggagaaatcatgcccgggagctggtgcgctctgaggagctgggccgctgggatgccctggtggtgatgtctggagatggcctgatgcatgaggtggtgaatggcctgatggagaggccagactgggagacagccatccagaagcccctgtgcagcctgcctgctggcagcggaaatgccctggccgccagcctgaaccactacgccggctatgagcaggtgaccaatgaagacctgctgaccaactgcaccctgctgctgtgccggcggctgctgagccccatgaacctgctgagcctgcacacagccagcggcctgcggctcttctctgtgctgagcctggcctggggcttcatcgcagatgtggacctggagagcgagaagtacagaaggctgggggagatgaggttcaccctgggcaccttcctgcggctggccgccctgcggacctaccggggccgcctggcctacctgcctgtgggccgggtgggcagcaagaccccagccagccctgtggtggtgcagcagggccctgtggatgcccacctggtgcccctggaggagcctgtgcccagccactggacagtggtgcctgatgaagattttgtgctggtgctggccctgctgcacagccacctgggcagcgagatgtttgctgcccccatgggccgctgtgccgccggcgtgatgcacctgttctacgtgcgggccggcgtgtcccgggccatgctgctgcggctcttcctggccatggagaagggccgccacatggagtatgaatgtccctacctggtgtatgtgcctgtggtggccttccggctggagcccaaggatggaaaaggagtgtttgctgtggatggagagctgatggtgtctgaggccgtgcagggccaggtgcaccccaactacttctggatggtgtctggctgtgtggagcccccacccagctggaagccccagcagatgcctcctcctgaggagcccctgtag

SEQ ID NO: 21983 - DNA, 1155 bp, Artificial Sequence
  Description of Artificial Sequence: Synthetic coding sequence
atggaccctgctgggggcccccggggcgtgctgccccggccctgccgggtgctggtgctgctgaacccccggggcggcaagggcaaggccctgcagctgttccgcagccacgtgcagcccctgctggccgaggccgagatctccttcaccctgatgctgacagagaggagaaatcatgcccgggagctggtgcgctctgaggagctgggccgctgggatgccctggtggtgatgtctggagatggcctgatgcatgaggtggtgaatggcctgatggagaggccagactgggagacagccatccagaagcccctgtgcagcctgcctgctggcagcggaaatgccctggccgccagcctgaaccactacgccggctatgagcaggtgaccaatgaagacctgctgaccaactgcaccctgctgctgtgccggcggctgctgagccccatgaacctgctgagcctgcacacagccagcggcctgcggctcttctctgtgctgagcctggcctggggcttcatcgcagatgtggacctggagagcgagaagtacagaaggctgggggagatgaggttcaccctgggcaccttcctgcggctggccgccctgcggacctaccggggccgcctggcctacctgcctgtgggccgggtgggcagcaagaccccagccagccctgtggtggtgcagcagggccctgtggatgcccacctggtgcccctggaggagcctgtgcccagccactggacagtggtgcctgatgaagattttgtgctggtgctggccctgctgcacagccacctgggcagcgagatgtttgctgcccccatgggccgctgtgccgccggcgtgatgcacctgttctacgtgcgggccggcgtgtcccgggccatgctgctgcggctcttcctggccatggagaagggccgccacatggagtatgaatgtccctacctggtgtatgtgcctgtggtggccttccggctggagcccaaggatggaaaaggagtgtttgctgtggatggagagctgatggtgtctgaggccgtgcagggccaggtgcaccccaactacttctggatggtgtctggctgtgtggagcccccacccagctggaagccccagcagatgcctcctcctgaggagcccctgtag

SEQ ID NO: 21984 - DNA, 1152 bp, Artificial Sequence
  Description of Artificial Sequence: Synthetic coding sequence
gagcccactggaggcccccggggcgtgctgccccggccctgccgggtgctggtgctgctgaacccccggggcggcaagggcaaggccctgcagctgttccgcagccacgtgcagcccctgctggccgaggccgagatctccttcaccctgatgctgacagaaagaagaaaccacgcccgggagctggtgcgctctgaggagctgggccgctgggatgccctggtggtgatgtctggagatggcctgatgcatgaggtggtgaatggcctgatggagaggccagactgggagacagccatccagaagcccctgtgcagcctgcctgctggcagcggaaatgccctggccgccagcctgaaccactacgccggctatgagcaggtgaccaatgaagacctgctgaccaactgcaccctgctgctgtgccggcggctgctgagccccatgaacctgctgagcctgcacacagccagcggcctgcggctcttctctgtgctgagcctggcctggggcttcatcgcagatgtggacctggagagcgagaagtaccgccgcctgggggagatgaggttcaccctgggcaccttcctgcggctggccgccctgcggacctaccggggccgcctggcctacctgcctgtgggccgggtgggcagcaagaccccagccagccctgtggtggtgcagcagggccctgtggatgcccacctggtgcccctggaggagcctgtgcccagccactggacagtggtgcctgatgaggactttgtgctggtgctggccctgctgcacagccacctgggcagcgagatgtttgctgcccccatgggccgctgtgccgccggcgtgatgcacctgttctacgtgcgggccggcgtgtcccgggccatgctgctgcggctcttcctggccatggagaagggccgccacatggagtatgagtgcccctacctggtgtatgtgcctgtggtggccttccggctggagcccaaggatggcaagggcgtgtttgctgtggatggagagctgatggtgtctgaggccgtgcagggccaggtgcaccccaactacttctggatggtgtctggctgtgtggagcccccacccagctggaagccccagcagatgcctcctcctgaggagcccctgtag

SEQ ID NO: 21985 - DNA, 1155 bp, Artificial Sequence; identical to SEQ ID NO: 21983
  Description of Artificial Sequence: Synthetic coding sequence

SEQ ID NO: 21986 - DNA, 1197 bp, Artificial Sequence
  Description of Artificial Sequence: Synthetic coding sequence
atggaccctgtggtgggctgcggccggggcctgtttggatttgtgttttctgctgggggcccccggggcgtgctgccccggccctgccgggtgctggtgctgctgaacccccggggcggcaagggcaaggccctgcagctgttccgcagccacgtgcagcccctgctggccgaggccgagatctccttcaccctgatgctgacagagaggagaaatcatgcccgggagctggtgcgctctgaggagctgggccgctgggatgccctggtggtgatgtctggagatggcctgatgcatgaggtggtgaatggcctgatggagaggccagactgggagacagccatccagaagcccctgtgcagcctgcctgctggcagcggaaatgccctggccgccagcctgaaccactacgccggctatgagcaggtgaccaatgaagacctgctgaccaactgcaccctgctgctgtgccggcggctgctgagccccatgaacctgctgagcctgcacacagccagcggcctgcggctcttctctgtgctgagcctggcctggggcttcatcgcagatgtggacctggagagcgagaagtacagaaggctgggggagatgaggttcaccctgggcaccttcctgcggctggccgccctgcggacctaccggggccgcctggcctacctgcctgtgggccgggtgggcagcaagaccccagccagccctgtggtggtgcagcagggccctgtggatgcccacctggtgcccctggaggagcctgtgcccagccactggacagtggtgcctgatgaagattttgtgctggtgctggccctgctgcacagccacctgggcagcgagatgtttgctgcccccatgggccgctgtgccgccggcgtgatgcacctgttctacgtgcgggccggcgtgtcccgggccatgctgctgcggctcttcctggccatggagaagggccgccacatggagtatgaatgtccctacctggtgtatgtgcctgtggtggccttccggctggagcccaaggatggaaaaggagtgtttgctgtggatggagagctgatggtgtctgaggccgtgcagggccaggtgcaccccaactacttctggatggtgtctggctgtgtggagcccccacccagctggaagccccagcagatgcctcctcctgaggagcccctgtag

SEQ ID NO: 21987 - DNA, 1155 bp, Artificial Sequence; identical to SEQ ID NO: 21983
  Description of Artificial Sequence: Synthetic coding sequence

SEQ ID NO: 21988 - DNA, 1965 bp, Artificial Sequence
  Description of Artificial Sequence: Synthetic coding sequence
atgaatggccacctggaggccgaggagcagcaggaccagaggccagaccaggagctgaccggctcctggggccacggccccaggagcaccctggtgcgggccaaggccatggcccctcctcctccacccctggccgccagcacccccctgctgcacggggagtttggcagctacccagcccggggccccaggtttgccctgaccctgaccagccaggccctgcacatccagaggctgcggcccaagccagaggcccggccccggggcggcctggtgcccctggccgaggtgtctggctgctgcaccctgcggagccgcagccccagcgacagcgctgcctacttctgcatctacacctacccccggggccggcggggggccaggagaagagccaccaggaccttccgggcagatggagctgccacctatgaagaaaatagagctgaggcccagcgctgggccacagccctgacctgcctgctgcggggcctgcccctgcctggagatggagagatcaccccagacctgctgccccggcccccccggctgctgctgctggtgaacccctttggaggccggggcctggcctggcagtggtgcaagaaccacgtgctgcccatgatcagcgaggccggcctgtccttcaacctgatccagacagagcggcagaaccacgcccgggagctggtgcagggcctgagcctgtctgagtgggatggcatcgtgacagtgtctggagatggcctgctgcacgaggtgctgaatggcctgctggacagaccagactgggaggaggccgtgaagatgcctgtgggcatcctgccctgtggcagcggaaatgccctggccggggctgtgaaccagcacggcggctttgagcccgccctgggcctggacctgctgctgaactgcagcctgctgctgtgccggggcggcggccaccccctggacctgctgtctgtgaccctggccagcggcagccgctgcttctccttcctgtctgtggcctggggctttgtgtctgatgtggacatccagagcgagcgcttccgggccctgggcagcgcccgcttcaccctgggcaccgtgctgggcctggccaccctgcacacctaccggggccgcctgagctacctgcctgccaccgtggagcccgccagccccaccccagcccacagcctgccccgggccaagtctgagctgaccctgaccccagaccctgccccacccatggcccacagccccctgcacaggtctgtgtctgacctgcccctgcccctgccccagcctgccctggccagccctggcagccctgagcccctgcccatcctgagcctgaatggaggcggccctgagctggccggggactggggcggcgctggagatgcccccctgagcccagaccccctgctgagcagccccccaggcagccccaaggccgccctgcacagccctgtgtctgagggcgcccctgtgatcccccccagcagcggcctgcccctgcccaccccagatgcccgggtgggcgccagcacctgtggccccccagaccacctgctgccccccctgggcacccccctgcccccagactgggtgaccctggagggggactttgtgctgatgctggccatcagccccagccacctgggcgctgacctggtggccgccccccacgccaggtttgatgatggcctggtgcacctgtgctgggtgcgcagcggcatcagccgggccgccctgctgcggctcttcctggccatggagcggggcagccacttcagcctgggctgcccccagctgggctatgctgctgcccgggccttccggctggagcccctgaccccccggggcgtgctgactgtggatggagagcaggtggagtatggccccctgcaggcccagatgcaccctggcatcggcaccctgctgaccggccccccaggctgccccggccgggagccctag

SEQ ID NO: 21989 - DNA, 1851 bp, Artificial Sequence
  Description of Artificial Sequence: Synthetic coding sequence
atggcccctcctcctccacccctggccgccagcacccccctgctgcacggggagtttggcagctacccagcccggggccccaggtttgccctgaccctgaccagccaggccctgcacatccagaggctgcggcccaagccagaggcccggccccggggcggcctggtgcccctggccgaggtgtctggctgctgcaccctgcggagccgcagccccagcgacagcgctgcctacttctgcatctacacctacccccggggccggcggggggccaggagaagagccaccaggaccttccgggcagatggagctgccacctatgaagaaaatagagctgaggcccagcgctgggccacagccctgacctgcctgctgcggggcctgcccctgcctggagatggagagatcaccccagacctgctgccccggcccccccggctgctgctgctggtgaacccctttggaggccggggcctggcctggcagtggtgcaagaaccacgtgctgcccatgatcagcgaggccggcctgtccttcaacctgatccagacagagcggcagaaccacgcccgggagctggtgcagggcctgagcctgtctgagtgggatggcatcgtgacagtgtctggagatggcctgctgcacgaggtgctgaatggcctgctggacagaccagactgggaggaggccgtgaagatgcctgtgggcatcctgccctgtggcagcggaaatgccctggccggggctgtgaaccagcacggcggccccagctggggagaccgggacccctacatcagccacagcgccaagcccaccgtgtcccaggtgaaccagcctgcctgtggcatgctgacccccagctcctggaccttcctgcctgcctgcttccctgctgtgtcccgggcccccaggaccctgcccggcatgggcggcacccaggccctgggcagcgcccgcttcaccctgggcaccgtgctgggcctggccaccctgcacacctaccggggccgcctgagctacctgcctgccaccgtggagcccgccagccccaccccagcccacagcctgccccgggccaagtctgagctgaccctgaccccagaccctgccccacccatggcccacagccccctgcacaggtctgtgtctgacctgcccctgcccctgccccagcctgccctggccagccctggcagccctgagcccctgcccatcctgagcctgaatggaggcggccctgagctggccggggactggggcggcgctggagatgcccccctgagcccagaccccctgctgagcagccccccaggcagccccaaggccgccctgcacagccctgtgtctgagggcgcccctgtgatcccccccagcagcggcctgcccctgcccaccccagatgcccgggtgggcgccagcacctgtggccccccagaccacctgctgccccccctgggcacccccctgcccccagactgggtgaccctggagggggactttgtgctgatgctggccatcagccccagccacctgggcgctgacctggtggccgccccccacgccaggtttgatgatggcctggtgcacctgtgctgggtgcgcagcggcatcagccgggccgccctgctgcggctcttcctggccatggagcggggcagccacttcagcctgggctgcccccagctgggctatgctgctgcccgggccttccggctggagcccctgaccccccggggcgtgctgactgtggatggagagcaggtggagtatggccccctgcaggcccagatgcaccctggcatcggcaccctgctgaccggccccccaggctgccccggccgggagccctag

SEQ ID NO: 21990 - DNA, 1884 bp, Artificial Sequence
  Description of Artificial Sequence: Synthetic coding sequence
atgaatggccacctggaggccgaggagcagcaggaccagaggccagaccaggagctgaccggctcctggggccacggccccaggagcaccctggtgcgggccaaggccatggcccctcctcctccacccctggccgccagcacccccctgctgcacggggagtttggcagctacccagcccggggccccaggtttgccctgaccctgaccagccaggccctgcacatccagaggctgcggcccaagcacagcgctgcctacttctgcatctacacctacccccggggcagaagaggagcccggcggcgggccaccaggaccttccgggcagatggagctgccacctatgaggagaacagagctgaggcccagcgctgggccacagccctgacctgcctgctgcggggcctgcccctgcctggagatggagagatcaccccagacctgctgcccaggcctccccggctgctgctgctggtgaacccctttggaggccggggcctggcctggcagtggtgcaagaaccacgtgctgcccatgatcagcgaggccggcctgtccttcaacctgatccagacagagcggcagaaccacgcccgggagctggtgcagggcctgagcctgtctgagtgggatggcatcgtgacagtgtctggagatggcctgctgcacgaggtgctgaatggcctgctggacagaccagactgggaggaggccgtgaagatgcctgtgggcatcctgccctgtggcagcggaaatgccctggccggggctgtgaaccagcacggcggctttgagcccgccctgggcctggacctgctgctgaactgcagcctgctgctgtgccggggcggcggccaccccctggacctgctgtctgtgaccctggccagcggcagccgctgcttctccttcctgtctgtggcctggggctttgtgtctgatgtggacatccagagcgagcgcttccgggccctgggcagcgcccgcttcaccctgggcaccgtgctgggcctggccaccctgcacacctaccggggccgcctgagctacctgcctgccaccgtggagcccgccagccccaccccagcccacagcctgccccgggccaagtctgagctgaccctgaccccagaccctgccccacccatggcccacagccccctgcacaggtctgtgtctgacctgcccctgcccctgccccagcctgccctggccagccctggcagccctgagcccctgcccatcctgagcctgaatggaggcggccctgagctggccggggactggggcggcgctggagatgcccccctgagcccagaccccctgctgagcagccccccaggcagccccaaggccgccctgcacagccctgtgtctgagggcgcccctgtgattcctcccagcagcggcctgcccctgcccaccccagatgcccgggtgggcgccagcacctgtggccccccagaccacctgctgccccccctgggcacccccctgcccccagactgggtgaccctggagggggactttgtgctgatgctggccatcagccccagccacctgggcgctgacctggtggccgcccctcatgccaggtttgatgatggcctggtgcacctgtgctgggtgcgcagcggcatcagcagagctgccctgctgcggctcttcctggccatggagcggggcagccacttcagcctgggctgcccccagctgggctacgccgccgcccgggccttccggctggagcccctgaccccccggggcgtgctgactgtggatggagagcaggtggagtatggccccctgcaggcccagatgcaccctggcatcggcaccctgctgactggacctcctggctgccccggccgggagccctag

SEQ ID NO: 21991 - DNA, 150 bp, Artificial Sequence
  Description of Artificial Sequence: Synthetic coding sequence
atgaatggccacctggaggccgaggagcagcaggaccagaggagccccctgacctgctacctgggccggcccggctgcttctactggagcatccccctgggcgtgggcgcctggccaggcagcggcgtgaggaccacctgcttcccctag

SEQ ID NO: 21992 - DNA, 2286 bp, Artificial Sequence
  Description of Artificial Sequence: Synthetic coding sequence
atgattggctgcctgcacgcccgggtgtctggccccctgtgggatgctggcctgtgcccagccagcagccgcagcgcccacacctgcctgagcctgtctgtgtctgatgcccctgtgtccccagccacagccccccactgcctgctgctgagcacagccccagccccaccctgcccctgccacggcgtgctgaacagccaccccttcagcccccccttcccccagaggccagaccaggagctgaccggctcctggggccacggccccaggagcaccctggtgcgggccaaggccatggcccctcctcctccacccctggccgccagcacccccctgctgcacggggagtttggcagctacccagcccggggccccaggtttgccctgaccctgaccagccaggccctgcacatccagaggctgcggcccaagccagaggcccggccccggggcggcctggtgcccctggccgaggtgtctggctgctgcaccctgcggagccgcagccccagcgacagcgctgcctacttctgcatctacacctacccccggggccggcggggggccaggagaagagccaccaggaccttccgggcagatggagctgccacctatgaagaaaatagagctgaggcccagcgctgggccacagccctgacctgcctgctgcggggcctgcccctgcctggagatggagagatcaccccagacctgctgccccggcccccccggctgctgctgctggtgaacccctttggaggccggggcctggcctggcagtggtgcaagaaccacgtgctgcccatgatcagcgaggccggcctgtccttcaacctgatccagacagagcggcagaaccacgcccgggagctggtgcagggcctgagcctgtctgagtgggatggcatcgtgacagtgtctggagatggcctgctgcacgaggtgctgaatggcctgctggacagaccagactgggaggaggccgtgaagatgcctgtgggcatcctgccctgtggcagcggaaatgccctggccggggctgtgaaccagcacggcggctttgagcccgccctgggcctggacctgctgctgaactgcagcctgctgctgtgccggggcggcggccaccccctggacctgctgtctgtgaccctggccagcggcagccgctgcttctccttcctgtctgtggcctggggctttgtgtctgatgtggacatccagagcgagcgcttccgggccctgggcagcgcccgcttcaccctgggcaccgtgctgggcctggccaccctgcacacctaccggggccgcctgagctacctgcctgccaccgtggagcccgccagccccaccccagcccacagcctgccccgggccaagtctgagctgaccctgaccccagaccctgccccacccatggcccacagccccctgcacaggtctgtgtctgacctgcccctgcccctgccccagcctgccctggccagccctggcagccctgagcccctgcccatcctgagcctgaatggaggcggccctgagctggccggggactggggcggcgctggagatgcccccctgagcccagaccccctgctgagcagccccccaggcagccccaaggccgccctgcacagccctgtgtctgagggcgcccctgtgatcccccccagcagcggcctgcccctgcccaccccagatgcccgggtgggcgccagcacctgtggccccccagaccacctgctgccccccctgggcacccccctgcccccagactgggtgaccctggagggggactttgtgctgatgctggccatcagccccagccacctgggcgctgacctggtggccgccccccacgccaggtttgatgatggcctggtgcacctgtgctgggtgcgcagcggcatcagccgggccgccctgctgcggctcttcctggccatggagcggggcagccacttcagcctgggctgcccccagctgggctatgctgctgcccgggccttccggctggagcccctgaccccccggggcgtgctgactgtggatggagagcaggtggagtatggccccctgcaggcccagatgcaccctggcatcgcccggggccgcacccagaccccagccctgcctgctgccccagccctgtatggccggcagcccggggccgcccacggcctgcagcctgtgtgccagggcgccgccctcttcttccacaacagctggctgtggggcagccaggacctcttcagaattgtgctgacagaggccgtgggcggctag

SEQ ID NO: 21993 - DNA, 1965 bp, Artificial Sequence; identical to SEQ ID NO: 21988
  Description of Artificial Sequence: Synthetic coding sequence

SEQ ID NO: 21994 - DNA, 1857 bp, Artificial Sequence
  Description of Artificial Sequence: Synthetic coding sequence
atggcccctcctcctccacccctggccgccagcacccccctgctgcacggggagtttggcagctacccagcccggggccccaggtttgccctgaccctgaccagccaggccctgcacatccagaggctgcggcccaagccagaggcccggccccggggcggcctggtgcccctggccgaggtgtctggctgctgcaccctgcggagccgcagccccagcgacagcgctgcctacttctgcatctacacctacccccggggccggcggggggccaggagaagagccaccaggaccttccgggcagatggagctgccacctatgaagaaaatagagctgaggcccagcgctgggccacagccctgacctgcctgctgcggggcctgcccctgcctggagatggagagatcaccccagacctgctgccccggcccccccggctgctgctgctggtgaacccctttggaggccggggcctggcctggcagtggtgcaagaaccacgtgctgcccatgatcagcgaggccggcctgtccttcaacctgatccagacagagcggcagaaccacgcccgggagctggtgcagggcctgagcctgtctgagtgggatggcatcgtgacagtgtctggagatggcctgctgcacgaggtgctgaatggcctgctggacagaccagactgggaggaggccgtgaagatgcctgtgggcatcctgccctgtggcagcggaaatgccctggccggggctgtgaaccagcacggcggctttgagcccgccctgggcctggacctgctgctgaactgcagcctgctgctgtgccggggcggcggccaccccctggacctgctgtctgtgaccctggccagcggcagccgctgcttctccttcctgtctgtggcctggggctttgtgtctgatgtggacatccagagcgagcgcttccgggccctgggcagcgcccgcttcaccctgggcaccgtgctgggcctggccaccctgcacacctaccggggccgcctgagctacctgcctgccaccgtggagcccgccagccccaccccagcccacagcctgccccgggccaagtctgagctgaccctgaccccagaccctgccccacccatggcccacagccccctgcacaggtctgtgtctgacctgcccctgcccctgccccagcctgccctggccagccctggcagccctgagcccctgcccatcctgagcctgaatggaggcggccctgagctggccggggactggggcggcgctggagatgcccccctgagcccagaccccctgctgagcagccccccaggcagccccaaggccgccctgcacagccctgtgtctgagggcgcccctgtgatcccccccagcagcggcctgcccctgcccaccccagatgcccgggtgggcgccagcacctgtggccccccagaccacctgctgccccccctgggcacccccctgcccccagactgggtgaccctggagggggactttgtgctgatgctggccatcagccccagccacctgggcgctgacctggtggccgccccccacgccaggtttgatgatggcctggtgcacctgtgctgggtgcgcagcggcatcagccgggccgccctgctgcggctcttcctggccatggagcggggcagccacttcagcctgggctgcccccagctgggctatgctgctgcccgggccttccggctggagcccctgaccccccggggcgtgctgactgtggatggagagcaggtggagtatggccccctgcaggcccagatgcaccctggcatcggcaccctgctgaccggccccccaggctgccccggccgggagccctag

SEQ ID NO: 21995 - DNA, 1149 bp, Artificial Sequence
  Description of Artificial Sequence: Synthetic coding sequence
atgggccccacctctgtgcccctggtgaaggcccacaggagctctgtgtctgactatgtgaactatgacatcatcgtgcgccactacaactacaccgggaagctgaacatctctgctgacaaggagaacagcatcaagctgacctctgtggtgttcatcctgatctgctgcttcatcatcctggagaacatctttgtgctgctgaccatctggaagaccaagaagttccaccggcccatgtactacttcatcggcaacctggccctgagtgacctgctggccggcgtggcctacacagccaacctgctgctgagcggggccaccacctacaagctgaccccagcccagtggttcctgcgggagggctccatgtttgtggccctgagcgcctctgtgttcagcctgctggccatcgccatcgagcgctacatcaccatgctgaagatgaagctgcacaacggcagcaacaacttccgcctcttcctgctgatcagcgcctgctgggtgatcagcctcatcctgggcggcctgcccatcatgggctggaactgcatcagcgccctgagcagctgcagcacagtgctgcccctgtaccacaagcactacatcctcttctgcaccaccgtcttcaccctgctgctgctgagcatcgtcatcctgtactgccgcatctacagcctggtgaggaccaggagccggcggctgaccttcaggaagaacatcagcaaggccagccgcagcagcgagaagagcctggccctgctgaagacagtcatcatcgtgctgtctgtgttcatcgcctgctgggcccccctcttcatcctgctgctgctggatgtgggctgcaaggtgaagacctgtgacatcctcttccgggcagagtacttcctggtgctggccgtgctgaacagcggcaccaaccccatcatctacaccctgaccaacaaggagatgagaagagccttcatccgcatcatgagctgctgcaagtgccccagcggggacagcgctgggaagttcaagaggcccatcatcgccggcatggagttcagccgcagcaagagtgacaacagcagccacccccagaaggatgaaggagacaaccctgagaccatcatgagcagtggaaatgtgaacagcagcagctag

SEQ ID NO: 21996 - DNA, 1353 bp, Artificial Sequence
  Description of Artificial Sequence: Synthetic coding sequence
atgggccccacctctgtgcccctggtgaaggcccacaggagctctgtgtctgactatgtgaactatgacatcatcgtgcgccactacaactacaccgggaagctgaacatctctgctgacaaggagaacagcatcaagctgacctctgtggtgttcatcctgatctgctgcttcatcatcctggagaacatctttgtgctgctgaccatctggaagaccaagaagttccaccggcccatgtactacttcatcggcaacctggccctgagtgacctgctggccggcgtggcctacacagccaacctgctgctgagcggggccaccacctacaagctgaccccagcccagtggttcctgcgggagggctccatgtttgtggccctgagcgcctctgtgttcagcctgctggccatcgccatcgagcgctacatcaccatgctgaagatgaagctgcacaacggcagcaacaacttccgcctcttcctgctgatcagcgcctgctgggtgatcagcctcatcctgggcggcctgcccatcatgggctggaactgcatcagcgccctgagcagctgcagcacagtgctgcccctgtaccacaagcactacatcctcttctgcaccaccgtcttcaccctgctgctgctgagcatcgtcatcctgtactgccgcatctacagcctggtgaggaccaggagccggcggctgaccttcaggaagaacatcagcaaggccagccgcagcagcgagaagagcctggccctgctgaagacagtcatcatcgtgctgtctgtgttcatcgcctgctgggcccccctcttcatcctgctgctgctggatgtgggctgcaaggtgaagacctgtgacatcctcttccgggcagagtacttcctggtgctggccgtgctgaacagcggcaccaaccccatcatctacaccctgaccaacaaggagaccctgctggccaacagcagtgaccccagcagccctgcctggaacagcgctgctgccaacagaaccatcccccccacccccaggaagaccaagggcaccacccagaggcccctgtgcctgctggagaccagcaccctgctgcccaggacaggcagctgccccccaactggaagtgccctgtacctggtggccggccaccccagcgtgtggaagaagatcagcggcctgcggctgctgcccggccgcagctgctgcaagccagagggcggccggggccgcatcagaacagcctggtggtgccgggtgctggtgggccgggtgagcagctgtgagcagtgcacaggaaaaggaggagaccaggtgcctgcctggaacatcttcagcacccccctggagctgtag

SEQ ID NO: 21997 - DNA, 726 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgctgtgggcatggcctgtgccatcagcatcctgatgaaggacctggctgatgagctggccctggtggatgtgattgaggacaagctgaagggggagatgatggacctgcagcacggcagcctcttcctgcggacccccaagatcgtgtctgggaaggactacaacgtgacagccaacagcaagctggtgatcatcacagctggggcccggcagcaggagggggagagccggctgaacctggtgcagagaaatgtgaacatcttcaagttcatcatccccaacgtggtgaagtacagccccaactgcaagctgctgattgtgagcaaccctgtggacatcctgacctacgtggcctggaagatcagcggcttccccaagaacagagtgattggcagcggctgcaacctggacagcgcccgcttccgctacctgatgggagagcggctgggcgtgcaccccctgagctgccacggctgggtgctgggggagcacggggacagctctgtgcctgtgtggagcggcatgaatgtggccggcgtgtccctgaagaccctgcacccagacctgggcacagacaaggacaaggagcagtggaaggaggtgcacaagcaggtggtggagagggtcttcacagaatag

SEQ ID NO: 21998 - DNA, 813 bp, Artificial Sequence
  Description of Artificial Sequence: Synthetic coding sequence
atgctgcaggcctgcaagatggagggcttccccctggtgcccccaccttctgaggacctggtgccctatgacacagacctgtaccagaggcagacccatgagtactacccctacctgagcagtgatggagagagccacagcgaccactactgggacttccacccccaccacgtgcacagcgagtttgagagctttgctgagaacaacttcacagagctgcagagcgtgcagcccccccagctgcagcagctgtaccgccacatggagctggagcagatgcacgtgctggacacccccatggtgcccccccaccccagcctgggccaccaggtgtcctacctgcccaggatgtgcctgcagtaccccagcctgagccctgcccagcccagcagtgatgaggaggagggggagcggcagagcccccccctggaggtgtctgatggagaggctgatggcctggagcccggccctggcctgctgcctggagagaccggcagcaagaagaagatccggctgtaccagttcctgctggacctgctgcggagcggggacatgaaggacagcatctggtgggtggacaaggacaagggcaccttccagttcagcagcaagcacaaggaggccctggcccaccgctggggcatccagaagggcaacaggaagaagatgacctaccagaagatggcccgggccctgagaaattatggcaagacaggagaggtgaagaaggtgaagaagaagctgacctaccagttctctggagaggtgctgggccggggcggcctggccgagaggaggcaccccccccactag

SEQ ID NO: 21999 - DNA, 2403 bp, Artificial Sequence
  Description of Artificial Sequence: Synthetic coding sequence
atgggcagcagcaagaagcacagaggagagaaggaggccgccggcaccacagctgctgctggcaccggcggggccacagagcagcccccaagacaccgggagcacaagaagcacaagcacaggtctgggggcagcggcggcagcggcggggagaggaggaagaggagccgggagcggggcggggagcggggcagcggcagaagaggagctgaggccgaggcccggagcagcacccacggccgggagaggagccaggccgagcccagcgagaggagagtgaagcgggagaagagagatgatggctatgaggccgccgccagcagcaagaccagcagtggagatgccagcagcctgagcattgaggagaccaacaagctgcgggccaagctgggcctgaagcccctggaggtgaatgccatcaagaaggaggccggcaccaaggaggagcctgtgacagcagatgtgatcaaccccatggccctgcggcagcgggaggagctgcgggagaagctggccgccgccaaggagaagaggctgctgaaccagaagctgggcaagatcaagaccctgggggaggatgacccctggctggatgacacagctgcctggattgaaagaagccggcagctgcagaaggagaaggacctggccgagaagagggccaagctgctggaggagatggaccaggagtttggagtgtccaccctggtggaggaggagtttggccagaggcggcaggacctgtacagcgcccgggacctgcagggcctgactgtggagcacgccatcgacagcttccgggagggggagaccatgatcctgaccctgaaggacaagggcgtgctgcaggaggaggaggatgtgctggtgaatgtgaacctggtggacaaggagcgggcagagaagaatgtggagctgaggaagaagaagccagactacctgccctatgcagaagatgaatctgtggatgacctggcccagcagaagcccaggagcatcctgagcaaatatgatgaggagctggagggggagcggccccacagcttccggctggagcagggcggcacagcagatggcctgcgggagcgggagctggaggagatccgggccaagctgcggctgcaggcccagagcctgagcacagtgggcccccggctggccagcgagtacctgaccccagaggagatggtgaccttcaagaagaccaagagaagagtgaagaagatcaggaagaaggagaaggaggtggtggtgcgggcagatgacctgctgcccctgggggaccagacccaggatggagactttggcagccggctgcggggccggggcagaagaagagtgtctgaggtggaggaggagaaggagcctgtgccccagcccctgcccagtgatgacaccagggtggagaacatggacatcagtgatgaggaggagggcggggcccctcctcctggcagcccccaggtgctggaggaggatgaagctgagctggagctgcagaagcagctggagaagggccgccgcctgcggcagctgcagcagctgcagcagctgcgggacagcggggagaaggtggtggagatcgtgaagaagctggagagccggcagaggggctgggaggaggatgaagatcctgagaggaagggggccatcgtgttcaatgccaccagcgagttctgcaggaccctgggggagatccccacctacggcctggccggcaaccgggaggagcaggaggagctgatggactttgaaagagatgaggagaggtctgccaatggaggcagcgagagtgatggagaggagaacatcggctggagcacagtgaacctggatgaggagaagcagcagcaggacttcagcgccagcagcaccaccatcctggatgaggagcccatcgtgaacagaggcctggccgccgccctgctgctgtgccagaacaagggcctgctggagaccaccgtgcagaaggtggcccgggtgaaggcccccaacaagagcctgcccagcgctgtgtactgcatcgaggacaagatggccattgatgacaagtacagcagaagagaggagtaccggggcttcacccaggacttcaaggagaaggatggctacaagccagatgtgaagattgaatatgtggatgagaccggcaggaagctgacccccaaggaggccttccggcagctgagccaccgcttccacggcaagggcagcggcaagatgaagacagaaagaaggatgaagaagctggatgaggaggccctgctgaagaagatgagcagcagtgacacccccctgggcaccgtggccctgctgcaggagaagcagaaggcccagaagaccccctacatcgtgctgagcggcagcggcaagtccatgaatgccaacaccatcaccaagtag

SEQ ID NO: 22000 - DNA, 1929 bp, Artificial Sequence
  Description of Artificial Sequence: Synthetic coding sequence
atggccctgcggcagcgggaggagctgcgggagaagctggccgccgccaaggagaagaggctgctgaaccagaagctgggcaagatcaagaccctgggggaggatgacccctggctggatgacacagctgcctggattgaaagaagccggcagctgcagaaggagaaggacctggccgagaagagggccaagctgctggaggagatggaccaggagtttggagtgtccaccctggtggaggaggagtttggccagaggcggcaggacctgtacagcgcccgggacctgcagggcctgactgtggagcacgccatcgacagcttccgggagggggagaccatgatcctgaccctgaaggacaagggcgtgctgcaggaggaggaggatgtgctggtgaatgtgaacctggtggacaaggagcgggcagagaagaatgtggagctgaggaagaagaagccagactacctgccctatgcagaagatgaatctgtggatgacctggcccagcagaagcccaggagcatcctgagcaaatatgatgaggagctggagggggagcggccccacagcttccggctggagcagggcggcacagcagatggcctgcgggagcgggagctggaggagatccgggccaagctgcggctgcaggcccagagcctgagcacagtgggcccccggctggccagcgagtacctgaccccagaggagatggtgaccttcaagaagaccaagagaagagtgaagaagatcaggaagaaggagaaggaggtggtggtgcgggcagatgacctgctgcccctgggggaccagacccaggatggagactttggcagccggctgcggggccggggcagaagaagagtgtctgaggtggaggaggagaaggagcctgtgccccagcccctgcccagtgatgacaccagggtggagaacatggacatcagtgatgaggaggagggcggggcccctcctcctggcagcccccaggtgctggaggaggatgaagctgagctggagctgcagaagcagctggagaagggccgccgcctgcggcagctgcagcagctgcagcagctgcgggacagcggggagaaggtggtggagatcgtgaagaagctggagagccggcagaggggctgggaggaggatgaagatcctgagaggaagggggccatcgtgttcaatgccaccagcgagttctgcaggaccctgggggagatccccacctacggcctggccggcaaccgggaggagcaggaggagctgatggactttgaaagagatgaggagaggtctgccaatggaggcagcgagagtgatggagaggagaacatcggctggagcacagtgaacctggatgaggagaagcagcagcaggacttcagcgccagcagcaccaccatcctggatgaggagcccatcgtgaacagaggcctggccgccgccctgctgctgtgccagaacaagggcctgctggagaccaccgtgcagaaggtggcccgggtgaaggcccccaacaagagcctgcccagcgctgtgtactgcatcgaggacaagatggccattgatgacaagtacagcagaagagaggagtaccggggcttcacccaggacttcaaggagaaggatggctacaagccagatgtgaagattgaatatgtggatgagaccggcaggaagctgacccccaaggaggccttccggcagctgagccaccgcttccacggcaagggcagcggcaagatgaagacagaaagaaggatgaagaagctggatgaggaggccctgctgaagaagatgagcagcagtgacacccccctgggcaccgtggccctgctgcaggagaagcagaaggcccagaagaccccctacatcgtgctgagcggcagcggcaagtccatgaatgccaacaccatcaccaagtag

SEQ ID NO: 22001 - DNA, 4392 bp, Artificial Sequence
  Description of Artificial Sequence: Synthetic coding sequence
atgaagaagaagacagtgtgcaccctgaacatgggagacaagaagtatgaggacatggagggggaggagaatggagacaacaccatcagcacaggcctgctgtacagcgaggccgaccgctgccccatctgcctgaactgcctgctggagaaggaggtgggcttccctgagagctgcaaccacgtgttctgcatgacctgcatcctgaagtgggccgagaccctggccagctgccccatcgacaggaagcccttccaggccgtgttcaagttcagcgccctggagggctacgtgaaggtgcaggtgaagaagcagctgcgggagaccaaggacaagaagaatgaaaattcctttgagaagcaggtgtcctgccacgagaacagcaagagctgcatccggaggaaggccatcgtgcgggaggacctgctgagcgccaaggtgtgtgacctgaagtggatccacaggaacagcctgtacagcgagaccggcggcaagaagaatgctgccatcaagatcaacaagccccagaggagcaactggagcaccaaccagtgcttcaggaacttcttcagcaacatgttcagctctgtgagccacagcggggagagcagcttcacctaccgggcctactgcacagagttcatcgaggccagcgagatcagcgccctgatccggcagaagagacatgagctggagctgtcctggttcccagacaccctgcccggcatcggccgcatcggcttcatcccctggaatgtggagacagaggtgctgcccctcatcagctctgtgctgcccaggaccatcttccccaccagcaccatcagctttgagcacttcggcaccagctgcaagggctacgccctggcccacacccaggagggggaggagaagaagcagaccagcggcaccagcaacacccggggcagcaggaggaagccagccatgaccacccccaccaggaggagcaccaggaacaccagggctgagacagccagccagagccagaggagccccatcagtgacaacagcggctgtgatgcccctggcaacagcaaccccagcctgtctgtgcccagcagcgctgagagcgagaagcagacccggcaggcccccaagaggaagtctgtgcggcggggcaggaagccacccctgctgaagaagaagctgcggagctctgtggccgcccctgagaagagcagcagcaatgattctgtggatgaggagacagctgagagtgacaccagccctgtgctggagaaggagcaccagccagatgtggacagcagcaacatctgcaccgtgcagacccacgtggagaaccagagcgccaactgcctgaagagctgcaatgagcagatcgaggagagcgagaagcacacagccaactatgacacagaggagcgggtgggcagcagcagcagcgagagctgtgcccaggacctgcctgtgctggtgggggaggagggggaggtgaagaagctggagaacacaggcatcgaggccaacgtgctgtgcctggagagcgagatcagcgagaacatcctggagaagggcggggaccccctggagaagcaggaccagatcagcggcctgagccagagcgaggtgaagacagatgtgtgcaccgtgcacctgcccaatgacttccccacctgcctgaccagcgagagcaaggtgtaccagcctgtgtcctgccccctgagtgacctgtctgaaaatgtggagagcgtggtgaatgaggagaagatcacagagagcagcctggtggagatcacagagcacaaggacttcaccctgaagacagaggagctgattgagagccccaagctggagagcagcgagggggagatcatccagacagtggaccggcagagcgtgaagagccctgaggtgcagctgctgggccacgtggagacagaagatgtggagatcatcgccacctgtgacacctttggaaatgaagacttcaacaacatccaggacagcgagaacaacctgctgaagaacaacctgctgaacaccaagctggagaagagcctggaggagaagaatgaaagcctgacagagcaccccaggagcacagagctgcccaagacccacatcgagcagatccagaagcacttcagcgaggacaacaatgagatgatccccatggagtgtgacagcttctgcagcgaccagaatgaaagtgaggtggagcccagcgtgaatgctgacctgaagcagatgaatgaaaacagcgtgacccactgcagcgagaacaacatgcccagcagtgacctggctgatgagaaggtggagaccgtgtcccagcccagcgagagccccaaggacaccatcgacaagaccaagaagcccaggacccggcgcagccgcttccacagccccagcaccacctggagccccaacaaggacaccccccaggagaagaagaggccccagagccccagcccccggcgggagaccgggaaggagagcaggaagagccagagccccagccccaagaatgaaagtgcccggggcaggaagaagagccgcagccagagccccaagaaggacatcgcccgggagcggcggcagagccagagccgcagccccaagagggacaccacccgggagagccgccgctctgagagcctgagcccccggcgggagaccagccgggagaacaagaggagccagccccgggtgaaggacagcagccctggagagaagagccgcagccagagccgggagcgggagagtgacagagatggccagaggcgggagcgggagaggaggaccaggaagtggagccgcagccgcagccacagccgcagccccagccgctgcaggaccaagagcaagagcagcagctttggaagaattgaccgggacagctacagcccccgctggaagggccgctgggccaatgatggctggcgctgccccagaggaaatgaccgctacaggaagaatgaccctgagaagcagaatgaaaacaccaggaaggagaagaatgacatccacctggatgctgatgaccccaacagcgctgacaagcacagaaatgactgccccaactggatcacagagaagatcaacagcggccctgaccccaggaccagaaatcctgagaagctgaaggagagccactgggaggagaacagaaatgaaaattctggcaacagctggaacaagaactttggaagtggctgggtgagcaacagaggccggggccggggcaacagaggccggggcacctaccgcagcagctttgcctacaaggaccagaatgaaaatcgctggcagaacaggaagcccctgagcggcaacagcaacagcagcggcagcgagagcttcaagtttgtggagcagcagagctacaagaggaagtctgagcaggagttctcctttgacaccccagctgacaggagcggctggaccagcgccagctcctgggccgtgaggaagaccctgcctgcagatgtgcagaactactacagccggcggggcaggaacagcagcggcccccagagcggctggatgaagcaggaggaggagaccagcggccaggacagcagcctgaaggaccagaccaaccagcaggtggatggcagccagctgcccatcaacatgatgcagccccagatgaatgtgatgcagcagcagatgaatgcccagcaccagcccatgaacatcttcccctaccctgtgggcgtgcacgcccccctgatgaacatccagaggaaccccttcaacatccacccccagctgcccctgcacctgcacactggagtgcccctgatgcaggtggccacccccacctctgtgtcccagggcctgcccccacctcctcctcctcctccacccagccagcaggtgaactacatcgccagccagccagatggcaagcagctgcagggcatccccagcagcagccacgtgagcaacaacatgagcacccctgtgctgcctgcccccacagctgcccctggcaacacaggcatggtgcagggccccagcagcggcaacaccagcagcagcagccacagcaaggccagcaatgctgctgtgaagctggccgagagcaaggtgtctgtggccgtggaggccagcgctgacagcagcaagacagacaagaagctgcagatccaggagaaggccgcccaggaggtgaagctggccatcaagcccttctaccagaacaaggacatcaccaaggaggagtacaaggagatcgtgaggaaggctgtggacaaggtgtgccacagcaagtctggagaggtgaacagcaccaaggtggccaacctggtgaaggcctacgtggacaagtacaagtacagcaggaagggcagccagaagaagaccctggaggagcctgtgtccacagagaagaacatcggctag

SEQ ID NO: 22002 - DNA, 4392 bp, Artificial Sequence; identical to SEQ ID NO: 22001
  Description of Artificial Sequence: Synthetic coding sequence

SEQ ID NO: 22003 - DNA, 3447 bp, Artificial Sequence
  Description of Artificial Sequence: Synthetic coding sequence
atgaccacccccacccggcgcagcaccaggaacaccagggctgagacagccagccagagccagaggagccccatcagtgacaacagcggctgtgatgcccctggcaacagcaaccccagcctgtctgtgcccagcagcgctgagagcgagaagcagacccggcaggcccccaagaggaagtctgtgagaagaggaaggaagccacccctgctgaagaagaagctgcggagctctgtggccgcccctgagaagagcagcagcaatgacagcgtggatgaggagacagctgagagtgacaccagccctgtgctggagaaggagcaccagccagatgtggacagcagcaacatctgcaccgtgcagacccacgtggagaaccagagcgccaactgcctgaagagctgcaatgagcagatcgaggagagcgagaagcacacagccaactatgacacagaggagcgggtgggcagcagcagcagcgagagctgtgcccaggacctgcctgtgctggtgggggaggagggggaggtgaagaagctggagaacacaggaattgaggccaacgtgctgtgcctggagagcgagatcagcgagaacatcctggagaagggcggggaccccctggagaagcaggaccagatcagcggcctgagccagagcgaggtgaagacagatgtgtgcaccgtgcacctgcccaatgacttccccacctgcctgaccagcgagagcaaggtgtaccagcctgtgtcctgccccctgagtgacctgtctgaaaatgtggagagcgtggtgaatgaggagaagatcacagagagcagcctggtggagatcacagagcacaaggacttcaccctgaagacagaggagctgattgagagccccaagctggagagcagcgagggggagatcatccagacagtggaccggcagagcgtgaagagccctgaggtgcagctgctgggccacgtggagacagaagatgtggagatcatcgccacctgtgacacctttggaaatgaagacttcaacaacatccaggacagcgagaacaacctgctgaagaacaacctgctgaacaccaagctggagaagagcctggaggagaagaatgaaagcctgacagagcaccccaggagcacagagctgcccaagacccacatcgagcagatccagaagcacttcagcgaggacaacaatgagatgatccccatggagtgtgacagcttctgcagcgaccagaatgaaagtgaggtggagcccagcgtgaatgctgacctgaagcagatgaatgaaaattctgtgacccactgcagcgagaacaacatgcccagcagtgacctggctgatgagaaggtggagaccgtgtcccagcccagcgagagccccaaggacaccatcgacaagaccaagaagcccaggaccaggaggagccgcttccacagccccagcaccacctggagccccaacaaggacaccccccaggagaagaagaggccccagagccccagcccccggcgggagaccgggaaggagagcaggaagagccagagccccagccccaagaatgaaagtgcccggggcaggaagaagagccgcagccagagccccaagaaggacatcgcccgggagcggcggcagagccagagccgcagccccaagagggacaccacccgggagagcagaagaagtgagagcctgagcccccggcgggagaccagccgggagaacaagaggagccagccccgggtgaaggacagcagccctggagagaagagccgcagccagagccgggagcgggagagtgacagagatggccagaggcgggagcgggagaggaggaccaggaagtggagccgcagccgcagccacagccgcagccccagccgctgcaggaccaagagcaagagcagcagctttggaagaattgaccgggacagctacagcccccgctggaagggccgctgggccaatgatggctggcgctgccccagaggaaatgaccgctacaggaagaatgaccctgagaagcagaatgaaaacaccaggaaggagaagaatgacatccacctggatgctgatgaccccaacagcgctgacaagcacagaaatgactgccccaactggatcacagagaagatcaacagcggccctgaccccaggaccaggaaccctgagaagctgaaggagagccactgggaggagaacagaaatgaaaacagcggcaacagctggaacaagaactttggcagcggctgggtgagcaacagaggccggggccggggcaacagaggccggggcacctaccgcagcagctttgcctacaaggaccagaatgaaaatcgctggcagaacaggaagcccctgagcggcaacagcaacagcagcggcagcgagagcttcaagtttgtggagcagcagagctacaagaggaagtctgagcaggagttctcctttgacaccccagctgacagaagtggctggaccagcgccagctcctgggccgtgaggaagaccctgcctgcagatgtgcagaactactacagcagaagaggaagaaacagcagcggcccccagagcggctggatgaagcaggaggaggagaccagcggccaggacagcagcctgaaggaccagaccaaccagcaggtggatggcagccagctgcccatcaacatgatgcagccccagatgaatgtgatgcagcagcagatgaatgcccagcaccagcccatgaacatcttcccctaccctgtgggcgtgcacgcccccctgatgaacatccagaggaaccccttcaacatccacccccagctgcccctgcacctgcacactggagtgcccctgatgcaggtggccacccccacctctgtgtcccagggcctgcccccacctcctcctcctcctccacccagccagcaggtgaactacatcgccagccagccagatggcaagcagctgcagggcatccccagcagcagccacgtgagcaacaacatgagcacccctgtgctgcctgcccccacagctgcccctggcaacacaggcatggtgcagggccccagcagcggcaacaccagcagcagcagccacagcaaggccagcaatgctgctgtgaagctggccgagagcaaggtgtctgtggccgtggaggccagcgctgacagcagcaagacagacaagaagctgcagatccaggagaaggccgcccaggaggtgaagctggccatcaagcccttctaccagaacaaggacatcaccaaggaggagtacaaggagatcgtgaggaaggctgtggacaaggtgtgccacagcaagagcggggaggtgaacagcaccaaggtggccaacctggtgaaggcctacgtggacaagtacaagtacagcaggaagggcagccagaagaagaccctggaggagcctgtgtccacagagaagaacattggatag

SEQ ID NO: 22004 - DNA, 1401 bp, Artificial Sequence
  Description of Artificial Sequence: Synthetic coding sequence
atggccgaggagcaggacctgtctgaggtggagctgagccctgtgggcagcgaggagccccgctgcctgagccctggcagcgcccccagcctgggcccagatggcggcggcggcggcagcggcctgcgggccagccctggccctggagagctgggcaaggtgaagaaggagcagcaggatggagaggctgatgatgacaagtttcctgtgtgcatccgggaggccgtgtcccaggtgctgagcggctatgactggaccctggtgcccatgcctgtgcgggtgaatggagccagcaagagcaagccccacgtgaagaggcccatgaatgccttcatggtgtgggcccaggccgcccggaggaagctggccgaccagtacccccacctgcacaatgctgagctgagcaagaccctgggcaagctgtggaggctgctgaatgaaagtgacaagaggcccttcatcgaggaggccgagcggctgaggatgcagcacaagaaggaccacccagactacaagtaccagcccaggaggaggaagaatggcaaggccgcccagggcgaggctgaatgtcctggaggagaggccgagcagggcggcacagctgccatccaggcccactacaagagcgcccacctggaccaccgccaccctggagagggcagccccatgtctgatggcaaccctgagcaccccagcggccagagccacggcccccccaccccacccaccacccccaagacagagctgcagagcggcaaggctgaccccaagagagatggccgctccatgggagagggcggcaagccccacatcgactttggaaatgtggacatcggggagatcagccatgaggtgatgagcaacatggagacctttgatgtggccgagctggaccagtacctgccccccaacggccaccctggccacgtgagcagctacagcgctgctggctacggcctgggcagcgccctggccgtggccagcggccacagcgcctggatcagcaagcccccaggagtggccctgcccaccgtgtccccacctggggtggatgccaaggcccaggtgaagacagaaacagctggcccccagggccccccccactacacagaccagcccagcaccagccagatcgcctacaccagcctgagcctgccccactacggcagcgccttccccagcatcagccggccccagtttgactacagcgaccaccagcccagcggcccctactacggccacagcggccaggccagcggcctgtacagcgccttctcctacatgggccccagccagaggcccctgtacacagccatcagtgaccccagccccagcggcccccagagccacagccccacccactgggagcagcctgtgtacaccaccctgagccggccctag

SEQ ID NO: 22005 - DNA, 1401 bp, Artificial Sequence; identical to SEQ ID NO: 22004
  Description of Artificial Sequence: Synthetic coding sequence

SEQ ID NO: 22006 - DNA, 861 bp, Artificial Sequence
  Description of Artificial Sequence: Synthetic coding sequence
atggccgaggagcaggacctgtctgaggtggagctgagccctgtgggcagcgaggagccccgctgcctgagccctggcagcgcccccagcctgggcccagatggcggcggcggcggcagcggcctgcgggccagccctggccctggagagctgggcaaggtgaagaaggagcagcaggatggagaggctgatgatgacaagtttcctgtgtgcatccgggaggccgtgtcccaggtgctgagcggctatgactggaccctggtgcccatgcctgtgcgggtgaatggagccagcaagagcaagccccacgtgaagaggcccatgaatgccttcatggtgtgggcccaggccgcccggaggaagctggccgaccagtacccccacctgcacaatgctgagctgagcaagaccctgggcaagctgtggaggctgctgaatgaaagtgacaagaggcccttcatcgaggaggccgagcggctgaggatgcagcacaagaaggaccacccagactacaagtaccagcccaggaggaggaagaatggcaaggccgcccagggcgaggctgaatgtcctggaggagaggccgagcagggcggcacagctgccatccaggcccactacaagagcgcccacctggaccaccgccaccctggagagggcagccccatgtctgatggcaaccctgagcaccccagcggccagagccacggcccccccaccccacccaccacccccaagacagagctgcagagcggcaaggctgaccccaagagagatggccggcccagccccagcggcccccagagccacagccccacccactgggagcagcctgtgtacaccaccctgagccggccctag

SEQ ID NO: 22007 - DNA, 642 bp, Artificial Sequence
  Description of Artificial Sequence: Synthetic coding sequence
atggccgaggagcaggacctgtctgaggtggagctgagccctgtgggcagcgaggagccccgctgcctgagccctggcagcgcccccagcctgggcccagatggcggcggcggcggcagcggcctgcgggccagccctggccctggagagctgggcaaggtgaagaaggagcagcaggatggagaggctgatgatgacaagtttcctgtgtgcatccgggaggccgtgtcccaggtgctgagcggctatgactggaccctggtgcccatgcctgtgcgggtgaatggagccagcaagagcaagccccacgtgaagaggcccatgaatgccttcatggtgtgggcccaggccgcccggaggaagctggccgaccagtacccccacctgcacaatgctgagctgagcaagaccctgggcaagctgtggaggctgctgaatgaaagtgacaagaggcccttcatcgaggaggccgagcggctgaggatgcagcacaagaaggaccacccagactacaagtaccagcccaggaggaggaagaatggcaaggccgcccagggcgaggctgaatgtcctggaggagaggccgagcagggcggcacagctgccatccaggcccactacaagagcgcccacctggactag

SEQ ID NO: 22008 - DNA, 1425 bp, Artificial Sequence
  Description of Artificial Sequence: Synthetic coding sequence
atggtgcagcagaccaacaatgcagaaaatacagaggccctgctggccggggagagcagtgacagcggggccggcctggagctgggcatcgccagcagccccaccccaggcagcacagccagcactggaggcaaggcagatgaccccagctggtgcaagacccccagcggccacatcaagaggcccatgaatgccttcatggtgtggagccagatcgagaggaggaagatcatggagcagagcccagacatgcacaatgctgagatcagcaagaggctgggcaagcgctggaagctgctgaaggacagcgacaagatccccttcatccgggaggccgagcggctgcggctgaagcacatggctgactacccagactacaagtaccggcccaggaagaaggtgaagtctggaaatgccaacagcagcagcagcgctgctgccagcagcaagccaggagagaagggggacaaggtgggcggcagcggcggcggcggccacggcggcggcggcggcggcggcagcagcaatgccggcggcggcggcggcggggccagcggcggcggggccaacagcaagccagcccagaagaagagctgtggcagcaaggtggccggcggggccggcggcggcgtgtccaagccccacgccaagctgatcctggccggcggcggcggcggcggcaaggctgctgctgctgctgctgccagctttgctgctgagcaggccggggctgctgccctgctgcccctgggcgctgctgctgaccaccacagcctgtacaaggcccggacccccagcgccagcgccagcgccagcagcgctgccagcgccagcgctgccctggccgcccctgggaagcacctggccgagaagaaggtgaagagggtgtacctgtttggaggcctgggcaccagcagcagccctgtgggcggcgtgggcgctggagctgaccccagcgaccccctgggcctgtatgaggaggagggcgccggctgcagcccagatgcccccagcctgagcggccgcagcagcgctgccagcagccctgctgctggccgcagccctgctgaccaccggggctacgccagcctgcgggccgccagccctgcccccagcagcgcccccagccacgccagcagcagcgccagcagccacagcagcagcagcagcagcagcggcagcagcagcagtgatgatgaatttgaagatgacctgctggacctgaaccccagcagcaactttgagagcatgagcctgggcagcttcagcagcagcagcgccctggaccgggacctggacttcaactttgagcccggcagcggcagccactttgagttcccagactactgcaccccagaggtgtctgagatgatcagcggggactggctggagagcagcatcagcaacctggtgttcacctactag

SEQ ID NO: 22009 - DNA, 1425 bp, Artificial Sequence; identical to SEQ ID NO: 22008
  Description of Artificial Sequence: Synthetic coding sequence

SEQ ID NO: 22010 - DNA, 3318 bp, Artificial Sequence
  Description of Artificial Sequence: Synthetic coding sequence
atgctggagcccagctctgtgctgcacgccaacgtgaaccaggcccccctgtggtgcctggtgctgcgctggtgccgggagtgcaaggacacagtgtgtggcggcaagcagaagagccgggtgaaccacaccttccagaggcgggagattgaggccaaggaggcctgtgactggctgcgggccgccggcttcccccagtatgcccagctgtatgaggacagccagttccccatcaacatcgtggccgtgaagaatgaccatgacttcctggagaaggacctggtggagcccctgtgccggcggctgaacaccctgaacaagtgtgcctccatgaagctggatgtgaacttccagaggaagaagggagatgacagtgatgaggaggacctgtgcatcagcaacaagtggaccttccagaggaccagccgccgctggagccgggtggatgacctgtacaccctgctgcccaggggggacagaaatggcagccctgggggcaccggcatgaggaacaccaccagcagcgagagcgtgctgacagacctgtctgagcctgaggtgtgcagcatccacagcgagagcagcggcggcagtgacagccgcagccagcccggccagtgctgcacagacaaccctgtgatgctggatgcccccctggtgagcagcagcctgccccagcccccaagagatgtgctgaaccaccccttccaccccaagaatgagaagcccacccgggcccgggccaagagcttcctgaagaggatggagaccctgcggggcaaaggagcccacggccgccacaagggcagcggccgcactggaggcctggtgatcagcggccccatgctgcagcaggagcctgagagcttcaaggccatgcagtgcatccagatccccaacggggacctgcagaacagccccccaccagcctgcaggaagggcctgccctgcagcggcaagagcagcggggagagcagccccagcgagcacagcagcagtggagtgtccaccccctgcctgaaggagaggaagtgccacgaggccaacaagaggggcggcatgtacctggaggacctggatgtgctggccggcacagccctgcctgatgctggggaccagagcaggatgcatgagttccacagccaggagaacctggtggtgcacatccccaaggaccacaagccaggcaccttccccaaggccctgagcattgagagcctgagccccacagacagcagcaatggagtgaactggaggacaggcagcatcagcctgggccgggagcaggtgcctggggcccgggagccccggctgatggccagctgccaccgggccagccgggtgtccatctatgacaacgtgcccggcagccacctgtatgccagcactggagacctgctggacctggagaaggatgacctcttcccccacctggatgacatcctgcagcacgtgaatggcctgcaggaggtggtggatgactggagcaaggatgtgctgcctgagctgcagacccatgacaccctggtgggggagcccggcctgagcaccttccccagccccaaccagatcaccctggactttgagggcaacagcgtgtctgagggccgcaccacccccagtgatgtggagagagatgtgaccagcctgaatgaaagtgagcccccaggagtgcgggacagaagagacagcggcgtgggcgccagcctgacccggcccaacagaaggctgcgctggaacagcttccagctgagccaccagcccaggcctgccccagccagcccccacatcagcagccagacagccagccagctgagcctgctgcagcgcttcagcctgctgcggctgacagccatcatggagaagcacagcatgagcaacaagcacggctggacctggagcgtgcccaagttcatgaagaggatgaaggtgcctgactacaaggacaaggctgtgtttggagtgcccctcatcgtgcacgtgcagaggacaggccagcccctgccccagagcatccagcaggccctgcgctacctgcggagcaactgcctggaccaggtgggcctcttcaggaagtctggagtgaagagccgcatccacgccctgcggcagatgaatgaaaacttcccagaaaatgtgaactatgaggaccagagcgcctatgatgtggccgacatggtgaagcagttcttccgggacctgcctgagcccctcttcaccaacaagctgtctgagaccttcctgcacatctaccagtatgtgtccaaggagcagaggctgcaggccgtgcaggccgccatcctgctgctggctgatgaaaatcgggaggtgctgcagaccctgctgtgcttcctgaatgatgtggtgaacctggtggaggagaaccagatgacccccatgaacctggccgtgtgcctggcccccagcctcttccacctgaacctgctgaagaaggagagcagccccagggtcatccagaagaagtatgccaccgggaagccagaccagaaggacctgaatgaaaacctggccgccgcccagggcctggcccacatgatcatggagtgtgaccggctgtttgaggtgccccatgagctggtggcccagagcagaaattcctatgtggaggccgagatccacgtgcccaccctggaggagctgggcacccagctggaggagagcggggccaccttccacacctacctgaaccacctgatccagggcctgcagaaggaggccaaggagaagttcaagggctgggtgacctgcagcagcacagacaacacagacctggccttcaagaaggtgggagatggcaaccccctgaagctgtggaaggcctctgtggaggtggaggccccacccagcgtggtgctgaacagagtgctgcgggagcggcacctgtgggatgaagattttgtgcagtggaaggtggtggagaccctggaccggcagacagagatctaccagtatgtgctgaacagcatggccccccaccccagccgggactttgtggtgctgcggacctggaagacagacctgcccaagggcatgtgcaccctggtgtccctgtctgtggagcacgaggaggcccagctgctgggcggcgtgcgggctgtggtgatggacagccagtacctgattgagccctgtggcagcggcaagagccggctgacccacatctgcagaattgacctgaagggccacagccctgagtggtacagcaagggcttcggccacctgtgtgccgctgaggtggcccgcatccggaacagcttccagcccctgattgctgagggccctgagaccaagatctag

SEQ ID NO: 22011 - DNA, 3342 bp, Artificial Sequence
  Description of Artificial Sequence: Synthetic coding sequence
atgttcagccaggtgcccaggaccccagccagcggctgctactacctgaacagcatgaccccagagggccaggagatgtacctgcgctttgaccagaccaccaggaggagcccctacaggatgagccgcatcctggcccggcaccagctggtgaccaagatccagcaggagattgaggccaaggaggcctgtgactggctgcgggccgccggcttcccccagtatgcccagctgtatgaggacagccagttccccatcaacatcgtggccgtgaagaatgaccatgacttcctggagaaggacctggtggagcccctgtgccggcggctgaacaccctgaacaagtgtgcctccatgaagctggatgtgaacttccagaggaagaagggagatgacagtgatgaggaggacctgtgcatcagcaacaagtggaccttccagaggaccagccgccgctggagccgggtggatgacctgtacaccctgctgcccaggggggacagaaatggcagccctgggggcaccggcatgaggaacaccaccagcagcgagagcgtgctgacagacctgtctgagcctgaggtgtgcagcatccacagcgagagcagcggcggcagtgacagccgcagccagcccggccagtgctgcacagacaaccctgtgatgctggatgcccccctggtgagcagcagcctgccccagcccccaagagatgtgctgaaccaccccttccaccccaagaatgagaagcccacccgggcccgggccaagagcttcctgaagaggatggagaccctgcggggcaaaggagcccacggccgccacaagggcagcggccgcactggaggcctggtgatcagcggccccatgctgcagcaggagcctgagagcttcaaggccatgcagtgcatccagatccccaacggggacctgcagaacagccccccaccagcctgcaggaagggcctgccctgcagcggcaagagcagcggggagagcagccccagcgagcacagcagcagtggagtgtccaccccctgcctgaaggagaggaagtgccacgaggccaacaagaggggcggcatgtacctggaggacctggatgtgctggccggcacagccctgcctgatgctggggaccagagcaggatgcatgagttccacagccaggagaacctggtggtgcacatccccaaggaccacaagccaggcaccttccccaaggccctgagcattgagagcctgagccccacagacagcagcaatggagtgaactggaggacaggcagcatcagcctgggccgggagcaggtgcctggggcccgggagccccggctgatggccagctgccaccgggccagccgggtgtccatctatgacaacgtgcccggcagccacctgtatgccagcactggagacctgctggacctggagaaggatgacctcttcccccacctggatgacatcctgcagcacgtgaatggcctgcaggaggtggtggatgactggagcaaggatgtgctgcctgagctgcagacccatgacaccctggtgggggagcccggcctgagcaccttccccagccccaaccagatcaccctggactttgagggcaacagcgtgtctgagggccgcaccacccccagtgatgtggagagagatgtgaccagcctgaatgaaagtgagcccccaggagtgcgggacagaagagacagcggcgtgggcgccagcctgacccggcccaacagaaggctgcgctggaacagcttccagctgagccaccagcccaggcctgccccagccagcccccacatcagcagccagacagccagccagctgagcctgctgcagcgcttcagcctgctgcggctgacagccatcatggagaagcacagcatgagcaacaagcacggctggacctggagcgtgcccaagttcatgaagaggatgaaggtgcctgactacaaggacaaggctgtgtttggagtgcccctcatcgtgcacgtgcagaggacaggccagcccctgccccagagcatccagcaggccctgcgctacctgcggagcaactgcctggaccaggtgggcctcttcaggaagtctggagtgaagagccgcatccacgccctgcggcagatgaatgaaaacttcccagaaaatgtgaactatgaggaccagagcgcctatgatgtggccgacatggtgaagcagttcttccgggacctgcctgagcccctcttcaccaacaagctgtctgagaccttcctgcacatctaccagtatgtgtccaaggagcagaggctgcaggccgtgcaggccgccatcctgctgctggctgatgaaaatcgggaggtgctgcagaccctgctgtgcttcctgaatgatgtggtgaacctggtggaggagaaccagatgacccccatgaacctggccgtgtgcctggcccccagcctcttccacctgaacctgctgaagaaggagagcagccccagggtcatccagaagaagtatgccaccgggaagccagaccagaaggacctgaatgaaaacctggccgccgcccagggcctggcccacatgatcatggagtgtgaccggctgtttgaggtgccccatgagctggtggcccagagcagaaattcctatgtggaggccgagatccacgtgcccaccctggaggagctgggcacccagctggaggagagcggggccaccttccacacctacctgaaccacctgatccagggcctgcagaaggaggccaaggagaagttcaagggctgggtgacctgcagcagcacagacaacacagacctggccttcaagaaggtgggagatggcaaccccctgaagctgtggaaggcctctgtggaggtggaggccccacccagcgtggtgctgaacagagtgctgcgggagcggcacctgtgggatgaagattttgtgcagtggaaggtggtggagaccctggaccggcagacagagatctaccagtatgtgctgaacagcatggccccccaccccagccgggactttgtggtgctgcggacctggaagacagacctgcccaagggcatgtgcaccctggtgtccctgtctgtggagcacgaggaggcccagctgctgggcggcgtgcgggctgtggtgatggacagccagtacctgattgagccctgtggcagcggcaagagccggctgacccacatctgcagaattgacctgaagggccacagccctgagtggtacagcaagggcttcggccacctgtgtgccgctgaggtggcccgcatccggaacagcttccagcccctgattgctgagggccctgagaccaagatctag

SEQ ID NO: 22012 - DNA, 2064 bp, Artificial Sequence
  Description of Artificial Sequence: Synthetic coding sequence
atgctggagcccagctctgtgctgcacgccaacgtgaaccaggcccccctgtggtgcctggtgctgcgctggtgccgggagtgcaaggacacagtgtgtggcggcaagcagaagagccgggtgaaccacaccttccagaggcgggagattgaggccaaggaggcctgtgactggctgcgggccgccggcttcccccagtatgcccagctgtatgaggacagccagttccccatcaacatcgtggccgtgaagaatgaccatgacttcctggagaaggacctggtggagcccctgtgccggcggctgaacaccctgaacaagtgtgcctccatgaagctggatgtgaacttccagaggaagaagggagatgacagtgatgaggaggacctgtgcatcagcaacaagtggaccttccagaggaccagccgccgctggagccgggtggatgacctgtacaccctgctgcccaggggggacagaaatggcagccctgggggcaccggcatgaggaacaccaccagcagcgagagcgtgctgacagacctgtctgagcctgaggtgtgcagcatccacagcgagagcagcggcggcagtgacagccgcagccagcccggccagtgctgcacagacaaccctgtgatgctggatgcccccctggtgagcagcagcctgccccagcccccaagagatgtgctgaaccaccccttccaccccaagaatgagaagcccacccgggcccgggccaagagcttcctgaagaggatggagaccctgcggggcaaaggagcccacggccgccacaagggcagcggccgcactggaggcctggtgatcagcggccccatgctgcagcaggagcctgagagcttcaaggccatgcagtgcatccagatccccaacggggacctgcagaacagccccccaccagcctgcaggaagggcctgccctgcagcggcaagagcagcggggagagcagccccagcgagcacagcagcagtggagtgtccaccccctgcctgaaggagaggaagtgccacgaggccaacaagaggggcggcatgtacctggaggacctggatgtgctggccggcacagccctgcctgatgctggggaccagagcaggatgcatgagttccacagccaggagaacctggtggtgcacatccccaaggaccacaagccaggcaccttccccaaggccctgagcattgagagcctgagccccacagacagcagcaatggagtgaactggaggacaggcagcatcagcctgggccgggagcaggtgcctggggcccgggagccccggctgatggccagctgccaccgggccagccgggtgtccatctatgacaacgtgcccggcagccacctgtatgccagcactggagacctgctggacctggagaaggatgacctcttcccccacctggatgacatcctgcagcacgtgaatggcctgcaggaggtggtggatgactggagcaaggatgtgctgcctgagctgcagacccatgacaccctggtgggggagcccggcctgagcaccttccccagccccaaccagatcaccctggactttgagggcaacagcgtgtctgagggccgcaccacccccagtgatgtggagagagatgtgaccagcctgaatgaaagtgagcccccaggagtgcgggacagaagagacagcggcgtgggcgccagcctgacccggcccaacagaaggctgcgctggaacagcttccagctgagccaccagcccaggcctgccccagccagcccccacatcagcagccagacagccagccagctgagcctgctgcagcgcttcagcctgctgcggctgacagccatcatggagaagcacagcatgagcaacaagcacggctggacctggagcgtgcccaagttcatgaagaggatgaaggtgcctgactacaaggacaaggctgtgtttggagtgcccctcatcgtgcacgtgcagaggacaggccagcccctgccccagagcatccagcaggccctgcgctacctgcggagcaactgcctggaccaggagtag

SEQ ID NO: 22013 - DNA, 2988 bp, Artificial Sequence
  Description of Artificial Sequence: Synthetic coding sequence
atgaagctggatgtgaacttccagaggaagaagggagatgacagtgatgaggaggacctgtgcatcagcaacaagtggaccttccagaggaccagccgccgctggagccgggtggatgacctgtacaccctgctgcccaggggggacagaaatggcagccctgggggcaccggcatgaggaacaccaccagcagcgagagcgtgctgacagacctgtctgagcctgaggtgtgcagcatccacagcgagagcagcggcggcagtgacagccgcagccagcccggccagtgctgcacagacaaccctgtgatgctggatgcccccctggtgagcagcagcctgccccagcccccaagagatgtgctgaaccaccccttccaccccaagaatgagaagcccacccgggcccgggccaagagcttcctgaagaggatggagaccctgcggggcaaaggagcccacggccgccacaagggcagcggccgcactggaggcctggtgatcagcggccccatgctgcagcaggagcctgagagcttcaaggccatgcagtgcatccagatccccaacggggacctgcagaacagccccccaccagcctgcaggaagggcctgccctgcagcggcaagagcagcggggagagcagccccagcgagcacagcagcagtggagtgtccaccccctgcctgaaggagaggaagtgccacgaggccaacaagaggggcggcatgtacctggaggacctggatgtgctggccggcacagccctgcctgatgctggggaccagagcaggatgcatgagttccacagccaggagaacctggtggtgcacatccccaaggaccacaagccaggcaccttccccaaggccctgagcattgagagcctgagccccacagacagcagcaatggagtgaactggaggacaggcagcatcagcctgggccgggagcaggtgcctggggcccgggagccccggctgatggccagctgccaccgggccagccgggtgtccatctatgacaacgtgcccggcagccacctgtatgccagcactggagacctgctggacctggagaaggatgacctcttcccccacctggatgacatcctgcagcacgtgaatggcctgcaggaggtggtggatgactggagcaaggatgtgctgcctgagctgcagacccatgacaccctggtgggggagcccggcctgagcaccttccccagccccaaccagatcaccctggactttgagggcaacagcgtgtctgagggccgcaccacccccagtgatgtggagagagatgtgaccagcctgaatgaaagtgagcccccaggagtgcgggacagaagagacagcggcgtgggcgccagcctgacccggcccaacagaaggctgcgctggaacagcttccagctgagccaccagcccaggcctgccccagccagcccccacatcagcagccagacagccagccagctgagcctgctgcagcgcttcagcctgctgcggctgacagccatcatggagaagcacagcatgagcaacaagcacggctggacctggagcgtgcccaagttcatgaagaggatgaaggtgcctgactacaaggacaaggctgtgtttggagtgcccctcatcgtgcacgtgcagaggacaggccagcccctgccccagagcatccagcaggccctgcgctacctgcggagcaactgcctggaccaggtgggcctcttcaggaagtctggagtgaagagccgcatccacgccctgcggcagatgaatgaaaacttcccagaaaatgtgaactatgaggaccagagcgcctatgatgtggccgacatggtgaagcagttcttccgggacctgcctgagcccctcttcaccaacaagctgtctgagaccttcctgcacatctaccagtatgtgtccaaggagcagaggctgcaggccgtgcaggccgccatcctgctgctggctgatgaaaatcgggaggtgctgcagaccctgctgtgcttcctgaatgatgtggtgaacctggtggaggagaaccagatgacccccatgaacctggccgtgtgcctggcccccagcctcttccacctgaacctgctgaagaaggagagcagccccagggtcatccagaagaagtatgccaccgggaagccagaccagaaggacctgaatgaaaacctggccgccgcccagggcctggcccacatgatcatggagtgtgaccggctgtttgaggtgccccatgagctggtggcccagagcagaaattcctatgtggaggccgagatccacgtgcccaccctggaggagctgggcacccagctggaggagagcggggccaccttccacacctacctgaaccacctgatccagggcctgcagaaggaggccaaggagaagttcaagggctgggtgacctgcagcagcacagacaacacagacctggccttcaagaaggtgggagatggcaaccccctgaagctgtggaaggcctctgtggaggtggaggccccacccagcgtggtgctgaacagagtgctgcgggagcggcacctgtgggatgaagattttgtgcagtggaaggtggtggagaccctggaccggcagacagagatctaccagtatgtgctgaacagcatggccccccaccccagccgggactttgtggtgctgcggacctggaagacagacctgcccaagggcatgtgcaccctggtgtccctgtctgtggagcacgaggaggcccagctgctgggcggcgtgcgggctgtggtgatggacagccagtacctgattgagccctgtggcagcggcaagagccggctgacccacatctgcagaattgacctgaagggccacagccctgagtggtacagcaagggcttcggccacctgtgtgccgctgaggtggcccgcatccggaacagcttccagcccctgattgctgagggccctgagaccaagatctag

SEQ ID NO: 22014 - DNA, 450 bp, Artificial Sequence
  Description of Artificial Sequence: Synthetic coding sequence
atggccagcagtgacatccaggtgaaggagctggagaagagggccagcggccaggcctttgagctgatcctgagccccaggagcaaggagagcgtgcctgagttccccctgagcccccccaagaagaaggacctgagcctggaggagatccagaagaagctggaggccgctgaggagaggaggaagagccatgaggccgaggtgctgaagcagctggccgagaagcgggagcacgagaaggaggtgctgcagaaggccatcgaggagaacaacaacttcagcaagatggccgaggagaagctgacccacaagatggaggccaacaaggagaaccgggaggcccagatggccgccaagctggagcggctgcgggagaaggacaagcacatcgaggaggtgaggaagaacaaggagagcaaggaccctgcagatgaaacagaggccgactag

SEQ ID NO: 22015 - DNA, 450 bp, Artificial Sequence; identical to SEQ ID NO: 22014
  Description of Artificial Sequence: Synthetic coding sequence

SEQ ID NO: 22016 - DNA, 450 bp, Artificial Sequence; identical to SEQ ID NO: 22014
  Description of Artificial Sequence: Synthetic coding sequence

SEQ ID NO: 22017 - DNA, 525 bp, Artificial Sequence
  Description of Artificial Sequence: Synthetic coding sequence
atggccagcagtgacatccaggtgaaggagctggagaagagggccagcggccaggcctttgagctgatcctgagccccaggagcaaggagagcgtgcctgagttccccctgagcccccccaagaagaaggacctgagcctggaggagatccagaagaagctggaggccgctgaggagaggaggaagagccatgaggccgaggtgctgaagcagctggccgagaagcgggagcacgagaaggaggtgctgcagaaggccatcgaggagaacaacaacttcagcaagatggccgaggagaagctgacccacaagatggaggccaacaaggagaaccgggaggcccagatggccgccaagctggagcggctgcgggagaagatgtacttctggacccacggccctggggcccacccagcccagatctctgctgagcagagctgcctgcacagcgtgcctgccctgtgcccagccctgggcctgcagagcgccctgatcacctggagcgacctgagccaccaccactag

SEQ ID NO: 22018 - DNA, 261 bp, Artificial Sequence
  Description of Artificial Sequence: Synthetic coding sequence
atggccagcagtgacatccaggtgaaggagctggagaagagggccagcggccaggcctttgagctgatcctgagccccaggagcaaggagagcgtgcctgagttccccctgagcccccccaagaagaaggacctgagcctggaggagatccagaagaagctggaggccgctgaggagaggaggaagagccatgaggccgaggtgctgaagcagctggccgagaagcgggagcacgagaaggaggtgctgcagaaggcctag

SEQ ID NO: 22019 - DNA, 450 bp, Artificial Sequence; identical to SEQ ID NO: 22014
  Description of Artificial Sequence: Synthetic coding sequence

SEQ ID NO: 22020 - DNA, 3615 bp, Artificial Sequence
  Description of Artificial Sequence: Synthetic coding sequence
atgtccttcttcaacttcaggaagatcttcaagctgggcagcgagaagaagaagaagcagtatgaacatgtgaagagggacctgaaccctgaggacttctgggagatcattggagagctgggagatggagccttcggcaaggtgtacaaggcccagaacaaggagacctctgtgctggccgccgccaaggtgattgacaccaagtctgaggaggagctggaggactacatggtggagattgacatcctggccagctgtgaccaccccaacatcgtgaagctgctggatgccttctactatgagaacaacctgtggatcctgattgagttctgtgccggcggcgctgtggatgctgtgatgctggagctggagcggcccctgacagagagccagatccaggtggtgtgcaagcagaccctggatgccctgaactacctgcatgacaacaagatcatccaccgggacctgaaggccggcaacatcctcttcaccctggatggagacatcaagctggccgactttggagtgtctgccaagaacaccaggaccatccagaggcgggacagcttcatcggcaccccctactggatggcccctgaggtggtgatgtgtgagaccagcaaggaccggccctatgactacaaggcagatgtgtggagcctgggcatcaccctcatcgagatggccgagattgagcccccccaccacgagctgaaccccatgagggtgctgctgaagatcgccaagtctgagccccccaccctggcccagcccagccgctggagcagcaacttcaaggacttcctgaagaagtgcctggagaagaatgtggatgcccgctggaccaccagccagctgctgcagcacccctttgtgacagtggacagcaacaagcccatccgggagctgattgctgaggccaaggccgaggtgacagaggaggtggaggatggcaaggaggaggatgaggaggaggagacagagaacagcctgcccatcccagccagcaagagggccagcagtgacctgagcatcgccagcagcgaggaggacaagctgagccagaatgcctgcatcctggagagcgtgtctgagaagacagagaggagcaacagcgaggacaagctgaacagcaagatcctgaatgagaagcccaccacagatgagcctgagaaggctgtggaggacatcaatgagcacatcacagatgcccagctggaggccatgacagagctgcatgacagaacagctgtgatcaaggaaaatgaaagagagaagaggcccaagctggagaacctgcctgacacagaggaccaggagaccgtggacatcaacagcgtgtctgagggcaaggagaacaacatcatgatcaccctggagaccaacatcgagcacaacctgaagtctgaggaggagaaggaccaggagaagcagcagatgtttgagaacaagctgatcaagtctgaggagatcaaggacaccatcctgcagacagtggacctggtgtcccaggagaccggggagaaggaggccaacatccaggccgtggacagcgaggtgggcctgaccaaggaggacacccaggagaagctgggagaagatgacaagacccagaaggatgtgatcagcaacaccagtgatgtgattggcacctgtgaggccgcagatgtggcccagaaggtggatgaagattctgctgaggacacccagagcaatgatggcaaggaggtggtggaggtgggccagaagctgatcaacaagcccatggtgggccctgaggccggcggcaccaaggaggtgcccatcaaggagatcgtggagatgaatgaaattgaggagggcaagaacaaggagcaggccatcaacagcagcgagaacatcatggacatcaatgaggagcccggcaccacagaaggagaggagatcacagagagcagcagcacagaggagatggaggtgcgctctgtggtggccgacacagaccagaaggccctgggcagcgaggtgcaggatgccagcaaggtgaccacccagattgacaaggagaagaaggagatccctgtgtccatcaagaaggagcctgaggtgacagtggtgtcccagcccacagagccccagcctgtgctgatccccagcatcaacatcaacagcgacagcggggagaacaaggaggagatcggcagcctgagcaagacagagaccatcctgcccccagagagcgagaaccccaaggaaaatgacaatgacagcggcaccggcagcacagctgacaccagcagcattgacctgaacctgagcatcagcagcttcctgagcaagaccaaggacagcggcagcatcagcctgcaggagacccggcggcagaagaagaccctgaagaagaccaggaagttcatcgtggatggagtggaggtgtctgtgaccaccagcaagatcgtgacagacagcgacagcaagacagaggagctgcgcttcctgcggcggcaggagctgcgggagctgcgcttcctgcagaaggaggagcagagggcccagcagcagctgaacagcaagctgcagcagcagcgggagcagatcttcagaagatttgagcaggagatgatgagcaagaagaggcagtatgaccaggagattgagaacctggagaagcagcagaagcagaccatcgagcggctggagcaggagcacaccaaccggctgagagatgaggccaagaggatcaagggggagcaggagaaggagctgagcaagttccagaacatgctgaagaacaggaagaaggaggagcaggagtttgtgcagaagcagcagcaggagctggatggcagcctgaagaagatcatccagcagcagaaggccgagctggccaacatcgagagagaatgtctgaacaacaagcagcagctgatgagggcccgggaggccgccatctgggagctggaggagcggcacctgcaggagaagcaccagctgctgaagcagcagctgaaggaccagtacttcatgcagaggcaccagctgctgaagagacatgagaaggagacagagcagatgcagcgctacaaccagaggctcatcgaggagctgaagaaccggcagacccaggagcgggcccggctgcccaagatccagaggtctgaggccaagaccaggatggccatgttcaagaagagcctgcgcatcaacagcacagccaccccagaccaggaccgggacaagatcaagcagtttgctgcccaggaggagaagaggcagaagaatgaaagaatggcccagcaccagaagcatgagaaccagatgagggacctgcagctgcagtgtgaggccaacgtgcgggagctgcaccagctgcagaatgagaagtgccacctgctggtggagcacgagacccagaagctgaaggagctggatgaggagcacagccaggagctgaaggagtggagggagaagctgcggcccaggaagaagaccctggaggaggagtttgccaggaagctgcaggagcaggaggtgttcttcaagatgaccggggagagcgagtgcctgaaccccagcacccagagccgcatcagcaagttctaccccatccccagcctgcacagcacaggcagctag

SEQ ID NO: 22021 - DNA, 3708 bp, Artificial Sequence
  Description of Artificial Sequence: Synthetic coding sequence
atgtccttcttcaacttcaggaagatcttcaagctgggcagcgagaagaagaagaagcagtatgaacatgtgaagagggacctgaaccctgaggacttctgggagatcattggagagctgggagatggagccttcggcaaggtgtacaaggcccagaacaaggagacctctgtgctggccgccgccaaggtgattgacaccaagtctgaggaggagctggaggactacatggtggagattgacatcctggccagctgtgaccaccccaacatcgtgaagctgctggatgccttctactatgagaacaacctgtggatcctgattgagttctgtgccggcggcgctgtggatgctgtgatgctggagctggagcggcccctgacagagagccagatccaggtggtgtgcaagcagaccctggatgccctgaactacctgcatgacaacaagatcatccaccgggacctgaaggccggcaacatcctcttcaccctggatggagacatcaagctggccgactttggagtgtctgccaagaacaccaggaccatccagaggcgggacagcttcatcggcaccccctactggatggcccctgaggtggtgatgtgtgagaccagcaaggaccggccctatgactacaaggcagatgtgtggagcctgggcatcaccctcatcgagatggccgagattgagcccccccaccacgagctgaaccccatgagggtgctgctgaagatcgccaagtctgagccccccaccctggcccagcccagccgctggagcagcaacttcaaggacttcctgaagaagtgcctggagaagaatgtggatgcccgctggaccaccagccagctgctgcagcacccctttgtgacagtggacagcaacaagcccatccgggagctgattgctgaggccaaggccgaggtgacagaggaggtggaggatggcaaggaggaggatgaggaggaggagacagagaacagcctgcccatcccagccagcaagagggccagcagtgacctgagcatcgccagcagcgaggaggacaagctgagccagaatgcctgcatcctggagagcgtgtctgagaagacagagaggagcaacagcgaggacaagctgaacagcaagatcctgaatgagaagcccaccacagatgagcctgagaaggctgtggaggacatcaatgagcacatcacagatgcccagctggaggccatgacagagctgcatgacagaacagctgtgatcaaggaaaatgaaagagagaagaggcccaagctggagaacctgcctgacacagaggaccaggagaccgtggacatcaacagcgtgtctgagggcaaggagaacaacatcatgatcaccctggagaccaacatcgagcacaacctgaagtctgaggaggagaaggaccaggagaagcagcagatgtttgagaacaagctgatcaagtctgaggagatcaaggacaccatcctgcagacagtggacctggtgtcccaggagaccggggagaaggaggccaacatccaggccgtggacagcgaggtgggcctgaccaaggaggacacccaggagaagctgggagaagatgacaagacccagaaggatgtgatcagcaacaccagtgatgtgattggcacctgtgaggccgcagatgtggcccagaaggtggatgaagattctgctgaggacacccagagcaatgatggcaaggaggtggtggaggtgggccagaagctgatcaacaagcccatggtgggccctgaggccggcggcaccaaggaggtgcccatcaaggagatcgtggagatgaatgaaattgaggagggcaagaacaaggagcaggccatcaacagcagcgagaacatcatggacatcaatgaggagcccggcaccacagaaggagaggagatcacagagagcagcagcacagaggagatggaggtgcgctctgtggtggccgacacagaccagaaggccctgggcagcgaggtgcaggatgccagcaaggtgaccacccagattgacaaggagaagaaggagatccctgtgtccatcaagaaggagcctgaggtgacagtggtgtcccagcccacagagccccagcctgtgctgatccccagcatcaacatcaacagcgacagcggggagaacaaggaggagatcggcagcctgagcaagacagagaccatcctgcccccagagagcgagaaccccaaggaaaatgacaatgacagcggcaccggcagcacagctgacaccagcagcattgacctgaacctgagcatcagcagcttcctgagcaagaccaaggacagcggcagcatcagcctgcaggagacccggcggcagaagaagaccctgaagaagaccaggaagttcatcgtggatggagtggaggtgtctgtgaccaccagcaagatcgtgacagacagcgacagcaagacagaggagctgcgcttcctgcggcggcaggagctgcgggagctgcgcttcctgcagaaggaggagcagagggcccagcagcagctgaacagcaagctgcagcagcagcgggagcagatcttcagaagatttgagcaggagatgatgagcaagaagaggcagtatgaccaggagattgagaacctggagaagcagcagaagcagaccatcgagcggctggagcaggagcacaccaaccggctgagagatgaggccaagaggatcaagggggagcaggagaaggagctgagcaagttccagaacatgctgaagaacaggaagaaggaggtgatcaatgaggtggagaaggcccccaaggagctgaggaaggagctgatgaagaggaggaaggaggagctggcccagagccagcacgcccaggagcaggagtttgtgcagaagcagcagcaggagctggatggcagcctgaagaagatcatccagcagcagaaggccgagctggccaacatcgagcgggagtgcctgaacaacaagcagcagctgatgagggcccgggaggccgccatctgggagctggaggagcggcacctgcaggagaagcaccagctgctgaagcagcagctgaaggaccagtacttcatgcagaggcaccagctgctgaagagacatgagaaggagacagagcagatgcagcgctacaaccagaggctgattgaggagctgaagaaccggcagacccaggagcgggcccggctgcccaagatccagaggtctgaggccaagaccaggatggccatgttcaagaagagcctgcgcatcaacagcacagccaccccagaccaggaccgggacaagatcaagcagtttgctgcccaggaggagaagaggcagaagaatgaaagaatggcccagcaccagaagcatgagaaccagatgagggacctgcagctgcagtgtgaggccaacgtgcgggagctgcaccagctgcagaatgagaagtgccacctgctggtggagcacgagacccagaagctgaaggagctggatgaggagcacagccaggagctgaaggagtggagggagaagctgcggcccaggaagaagaccctggaggaggagtttgccaggaagctgcaggagcaggaggtgttcttcaagatgactggagagagtgaatgtctgaaccccagcacccagagccgcatcagcaagttctaccccatccccagcctgcacagcacaggcagctag

SEQ ID NO: 22022 - DNA, 3444 bp, Artificial Sequence
  Description of Artificial Sequence: Synthetic coding sequence
atggatgagccccccttcagcgaggccgccctggagcaggccctgggggagccctgtgacctggatgctgccctgctgacagacatcgaggacatgctgcagctgatcaacaaccaggacagcgacttccctggcctgtttgatcctccctatgccggcagcggggccggcggcacagatcctgccagcccagacaccagcagccctggcagcctgagccccccaccagccaccctgagcagcagcctggaggccttcctgagcggcccccaggccgcccccagccccctgagccccccccagcctgcccccacccccctgaagatgtaccccagcatgcctgccttcagccctggccctggcatcaaggaggagagcgtgcccctgagcatcctgcagacccccaccccccagcccctgcccggggccctgctgccccagagcttccctgccccagccccaccccagttcagcagcacccctgtgctgggctaccccagccccccaggcggcttcagcacaggcagccccccaggcaacacccagcagcccctgcccggcctgcccctggccagccccccaggagtgccccctgtgtccctgcacacccaggtgcagagcgtggtgccccagcagctgctgactgtgacagctgcccccacagctgcccctgtgaccaccaccgtgaccagccagatccagcaggtgcctgtgctgctgcagccccacttcatcaaggctgacagcctgctgctgacagccatgaagacagatggagccaccgtgaaggctgctggcctgagccccctggtgtctggcaccaccgtgcagacaggccccctgcccaccctggtgtctgggggcaccatcctggccaccgtgcccctggtggtggatgctgagaagctgcccatcaaccggctggccgccggcagcaaggccccagccagcgcccagagcagaggagagaagaggacagcccacaatgccatcgagaagcgctaccgcagcagcatcaatgacaagatcatcgagctgaaggacctggtggtgggcacagaggccaagctgaacaagtctgctgtgctgaggaaggccatcgactacatccgcttcctgcagcacagcaaccagaagctgaagcaggagaacctgagcctgaggacagctgtgcacaagagcaagagcctgaaggacctggtgtctgcctgtggcagcggcggcaacacagatgtgctgatggagggcgtgaagacagaggtggaggacaccctgaccccaccacccagtgatgctggcagccccttccagagcagccccctgagcctgggcagccggggcagcggcagcggcggcagcggcagtgacagcgagccagacagccctgtgtttgaggacagcaaggccaagccagagcagaggcccagcctgcacagccggggcatgctggacaggagccggctggccctgtgcaccctggtgttcctgtgcctgagctgcaaccccctggccagcctgctgggcgcccggggcctgcccagccccagcgacaccacctctgtgtaccacagccctggaagaaatgtgctgggcacagagagcagagatggccctggctgggcccagtggctgctgccccctgtggtgtggctgctgaatggcctgctggtgctggtgtccctggtgctgctgtttgtgtatggagagcctgtgacccggccccacagcggccctgctgtgtacttctggaggcacaggaagcaggccgacctggacctggcccggggggactttgcccaggccgcccagcagctgtggctggccctgcgggccctgggccggcccctgcccaccagccacctggacctggcctgcagcctgctgtggaacctgatccgccacctgctgcagaggctgtgggtgggccgctggctggccggccgggccggcggcctgcagcaggactgtgccctgcgggtggatgccagcgccagcgccagagatgctgccctggtgtaccacaagctgcaccagctgcacaccatgggcaagcacactggaggccacctgacagccaccaacctggccctgagcgccctgaacctggccgagtgtgctggagatgctgtgtctgtggccaccctggccgagatctacgtggccgccgccctgcgggtgaagaccagcctgccccgggccctgcacttcctgacccgcttcttcctgagcagcgcccggcaggcctgcctggcccagagcggctctgtgcccccagccatgcagtggctgtgccaccctgtgggccaccgcttctttgtggatggagactggagcgtgctgagcaccccctgggagagcctgtacagcctggccggcaaccctgtggaccccctggcccaggtgacccagctgttccgggagcacctgctggagcgggccctgaactgtgtgacccagcccaaccccagccctggcagcgcagatggagacaaggagttcagtgatgccctgggctacctgcagctgctgaacagctgcagtgatgctgctggggccccagcctacagcttcagcatcagcagctccatggccaccaccactggagtggaccctgtggccaagtggtgggccagcctgacagctgtggtgatccactggctgcggagagatgaggaggccgctgagcggctgtgccccctggtggagcacctgccccgggtgctgcaggagagcgagcggcccctgccccgggccgccctgcacagcttcaaggccgcccgggccctgctgggctgtgccaaggccgagagcggccctgccagcctgaccatctgtgagaaggccagcggctacctgcaggacagcctggccaccaccccagccagcagcagcattgacaaggctgtgcagctgttcctgtgtgacctgctgctggtggtgaggaccagcctgtggaggcagcagcagcccccagccccagccccagctgcccagggcaccagcagccggccccaggccagcgccctggagctgcggggcttccagagggacctgagcagcctgcggcggctggcccagagcttccggcctgccatgagaagagtcttcctgcacgaggccacagcccggctgatggccggggccagccccaccaggacccaccagctgctggacaggagcctgcggaggagagctggccctgggggcaagggcggcgctgtggccgagctggagccccggcccacccggcgggagcacgccgaggccctgctgctggccagctgctacctgcccccaggcttcctgagcgcccctggccagagggtgggcatgctggccgaggccgcccggaccctggagaagctgggggaccggcggctgctgcatgactgccagcagatgctgatgaggctgggcggcggcaccaccgtgaccagcagctag

SEQ ID NO: 22023 - DNA, 3216 bp, Artificial Sequence
  Description of Artificial Sequence: Synthetic coding sequence
atggatgagccccccttcagcgaggccgccctggagcaggccctgggggagccctgtgacctggatgctgccctgctgacagacatcgaggacatgctgcagctgatcaacaaccaggacagcgacttccctggcctgtttgatcctccctatgccggcagcggggccggcggcacagatcctgccagcccagacaccagcagccctggcagcctgagccccccaccagccaccctgagcagcagcctggaggccttcctgagcggcccccaggccgcccccagccccctgagccccccccagcctgcccccacccccctgaagatgtaccccagcatgcctgccttcagccctggccctggcatcaaggaggagagcgtgcccctgagcatcctgcagacccccaccccccagcccctgcccggggccctgctgccccagagcttccctgccccagccccaccccagttcagcagcacccctgtgctgggctaccccagccccccaggcggcttcagcacaggcagccccccaggcaacacccagcagcccctgcccggcctgcccctggccagccccccaggagtgccccctgtgtccctgcacacccaggtgcagagcgtggtgccccagcagctgctgactgtgacagctgcccccacagctgcccctgtgaccaccaccgtgaccagccagatccagcaggtgcctgtgctgctgcagccccacttcatcaaggctgacagcctgctgctgacagccatgaagacagatggagccaccgtgaaggctgctggcctgagccccctggtgtctggcaccaccgtgcagacaggccccctgcccaccctggtgtctgggggcaccatcctggccaccgtgcccctggtggtggatgctgagaagctgcccatcaaccggctggccgccggcagcaaggccccagccagcgcccagagcagaggagagaagaggacagcccacaatgccatcgagaagcgctaccgcagcagcatcaatgacaagatcatcgagctgaaggacctggtggtgggcacagaggccaagctgaacaagtctgctgtgctgaggaaggccatcgactacatccgcttcctgcagcacagcaaccagaagctgaagcaggagaacctgagcctgaggacagctgtgcacaagagcaagagcctgaaggacctggtgtctgcctgtggcagcggcggcaacacagatgtgctgatggagggcgtgaagacagaggtggaggacaccctgaccccaccacccagtgatgctggcagccccttccagagcagccccctgagcctgggcagccggggcagcggcagcggcggcagcggcagtgacagcgagccagacagccctgtgtttgaggacagcaaggccaagccagagcagaggcccagcctgcacagccggggcatgctggacaggagccggctggccctgtgcaccctggtgttcctgtgcctgagctgcaaccccctggccagcctgctgggcgcccggggcctgcccagccccagcgacaccacctctgtgtaccacagccctggaagaaatgtgctgggcacagagagcagagatggccctggctgggcccagtggctgctgccccctgtggtgtggctgctgaatggcctgctggtgctggtgtccctggtgctgctgtttgtgtatggagagcctgtgacccggccccacagcggccctgctgtgtacttctggaggcacaggaagcaggccgacctggacctggcccggggggactttgcccaggccgcccagcagctgtggctggccctgcgggccctgggccggcccctgcccaccagccacctggacctggcctgcagcctgctgtggaacctgatccgccacctgctgcagaggctgtgggtgggccgctggctggccggccgggccggcggcctgcagcaggactgtgccctgcgggtggatgccagcgccagcgccagagatgctgccctggtgtaccacaagctgcaccagctgcacaccatgggcaagcacactggaggccacctgacagccaccaacctggccctgagcgccctgaacctggccgagtgtgctggagatgctgtgtctgtggccaccctggccgagatctacgtggccgccgccctgcgggtgaagaccagcctgccccgggccctgcacttcctgacccgcttcttcctgagcagcgcccggcaggcctgcctggcccagagcggctctgtgcccccagccatgcagtggctgtgccaccctgtgggccaccgcttctttgtggatggagactggagcgtgctgagcaccccctgggagagcctgtacagcctggccggcaaccctgtggaccccctggcccaggtgacccagctgttccgggagcacctgctggagcgggccctgaactgtgtgacccagcccaaccccagccctggcagcgcagatggagacaaggagttcagtgatgccctgggctacctgcagctgctgaacagctgcagtgatgctgctggggccccagcctacagcttcagcatcagcagctccatggccaccaccactggagtggaccctgtggccaagtggtgggccagcctgacagctgtggtgatccactggctgcggagagatgaggaggccgctgagcggctgtgccccctggtggagcacctgccccgggtgctgcaggagagcgagcggcccctgccccgggccgccctgcacagcttcaaggccgcccgggccctgctgggctgtgccaaggccgagagcggccctgccagcctgaccatctgtgagaaggccagcggctacctgcaggacagcctggccaccaccccagccagcagcagcattgacaaggctgtgcagctgttcctgtgtgacctgctgctggtggtgaggaccagcctgtggaggcagcagcagcccccagccccagccccagctgcccagggcaccagcagccggccccaggccagcgccctggagctgcggggcttccagagggacctgagcagcctgcggcggctggcccagagcttccggcctgccatgaggcggctgatggatgtgctgaccagcgagagcgcctgggccctgccccagcacctgggcaagggcttccccagccccagcggccacaaggtgcccggctggcacggccgcatggactag

SEQ ID NO: 22024 - DNA, 3534 bp, Artificial Sequence
  Description of Artificial Sequence: Synthetic coding sequence
atggatgagccccccttcagcgaggccgccctggagcaggccctgggggagccctgtgacctggatgctgccctgctgacagacattgaaggagaggtgggcgccggccggggccgggccaacggcctggatgccccccgggccggggctgacagaggagccatggactgcacctttgaggacatgctgcagctgatcaacaaccaggacagcgacttccctggcctgtttgatcctccctatgccggcagcggggccggcggcacagatcctgccagcccagacaccagcagccctggcagcctgagccccccaccagccaccctgagcagcagcctggaggccttcctgagcggcccccaggccgcccccagccccctgagccccccccagcctgcccccacccccctgaagatgtaccccagcatgcctgccttcagccctggccctggcatcaaggaggagagcgtgcccctgagcatcctgcagacccccaccccccagcccctgcccggggccctgctgccccagagcttccctgccccagccccaccccagttcagcagcacccctgtgctgggctaccccagccccccaggcggcttcagcacaggcagccccccaggcaacacccagcagcccctgcccggcctgcccctggccagccccccaggagtgccccctgtgtccctgcacacccaggtgcagagcgtggtgccccagcagctgctgactgtgacagctgcccccacagctgcccctgtgaccaccaccgtgaccagccagatccagcaggtgcctgtgctgctgcagccccacttcatcaaggctgacagcctgctgctgacagccatgaagacagatggagccaccgtgaaggctgctggcctgagccccctggtgtctggcaccaccgtgcagacaggccccctgcccaccctggtgtctgggggcaccatcctggccaccgtgcccctggtggtggatgctgagaagctgcccatcaaccggctggccgccggcagcaaggccccagccagcgcccagagcagaggagagaagaggacagcccacaatgccatcgagaagcgctaccgcagcagcatcaatgacaagatcatcgagctgaaggacctggtggtgggcacagaggccaagctgaacaagtctgctgtgctgaggaaggccatcgactacatccgcttcctgcagcacagcaaccagaagctgaagcaggagaacctgagcctgaggacagctgtgcacaagagcaagagcctgaaggacctggtgtctgcctgtggcagcggcggcaacacagatgtgctgatggagggcgtgaagacagaggtggaggacaccctgaccccaccacccagtgatgctggcagccccttccagagcagccccctgagcctgggcagccggggcagcggcagcggcggcagcggcagtgacagcgagccagacagccctgtgtttgaggacagcaaggccaagccagagcagaggcccagcctgcacagccggggcatgctggacaggagccggctggccctgtgcaccctggtgttcctgtgcctgagctgcaaccccctggccagcctgctgggcgcccggggcctgcccagccccagcgacaccacctctgtgtaccacagccctggaagaaatgtgctgggcacagagagcagagatggccctggctgggcccagtggctgctgccccctgtggtgtggctgctgaatggcctgctggtgctggtgtccctggtgctgctgtttgtgtatggagagcctgtgacccggccccacagcggccctgctgtgtacttctggaggcacaggaagcaggccgacctggacctggcccggggggactttgcccaggccgcccagcagctgtggctggccctgcgggccctgggccggcccctgcccaccagccacctggacctggcctgcagcctgctgtggaacctgatccgccacctgctgcagaggctgtgggtgggccgctggctggccggccgggccggcggcctgcagcaggactgtgccctgcgggtggatgccagcgccagcgccagagatgctgccctggtgtaccacaagctgcaccagctgcacaccatgggcaagcacactggaggccacctgacagccaccaacctggccctgagcgccctgaacctggccgagtgtgctggagatgctgtgtctgtggccaccctggccgagatctacgtggccgccgccctgcgggtgaagaccagcctgccccgggccctgcacttcctgacccgcttcttcctgagcagcgcccggcaggcctgcctggcccagagcggctctgtgcccccagccatgcagtggctgtgccaccctgtgggccaccgcttctttgtggatggagactggagcgtgctgagcaccccctgggagagcctgtacagcctggccggcaaccctgtggaccccctggcccaggtgacccagctgttccgggagcacctgctggagcgggccctgaactgtgtgacccagcccaaccccagccctggcagcgcagatggagacaaggagttcagtgatgccctgggctacctgcagctgctgaacagctgcagtgatgctgctggggccccagcctacagcttcagcatcagcagctccatggccaccaccactggagtggaccctgtggccaagtggtgggccagcctgacagctgtggtgatccactggctgcggagagatgaggaggccgctgagcggctgtgccccctggtggagcacctgccccgggtgctgcaggagagcgagcggcccctgccccgggccgccctgcacagcttcaaggccgcccgggccctgctgggctgtgccaaggccgagagcggccctgccagcctgaccatctgtgagaaggccagcggctacctgcaggacagcctggccaccaccccagccagcagcagcattgacaaggctgtgcagctgttcctgtgtgacctgctgctggtggtgaggaccagcctgtggaggcagcagcagcccccagccccagccccagctgcccagggcaccagcagccggccccaggccagcgccctggagctgcggggcttccagagggacctgagcagcctgcggcggctggcccagagcttccggcctgccatgagaagagtcttcctgcacgaggccacagcccggctgatggccggggccagccccaccaggacccaccagctgctggacaggagcctgcggaggagagctggccctgggggcaagggcggcgctgtggccgagctggagccccggcccacccggcgggagcacgccgaggccctgctgctggccagctgctacctgcccccaggcttcctgagcgcccctggccagagggtgggcatgctggccgaggccgcccggaccctggagaagctgggggaccggcggctgctgcatgactgccagcagatgctgatgaggctgggcggcggcaccaccgtgaccagcagctag

SEQ ID NO: 22025 - DNA, 3468 bp, Artificial Sequence
  Description of Artificial Sequence: Synthetic coding sequence
tgaaaaatccggcgggccctgaccggggaggtgggcgccggccggggccgggccaacggcctggatgccccccgggccggggctgacagaggagccatggactgcacctttgaggacatgctgcagctgatcaacaaccaggacagcgacttccctggcctgtttgatcctccctatgccggcagcggggccggcggcacagatcctgccagcccagacaccagcagccctggcagcctgagccccccaccagccaccctgagcagcagcctggaggccttcctgagcggcccccaggccgcccccagccccctgagccccccccagcctgcccccacccccctgaagatgtaccccagcatgcctgccttcagccctggccctggcatcaaggaggagagcgtgcccctgagcatcctgcagacccccaccccccagcccctgcccggggccctgctgccccagagcttccctgccccagccccaccccagttcagcagcacccctgtgctgggctaccccagccccccaggcggcttcagcacaggcagccccccaggcaacacccagcagcccctgcccggcctgcccctggccagccccccaggagtgccccctgtgtccctgcacacccaggtgcagagcgtggtgccccagcagctgctgactgtgacagctgcccccacagctgcccctgtgaccaccaccgtgaccagccagatccagcaggtgcctgtgctgctgcagccccacttcatcaaggctgacagcctgctgctgacagccatgaagacagatggagccaccgtgaaggctgctggcctgagccccctggtgtctggcaccaccgtgcagacaggccccctgcccaccctggtgtctgggggcaccatcctggccaccgtgcccctggtggtggatgctgagaagctgcccatcaaccggctggccgccggcagcaaggccccagccagcgcccagagcagaggagagaagaggacagcccacaatgccatcgagaagcgctaccgcagcagcatcaatgacaagatcatcgagctgaaggacctggtggtgggcacagaggccaagctgaacaagtctgctgtgctgaggaaggccatcgactacatccgcttcctgcagcacagcaaccagaagctgaagcaggagaacctgagcctgaggacagctgtgcacaagagcaagagcctgaaggacctggtgtctgcctgtggcagcggcggcaacacagatgtgctgatggagggcgtgaagacagaggtggaggacaccctgaccccaccacccagtgatgctggcagccccttccagagcagccccctgagcctgggcagccggggcagcggcagcggcggcagcggcagtgacagcgagccagacagccctgtgtttgaggacagcaaggccaagccagagcagaggcccagcctgcacagccggggcatgctggacaggagccggctggccctgtgcaccctggtgttcctgtgcctgagctgcaaccccctggccagcctgctgggcgcccggggcctgcccagccccagcgacaccacctctgtgtaccacagccctggaagaaatgtgctgggcacagagagcagagatggccctggctgggcccagtggctgctgccccctgtggtgtggctgctgaatggcctgctggtgctggtgtccctggtgctgctgtttgtgtatggagagcctgtgacccggccccacagcggccctgctgtgtacttctggaggcacaggaagcaggccgacctggacctggcccggggggactttgcccaggccgcccagcagctgtggctggccctgcgggccctgggccggcccctgcccaccagccacctggacctggcctgcagcctgctgtggaacctgatccgccacctgctgcagaggctgtgggtgggccgctggctggccggccgggccggcggcctgcagcaggactgtgccctgcgggtggatgccagcgccagcgccagagatgctgccctggtgtaccacaagctgcaccagctgcacaccatgggcaagcacactggaggccacctgacagccaccaacctggccctgagcgccctgaacctggccgagtgtgctggagatgctgtgtctgtggccaccctggccgagatctacgtggccgccgccctgcgggtgaagaccagcctgccccgggccctgcacttcctgacccgcttcttcctgagcagcgcccggcaggcctgcctggcccagagcggctctgtgcccccagccatgcagtggctgtgccaccctgtgggccaccgcttctttgtggatggagactggagcgtgctgagcaccccctgggagagcctgtacagcctggccggcaaccctgtggaccccctggcccaggtgacccagctgttccgggagcacctgctggagcgggccctgaactgtgtgacccagcccaaccccagccctggcagcgcagatggagacaaggagttcagtgatgccctgggctacctgcagctgctgaacagctgcagtgatgctgctggggccccagcctacagcttcagcatcagcagctccatggccaccaccactggagtggaccctgtggccaagtggtgggccagcctgacagctgtggtgatccactggctgcggagagatgaggaggccgctgagcggctgtgccccctggtggagcacctgccccgggtgctgcaggagagcgagcggcccctgccccgggccgccctgcacagcttcaaggccgcccgggccctgctgggctgtgccaaggccgagagcggccctgccagcctgaccatctgtgagaaggccagcggctacctgcaggacagcctggccaccaccccagccagcagcagcattgacaaggctgtgcagctgttcctgtgtgacctgctgctggtggtgaggaccagcctgtggaggcagcagcagcccccagccccagccccagctgcccagggcaccagcagccggccccaggccagcgccctggagctgcggggcttccagagggacctgagcagcctgcggcggctggcccagagcttccggcctgccatgagaagagtcttcctgcacgaggccacagcccggctgatggccggggccagccccaccaggacccaccagctgctggacaggagcctgcggaggagagctggccctgggggcaagggcggcgctgtggccgagctggagccccggcccacccggcgggagcacgccgaggccctgctgctggccagctgctacctgcccccaggcttcctgagcgcccctggccagagggtgggcatgctggccgaggccgcccggaccctggagaagctgggggaccggcggctgctgcatgactgccagcagatgctgatgaggctgggcggcggcaccaccgtgaccagcagctag

SEQ ID NO: 22026 - DNA, 2301 bp, Artificial Sequence
  Description of Artificial Sequence: Synthetic coding sequence
atgctggcccacctgagccgggccgccccctgccccctggccgccggggctgtggccgctgtggccgtggccgtgaccaggagcctgacagcccagagcctgaggacagcccggctgggccctgccaccgtgccccccagccccctgcctgccatcagcagcgagccccatgaccgggccggcaagaccctgacagaccccaccagccacttcatcgaccgcatcacagaggcctggagccacgtgggcagccacagcaaggccaagccagagcagaggcccagcctgcacagccggggcatgctggacaggagccggctggccctgtgcaccctggtgttcctgtgcctgagctgcaaccccctggccagcctgctgggcgcccggggcctgcccagccccagcgacaccacctctgtgtaccacagccctggaagaaatgtgctgggcacagagagcagagatggccctggctgggcccagtggctgctgccccctgtggtgtggctgctgaatggcctgctggtgctggtgtccctggtgctgctgtttgtgtatggagagcctgtgacccggccccacagcggccctgctgtgtacttctggaggcacaggaagcaggccgacctggacctggcccggggggactttgcccaggccgcccagcagctgtggctggccctgcgggccctgggccggcccctgcccaccagccacctggacctggcctgcagcctgctgtggaacctgatccgccacctgctgcagaggctgtgggtgggccgctggctggccggccgggccggcggcctgcagcaggactgtgccctgcgggtggatgccagcgccagcgccagagatgctgccctggtgtaccacaagctgcaccagctgcacaccatgggcaagcacactggaggccacctgacagccaccaacctggccctgagcgccctgaacctggctgaatgtgctggagatgctgtgtctgtggccaccctggccgagatctacgtggccgccgccctgcgggtgaagaccagcctgccccgggccctgcacttcctgacccgcttcttcctgagcagcgcccggcaggcctgcctggcccagagcggctctgtgcccccagccatgcagtggctgtgccaccctgtgggccaccgcttctttgtggatggagactggagcgtgctgagcaccccctgggagagcctgtacagcctggccggcaaccctgtggaccccctggcccaggtgacccagctgttccgggagcacctgctggagcgggccctgaactgtgtgacccagcccaaccccagccctggcagcgcagatggagacaaggagttcagtgatgccctgggctacctgcagctgctgaacagctgcagtgatgctgctggggccccagcctacagcttcagcatcagcagctccatggccaccaccaccggggtggaccctgtggccaagtggtgggccagcctgacagctgtggtgatccactggctgcggagagatgaggaggccgctgagcggctgtgccccctggtggagcacctgccccgggtgctgcaggagagcgagcggcccctgcccagggctgccctgcacagcttcaaggccgcccgggccctgctgggctgtgccaaggccgagagcggccctgccagcctgaccatctgtgagaaggccagcggctacctgcaggacagcctggccaccaccccagccagcagcagcattgacaaggctgtgcagctgttcctgtgtgacctgctgctggtggtgaggaccagcctgtggaggcagcagcagcccccagccccagccccagctgcccagggcaccagcagccggccccaggccagcgccctggagctgcggggcttccagagggacctgagcagcctgcggcggctggcccagagcttccggcctgccatgagaagagtcttcctgcacgaggccacagcccggctgatggccggggccagccccaccaggacccaccagctgctggacaggagcctgcggcggcgggccggccctgggggcaaaggaggagctgtggccgagctggagccccggcccacccggcgggagcacgccgaggccctgctgctggccagctgctacctgcccccaggcttcctgagcgcccctggccagagggtgggcatgctggccgaggccgcccggaccctggagaagctgggggaccggcggctgctgcatgactgccagcagatgctgatgaggctgggcggcggcaccaccgtgaccagcagctag

SEQ ID NO: 22027 - DNA, 2682 bp, Artificial Sequence
  Description of Artificial Sequence: Synthetic coding sequence
atgaagacagatggagccaccgtgaaggctgctggcctgagccccctggtgtctggcaccaccgtgcagacaggccccctgcccaccctggtgtctgggggcaccatcctggccaccgtgcccctggtggtggatgctgagaagctgcccatcaaccggctggccgccggcagcaaggccccagccagcgcccagagcagaggagagaagaggacagcccacaatgccatcgagaagcgctaccgcagcagcatcaatgacaagatcatcgagctgaaggacctggtggtgggcacagaggccaagctgaacaagtctgctgtgctgaggaaggccatcgactacatccgcttcctgcagcacagcaaccagaagctgaagcaggagaacctgagcctgaggacagctgtgcacaagagcaagagcctgaaggacctggtgtctgcctgtggcagcggcggcaacacagatgtgctgatggagggcgtgaagacagaggtggaggacaccctgaccccaccacccagtgatgctggcagccccttccagagcagccccctgagcctgggcagccggggcagcggcagcggcggcagcggcagtgacagcgagccagacagccctgtgtttgaggacagcaaggccaagccagagcagaggcccagcctgcacagccggggcatgctggacaggagccggctggccctgtgcaccctggtgttcctgtgcctgagctgcaaccccctggccagcctgctgggcgcccggggcctgcccagccccagcgacaccacctctgtgtaccacagccctggaagaaatgtgctgggcacagagagcagagatggccctggctgggcccagtggctgctgccccctgtggtgtggctgctgaatggcctgctggtgctggtgtccctggtgctgctgtttgtgtatggagagcctgtgacccggccccacagcggccctgctgtgtacttctggaggcacaggaagcaggccgacctggacctggcccggggggactttgcccaggccgcccagcagctgtggctggccctgcgggccctgggccggcccctgcccaccagccacctggacctggcctgcagcctgctgtggaacctgatccgccacctgctgcagaggctgtgggtgggccgctggctggccggccgggccggcggcctgcagcaggactgtgccctgcgggtggatgccagcgccagcgccagagatgctgccctggtgtaccacaagctgcaccagctgcacaccatgggcaagcacactggaggccacctgacagccaccaacctggccctgagcgccctgaacctggccgagtgtgctggagatgctgtgtctgtggccaccctggccgagatctacgtggccgccgccctgcgggtgaagaccagcctgccccgggccctgcacttcctgacccgcttcttcctgagcagcgcccggcaggcctgcctggcccagagcggctctgtgcccccagccatgcagtggctgtgccaccctgtgggccaccgcttctttgtggatggagactggagcgtgctgagcaccccctgggagagcctgtacagcctggccggcaaccctgtggaccccctggcccaggtgacccagctgttccgggagcacctgctggagcgggccctgaactgtgtgacccagcccaaccccagccctggcagcgcagatggagacaaggagttcagtgatgccctgggctacctgcagctgctgaacagctgcagtgatgctgctggggccccagcctacagcttcagcatcagcagctccatggccaccaccactggagtggaccctgtggccaagtggtgggccagcctgacagctgtggtgatccactggctgcggagagatgaggaggccgctgagcggctgtgccccctggtggagcacctgccccgggtgctgcaggagagcgagcggcccctgccccgggccgccctgcacagcttcaaggccgcccgggccctgctgggctgtgccaaggccgagagcggccctgccagcctgaccatctgtgagaaggccagcggctacctgcaggacagcctggccaccaccccagccagcagcagcattgacaaggctgtgcagctgttcctgtgtgacctgctgctggtggtgaggaccagcctgtggaggcagcagcagcccccagccccagccccagctgcccagggcaccagcagccggccccaggccagcgccctggagctgcggggcttccagagggacctgagcagcctgcggcggctggcccagagcttccggcctgccatgagaagagtcttcctgcacgaggccacagcccggctgatggccggggccagccccaccaggacccaccagctgctggacaggagcctgcggaggagagctggccctgggggcaagggcggcgctgtggccgagctggagccccggcccacccggcgggagcacgccgaggccctgctgctggccagctgctacctgcccccaggcttcctgagcgcccctggccagagggtgggcatgctggccgaggccgcccggaccctggagaagctgggggaccggcggctgctgcatgactgccagcagatgctgatgaggctgggcggcggcaccaccgtgaccagcagctag

SEQ ID NO: 22028 - DNA, 2955 bp, Artificial Sequence
  Description of Artificial Sequence: Synthetic coding sequence
atggactgcacctttgaggacatgctgcagctgatcaacaaccaggacagcgacttccctggcctgtttgatcctccctatgccggcagcggggccggcggcacagatcctgccagcccagacaccagcagccctggcagcctgagccccccaccagccaccctgagcagcagcctggaggccttcctgagcggcccccaggccgcccccagccccctgagccccccccagcctgcccccacccccctgaagatgtaccccagcatgcctgccttcagccctggccctggcatcaaggaggagagcgtgcccctgagcatcctgcagacccccaccccccagcccctgcctgtgcccaccctggtgtctgggggcaccatcctggccaccgtgcccctggtggtggatgctgagaagctgcccatcaaccggctggccgccggcagcaaggccccagccagcgcccagagcagaggagagaagaggacagcccacaatgccatcgagaagcgctaccgcagcagcatcaatgacaagatcatcgagctgaaggacctggtggtgggcacagaggccaagctgaacaagtctgctgtgctgaggaaggccatcgactacatccgcttcctgcagcacagcaaccagaagctgaagcaggagaacctgagcctgaggacagctgtgcacaagagcaagagcctgaaggacctggtgtctgcctgtggcagcggcggcaacacagatgtgctgatggagggcgtgaagacagaggtggaggacaccctgaccccacctccttctgatgctggcagccccttccagagcagccccctgagcctgggcagccggggcagcggcagcggcggcagcggcagtgacagcgagccagacagccctgtgtttgaggacagcaaggccaagccagagcagaggcccagcctgcacagccggggcatgctggacaggagccggctggccctgtgcaccctggtgttcctgtgcctgagctgcaaccccctggccagcctgctgggcgcccggggcctgcccagccccagcgacaccacctctgtgtaccacagccctggaagaaatgtgctgggcacagagagcagagatggccctggctgggcccagtggctgctgccccctgtggtgtggctgctgaatggcctgctggtgctggtgtccctggtgctgctgtttgtgtatggagagcctgtgacccggccccacagcggccctgctgtgtacttctggaggcacaggaagcaggccgacctggacctggcccggggggactttgcccaggccgcccagcagctgtggctggccctgcgggccctgggccggcccctgcccaccagccacctggacctggcctgcagcctgctgtggaacctgatccgccacctgctgcagaggctgtgggtgggccgctggctggccggccgggccggcggcctgcagcaggactgtgccctgcgggtggatgccagcgccagcgccagagatgctgccctggtgtaccacaagctgcaccagctgcacaccatgggcaagcacactggaggccacctgacagccaccaacctggccctgagcgccctgaacctggctgaatgtgctggagatgctgtgtctgtggccaccctggccgagatctacgtggccgccgccctgcgggtgaagaccagcctgccccgggccctgcacttcctgacccgcttcttcctgagcagcgcccggcaggcctgcctggcccagagcggctctgtgcccccagccatgcagtggctgtgccaccctgtgggccaccgcttctttgtggatggagactggagcgtgctgagcaccccctgggagagcctgtacagcctggccggcaaccctgtggaccccctggcccaggtgacccagctgttccgggagcacctgctggagcgggccctgaactgtgtgacccagcccaaccccagccctggcagcgcagatggagacaaggagttcagtgatgccctgggctacctgcagctgctgaacagctgcagtgatgctgctggggccccagcctacagcttcagcatcagcagctccatggccaccaccaccggggtggaccctgtggccaagtggtgggccagcctgacagctgtggtgatccactggctgcggagagatgaggaggccgctgagcggctgtgccccctggtggagcacctgccccgggtgctgcaggagagcgagcggcccctgcccagggctgccctgcacagcttcaaggccgcccgggccctgctgggctgtgccaaggccgagagcggccctgccagcctgaccatctgtgagaaggccagcggctacctgcaggacagcctggccaccaccccagccagcagcagcattgacaaggctgtgcagctgttcctgtgtgacctgctgctggtggtgaggaccagcctgtggaggcagcagcagcccccagccccagccccagctgcccagggcaccagcagccggccccaggccagcgccctggagctgcggggcttccagagggacctgagcagcctgcggcggctggcccagagcttccggcctgccatgagaagagtcttcctgcacgaggccacagcccggctgatggccggggccagccccaccaggacccaccagctgctggacaggagcctgcggcggcgggccggccctgggggcaaaggaggagctgtggccgagctggagccccggcccacccggcgggagcacgccgaggccctgctgctggccagctgctacctgcccccaggcttcctgagcgcccctggccagagggtgggcatgctggccgaggccgcccggaccctggagaagctgggggaccggcggctgctgcatgactgccagcagatgctgatgaggctgggcggcggcaccaccgtgaccagcagctag

SEQ ID NO: 22029 - DNA, 3222 bp, Artificial Sequence
  Description of Artificial Sequence: Synthetic coding sequence
atggactgcacctttgaggacatgctgcagctgatcaacaaccaggacagcgacttccctggcctgtttgatcctccccagcctgcccccacccccctgaagatgtaccccagcatgcctgccttcagccctggccctggcatcaaggaggagagcgtgcccctgagcatcctgcagacccccaccccccagcccctgcccggggccctgctgccccagagcttccctgccccagccccaccccagttcagcagcacccctgtgctgggctaccccagccccccaggcggcttcagcacaggcagccccccaggcaacacccagcagcccctgcccggcctgcccctggccagccccccaggagtgccccctgtgtccctgcacacccaggtgcagagcgtggtgccccagcagctgctgactgtgacagctgcccccacagctgcccctgtgaccaccaccgtgaccagccagatccagcaggtgcctgtgctgctgcagccccacttcatcaaggctgacagcctgctgctgacagccatgaagacagatggagccaccgtgaaggctgctggcctgagccccctggtgtctggcaccaccgtgcagacaggccccctgcccaccctggtgtctgggggcaccatcctggccaccgtgcccctggtggtggatgctgagaagctgcccatcaaccggctggccgccggcagcaaggccccagccagcgcccagagcagaggagagaagaggacagcccacaatgccatcgagaagcgctaccgcagcagcatcaatgacaagatcatcgagctgaaggacctggtggtgggcacagaggccaagctgaacaagtctgctgtgctgaggaaggccatcgactacatccgcttcctgcagcacagcaaccagaagctgaagcaggagaacctgagcctgaggacagctgtgcacaagagcaagagcctgaaggacctggtgtctgcctgtggcagcggcggcaacacagatgtgctgatggagggcgtgaagacagaggtggaggacaccctgaccccaccacccagtgatgctggcagccccttccagagcagccccctgagcctgggcagccggggcagcggcagcggcggcagcggcagtgacagcgagccagacagccctgtgtttgaggacagcaaggccaagccagagcagaggcccagcctgcacagccggggcatgctggacaggagccggctggccctgtgcaccctggtgttcctgtgcctgagctgcaaccccctggccagcctgctgggcgcccggggcctgcccagccccagcgacaccacctctgtgtaccacagccctggaagaaatgtgctgggcacagagagcagagatggccctggctgggcccagtggctgctgccccctgtggtgtggctgctgaatggcctgctggtgctggtgtccctggtgctgctgtttgtgtatggagagcctgtgacccggccccacagcggccctgctgtgtacttctggaggcacaggaagcaggccgacctggacctggcccggggggactttgcccaggccgcccagcagctgtggctggccctgcgggccctgggccggcccctgcccaccagccacctggacctggcctgcagcctgctgtggaacctgatccgccacctgctgcagaggctgtgggtgggccgctggctggccggccgggccggcggcctgcagcaggactgtgccctgcgggtggatgccagcgccagcgccagagatgctgccctggtgtaccacaagctgcaccagctgcacaccatgggcaagcacactggaggccacctgacagccaccaacctggccctgagcgccctgaacctggccgagtgtgctggagatgctgtgtctgtggccaccctggccgagatctacgtggccgccgccctgcgggtgaagaccagcctgccccgggccctgcacttcctgacccgcttcttcctgagcagcgcccggcaggcctgcctggcccagagcggctctgtgcccccagccatgcagtggctgtgccaccctgtgggccaccgcttctttgtggatggagactggagcgtgctgagcaccccctgggagagcctgtacagcctggccggcaaccctgtggaccccctggcccaggtgacccagctgttccgggagcacctgctggagcgggccctgaactgtgtgacccagcccaaccccagccctggcagcgcagatggagacaaggagttcagtgatgccctgggctacctgcagctgctgaacagctgcagtgatgctgctggggccccagcctacagcttcagcatcagcagctccatggccaccaccactggagtggaccctgtggccaagtggtgggccagcctgacagctgtggtgatccactggctgcggagagatgaggaggccgctgagcggctgtgccccctggtggagcacctgccccgggtgctgcaggagagcgagcggcccctgccccgggccgccctgcacagcttcaaggccgcccgggccctgctgggctgtgccaaggccgagagcggccctgccagcctgaccatctgtgagaaggccagcggctacctgcaggacagcctggccaccaccccagccagcagcagcattgacaaggctgtgcagctgttcctgtgtgacctgctgctggtggtgaggaccagcctgtggaggcagcagcagcccccagccccagccccagctgcccagggcaccagcagccggccccaggccagcgccctggagctgcggggcttccagagggacctgagcagcctgcggcggctggcccagagcttccggcctgccatgagaagagtcttcctgcacgaggccacagcccggctgatggccggggccagccccaccaggacccaccagctgctggacaggagcctgcggaggagagctggccctgggggcaagggcggcgctgtggccgagctggagccccggcccacccggcgggagcacgccgaggccctgctgctggccagctgctacctgcccccaggcttcctgagcgcccctggccagagggtgggcatgctggccgaggccgcccggaccctggagaagctgggggaccggcggctgctgcatgactgccagcagatgctgatgaggctgggcggcggcaccaccgtgaccagcagctag

SEQ ID NO: 22030 - DNA, 1413 bp, Artificial Sequence
  Description of Artificial Sequence: Synthetic coding sequence
atggatgagccccccttcagcgaggccgccctggagcaggccctgggggagccctgtgacctggatgctgccctgctgacagacatcgaggacatgctgcagctgatcaacaaccaggacagcgacttccctggcctgtttgatcctccctatgccggcagcggggccggcggcacagatcctgccagcccagacaccagcagccctggcagcctgagccccccaccagccaccctgagcagcagcctggaggccttcctgagcggcccccaggccgcccccagccccctgagccccccccagcctgcccccacccccctgaagatgtaccccagcatgcctgccttcagccctggccctggcatcaaggaggagagcgtgcccctgagcatcctgcagacccccaccccccagcccctgcccggggccctgctgccccagagcttccctgccccagccccaccccagttcagcagcacccctgtgctgggctaccccagccccccaggcggcttcagcacaggcagccccccaggcaacacccagcagcccctgcccggcctgcccctggccagccccccaggagtgccccctgtgtccctgcacacccaggtgcagagcgtggtgccccagcagctgctgactgtgacagctgcccccacagctgcccctgtgaccaccaccgtgaccagccagatccagcaggtgcctgtgctgctgcagccccacttcatcaaggctgacagcctgctgctgacagccatgaagacagatggagccaccgtgaaggctgctggcctgagccccctggtgtctggcaccaccgtgcagacaggccccctgcccaccctggtgtctgggggcaccatcctggccaccgtgcccctggtggtggatgctgagaagctgcccatcaaccggctggccgccggcagcaaggccccagccagcgcccagagcagaggagagaagaggacagcccacaatgccatcgagaagcgctaccgcagcagcatcaatgacaagatcatcgagctgaaggacctggtggtgggcacagaggccaagctgaacaagtctgctgtgctgaggaaggccatcgactacatccgcttcctgcagcacagcaaccagaagctgaagcaggagaacctgagcctgaggacagctgtgcacaagagcaagagcctgaaggacctggtgtctgcctgtggcagcggcggcaacacagatgtgctgatggagggcgtgaagacagaggtggaggacaccctgaccccaccacccagtgatgctggcagccccttccagagcagccccctgagcctgggcagccggggcagcggcagcggcggcagcggcagtgacagcgagccagacagccctgtgtttgaggacagcaagacagaatag

SEQ ID NO: 22031 - DNA, 645 bp, Artificial Sequence
  Description of Artificial Sequence: Synthetic coding sequence
ctgatgcctgcctgcctgcccgggaagcacactggaggccacctgacagccaccaacctggccctgagcgccctgaacctggctgaatgtgctggagatgctgtgtctgtggccaccctggccgagatctacgtggccgccgccctgcgggtgaagaccagcctgccccgggccctgcacttcctgacccgcttcttcctgagcagcgcccggcaggcctgcctggcccagagcggctctgtgcccccagccatgcagtggctgtgccaccctgtgggccaccgcttctttgtggatggagactggagcgtgctgagcaccccctgggagagcctgtacagcctggccggcaaccctgtggaccccctggcccaggtgacccagctgttccgggagcacctgctggagcgggccctgaactgtgtgacccagcccaaccccagccctggcagcgcagatggagacaaggagttcagtgatgccctgggctacctgcagctgctgaacagctgcagtgatgctgctggggccccagcctacagcttcagcatcagcagctccatggccaccaccaccggggacccctgccccggccagctgtgcacccccagccggctgcccggcccctgctgggccgtgccctag

SEQ ID NO: 22032 - DNA, 747 bp, Artificial Sequence
  Description of Artificial Sequence: Synthetic coding sequence
atggagcgggccagcctcatccagaaggccaagctggccgagcaggccgagagatatgaggacatggccgccttcatgaagggagctgtggagaagggggaggagctgagctgtgaggagaggaacctgctgtctgtggcctacaagaatgtggtgggcggccagagagctgcctggagggtgctgagcagcattgagcagaagagcaatgaggagggcagcgaggagaagggccctgaggtgcgggagtaccgggagaaggtggagacagagctgcagggcgtgtgtgacacagtgctgggcctgctggacagccacctgatcaaggaggccggagatgctgagagcagggtcttctacctgaagatgaagggggactactaccgctacctggccgaggtggccactggagatgacaagaagaggatcatcgacagcgcccggagcgcctaccaggaggccatggacatcagcaagaaggagatgccacccaccaaccccatccggctgggcctggccctgaacttctctgtgttccactatgaaattgccaacagccctgaggaggccatcagcctggccaagaccacctttgatgaggccatggctgacctgcacaccctgtctgaggacagctacaaggacagcaccctcatcatgcagctgctgcgggacaacctgaccctgtggacagctgacaatgctggggaggagggcggggaggccccccaggagccccagagctag

SEQ ID NO: 22033 - DNA, 651 bp, Artificial Sequence
  Description of Artificial Sequence: Synthetic coding sequence
atggagcgggccagcctcatccagaaggccaagctggccgagcaggccgagagatatgaggacatggccgccttcatgaagggagctgtggagaagggggaggagctgagctgtgaggagaggaacctgctgtctgtggcctacaagaatgtggtgggcggccagagagctgcctggagggtgctgagcagcattgagcagaagagcaatgaggagggcagcgaggagaagggccctgaggtgcgggagtacagagtcttctacctgaagatgaagggggactactaccgctacctggccgaggtggccactggagatgacaagaagaggatcatcgacagcgcccggagcgcctaccaggaggccatggacatcagcaagaaggagatgccacccaccaaccccatccggctgggcctggccctgaacttctctgtgttccactatgaaattgccaacagccctgaggaggccatcagcctggccaagaccacctttgatgaggccatggctgacctgcacaccctgtctgaggacagctacaaggacagcaccctcatcatgcagctgctgcgggacaacctgaccctgtggacagctgacaatgctggggaggagggcggggaggccccccaggagccccagagctag

SEQ ID NO: 22034 - DNA, 3702 bp, Artificial Sequence
  Description of Artificial Sequence: Synthetic coding sequence
atgggcttcctgaagctgattgaaattgagaacttcaagagctacaagggccggcagatcatcggccccttccagcgcttcaccgccatcatcggccccaacggcagcggcaagagcaacctgatggatgccatcagctttgtgctgggggagaagaccagcaacctgcgggtgaagaccctgcgggacctgatccacggggcccctgtgggcaagccagctgccaacagagcctttgtgtccatggtgtacagcgaggagggcgctgaggacaggacctttgcccgggtcatcgtgggcggcagcagcgagtacaagatcaacaacaaggtggtgcagctgcacgagtacagcgaggagctggagaagctgggcatcctgatcaaggccaggaacttcctggtgttccagggcgctgtggagagcatcgccatgaagaaccccaaggagaggacagccctgtttgaggagatcagccgctctggagagctggcccaggagtatgacaagaggaagaaggagatggtgaaggccgaggaggacacccagttcaactaccacaggaagaagaacattgctgctgagaggaaggaggccaagcaggagaaggaggaggccgaccgctaccagaggctgaaggatgaggtggtgcgggcccaggtgcagctgcagctgttcaagctgtaccacaatgaggtggagattgagaagctgaacaaggagctggccagcaagaacaaggagattgagaaggacaagaagaggatggacaaggtggaggatgagctgaaggagaagaagaaggagctgggcaagatgatgagggagcagcagcagatcgagaaggagatcaaggagaaggacagcgagctgaaccagaagaggccccagtacatcaaggccaaggagaacaccagccacaagatcaagaagctggaggccgccaagaagagcctgcagaatgcccagaagcactacaagaagaggaagggggacatggatgagctggagaaggagatgctgtctgtggagaaggcccggcaggagtttgaggagaggatggaggaggagagccagagccagggccgggacctgaccctggaggagaaccaggtgaagaagtaccaccggctgaaggaggaggccagcaagagagctgccaccctggcccaggagctggagaagttcaacagagaccagaaggctgaccaggaccggctggacctggaggagaggaagaaggtggagacagaggccaagatcaagcagaagctgcgggagattgaggagaaccagaagagaattgagaagctggaggagtacatcaccaccagcaagcagagcctggaggagcagaagaagctggagggggagctgacagaggaggtggagatggccaagagaagaattgatgagatcaacaaggagctgaaccaggtgatggagcagctgggagatgccagaattgaccggcaggagagcagccggcagcagaggaaggccgagatcatggagagcatcaagaggctgtacccaggctctgtgtatggccgcctgattgacctgtgccagcccacccagaagaagtaccagattgctgtgaccaaggtgctgggcaagaacatggatgccatcatcgtggacagcgagaagacaggccgggactgcatccagtacatcaaggagcagagaggagagcctgagaccttcctgcccctggactacctggaggtgaagcccacagatgagaagctgcgggagctgaagggggccaagctggtgattgatgtgatccgctatgagcccccccacatcaagaaggccctgcagtatgcctgtggaaatgccctggtgtgtgacaacgtggaggatgcccggcgcatcgccttcggcggccaccagaggcacaagacagtggccctggatggcaccctcttccagaagtctggagtcatctctggaggagccagtgacctgaaggccaaggcccggcgctgggatgagaaggctgtggacaagctgaaggagaagaaggagcggctgacagaggagctgaaggagcagatgaaggccaagaggaaggaggccgagctgcggcaggtgcagagccaggcccacggcctgcagatgaggctgaagtacagccagagcgacctggagcagaccaagaccaggcacctggccctgaacctgcaggagaagagcaagctggagagcgagctggccaactttggcccccgcatcaatgacatcaagaggatcatccagagccgggagcgggagatgaaggacctgaaggagaagatgaaccaggtggaggatgaggtgtttgaggagttctgccgggagattggagtgaggaacatccgggagtttgaggaggagaaggtgaagaggcagaatgaaattgccaagaagaggctggagtttgagaaccagaagacccggctgggcatccagctggactttgagaagaaccagctgaaggaggaccaggacaaggtgcacatgtgggagcagacagtgaagaaggatgaaaatgaaattgagaagctgaagaaggaggagcagaggcacatgaagatcattgatgagaccatggcccagctgcaggacctgaagaaccagcacctggccaagaagtctgaggtgaatgacaagaaccacgagatggaggagatcaggaagaagctgggcggggccaacaaggagatgacccacctgcagaaggaggtgacagccatcgagaccaagctggagcagaagagaagtgacagacacaacctgctgcaggcctgcaagatgcaggacatcaagctgcccctgagcaagggcaccatggatgacatcagccaggaggagggcagcagccagggcgaggacagcgtgtctggcagccagaggatcagcagcatctatgcccgggaggccctgattgaaattgattatggagacctgtgtgaggacctgaaggatgcccaggccgaggaggagatcaagcaggagatgaacaccctgcagcagaagctgaatgagcagcagagcgtgctgcagagaattgctgcccccaacatgaaggccatggagaagctggagagcgtgcgggacaagttccaggagaccagtgatgaatttgaagctgccaggaagagggccaagaaggccaagcaggcctttgagcagatcaagaaggagagatttgaccgcttcaatgcctgctttgagagcgtggccaccaacattgatgagatctacaaggccctgagcaggaacagcagcgcccaggccttcctgggcccagaaaatcctgaggagccctacctggatggcatcaactacaactgtgtggcccctgggaagcgcttccggcccatggacaacctgtctggaggagagaagacagtggccgccctggccctgctgtttgccatccacagctacaagccagcccccttctttgtgctggatgaaattgatgctgccctggacaacaccaacatcggcaaggtggccaactacatcaaggagcagagcacctgcaacttccaggccatcgtcatcagcctgaaggaggagttctacaccaaggccgagagcctgattggagtgtacccagagcagggcgactgtgtgatcagcaaggtgctgacctttgacctgaccaagtacccagatgccaaccccaaccccaatgagcagtag

SEQ ID NO: 22035 - DNA, 612 bp, Artificial Sequence
  Description of Artificial Sequence: Synthetic coding sequence
atgggcttcctgaagctgattgaaattgagaacttcaagagctacaagggccggcagatcatcggccccttccagcgcttcaccgccatcatcggccccaacggcagcggcaagagcaacctgatggatgccatcagctttgtgctgggggagaagaccagcaacctgcgggtgaagaccctgcgggacctgatccacggggcccctgtgggcaagccagctgccaacagagcctttgtgtccatggtgtacagcgaggagggcgctgaggacaggacctttgcccgggtcatcgtgggcggcagcagcgagtacaagatcaacaacaaggtggtgcagctgcacgagtacagcgaggagctggagaagctgggcatcctgatcaaggccaggaacttcctggtgttccagggctgctgcggcatctactgccacgagacccccaagaggggccagctgtacctgaagatcagccgcagcggggagctggcccaggagtatgacaagaggaagaaggagatggtgaaggccgaggaggacacccagttcaactaccacaggaagaagaacattgctgctgagaggaaggaggccaagcaggagaaggagtag

SEQ ID NO: 22036 - DNA, 1551 bp, Artificial Sequence
  Description of Artificial Sequence: Synthetic coding sequence
atgggcttcctgaagctgattgaaattgagaacttcaagagctacaagggccggcagatcatcggccccttccagcgcttcaccgccatcatcggccccaacggcagcggcaagagcaacctgatggatgccatcagctttgtgctgggggagaagaccagcaacctgcgggtgaagaccctgcgggacctgatccacggggcccctgtgggcaagccagctgccaacagagcctttgtgtccatggtgtacagcgaggagggcgctgaggacaggacctttgcccgggtcatcgtgggcggcagcagcgagtacaagatcaacaacaaggtggtgcagctgcacgagtacagcgaggagctggagaagctgggcatcctgatcaaggccaggaacttcctggtgttccaggtgaagaagtaccaccggctgaaggaggaggccagcaagagagctgccaccctggcccaggagctggagaagttcaacagagaccagaaggctgaccaggaccggctggacctggaggagaggaagaaggtggagacagaggccaagatcaagcagaagctgcgggagattgaggagaaccagaagagaattgagaagctggaggagtacatcaccaccagcaagcagagcctggaggagcagaagaagctggagggggagctgacagaggaggtggagatggccaagagaagaattgatgagatcaacaaggagctgaaccaggtgatggagcagctgggagatgccagaattgaccggcaggagagcagccggcagcagaggaaggccgagatcatggagagcatcaagaggctgtacccaggctctgtgtatggccgcctgattgacctgtgccagcccacccagaagaagtaccagattgctgtgaccaaggtgctgggcaagaacatggatgccatcatcgtggacagcgagaagacaggccgggactgcatccagtacatcaaggagcagagaggagagcctgagaccttcctgcccctggactacctggaggtgaagcccacagatgagaagctgcgggagctgaagggggccaagctggtgattgatgtgatccgctatgagcccccccacatcaagaaggccctgcagtatgcctgtggaaatgccctggtgtgtgacaacgtggaggatgcccggcgcatcgccttcggcggccaccagaggcacaagacagtggccctggatggcaccctcttccagaagtctggagtcatctctggaggagccagtgacctgaaggccaaggcccggcgctgggatgagaaggctgtggacaagctgaaggagaagaaggagcggctgacagaggagctgaaggagcagatgaaggccaagaggaaggaggccgagctgcggcaggtgcagagccaggcccacggcctgcagatgaggctgaagtacagccagagcgacctggagcagaccaagaccaggcacctggccctgaacctgcaggtgggccctggcctgcagccctgcagccccaaggccatccacaccttcctggcctag

SEQ ID NO: 22037 - DNA, 870 bp, Artificial Sequence
  Description of Artificial Sequence: Synthetic coding sequence
tgatggtacacccccacccccttctacagcagcctggaggccgccctgctgaacttccggcccagcgcccctgtgttcaggatgctggaggtgtccatccccaccccccacagatatgtgcggggcaagagcaacctgatggatgccatcagctttgtgctgggggagaagaccagcaacctgcgggtgaagaccctgcgggacctgattcatggagcccctgtgggcaagccagctgccaacagagcctttgtgtccatggtgtacagcgaggagggcgctgaggacaggacctttgcccgggtgattgtgggcggcagcagcgagtacaagatcaacaacaaggtggtgcagctgcacgagtacagcgaggagctggagaagctgggcatcctgatcaaggccaggaacttcctggtgttccagggcgctgtggagagcatcgccatgaagaaccccaaggagaggacagccctgtttgaggagatcagccgcagcggggagctggcccaggagtatgacaagaggaagaaggagatggtgaaggccgaggaggacacccagttcaactaccacaggaagaagaacattgctgctgagaggaaggaggccaagcaggagaaggaggaggccgaccgctaccagaggctgaaggatgaggtggtgcgggcccaggtgcagctgcagctgttcaagctgtaccacaatgaggtggagattgagaagctgaacaaggagctggccagcaagaacaaggagattgagaaggacaagaagaggatggacaaggtggaggatgagctgaaggagaagaagaaggagctgggcaagatgatgagggagcagcagcagatcgagaaggagatctag

SEQ ID NO: 22038 - DNA, 1995 bp, Artificial Sequence
  Description of Artificial Sequence: Synthetic coding sequence
atgtctggagtgcggggcctgagccggctgctgagcgcccggcggctggccctggccaaggcctggcccaccgtgctgcagacaggcacccggggcttccacttcaccgtggatggcaacaagagggccagcgccaaggtgtctgacagcatcagcgcccagtaccctgtggtggaccacgagtttgatgctgtggtggtgggcgccggcggggccggcctgcgggccgccttcggcctgtctgaggccggcttcaacacagcctgtgtgaccaagctgttccccaccaggagccacacagtggccgcccagggcggcatcaatgctgccctgggcaacatggaggaggacaactggcgctggcacttctatgacacagtgaagggcagtgactggctgggggaccaggatgccatccactacatgacagagcaggccccagctgctgtggtggagctggagaactacggcatgcccttcagcaggacagaagatggcaagatctaccagagggcctttggaggccagagcctgaagtttgggaagggcggccaggcccaccgctgctgctgcgtggccgacagaacaggccacagcctgctgcacaccctgtatggccgcagcctgcgctatgacaccagctactttgtggagtactttgccctggacctgctgatggagaatggagagtgccggggcgtgattgccctgtgcattgaagatggcagcatccaccgcatccgggccaagaacacagtggtggccaccggcggctacggccgcacctacttcagctgcaccagcgcccacaccagcactggagatggaacagccatgatcaccagggctggcctgccctgccaggacctggagtttgtgcagttccaccccaccggcatctatggagctggctgcctgatcacagagggctgccgcggggagggcggcatcctgatcaacagccagggcgagcgcttcatggagagatatgcccctgtggccaaggacctggccagcagagatgtggtgagccgctccatgaccctggagatccgggagggccggggctgcggccctgagaaggaccacgtgtacctgcagctgcaccacctgcccccagagcagctggccacccggctgcccggcatcagcgagacagccatgatctttgctggggtggatgtgaccaaggagcccatccctgtgctgcccaccgtgcactacaacatgggcggcatccccaccaactacaagggccaggtgctgcggcacgtgaatggccaggaccagatcgtgcccggcctgtatgcctgtggggaggccgcctgtgcctctgtgcatggagccaaccggctgggcgccaacagcctgctggacctggtggtgtttggccgggcctgtgccctgagcattgaggagagctgcaggcctggggacaaggtgccccccatcaagcccaatgctggggaggagagcgtgatgaacctggacaagctgcgctttgctgatggcagcatccgcaccagcgagctgcggctgtccatgcagaagtccatgcagaaccacgccgctgtgttccgggtgggctctgtgctgcaggagggctgtgggaagatcagcaagctgtatggagacctgaagcacctgaagacctttgaccggggcatggtgtggaacacagacctggtggagaccctggagctgcagaacctgatgctgtgtgccctgcagaccatctacggggctgaggccaggaaggagagcagaggagcccacgcccgggaggactacaaggtgagaattgatgaatatgactacagcaagcccatccagggccagcagaagaagccctttgaggagcactggaggaagcacaccctgtcctatgtggatgtgggcaccgggaaggtgaccctggagtacagacctgtgattgacaagaccctgaatgaggccgactgtgccaccgtgcccccagccatccgcagctactag

SEQ ID NO: 22039 - DNA, 1560 bp, Artificial Sequence
  Description of Artificial Sequence: Synthetic coding sequence
atgtctggagtgcggggcctgagccggctgctgagcgcccggcggctggccctggccaaggcctggcccaccgtgctgcagacaggcacccggggcttccacttcaccgtggatggcaacaagagggccagcgccaaggtgtctgacagcatcagcgcccagtaccctgtggtggaccacgagtttgatgctgtggtggtgggcgccggcggggccggcctgcgggccgccttcggcctgtctgaggccggcttcaacacagcctgtgtgaccaagctgttccccaccaggagccacacagtggccgcccagggcggcatcaatgctgccctgggcaacatggaggaggacaactggcgctggcacttctatgacaccagcactggagatggaacagccatgatcacccgggccggcctgccctgccaggacctggagtttgtgcagttccaccccaccggcatctacggggccggctgcctgatcacagagggctgccgcggggagggcggcatcctgatcaacagccagggcgagcgcttcatggagagatatgcccctgtggccaaggacctggccagcagagatgtggtgagccgctccatgaccctggagatccgggagggccggggctgcggccctgagaaggaccacgtgtacctgcagctgcaccacctgcccccagagcagctggccacccggctgcccggcatcagcgagacagccatgatctttgctggggtggatgtgaccaaggagcccatccctgtgctgcccaccgtgcactacaacatgggcggcatccccaccaactacaagggccaggtgctgcggcacgtgaatggccaggaccagatcgtgcccggcctgtatgcctgtggggaggccgcctgtgcctctgtgcacggggccaaccggctgggcgccaacagcctgctggacctggtggtgtttggccgggcctgtgccctgagcattgaggagagctgcaggcctggggacaaggtgccccccatcaagcccaatgctggggaggagagcgtgatgaacctggacaagctgcgctttgctgatggcagcatccgcaccagcgagctgcggctgtccatgcagaagtccatgcagaaccacgccgctgtgttccgggtgggctctgtgctgcaggagggctgcggcaagatcagcaagctgtatggagacctgaagcacctgaagacctttgaccggggcatggtgtggaacacagacctggtggagaccctggagctgcagaacctgatgctgtgtgccctgcagaccatctatggagctgaggccaggaaggagagcagaggagcccacgcccgggaggactacaaggtgagaattgatgaatatgactacagcaagcccatccagggccagcagaagaagccctttgaggagcactggaggaagcacaccctgtcctatgtggatgtgggcaccgggaaggtgaccctggagtacagacctgtgattgacaagaccctgaatgaagctgactgtgccaccgtgcccccagccatccgcagctactag

SEQ ID NO: 22040 - DNA, 6645 bp, Artificial Sequence
  Description of Artificial Sequence: Synthetic coding sequence
atgaagaggaaggagagaattgcccggcggctggagggcattgaaaatgacacccagcccatcctgctgcagagctgcaccggcctggtgacccaccggctgctggaggaggacaccccccgctacatgagggccagtgaccctgccagcccccacatcggccgcagcaatgaggaggaggagaccagtgacagcagcctggagaagcagaccaggagcaagtactgcacagagaccagcggcgtgcatggagacagcccctacggcagcggcaccatggacacccacagcctggagagcaaggccgagagaattgcccgctacaaggccgagcggcggcggcagctggccgagaagtatggcctgaccctggaccctgaggccgacagcgagtacctgagccgctacaccaagagcaggaaggagccagatgctgtggagaagaggggcggcaagagtgacaagcaggaggagagcagcagagatgccagcagcctgtacccaggcacagagaccatgggcctgcggacctgtgccggggagagcaaggactatgccctgcacgtgggagatggcagcagtgaccctgaggtgctgctgaacatcgagaaccagaggcggggccaggagctgagcgccacccggcaggcccatgacctgagccctgctgctgagagcagcagcaccttctccttcagcggccgggacagcagcttcacagaggtgcccaggagccccaagcacgcccacagcagcagcctgcagcaggccgccagccgcagccccagctttggagacccccagctgagccctgaggcccggcccagcacaggcaagcccaagcatgagtggttcctgcagaaggacagcgagggggacacccccagcctcatcaactggcccagccgggtgaaggtgcgggagaagctggtgaaggaggagagcgccaggaacagccctgagctggccagcgagagcgtgacccagaggaggcaccagcctgcccctgtgcactacgtgtccttccagagcgagcacagcgcctttgacagagtgcccagcaaggctgctggcagcacccggcagcccatccggggctacgtgcagcctgctgacaccggccacacagccaagctggtgaccccagagaccccagaaaatgccagcgagtgctcctgggtggccagcgccacccagaatgtgcccaagccacccagcctgactgtgctggagggagatggccgggacagccctgtgctgcacgtgtgtgagagcaaggccgaggaggaggagggggagggggagggggaggagaaggaggaggatgtgtgcttcacagaggccctggagcagagcaagaagaccctgctggccctggagggagatggcctggtgcgcagccctgaggaccccagcagaaatgaagattttgggaagccagctgtgtccacagtgaccctggagcaccagaaggagctggagaatgtggcccagcccccccaggccccccaccagcccacagagaggacaggccgctctgagatggtgctgtacatccagagcgagcctgtgtcccaggatgccaagcccaccggccacaaccgggaggccagcaagaagaggaaggtgaggaccaggagcctgagtgacttcaccggccccccccagctgcaggccctgaagtacaaggaccctgccagccggcgggagctggagctgcccagcagcaagacagagggcccctacggggagatctccatgctggacaccaaggtgtctgtggcccagctgcggagcgccttcctggccagcgccaatgcctgcagaagacctgagctgaagagccgggtggagaggtctgctgagggccctggcctgcccaccggggtggagcgggagcggggcagcaggaagccccggcgctacttcagccctggagagagcaggaagaccagcgagcgcttccgcacccagcccatcaccagcgctgagaggaaggagagtgaccgctgcaccagccacagcgagacccccaccgtggatgatgaggagaaggtggatgagcgggccaagctgtctgtggccgccaagaggctgctcttccgggagatggagaagagctttgatgagcagaatgtgcccaagaggaggagcaggaacacagctgtggagcagaggctgcggcggctgcaggacaggagcctgacccagcccatcaccacagaggaggtggtgattgctgccacagagcccatcccagccagctgcagcggcggcacccaccctgtgatggcccggctgcccagccccaccgtggcccggtctgctgtgcagcctgcccggctgcaggccagcgcccaccagaaggccctggccaaggaccagaccaatgaaggcaaggagctggccgagcagggcgagccagacagcagcaccctgagcctggccgagaagctggccctcttcaacaagctgagccagcctgtgtccaaggccatcagcaccaggaacagaattgacacccggcagaggaggatgaatgcccgctaccagacccagcctgtgaccctgggggaggtggagcaggtgcagagcggcaagctgatccccttctccccagctgtgaacacctctgtgtccacagtggccagcacagtggcccccatgtatgctggggacctgcggaccaagccacccctggaccacaatgccagcgccacagactacaagttcagcagcagcattgagaacagcgacagccctgtgcgcagcatcctgaagagccaggcctggcagcccctggtggagggctctgaaaataaaggcatgctgcgggagtatggagaaacagagagcaagagggccctgaccggccgggacagcggcatggagaagtatggcagctttgaggaggccgaggccagctaccccatcctgaacagagcccgggagggggacagccacaaggagagcaaatatgctgtgccccggcggggcagcctggagcgggccaacccccccatcacccacctgggagatgagcccaaggagttctccatggccaagatgaatgcccagggcaacctggacctgcgggaccggctgccctttgaggagaaggtggaggtggagaatgtgatgaagaggaagttcagcctgcgggctgctgagtttggagagcccaccagcgagcagacaggaacagctgctgggaagaccatcgcccagaccacagcccctgtgtcctggaagccccaggacagcagcgagcagccccaggagaagctgtgcaagaacccctgtgccatgtttgctgctggggagatcaagacccccactggagagggcctgctggacagccccagcaagaccatgagcatcaaggagcggctggccctgctgaagaagtctggagaggaggactggaggaaccggctgagccggcggcaggagggcggcaaggccccagccagcagcctgcacacccaggaggccggccgcagcctcatcaagaagagggtgacagagagccgggagagccagatgaccatcgaggagaggaagcagctgatcaccgtgcgggaggaggcctggaagacccggggcagaggagctgccaatgacagcacccagttcaccgtggccggccgcatggtgaagaagggcctggccagccccacagccatcacccctgtggccagccccatctgtgggaagacccggggcaccacccctgtgtccaagcccctggaggacatcgaggcccggccagacatgcagctggagagtgacctgaagctggaccggctggagaccttcctgcggcggctgaacaacaaggtgggcggcatgcatgaaacagtgctgactgtgacaggcaagtctgtgaaggaggtgatgaagccagatgatgatgagacctttgccaagttctacagatctgtggactacaacatgcccaggagccctgtggagatggatgaggactttgatgtgatctttgacccctatgcccccaagctgaccagctctgtggccgagcacaagagagctgtgcggcccaagagaagagtgcaggccagcaagaaccccctgaagatgctggccgcccgggaggacctgctgcaggagtacacagagcagaggctgaatgtggccttcatggagagcaagaggatgaaggtggagaagatgagcagcaacagcaacttcagcgaggtgaccctggccggcctggccagcaaggagaacttcagcaatgtgtccctgcggtctgtgaacctgacagagcagaacagcaacaacagcgctgtgccctacaagaggctgatgctgctgcagatcaagggcagaagacatgtgcagacccggctggtggagccccgggccagcgccctgaacagcggggactgcttcctgctgctgagcccccactgctgcttcctgtgggtgggggagtttgccaacgtgattgagaaggccaaggccagcgagctggccaccctcatccagaccaagcgggagctgggctgccgggccacctacatccagaccatcgaggagggcatcaacacccacacccatgctgccaaggacttctggaagctgctgggcggccagaccagctaccagagcgctggggaccccaaggaggatgagctgtatgaagctgccatcatcgagaccaactgcatctaccgcctgatggatgacaagctggtgcctgatgatgactactggggcaagatccccaagtgcagcctgctgcagcccaaggaggtgctggtgtttgattttggaagtgaggtgtatgtgtggcacggcaaggaggtgaccctggcccagaggaagatcgccttccagctggccaagcacctgtggaatggcacctttgattatgagaactgtgacatcaaccccctggaccctggagagtgcaaccccctcatccccaggaagggccagggccgcccagactgggccatcttcggccgcctgacagagcacaatgagaccatcctcttcaaggagaagttcctggactggacagagctgaagaggagcaatgagaagaaccctggagagctggcccagcacaaggaggaccccaggacagatgtgaaggcctatgatgtgaccaggatggtgtccatgccccagaccacagctggcaccatcctggatggagtgaatgtgggccggggctacggcctggtggagggccatgaccggcggcagtttgagatcacctctgtgtctgtggatgtgtggcacatcctggagtttgactacagccggctgcccaagcagagcatcggccagttccacgagggagatgcctacgtggtgaagtggaagttcatggtgtccacagctgtgggcagccggcagaagggggagcacagcgtgcgggccgccggcaaggagaagtgtgtgtacttcttctggcagggccgccacagcacagtgtctgagaagggcaccagcgccctgatgacagtggagctggatgaggagcggggggcccaggtgcaggtgctgcagggcaaggagcccccctgcttcctgcagtgcttccagggcggcatggtggtgcacagcggcagaagagaggaggaggaggagaatgtgcagagcgagtggaggctgtactgtgtgcggggggaggtgcctgtggagggcaacctgctggaggtggcctgccactgcagcagcctgcggagcaggacctccatggtggtgctgaatgtgaacaaggccctgatctacctgtggcacggctgcaaggcccaggcccacaccaaggaggtgggccgcacagctgccaacaagatcaaggagcagtgccccctggaggccggcctgcacagcagcagcaaggtgaccatccatgaatgtgatgagggcagcgagcccctgggcttctgggatgccctgggcagaagagacaggaaggcctatgactgcatgctgcaggaccccggcagcttcaactttgcccccaggctcttcatcctgagcagcagcagcggggactttgctgccacagaatttgtgtacccagcccgggcccccagcgtggtgtcctccatgcccttcctgcaggaggacctgtacagcgccccccagcctgccctcttcctggtggacaaccaccacgaggtgtacctgtggcagggctggtggcccatcgagaacaagatcactggaagtgcccgcatccgctgggccagtgacaggaagagcgccatggagaccgtgctgcagtactgcaagggcaagaacctgaagaagccagcccccaagagctacctgattcatgctggcctggagcccctgaccttcaccaacatgttccccagctgggagcaccgggaggacattgctgagatcacagagatggacacagaggtgagcaaccagatcaccctggtggaggatgtgctggccaagctgtgcaagaccatctaccccctggccgacctgctggcccggcccctgcctgagggcgtggaccccctgaagctggagatctacctgacagatgaagattttgaatttgccctggacatgaccagagatgagtacaatgccctgcctgcctggaagcaggtgaacctgaagaaggccaagggcctcttctag

SEQ ID NO: 22041 - DNA, 6645 bp, Artificial Sequence; identical to SEQ ID NO: 22040
  Description of Artificial Sequence: Synthetic coding sequence

SEQ ID NO: 22042 - DNA, 5367 bp, Artificial Sequence
  Description of Artificial Sequence: Synthetic coding sequence
atgaagaggaaggagagaattgcccggcggctggagggcattgaaaatgacacccagcccatcctgctgcagagctgcaccggcctggtgacccaccggctgctggaggaggacaccccccgctacatgagggccagtgaccctgccagcccccacatcggccgcagcaatgaggaggaggagaccagtgacagcagcctggagaagcagaccaggagcaagtactgcacagagaccagcggcgtgcatggagacagcccctacggcagcggcaccatggacacccacagcctggagagcaaggccgagagaattgcccgctacaaggccgagcggcggcggcagctggccgagaagtatggcctgaccctggaccctgaggccgacagcgagtacctgagccgctacaccaagagcaggaaggagccagatgctgtggagaagaggggcggcaagagtgacaagcaggaggagagcagcagagatgccagcagcctgtacccaggcacagagaccatgggcctgcggacctgtgccggggagagcaaggactatgccctgcacgtgggagatggcagcagtgaccctgaggtgctgctgaacatcgagaaccagaggcggggccaggagctgagcgccacccggcaggcccatgacctgagccctgctgctgagagcagcagcaccttctccttcagcggccgggacagcagcttcacagaggtgcccaggagccccaagcacgcccacagcagcagcctgcagcaggccgccagccgcagccccagctttggagacccccagctgagccctgaggcccggccccgctgcaccagccacagcgagacccccaccgtggatgatgaggagaaggtggatgagcgggccaagctgtctgtggccgccaagaggctgctcttccgggagatggagaagagctttgatgagcagaatgtgcccaagaggaggagcaggaacacagctgtggagcagaggctgcggcggctgcaggacaggagcctgacccagcccatcaccacagaggaggtggtgattgctgccaccctgcaggccagcgcccaccagaaggccctggccaaggaccagaccaatgaaggcaaggagctggccgagcagggcgagccagacagcagcaccctgagcctggccgagaagctggccctcttcaacaagctgagccagcctgtgtccaaggccatcagcaccaggaacagaattgacacccggcagaggaggatgaatgcccgctaccagacccagcctgtgaccctgggggaggtggagcaggtgcagagcggcaagctgatccccttctccccagctgtgaacacctctgtgtccacagtggccagcacagtggcccccatgtatgctggggacctgcggaccaagccacccctggaccacaatgccagcgccacagactacaagttcagcagcagcattgagaacagcgacagccctgtgcgcagcatcctgaagagccaggcctggcagcccctggtggagggctctgaaaataaaggcatgctgcgggagtatggagaaacagagagcaagagggccctgaccggccgggacagcggcatggagaagtatggcagctttgaggaggccgaggccagctaccccatcctgaacagagcccgggagggggacagccacaaggagagcaaatatgctgtgccccggcggggcagcctggagcgggccaacccccccatcacccacctgggagatgagcccaaggagttctccatggccaagatgaatgcccagggcaacctggacctgcgggaccggctgccctttgaggagaaggtggaggtggagaatgtgatgaagaggaagttcagcctgcgggctgctgagtttggagagcccaccagcgagcagacaggaacagctgctgggaagaccatcgcccagaccacagcccctgtgtcctggaagccccaggacagcagcgagcagccccaggagaagctgtgcaagaacccctgtgccatgtttgctgctggggagatcaagacccccactggagagggcctgctggacagccccagcaagaccatgagcatcaaggagcggctggccctgctgaagaagtctggagaggaggactggaggaaccggctgagccggcggcaggagggcggcaaggccccagccagcagcctgcacacccaggaggccggccgcagcctcatcaagaagagggtgacagagagccgggagagccagatgaccatcgaggagaggaagcagctgatcaccgtgcgggaggaggcctggaagacccggggcagaggagctgccaatgacagcacccagttcaccgtggccggccgcatggtgaagaagggcctggccagccccacagccatcacccctgtggccagccccatctgtgggaagacccggggcaccacccctgtgtccaagcccctggaggacatcgaggcccggccagacatgcagctggagagtgacctgaagctggaccggctggagaccttcctgcggcggctgaacaacaaggtgggcggcatgcatgaaacagtgctgactgtgacaggcaagtctgtgaaggaggtgatgaagccagatgatgatgagacctttgccaagttctacagatctgtggactacaacatgcccaggagccctgtggagatggatgaggactttgatgtgatctttgacccctatgcccccaagctgaccagctctgtggccgagcacaagagagctgtgcggcccaagagaagagtgcaggccagcaagaaccccctgaagatgctggccgcccgggaggacctgctgcaggagtacacagagcagaggctgaatgtggccttcatggagagcaagaggatgaaggtggagaagatgagcagcaacagcaacttcagcgaggtgaccctggccggcctggccagcaaggagaacttcagcaatgtgtccctgcggtctgtgaacctgacagagcagaacagcaacaacagcgctgtgccctacaagaggctgatgctgctgcagatcaagggcagaagacatgtgcagacccggctggtggagccccgggccagcgccctgaacagcggggactgcttcctgctgctgagcccccactgctgcttcctgtgggtgggggagtttgccaacgtgattgagaaggccaaggccagcgagctggccaccctcatccagaccaagcgggagctgggctgccgggccacctacatccagaccatcgaggagggcatcaacacccacacccatgctgccaaggacttctggaagctgctgggcggccagaccagctaccagagcgctggggaccccaaggaggatgagctgtatgaagctgccatcatcgagaccaactgcatctaccgcctgatggatgacaagctggtgcctgatgatgactactggggcaagatccccaagtgcagcctgctgcagcccaaggaggtgctggtgtttgattttggaagtgaggtgtatgtgtggcacggcaaggaggtgaccctggcccagaggaagatcgccttccagctggccaagcacctgtggaatggcacctttgattatgagaactgtgacatcaaccccctggaccctggagagtgcaaccccctcatccccaggaagggccagggccgcccagactgggccatcttcggccgcctgacagagcacaatgagaccatcctcttcaaggagaagttcctggactggacagagctgaagaggagcaatgagaagaaccctggagagctggcccagcacaaggaggaccccaggacagatgtgaaggcctatgatgtgaccaggatggtgtccatgccccagaccacagctggcaccatcctggatggagtgaatgtgggccggggctacggcctggtggagggccatgaccggcggcagtttgagatcacctctgtgtctgtggatgtgtggcacatcctggagtttgactacagccggctgcccaagcagagcatcggccagttccacgagggagatgcctacgtggtgaagtggaagttcatggtgtccacagctgtgggcagccggcagaagggggagcacagcgtgcgggccgccggcaaggagaagtgtgtgtacttcttctggcagggccgccacagcacagtgtctgagaagggcaccagcgccctgatgacagtggagctggatgaggagcggggggcccaggtgcaggtgctgcagggcaaggagcccccctgcttcctgcagtgcttccagggcggcatggtggtgcacagcggcagaagagaggaggaggaggagaatgtgcagagcgagtggaggctgtactgtgtgcggggggaggtgcctgtggagggcaacctgctggaggtggcctgccactgcagcagcctgcggagcaggacctccatggtggtgctgaatgtgaacaaggccctgatctacctgtggcacggctgcaaggcccaggcccacaccaaggaggtgggccgcacagctgccaacaagatcaaggagcagtgccccctggaggccggcctgcacagcagcagcaaggtgaccatccatgaatgtgatgagggcagcgagcccctgggcttctgggatgccctgggcagaagagacaggaaggcctatgactgcatgctgcaggaccccggcagcttcaactttgcccccaggctcttcatcctgagcagcagcagcggggactttgctgccacagaatttgtgtacccagcccgggcccccagcgtggtgtcctccatgcccttcctgcaggaggacctgtacagcgccccccagcctgccctcttcctggtggacaaccaccacgaggtgtacctgtggcagggctggtggcccatcgagaacaagatcactggaagtgcccgcatccgctgggccagtgacaggaagagcgccatggagaccgtgctgcagtactgcaagggcaagaacctgaagaagccagcccccaagagctacctgattcatgctggcctggagcccctgaccttcaccaacatgttccccagctgggagcaccgggaggacattgctgagatcacagagatggacacagaggtgagcaaccagatcaccctggtggaggatgtgctggccaagctgtgcaagaccatctaccccctggccgacctgctggcccggcccctgcctgagggcgtggaccccctgaagctggagatctacctgacagatgaagattttgaatttgccctggacatgaccagagatgagtacaatgccctgcctgcctggaagcaggtgaacctgaagaaggccaagggcctcttctag

SEQ ID NO: 22043 - DNA, 3387 bp, Artificial Sequence
  Description of Artificial Sequence: Synthetic coding sequence
atgtttgctgctggggagatcaagacccccactggagagggcctgctggacagccccagcaagaccatgagcatcaaggagcggctggccctgctgaagaagtctggagaggaggactggaggaaccggctgagccggcggcaggagggcggcaaggccccagccagcagcctgcacacccaggaggccggccgcagcctcatcaagaaggaggagggcggcgtggctgatgattctgccatcagcaacctgctgtggagggtgacagagagccgggagagccagatgaccatcgaggagaggaagcagctgatcaccgtgcgggaggaggcctggaagacccggggcagaggagctgccaatgacagcacccagttcaccgtggccggccgcatggtgaagaagggcctggccagccccacagccatcacccctgtggccagccccatctgtgggaagacccggggcaccacccctgtgtccaagcccctggaggacatcgaggcccggccagacatgcagctggagagtgacctgaagctggaccggctggagaccttcctgcggcggctgaacaacaaggtgggcggcatgcatgaaacagtgctgactgtgacaggcaagtctgtgaaggaggtgatgaagccagatgatgatgagacctttgccaagttctacagatctgtggactacaacatgcccaggagccctgtggagatggatgaggactttgatgtgatctttgacccctatgcccccaagctgaccagctctgtggccgagcacaagagagctgtgcggcccaagagaagagtgcaggccagcaagaaccccctgaagatgctggccgcccgggaggacctgctgcaggagtacacagagcagaggctgaatgtggccttcatggagagcaagaggatgaaggtggagaagatgagcagcaacagcaacttcagcgaggtgaccctggccggcctggccagcaaggagaacttcagcaatgtgtccctgcggtctgtgaacctgacagagcagaacagcaacaacagcgctgtgccctacaagaggctgatgctgctgcagatcaagggcagaagacatgtgcagacccggctggtggagccccgggccagcgccctgaacagcggggactgcttcctgctgctgagcccccactgctgcttcctgtgggtgggggagtttgccaacgtgattgagaaggccaaggccagcgagctggccaccctcatccagaccaagcgggagctgggctgccgggccacctacatccagaccatcgaggagggcatcaacacccacacccatgctgccaaggacttctggaagctgctgggcggccagaccagctaccagagcgctggggaccccaaggaggatgagctgtatgaagctgccatcatcgagaccaactgcatctaccgcctgatggatgacaagctggtgcctgatgatgactactggggcaagatccccaagtgcagcctgctgcagcccaaggaggtgctggtgtttgattttggaagtgaggtgtatgtgtggcacggcaaggaggtgaccctggcccagaggaagatcgccttccagctggccaagcacctgtggaatggcacctttgattatgagaactgtgacatcaaccccctggaccctggagagtgcaaccccctcatccccaggaagggccagggccgcccagactgggccatcttcggccgcctgacagagcacaatgagaccatcctcttcaaggagaagttcctggactggacagagctgaagaggagcaatgagaagaaccctggagagctggcccagcacaaggaggaccccaggacagatgtgaaggcctatgatgtgaccaggatggtgtccatgccccagaccacagctggcaccatcctggatggagtgaatgtgggccggggctacggcctggtggagggccatgaccggcggcagtttgagatcacctctgtgtctgtggatgtgtggcacatcctggagtttgactacagccggctgcccaagcagagcatcggccagttccacgagggagatgcctacgtggtgaagtggaagttcatggtgtccacagctgtgggcagccggcagaagggggagcacagcgtgcgggccgccggcaaggagaagtgtgtgtacttcttctggcagggccgccacagcacagtgtctgagaagggcaccagcgccctgatgacagtggagctggatgaggagcggggggcccaggtgcaggtgctgcagggcaaggagcccccctgcttcctgcagtgcttccagggcggcatggtggtgcacagcggcagaagagaggaggaggaggagaatgtgcagagcgagtggaggctgtactgtgtgcggggggaggtgcctgtggagggcaacctgctggaggtggcctgccactgcagcagcctgcggagcaggacctccatggtggtgctgaatgtgaacaaggccctgatctacctgtggcacggctgcaaggcccaggcccacaccaaggaggtgggccgcacagctgccaacaagatcaaggagcagtgccccctggaggccggcctgcacagcagcagcaaggtgaccatccatgaatgtgatgagggcagcgagcccctgggcttctgggatgccctgggcagaagagacaggaaggcctatgactgcatgctgcaggaccccggcagcttcaactttgcccccaggctcttcatcctgagcagcagcagcggggactttgctgccacagaatttgtgtacccagcccgggcccccagcgtggtgtcctccatgcccttcctgcaggaggacctgtacagcgccccccagcctgccctcttcctggtggacaaccaccacgaggtgtacctgtggcagggctggtggcccatcgagaacaagatcactggaagtgcccgcatccgctgggccagtgacaggaagagcgccatggagaccgtgctgcagtactgcaagggcaagaacctgaagaagccagcccccaagagctacctgattcatgctggcctggagcccctgaccttcaccaacatgttccccagctgggagcaccgggaggacattgctgagatcacagagatggacacagaggtgagcaaccagatcaccctggtggaggatgtgctggccaagctgtgcaagaccatctaccccctggccgacctgctggcccggcccctgcctgagggcgtggaccccctgaagctggagatctacctgacagatgaagattttgaatttgccctggacatgaccagagatgagtacaatgccctgcctgcctggaagcaggtgaacctgaagaaggccaagggcctcttctag

SEQ ID NO: 22044 - DNA, 2301 bp, Artificial Sequence
  Description of Artificial Sequence: Synthetic coding sequence
atgaagaggaagttcagcctgcgggctgctgagtttggagagcccaccagcgagcagacaggaacagctgctgggaagaccatcgcccagaccacagcccctgtgtcctggaagccccaggacagcagcgagcagccccaggagaagctgtgcaagaacccctgtgccatgtttgctgctggggagatcaagacccccactggagagggcctgctggacagccccagcaagaccatgagcatcaaggagcggctggccctgctgaagaagtctggagaggaggactggaggaaccggctgagccggcggcaggagggcggcaaggccccagccagcagcctgcacacccaggaggccggccgcagcctcatcaagaagagggtgacagagagccgggagagccagatgaccatcgaggagaggaagcagctgatcaccgtgcgggaggaggcctggaagacccggggcagaggagctgccaatgacagcacccagttcaccgtggccggccgcatggtgaagaagggcctggccagccccacagccatcacccctgtggccagccccatctgtgggaagacccggggcaccacccctgtgtccaagcccctggaggacatcgaggcccggccagacatgcagctggagagtgacctgaagctggaccggctggagaccttcctgcggcggctgaacaacaaggtgggcggcatgcatgaaacagtgctgactgtgacaggcaagtctgtgaaggaggtgatgaagccagatgatgatgagacctttgccaagttctacagatctgtggactacaacatgcccaggagccctgtggagatggatgaggactttgatgtgatctttgacccctatgcccccaagctgaccagctctgtggccgagcacaagagagctgtgcggcccaagagaagagtgcaggccagcaagaaccccctgaagatgctggccgcccgggaggacctgctgcaggagtacacagagcagaggctgaatgtggccttcatggagagcaagaggatgaaggtggagaagatgagcagcaacagcaacttcagcgaggtgaccctggccggcctggccagcaaggagaacttcagcaatgtgtccctgcggtctgtgaacctgacagagcagaacagcaacaacagcgctgtgccctacaagaggctgatgctgctgcagatcaagggcagaagacatgtgcagacccggctggtggagccccgggccagcgccctgaacagcggggactgcttcctgctgctgagcccccactgctgcttcctgtgggtgggggagtttgccaacgtgattgagaaggccaaggccagcgagctggccaccctcatccagaccaagcgggagctgggctgccgggccacctacatccagaccatcgaggagggcatcaacacccacacccatgctgccaaggacttctggaagctgctgggcggccagaccagctaccagagcgctggggaccccaaggaggatgagctgtatgaagctgccatcatcgagaccaactgcatctaccgcctgatggatgacaagctggtgcctgatgatgactactggggcaagatccccaagtgcagcctgctgcagcccaaggaggtgctggtgtttgattttggaagtgaggtgtatgtgtggcacggcaaggaggtgaccctggcccagaggaagatcgccttccagctggccaagcacctgtggaatggcacctttgattatgagaactgtgacatcaaccccctggaccctggagagtgcaaccccctcatccccaggaagggccagggccgcccagactgggccatcttcggccgcctgacagagcacaatgagaccatcctcttcaaggagaagttcctggactggacagagctgaagaggagcaatgagaagaaccctggagagctggcccagcacaaggaggaccccaggacagatgtgaaggcctatgatgtgaccaggatggtgtccatgccccagaccacagctggcaccatcctggatggagtgaatgtgggccggggctacggcctggtggagggccatgaccggcggcagtttgagatcacctctgtgtctgtggatgtgtggcacatcctggagtttgactacagccggctgcccaagcagagcatcggccagttccacgagggagatgcctacgtggtgaagtggaagttcatggtgtccacagctgtgctgcgggcctggaggggggcccggggccgggagtttgctggcagcggcctgagcctgtag

SEQ ID NO: 22045 - DNA, 1758 bp, Artificial Sequence
  Description of Artificial Sequence: Synthetic coding sequence
atgaacagcagtgatgtgagcagcctgaagcaccccagcagcctggccagccccacagccatcacccctgtggccagccccatctgtgggaagacccggggcaccacccctgtgtccaagcccctggaggacatcgaggcccggccagacatgcagctggagagtgacctgaagctggaccggctggagaccttcctgcggcggctgaacaacaaggtgggcggcatgcatgaaacagtgctgactgtgacaggcaagtctgtgaaggaggtgatgaagccagatgatgatgagacctttgccaagttctacagatctgtggactacaacatgcccaggagccctgtggagatggatgaggactttgatgtgatctttgacccctatgcccccaagctgaccagctctgtggccgagcacaagagagctgtgcggcccaagagaagagtgcaggccagcaagaaccccctgaagatgctggccgcccgggaggacctgctgcaggagtacacagagcagaggctgaatgtggccttcatggagagcaagaggatgaaggtggagaagatgagcagcaacagcaacttcagcgaggtgaccctggccggcctggccagcaaggagaacttcagcaatgtgtccctgcggtctgtgaacctgacagagcagaacagcaacaacagcgctgtgccctacaagaggctgatgctgctgcagatcaagggcagaagacatgtgcagacccggctggtggagccccgggccagcgccctgaacagcggggactgcttcctgctgctgagcccccactgctgcttcctgtgggtgggggagtttgccaacgtgattgagaaggccaaggccagcgagctggccaccctcatccagaccaagcgggagctgggctgccgggccacctacatccagaccatcgaggagggcatcaacacccacacccatgctgccaaggacttctggaagctgctgggcggccagaccagctaccagagcgctggggaccccaaggaggatgagctgtatgaagctgccatcatcgagaccaactgcatctaccgcctgatggatgacaagctggtgcctgatgatgactactggggcaagatccccaagtgcagcctgctgcagcccaaggaggtgctggtgtttgattttggaagtgaggtgtatgtgtggcacggcaaggaggtgaccctggcccagaggaagatcgccttccagctggccaagcacctgtggaatggcacctttgattatgagaactgtgacatcaaccccctggaccctggagagtgcaaccccctcatccccaggaagggccagggccgcccagactgggccatcttcggccgcctgacagagcacaatgagaccatcctcttcaaggagaagttcctggactggacagagctgaagaggagcaatgagaagaaccctggagagctggcccagcacaaggaggaccccaggacagatgtgaaggcctatgatgtgaccaggatggtgtccatgccccagaccacagctggcaccatcctggatggagtgaatgtgggccggggctacggcctggtggagggccatgaccggcggcagtttgagatcacctctgtgtctgtggatgtgtggcacatcctggagtttgactacagccggctgcccaagcagagcatcggccagttccacgagggagatgcctacgtggtgaagtggaagttcatggtgtccacagctggatag

SEQ ID NO: 22046 - DNA, 636 bp, Artificial Sequence
  Description of Artificial Sequence: Synthetic coding sequence
atggtggcccacaaccaggtggccgctgacaatgctgtgtccacagctgctgagcccaggagaagacctgagcccagcagcagcagcagcagcagccctgctgccccagcccggccccggccctgcccagctgtgcctgccccagcccctggggacacccacttccgcaccttccgcagccacgccgactaccgccgcatcacccgggccagcgccctgctggatgcctgtggcttctactggggccccctgtctgtgcatggagcccacgagcggctgcgggcagagcctgtgggcaccttcctggtgcgggacagccggcagaggaactgcttctttgccctgtctgtgaagatggccagcggccccaccagcatccgggtgcacttccaggccggccgcttccacctggatggcagccgggagagctttgactgcctgtttgagctgctggagcactacgtggccgcccccaggaggatgctgggcgcccccctgcggcagaggagagtgcggcccctgcaggagctgtgccggcagagaattgtggccaccgtgggccgggagaacctggcccgcatccccctgaaccctgtgctgcgggactacctgagcagcttccccttccagatctag

SEQ ID NO: 22047 - DNA, 678 bp, Artificial Sequence
  Description of Artificial Sequence: Synthetic coding sequence
atggtgacccacagcaagtttcctgctgctggcatgagccggcccctggacaccagcctgcggctgaagaccttcagcagcaagtctgagtaccagctggtggtgaatgctgtgaggaagctgcaggagagcggcttctactggagcgctgtgactggaggagaggccaacctgctgctgtctgctgagcctgctggcaccttcctgatccgggacagcagtgaccagaggcacttcttcaccctgtctgtgaagacccagagcggcaccaagaacctgcgcatccagtgtgagggcggcagcttcagcctgcagagcgaccccaggagcacccagcctgtgcccaggtttgactgtgtgctgaagctggtgcaccactacatgcctcctcctggggcccccagcttccccagccccccaacagagcccagcagcgaggtgcctgagcagcccagcgcccagcccctgcccggcagccccccccggcgggcctactacatctacagcggcggggagaagatccccctggtgctgagccggcccctgagcagcaatgtggccaccctgcagcacctgtgcaggaagacagtgaatggccacctggacagctatgagaaggtgacccagctgcccggccccatccgggagttcctggaccagtatgatgcccccctgtag

SEQ ID NO: 22048 - DNA, 1302 bp, Artificial Sequence
  Description of Artificial Sequence: Synthetic coding sequence
atggccgagctgcggcccagcggggcccctggccccacagcccccccagcccctggccccacagcccccccagcctttgccagcctcttccccccaggcctgcacgccatctacggggagtgccggcggctgtacccagaccagcccaaccccctgcaggtgacagccatcgtgaagtactggctgggcggccctgaccccctggactatgtgtccatgtacagaaatgtgggcagccccagcgccaacatccctgagcactggcactacatcagctttggcctgagtgacctgtatggagacaacagagtgcatgagttcaccggcacagatggccccagcggcttcggctttgagctgaccttccggctgaagcgggagaccggggagagcgccccacccacctggccagctgagctgatgcagggcctggcccgctacgtgttccagagcgagaacaccttctgcagcggggaccacgtgtcctggcacagccccctggacaacagcgagagccgcatccagcacatgctgctgacagaggacccccagatgcagcctgtgcagacccccttcggcgtggtgaccttcctgcagatcgtgggcgtgtgcacagaggagctgcacagcgcccagcagtggaatggccagggcatcctggagctgctgaggacagtgcccatcgccggcggcccctggctgatcacagacatgagaagaggagagaccatctttgaaattgacccccacctgcaggagcgggtggacaagggcattgaaacagatggcagcaacctgtctggagtgtctgccaagtgtgcctgggatgacctgagccggcccccagaagatgatgaggacagccgcagcatctgcatcggcacccagccccggcggctgagcggcaaggacacagagcagatccgggagaccctgcggcggggcctggagatcaacagcaagcctgtgctgccccccatcaacccccagaggcagaatggcctggcccatgaccgggcccccagcaggaaggacagcctggagagtgacagcagcacagccatcatcccccatgagctgatccgcacccggcagctggagagcgtgcacctgaagttcaaccaggagagcggggccctgatccccctgtgcctgcggggccgcctgctgcacggccgccacttcacctacaagagcatcactggagacatggccatcacctttgtgtccactggagtggagggcgcctttgccacagaggagcacccctatgctgcccacggcccctggctgcagctgtag

SEQ ID NO: 22049 - DNA, 1455 bp, Artificial Sequence
  Description of Artificial Sequence: Synthetic coding sequence
atggccgagctgcggcccagcggggcccctggccccacagcccccccagcccctggccccacagcccccccagcctttgccagcctcttccccccaggcctgcacgccatctacggggagtgccggcggctgtacccagaccagcccaaccccctgcaggtgacagccatcgtgaagtactggctgggcggccctgaccccctggactatgtgtccatgtacagaaatgtgggcagccccagcgccaacatccctgagcactggcactacatcagctttggcctgagtgacctgtatggagacaacagagtgcatgagttcaccggcacagatggccccagcggcttcggctttgagctgaccttccggctgaagcgggagaccggggagagcgccccacccacctggccagctgagctgatgcagggcctggcccgctacgtgttccagagcgagaacaccttctgcagcggggaccacgtgtcctggcacagccccctggacaacagcgagagccgcatccagcacatgctgctgacagaggacccccagatgcagcctgtgcagacccccttcggcgtggtgaccttcctgcagatcgtgggcgtgtgcacagaggagctgcacagcgcccagcagtggaatggccagggcatcctggagctgctgaggacagtgcccatcgccggcggcccctggctgatcacagacatgagaagaggagagaccatctttgaaattgacccccacctgcaggagcgggtggacaagggcattgaaacagatggcagcaacctgtctggagtgtctgccaagtgtgcctgggatgacctgagccggcccccagaagatgatgaggacagccgcagcatctgcatcggcacccagccccggcggctgagcggcaaggacacagagcagatccgggagaccctgcggcggggcctggagatcaacagcaagcctgtgctgccccccatcaacccccagaggcagaatggcctggcccatgaccgggcccccagcaggaaggacagcctggagagtgacagcagcacagccatcatcccccatgagctgatccgcacccggcagctggagagcgtgcacctgaagttcaaccaggagagcggggccctgatccccctgtgcctgcggggccgcctgctgcacggccgccacttcacctacaagagcatcactggagacatggccatcacctttgtgtccactggagtggagggcgcctttgccacagaggagcacccctatgctgcccacggcccctggctgcagatcctgctgacagaggagtttgtggagaagatgctggaggacctggaggacctgaccagccctgaggagttcaagctgcccaaggagtacagctggccagagaagaagctgaaggtgtccatcctgcctgatgtggtgtttgacagccccctgcactag

SEQ ID NO: 22050 - DNA, 240 bp, Artificial Sequence
  Description of Artificial Sequence: Synthetic coding sequence
atggcccggagccggctgacagccacctctgtgtcccaggtgcaggagaatggatttgtgaagaagctggagcccaagagcggctggatgaccttcctggaggtgacaggcaagatctgtgagatgctgttctgcccagaggccatcctgctgaccaggaaggacaccccctactgtgaaacaggcctcatcttcctgaccctgaccaagaccatcgccaacacctacttctacttctag

SEQ ID NO: 22051 - DNA, 240 bp, Artificial Sequence; identical to SEQ ID NO: 22050
  Description of Artificial Sequence: Synthetic coding sequence

SEQ ID NO: 22052 - DNA, 1245 bp, Artificial Sequence
  Description of Artificial Sequence: Synthetic coding sequence
atgaacctgcagcgctactggggcgagatccccatcagcagcagccagaccaacagaagcagctttgacctgctgccccgggagttccggctggtggaggtgcatgacccccccctgcaccagcccagcgccaacaagcccaagccacccaccatgctggacatccccagcgagccctgcagcctgaccatccacaccatccagctgatccagcacaacagaaggctgaggaacctgattgccacagcccaggcccagaaccagcagcagacagaaggagtgaagacagaggagagcgagcccctgcccagctgccccggcagcccccccctgcctgatgacctgctgcccctggactgcaagaaccccaatgcccccttccagatccgccacagcgaccctgagagtgacttctaccggggcaagggggagcctgtgacagagctgtcctggcacagctgccggcagctgctgtaccaggccgtggccaccatcctggcccatgctggctttgactgtgccaatgaatctgtgctggagaccctgacagatgtggcccacgagtactgcctgaagttcaccaagctgctgcgctttgctgtggaccgggaggcccggctgggccagacccccttcccagatgtgatggagcaggtgttccacgaggtgggcatcggctctgtgctgagcctgcagaagttctggcagcaccgcatcaaggactaccacagctacatgctgcagatcagcaagcagctgtctgaggagtatgagcgcatcgtgaaccctgagaaggccacagaagatgccaagcctgtgaagatcaaggaggagcctgtgtctgacatcaccttccctgtgtctgaggagctggaggccgacctggccagcggggaccagagcctgcccatgggcgtgctgggcgcccagagcgagcgcttccccagcaacctggaggtggaggccagcccccaggccagcagcgctgaggtgaatgccagccccctgtggaacctggcccacgtgaagatggagccccaggagagcgaggagggcaatgtgtctggccatggagtgctgggcagtgatgtgtttgaggagcccatgagcggcatgtctgaggccggcatcccccagagcccagatgacagcgacagcagctatggcagccacagcacagacagcctgatgggcagcagccctgtgttcaaccagcgctgcaagaagaggatgaggaagatctag

SEQ ID NO: 22053 - DNA, 840 bp, Artificial Sequence
  Description of Artificial Sequence: Synthetic coding sequence
atgaacctgcagagcgggaaaggagagcctgtgacagagctgtcctggcacagctgccggcagctgctgtaccaggccgtggccaccatcctggcccacgccggctttgactgtgccaatgaatctgtgctggagaccctgacagatgtggcccacgagtactgcctgaagttcaccaagctgctgcgctttgctgtggaccgggaggcccggctgggccagacccccttcccagatgtgatggagcaggtgttccacgaggtgggcatcggctctgtgctgagcctgcagaagttctggcagcaccgcatcaaggactaccacagctacatgctgcagatcagcaagcagctgtctgaggagtatgaaagaattgtgaaccctgagaaggccacagaagatgccaagcctgtgaagatcaaggaggagcctgtgtctgacatcaccttccctgtgtctgaggagctggaggccgacctggccagcggggaccagagcctgcccatgggcgtgctgggcgcccagagcgagcgcttccccagcaacctggaggtggaggccagcccccaggccagcagcgctgaggtgaatgccagccccctgtggaacctggcccacgtgaagatggagccccaggagagcgaggagggcaatgtgtctggccacggcgtgctgggcagtgatgtgtttgaggagcccatgagcggcatgtctgaggccggcatcccccagagcccagatgacagcgacagcagctatggcagccacagcacagacagcctgatgggcagcagccctgtgttcaaccagcgctgcaagaagaggatgaggaagatctag

SEQ ID NO: 22054 - DNA, 1239 bp, Artificial Sequence
  Description of Artificial Sequence: Synthetic coding sequence
atgctgcgctactggggcgagatccccatcagcagcagccagaccaacagaagcagctttgacctgctgccccgggagttccggctggtggaggtgcatgacccccccctgcaccagcccagcgccaacaagcccaagccacccaccatgctggacatccccagcgagccctgcagcctgaccatccacaccatccagctgatccagcacaacagaaggctgaggaacctgattgccacagcccaggcccagaaccagcagcagacagaaggagtgaagacagaggagagcgagcccctgcccagctgccccggcagcccccccctgcctgatgacctgctgcccctggactgcaagaaccccaatgcccccttccagatccgccacagcgaccctgagagtgacttctaccggggcaagggggagcctgtgacagagctgtcctggcacagctgccggcagctgctgtaccaggccgtggccaccatcctggcccatgctggctttgactgtgccaatgaatctgtgctggagaccctgacagatgtggcccacgagtactgcctgaagttcaccaagctgctgcgctttgctgtggaccgggaggcccggctgggccagacccccttcccagatgtgatggagcaggtgttccacgaggtgggcatcggctctgtgctgagcctgcagaagttctggcagcaccgcatcaaggactaccacagctacatgctgcagatcagcaagcagctgtctgaggagtatgagcgcatcgtgaaccctgagaaggccacagaagatgccaagcctgtgaagatcaaggaggagcctgtgtctgacatcaccttccctgtgtctgaggagctggaggccgacctggccagcggggaccagagcctgcccatgggcgtgctgggcgcccagagcgagcgcttccccagcaacctggaggtggaggccagcccccaggccagcagcgctgaggtgaatgccagccccctgtggaacctggcccacgtgaagatggagccccaggagagcgaggagggcaatgtgtctggccatggagtgctgggcagtgatgtgtttgaggagcccatgagcggcatgtctgaggccggcatcccccagagcccagatgacagcgacagcagctatggcagccacagcacagacagcctgatgggcagcagccctgtgttcaaccagcgctgcaagaagaggatgaggaagatctag

SEQ ID NO: 22055 - DNA, 1239 bp, Artificial Sequence; identical to SEQ ID NO: 22054
  Description of Artificial Sequence: Synthetic coding sequence

SEQ ID NO: 22056 - DNA, 1239 bp, Artificial Sequence; identical to SEQ ID NO: 22054
  Description of Artificial Sequence: Synthetic coding sequence

SEQ ID NO: 22057 - DNA, 1272 bp, Artificial Sequence
  Description of Artificial Sequence: Synthetic coding sequence
atggtgggcatgagccggctgagaaatgaccggctggccgaccccctgaccggctgcagcgtgtgctgcaagagctcctggaaccagctgcaggacctgtgccgcctggccaagctgagctgcccagccctgggcatcagcaagaggaacctgtatgactttgaggtggagtacctgtgtgactacaagaagatccgggagcaggagtactacctggtgaagtggaggggctacccagattctgagagcacctgggagccccggcagaacctgaagtgtgtgcgcatcctgaagcagttccacaaggacctggagcgggagctgctgcggcggcaccacaggagcaagacccccaggcacctggaccccagcctggccaactacctggtgcagaaggccaagcagaggcgggccctgcggcgctgggagcaggagctgaatgccaagaggagccacctgggccgcatcaccgtggagaatgaggtggacctggatggccccccccgggcctttgtgtacatcaatgagtacagagtgggggagggcatcaccctgaaccaggtggccgtgggctgtgagtgccaggactgcctgtgggcccccaccggcggctgctgccctggggccagcctgcacaagtttgcctacaatgaccagggccaggtgcggctgcgggccggcctgcccatctatgagtgcaacagccgctgccgctgtggctatgactgccccaacagagtggtgcagaagggcatccgctatgacctgtgcatcttcagaacagatgatggccggggctggggcgtgaggaccctggagaagatcaggaagaacagctttgtgatggagtatgtgggggagatcatcaccagcgaggaggccgagcggcggggccagatctatgaccggcagggcgccacctacctgtttgacctggactatgtggaggatgtgtacacagtggatgctgcctactacggcaacatcagccactttgtgaaccacagctgtgaccccaacctgcaggtgtacaacgtgttcatcgacaacctggatgagcggctgccccgcatcgccttctttgccaccaggaccatccgggccggggaggagctgacctttgactacaacatgcaggtggaccctgtggacatggagagcaccaggatggacagcaactttggcctggccggcctgcccggcagccccaagaagagggtgagaattgagtgcaagtgtggcacagagagctgcaggaagtacctgttctag

SEQ ID NO: 22058 - DNA, 1239 bp, Artificial Sequence
  Description of Artificial Sequence: Synthetic coding sequence
atggccgagaacctgaagggctgcagcgtgtgctgcaagagctcctggaaccagctgcaggacctgtgccgcctggccaagctgagctgcccagccctgggcatcagcaagaggaacctgtatgactttgaggtggagtacctgtgtgactacaagaagatccgggagcaggagtactacctggtgaagtggaggggctacccagacagcgagagcacctgggagccccggcagaacctgaagtgtgtgcgcatcctgaagcagttccacaaggacctggagcgggagctgctgcggcggcaccacaggagcaagacccccaggcacctggaccccagcctggccaactacctggtgcagaaggccaagcagaggcgggccctgcggcgctgggagcaggagctgaatgccaagaggagccacctgggccgcatcaccgtggagaatgaggtggacctggatggccccccccgggcctttgtgtacatcaatgagtacagagtgggggagggcatcaccctgaaccaggtggccgtgggctgtgagtgccaggactgcctgtgggcccccactggaggctgctgccctggggccagcctgcacaagtttgcctacaatgaccagggccaggtgcggctgcgggccggcctgcccatctatgagtgcaacagccgctgccgctgtggctatgactgccccaacagagtggtgcagaagggcatccgctatgacctgtgcatcttcagaacagatgatggccggggctggggcgtgaggaccctggagaagatcaggaagaacagctttgtgatggagtatgtgggggagatcatcaccagcgaggaggccgagcggcggggccagatctatgaccggcagggcgccacctacctgtttgacctggactatgtggaggatgtgtacacagtggatgctgcctactacggcaacatcagccactttgtgaaccacagctgtgaccccaacctgcaggtgtacaacgtgttcatcgacaacctggatgagcggctgcccagaattgccttctttgccaccaggaccatccgggccggggaggagctgacctttgactacaacatgcaggtggaccctgtggacatggagagcaccaggatggacagcaactttggcctggccggcctgcccggcagccccaagaagagggtgagaattgaatgtaaatgtggcacagagagctgcaggaagtacctgttctag

SEQ ID NO: 22059 - DNA, 648 bp, Artificial Sequence
  Description of Artificial Sequence: Synthetic coding sequence
atggcctggatcagccggctgcgggagcacctggatggccccccccgggcctttgtgtacatcaatgagtacagagtgggggagggcatcaccctgaaccaggtggccgtgggctgtgagtgccaggactgcctgtgggcccccactggaggctgctgccctggggccagcctgcacaagtttgcctacaatgaccagggccaggtgcggctgcgggccggcctgcccatctatgagtgcaacagccgctgccgctgtggctatgactgccccaacagagtggtgcagaagggcatccgctatgacctgtgcatcttcagaacagatgatggccggggctggggcgtgaggaccctggagaagatcaggaagaacagctttgtgatggaccctgccctgctgactgtgtgcctgaagctgcctgccttccccatgggcaaggcctgggagacagacctgtctgtgacaggcaccctgggccggggctgcggcagaggagaagatcggctgcaggagagccccttccctgtgcctgcccccagcgtgggctgcacctacaagcccccacccaccttcagaaattccttcagcaccagccggctgtctgtggtgggcatccacggcctgctgcggcgcagcaagggctag

SEQ ID NO: 22060 - DNA, 1230 bp, Artificial Sequence
  Description of Artificial Sequence: Synthetic coding sequence
atggccgagaacctgaagggctgcagcgtgtgctgcaagagctcctggaaccagctgcaggacctgtgccgcctggccaagctgagctgcccagccctgggcatcagcaagaggaacctgtatgactttgaggtggagtatgtgcggctgcaggaggaccccaggacaggcatcctgcccggggagatggcctggatcagccggctgcgggagcacctgggcgccacagctgagagccaggtgtgtgcctacccccaggccgtgccccagggcctgaggaagggggccgccccagctgcccctcctgtgaaggaccccccagcccctggccccaagctgggccagctgcctggagctgagggccaggccgaggccggggcccccagcctgggcgctggggcccagtgccaggcccacctgggccgcatcaccgtggagaatgaggtggacctggatggccccccccgggcctttgtgtacatcaatgagtacagagtgggggagggcatcaccctgaaccaggtggccgtgggctgtgagtgccaggactgcctgtgggcccccactggaggctgctgccccaggcactgcaccagcctgcccaccatgacccgggcccgctgtggctttgagcccggctgccccagcaccagcgccaccccagctgctgctgctgccatgacagcccagatcgtgtggtacagaagagtgtctgacatgaccagcgccagcagcgccaggatgatgggcgtggccggggccagcgccccctggaggagatttgccaggacagccagctcctggagcacctgggagaggagcctgccccagaggcggcagagcggcggccagatctatgaccggcagggcgccacctacctgtttgacctggactatgtggaggatgtgtacacagtggatgctgcctactacggcaacatcagccactttgtgaaccacagctgtgaccccaacctgcaggtgtacaacgtgttcatcgacaacctggatgagcggctgcccagcctgagcctgccccaggagcccagcggccaggcccggagcagccccctcatcaccacctgcaagtggaccccctggacctggagggccccagcctggacccccaccctggcctggctgggcagcctggcccccctgcggagcggctctgtgctgaatgcctctgtgggcctgagccctgctgccaacaccagcagcagcccctag

SEQ ID NO: 22061 - DNA, 555 bp, Artificial Sequence
  Description of Artificial Sequence: Synthetic coding sequence
atggcctggatcagccggctgcgggagcacctgggcgccacagctgagagccaggtgtgtgcctacccccaggccgtgccccagggcctgaggaagggggccgccccagctgcccctcctgtgaaggaccccccagcccctggccccaagctgggccagctgcctggagctgagggccaggccgagcccggctgccccagcaccagcgccaccccagctgctgctgctgccatgacagcccagatcgtgtggtaccgccgggtgtctgacatgaccagcgccagcagcgccaggatgatgggcgtggccggggccagcgccccctggaggagatttgccaggacagccagctcctggagcacctgggagaggagcctgccccagaggcggcagagcggcggggcccggagcaccaccgtgcgggccccacccaccagcctgacctggaccacctggaggacctgcaccccctggatgccacccaccatggccaccagccccaccctgagcaccaccgtggtgacccccacctgccgctgcaccaccagcagctag

SEQ ID NO: 22062 - DNA, 285 bp, Artificial Sequence
  Description of Artificial Sequence: Synthetic coding sequence
atgagagctggcttcagtgacttccagctgatccgggaccaggtgctcttcctgcaggaccaggcccagaggctgacagagtggctgcagctgagcggctttgaaaatcctgtgtctgagagcaccaccctgtgcctgcgggagcgggagaagaggatccccacctgtgtggccgtgtgtgtgcccagccctggcaccgtgcacacagccctgctgcaccccaccaccctgagccagagccgcagcagcagcgaggccaagatgctgatcatccacacagcctag

SEQ ID NO: 22063 - DNA, 594 bp, Artificial Sequence
  Description of Artificial Sequence: Synthetic coding sequence
atggatgtgggcagcaaggaggtgctgatggagagccccccagactacagcgctgccccccggggccgcttcggcatcccctgctgccctgtgcacctgaagaggctgctgattgtggtggtggtggtggtgctgattgtggtggtgattgtgggcgccctgctgatgggcctgcacatgagccagaagcacacagagatggtgctggagatgagcattggagcccctgaggcccagcagaggctggccctgtctgagcacctggtgaccacagccaccttcagcatcggcagcacaggcctggtggtgtatgactaccagcagctgctgattgcctacaagccagcccctggcacctgctgctacatcatgaagatcgcccctgagagcatccccagcctggaggccctgaccaggaaggtgcacaacttccagatggagtgcagcctgcaggccaagccagctgtgcccaccagcaagctgggccaggccgagggcagagatgctggcagcgcccccagcggcggggaccctgccttcctgggcatggctgtgtccaccctgtgtggggaggtgcccctgtactacatctag

SEQ ID NO: 22064 - DNA, 576 bp, Artificial Sequence
  Description of Artificial Sequence: Synthetic coding sequence
atggatgtgggcagcaaggaggtgctgatggagagccccccagactacagcgctgccccccggggccgcttcggcatcccctgctgccctgtgcacctgaagaggctgctgattgtggtggtggtggtggtgctgattgtggtggtgattgtgggcgccctgctgatgggcctgcacatgagccagaagcacacagagatggtgctggagatgagcattggagcccctgaggcccagcagaggctggccctgtctgagcacctggtgaccacagccaccttcagcatcggcagcacaggcctggtggtgtatgactaccagcagctgctgattgcctacaagccagcccctggcacctgctgctacatcatgaagatcgcccctgagagcatccccagcctggaggccctgaccaggaaggtgcacaacttccaggccaagccagctgtgcccaccagcaagctgggccaggccgagggcagagatgctggcagcgcccccagcggcggggaccctgccttcctgggcatggctgtgtccaccctgtgtggggaggtgcccctgtactacatctag

SEQ ID NO: 22065 - DNA, 1158 bp, Artificial Sequence
  Description of Artificial Sequence: Synthetic coding sequence
atgatgatgatggccctgagcaagaccttcggccagaagcctgtgaagttccagctggaggatgatggagagttctacatgattggcagcgaggtgggcaactacctgaggatgttccggggcagcctgtacaagcgctaccccagcctgtggaggcggctggccaccgtggaggagaggaagaagatcgtggccagcagccacggcaagaagaccaagcccaacaccaaggaccacggctacaccaccctggccacctctgtgaccctgctgaaggccagcgaggtggaggagatcctggatggaaatgatgagaagtacaaggctgtgtccatcagcacagagccccccacctacctgcgggagcagaaggccaagaggaacagccagtgggtgcccaccctgcccaacagcagccaccacctggatgctgtgccctgcagcaccaccatcaacagaaacaggatgggccgggacaagaagaggaccttccccctgtgctttgatgaccatgaccctgctgtgattcatgaaaatgccagccagcctgaggtgctggtgcccatccggctggacatggagattgatggccagaagctgagagatgccttcacctggaacatgaatgagaagctgatgaccccagagatgttttctgagatcctgtgtgatgacctggacctgaaccccctgacctttgtgcctgccatcgccagcgccatccggcagcagatcgagagctaccccacagacagcatcctggaggaccagagcgaccagagggtcatcatcaagctgaacatccacgtgggcaacatcagcctggtggaccagtttgagtgggacatgtctgagaaggagaacagccctgagaagtttgccctgaagctgtgcagcgagctgggcctgggcggggagtttgtgaccaccatcgcctacagcatccggggccagctgtcctggcaccagaagacctacgccttcagcgagaaccccctgcccaccgtggagatcgccatcagaaatactggagatgctgaccagtggtgccccctgctggagaccctgacagatgctgagatggagaagaagatccgggaccaggacaggaacaccaggaggatgaggcggctggccaacacagccccagcctggtag

SEQ ID NO: 22066 - DNA, 1131 bp, Artificial Sequence
  Description of Artificial Sequence: Synthetic coding sequence
atgatgatgatggccctgagcaagaccttcggccagaagcctgtgaagttccagctggaggatgatggagagttctacatgattggcagcgaggtgggcaactacctgaggatgttccggggcagcctgtacaagcgctaccccagcctgtggaggcggctggccaccgtggaggagaggaagaagatcgtggccagcagccatgaccacggctacaccaccctggccacctctgtgaccctgctgaaggccagcgaggtggaggagatcctggatggaaatgatgagaagtacaaggctgtgtccatcagcacagagccccccacctacctgcgggagcagaaggccaagaggaacagccagtgggtgcccaccctgcccaacagcagccaccacctggatgctgtgccctgcagcaccaccatcaacagaaacaggatgggccgggacaagaagaggaccttccccctgtgctttgatgaccatgaccctgctgtgattcatgaaaatgccagccagcctgaggtgctggtgcccatccggctggacatggagattgatggccagaagctgagagatgccttcacctggaacatgaatgagaagctgatgaccccagagatgttcagcgagatcctgtgtgatgacctggacctgaaccccctgacctttgtgcctgccatcgccagcgccatccggcagcagatcgagagctaccccacagacagcatcctggaggaccagagcgaccagagggtcatcatcaagctgaacatccacgtgggcaacatcagcctggtggaccagtttgagtgggacatgtctgagaaggagaacagccctgagaagtttgccctgaagctgtgcagcgagctgggcctgggcggggagtttgtgaccaccatcgcctacagcatccggggccagctgtcctggcaccagaagacctacgccttcagcgagaaccccctgcccaccgtggagatcgccatccggaacacaggagatgctgaccagtggtgccccctgctggagaccctgacagatgctgagatggagaagaagatccgggaccaggacaggaacaccaggaggatgaggcggctggccaacacagccccagcctggtag

SEQ ID NO: 22067 - DNA, 81 bp, Artificial Sequence
  Description of Artificial Sequence: Synthetic coding sequence
tggaggcggctggccaccgtggaggagaggaagaagatcgtggccagcagccacgccctgatgaccatgacccagctgtag

SEQ ID NO: 22068 - DNA, 7626 bp, Artificial Sequence
  Description of Artificial Sequence: Synthetic coding sequence
atggtggccctgagcctgaagatcagcattggaaatgtggtgaagaccatgcagtttgagcccagcaccatggtgtatgatgcctgccgcatcatccgggagcgcatccctgaggccccagctggccccccaagtgactttggcctcttcctgagtgatgatgaccccaagaagggcatctggctggaggccggcaaggccctggactactacatgctgagaaatggagacaccatggagtacaggaagaagcagaggcccctgaagatccgcatgctggatggcaccgtgaagaccatcatggtggatgacagcaagacagtgacagacatgctgatgaccatctgtgccagaattggcatcaccaaccatgatgagtacagcctggtgcgggagctgatggaggagaagaaggaggagatcaccggcaccctgaggaaggacaagaccctgctgagagatgagaagaagatggagaagctgaagcagaagctgcacacagatgatgagctgaactggctggaccacggccgcaccctgcgggagcagggcgtggaggagcacgagaccctgctgctgcggaggaagttcttctacagcgaccagaatgtggacagccgggaccctgtgcagctgaacctgctgtatgtgcaggccagagatgacatcctgaatggcagccaccctgtgtcctttgacaaggcctgtgaatttgctggcttccagtgccagatccagtttggcccccacaatgagcagaagcacaaggccggcttcctggacctgaaggacttcctgcccaaggagtatgtgaagcagaagggggagaggaagatcttccaggcccacaagaactgtggccagatgtctgaaattgaggccaaggtgcgctacgtgaagctggcccggagcctgaagacctacggcgtgtccttcttcctggtgaaggagaagatgaagggcaagaacaagctggtgccccggctgctgggcatcaccaaggaatgtgtgatgagggtggatgagaagaccaaggaggtgatccaggagtggaacctgaccaacatcaagcgctgggccgccagccccaagagcttcaccctggactttggagactaccaggacggctactacagcgtgcagaccacagaaggagagcagatcgcccagctgattgctggctacatcgacatcatcctgaagaagaagaagagcaaggaccacttcggcctggagggagatgaggagagcaccatgctggaggacagcgtgagccccaagaagagcacagtgctgcagcagcagtacaacagagtgggcaaggtggagcacggctctgtggccctgcctgccatcatgaggtctggggccagcggccctgagaacttccaggtgggctccatgcccccagcccagcagcagatcaccagcggccagatgcaccggggccacatgccacccctgaccagcgcccagcaggccctgaccggcaccatcaacagctccatgcaggccgtgcaggccgcccaggccaccctggatgactttgacaccctgccccccctgggccaggatgctgccagcaaggcctggaggaagaacaagatggatgagagcaagcatgagatccacagccaggtggatgccatcacagctggaacagcctctgtggtgaacctgacagctggggaccctgctgagacagactacacagctgtgggctgtgctgtgaccaccatcagcagcaacctgacagagatgagccggggcgtgaagctgctggccgccctgctggaggatgagggcggcagcggccggcccctgctgcaggccgccaagggcctggccggggctgtgtctgagctgctgcggagcgcccagcctgccagcgctgagccccggcagaacctgctgcaggccgctggaaatgtgggccaggccagcggggagctgctgcagcagattggagagagtgacacagacccccacttccaggatgccctgatgcagctggccaaggctgtggccagcgctgctgctgccctggtgctgaaggccaagtctgtggcccagaggacagaggacagcggcctgcagacccaggtgattgctgctgccacccagtgtgccctgagcaccagccagctggtggcctgcaccaaggtggtggcccccaccatcagcagccctgtgtgccaggagcagctggtggaggccggccgcctggtggccaaggctgtggagggctgtgtgtctgccagccaggccgccacagaagatggccagctgctgcggggcgtgggcgccgccgccacagctgtgacccaggccctgaatgagctgctgcagcacgtgaaggcccacgccaccggggccggccctgctggccgctatgaccaggccacagacaccatcctgactgtgacagagaacatcttcagctccatgggagatgctggggagatggtgcggcaggcccgcatcctggcccaggccaccagtgacctggtgaatgccatcaaggcagatgctgagggggagagtgacctggagaacagcaggaagctgctgtctgctgccaagatcctggctgatgccacagccaagatggtggaggccgccaagggagctgctgcccacccagattctgaggagcagcagcagaggctgcgggaggccgctgagggcctgaggatggccaccaatgctgctgcccagaatgccatcaagaagaagctggtgcagaggctggagcacgccgccaagcaggccgccgccagcgccacccagaccatcgccgccgcccagcacgccgccagcacccccaaggccagcgctggcccccagcccctgctggtgcagagctgcaaggctgtggccgagcagatccccctgctggtgcagggcgtgcggggcagccaggcccagcctgacagccccagcgcccagctggccctgattgctgccagccagagcttcctgcagcccggcggcaagatggtggccgccgccaaggcctctgtgcccaccatccaggaccaggccagcgccatgcagctgagccagtgtgccaagaacctgggcacagccctggccgagctgaggacagctgcccagaaggcccaggaggcctgtggccccctggagatggacagcgccctgtctgtggtgcagaacctggagaaggacctgcaggaggtgaaggccgccgccagagatggcaagctgaagcccctgcccggggagaccatggagaagtgcacccaggacctgggcaacagcaccaaggctgtgagcagcgccatcgcccagctgctgggggaggtggcccagggcaatgaaaattatgccggcattgctgccagagatgtggccggcggcctgcggagcctggcccaggccgcccggggcgtggccgccctgaccagtgaccctgctgtgcaggccatcgtgctggacacagccagtgatgtgctggacaaggccagcagcctcatcgaggaggccaagaaggctgctggccaccctggggaccctgagagccagcagaggctggcccaggtggccaaggctgtgacccaggccctgaacagatgtgtgtcctgcctgcccggccagagagatgtggacaatgccctgcgggctgtgggagatgccagcaagaggctgctgagtgacagcctgccccccagcacaggcaccttccaggaggcccagagccggctgaatgaagctgctgctggcctgaaccaggccgccacagagctggtgcaggccagccggggcaccccccaggacctggcccgggccagcggccgcttcggccaggacttcagcaccttcctggaggccggcgtggagatggccggccaggcccccagccaggaggaccgggcccaggtggtgagcaacctgaagggcatctccatgagcagcagcaagctgctgctggccgccaaggccctgagcacagatcctgctgcccccaacctgaagagccagctggccgccgccgcccgggctgtgacagacagcatcaaccagctgatcaccatgtgcacccagcaggcccctggccagaaggaatgtgacaatgccctgcgggagctggagaccgtgcgggagctgctggagaaccctgtgcagcccatcaatgacatgagctacttcggctgcctggacagcgtgatggagaacagcaaggtgctgggggaggccatgacaggcatcagccagaatgccaagaatggaaacctgcctgagtttggagatgccatcagcacagccagcaaggccctgtgtggcttcacagaagctgctgcccaggccgcctacctggtgggcgtgtctgaccccaacagccaggccggccagcagggcctggtggagcccacccagtttgcccgggccaaccaggccatccagatggcctgccagagcctgggggagcccggctgcacccaggcccaggtgctgtctgctgccaccatcgtggccaagcacaccagcgccctgtgcaacagctgccgcctggccagcgcccggaccaccaaccccacagccaagaggcagtttgtgcagagcgccaaggaggtggccaacagcacagccaacctggtgaagaccatcaaggccctggatggagccttcacagaagaaaatagagcccagtgccgggccgccacagcccccctgctggaggccgtggacaacctgagcgcctttgccagcaaccctgagttcagcagcatcccagcccagatcagccctgagggccgggccgccatggagcccatcgtcatcagcgccaagaccatgctggagagcgctgggggcctcatccagacagcccgggccctggccgtgaacccccgggaccccccatcctggagcgtgctggccggccacagcaggacagtgtctgacagcatcaagaagctgatcacctccatgagggacaaggcccctggccagctggagtgtgaaacagccatcgccgccctgaacagctgcctgcgggacctggaccaggccagcctggccgctgtgtcccagcagctggccccccgggagggcatcagccaggaggccctgcacacccagatgctgacagctgtgcaggagatcagccacctgattgagcccctggccaatgctgcccgggcagaggccagccagctgggccacaaggtgtcccagatggcccagtactttgagcccctgaccctggccgctgtgggcgccgccagcaagaccctgagccacccccagcagatggccctgctggaccagaccaagaccctggccgagagcgccctgcagctgctgtacacagccaaggaggccggcggcaaccccaagcaggccgcccacacccaggaggccctggaggaggccgtgcagatgatgacagaggccgtggaggacctgaccaccaccctgaatgaagctgccagcgctgctggggtggtgggcggcatggtggacagcatcacccaggccatcaaccagctggatgagggccccatgggagagcctgagggcagctttgtggactaccagaccaccatggtgaggacagccaaggccatcgctgtgacagtgcaggagatggtgaccaagagcaacaccagccctgaggagctgggccccctggccaaccagctgaccagtgactatggccgcctggccagcgaggccaagccagctgctgtggccgcagaaaatgaggagatcggcagccacatcaagcaccgggtgcaggagctgggccacggctgtgccgccctggtgaccaaggccggggccctgcagtgcagccccagtgatgcctacaccaagaaggagctgattgaatgtgccaggagagtgtctgagaaggtgagccacgtgctggccgccctgcaggccggcaacagaggcacccaggcctgcatcacagctgccagcgctgtgtctggcatcatcgctgacctggacaccaccatcatgtttgccacagctggcaccctgaaccgggagggcacagagacctttgctgaccaccgggagggcatcctgaagacagccaaggtgctggtggaggacaccaaggtgctggtgcagaatgctgctggcagccaggagaagctggcccaggccgcccagagctctgtggccaccatcacccggctggctgatgtggtgaagctgggcgccgccagcctgggcgctgaggaccctgagacccaggtggtgctgatcaatgctgtgaaggatgtggccaaggccctgggggacctgatcagcgccaccaaggctgctgctgggaaggtgggagatgatcctgctgtgtggcagctgaagaacagcgccaaggtgatggtgaccaacgtgaccagcctgctgaagacagtgaaggctgtggaggatgaggccaccaagggcacccgggccctggaggccaccacagagcacatccggcaggagctggccgtgttctgcagccctgagcccccagccaagaccagcaccccagaggacttcatccgcatgaccaagggcatcaccatggccacagccaaggctgtggccgccggcaacagctgccggcaggaggatgtgattgccacagccaacctgagcagaagagccatcgctgacatgctgcgggcctgcaaggaggccgcctaccaccctgaggtggccccagatgtgcggctgcgggccctgcactacggccgggagtgtgccaacggctacctggagctgctggaccacgtgctgctgaccctgcagaagcccagccctgagctgaagcagcagctgaccggccacagcaagagggtggccggctctgtgacagagctgatccaggccgctgaggccatgaagggcacagagtgggtggaccctgaggaccccaccgtgattgctgaaaatgagctgctgggcgctgctgctgccatcgaggccgccgccaagaagctggagcagctgaagccccgggccaagcccaaggaggctgatgagagcctgaactttgaggagcagatcctggaggccgccaagagcattgctgctgccaccagcgccctggtgaaggccgccagcgctgcccagcgggagctggtggcccagggcaaggtgggcgccatcccagccaatgccctggatgatggccagtggagccagggcctcatctctgctgccaggatggtggccgccgccaccaacaacctgtgtgaggccgccaatgctgctgtgcagggccacgccagccaggagaagctgatcagcagcgccaagcaggtggccgccagcacagcccagctgctggtggcctgcaaggtgaaggctgaccaggacagcgaggccatgaagaggctgcaggccgctggaaatgctgtgaagagggccagtgacaacctggtgaaggccgcccagaaggccgccgcctttgaggagcaggagaatgaaacagtggtggtgaaggagaagatggtgggcggcatcgcccagatcatcgccgcccaggaggagatgctgaggaaggagcgggagctggaggaggccaggaagaagctggcccagatccggcagcagcagtacaagttcctgcccagcgagctgagagatgagcactag

SEQ ID NO: 22069 - DNA, 7290 bp, Artificial Sequence
  Description of Artificial Sequence: Synthetic coding sequence
atggtggccctgagcctgaagatcagcattggaaatgtggtgaagaccatgcagtttgagcccagcaccatggtgtatgatgcctgccgcatcatccgggagcgcatccctgaggccccagctggccccccaagtgactttggcctcttcctgagtgatgatgaccccaagaagggcatctggctggaggccggcaaggccctggactactacatgctgagaaatggagacaccatggagtacaggaagaagcagaggcccctgaagatccgcatgctggatggcaccgtgaagaccatcatggtggatgacagcaagacagtgacagacatgctgatgaccatctgtgccagaattggcatcaccaaccatgatgagtacagcctggtgcgggagctgatggaggagaagaaggaggagatcaccggcaccctgaggaaggacaagaccctgctgagagatgagaagaagatggagaagctgaagcagaagctgcacacagatgatgagctgaactggctggaccacggccgcaccctgcgggagcagggcgtggaggagcacgagaccctgctgctgcggaggaagttcttctacagcgaccagaatgtggacagccgggaccctgtgcagctgaacctgctgtatgtgcaggccagagatgacatcctgaatggcagccaccctgtgtcctttgacaaggcctgtgaatttgctggcttccagtgccagatccagtttggcccccacaatgagcagaagcacaaggccggcttcctggacctgaaggacttcctgcccaaggagtatgtgaagcagaagggggagaggaagatcttccaggcccacaagaactgtggccagatgtctgaaattgaggccaaggtgcgctacgtgaagctggcccggagcctgaagacctacggcgtgtccttcttcctggtgaaggagaagatgaagggcaagaacaagctggtgccccggctgctgggcatcaccaaggaatgtgtgatgagggtggatgagaagaccaaggaggtgatccaggagtggaacctgaccaacatcaagcgctgggccgccagccccaagagcttcaccctggactttggagactaccaggacggctactacagcgtgcagaccacagaaggagagcagatcgcccagctgattgctggctacatcgacatcatcctgaagaagaagaagagcaaggaccacttcggcctggagggagatgaggagagcaccatgctggaggacagcgtgagccccaagaagagcacagtgctgcagcagcagtacaacagagtgggcaaggtggagcacggctctgtggccctgcctgccatcatgaggtctggggccagcggccctgagaacttccaggtgggctccatgcccccagcccagcagcagatcaccagcggccagatgcaccggggccacatgccacccctgaccagcgcccagcaggccctgaccggcaccatcaacagctccatgcaggccgtgcaggccgcccaggccaccctggatgactttgacaccctgccccccctgggccaggatgctgccagcaaggcctggaggaagaacaagatggatgagagcaagcatgagatccacagccaggtggatgccatcacagctggaacagcctctgtggtgaacctgacagctggggaccctgctgagacagactacacagctgtgggctgtgctgtgaccaccatcagcagcaacctgacagagatgagccggggcgtgaagctgctggccgccctgctggaggatgagggcggcagcggccggcccctgctgcaggccgccaagggcctggccggggctgtgtctgagctgctgcggagcgcccagcctgccagcgctgagccccggcagaacctgctgcaggccgctggaaatgtgggccaggccagcggggagctgctgcagcagattggagagagtgacacagacccccacttccaggatgccctgatgcagctggccaaggctgtggccagcgctgctgctgccctggtgctgaaggccaagtctgtggcccagaggacagaggacagcggcctgcagacccaggtgattgctgctgccacccagtgtgccctgagcaccagccagctggtggcctgcaccaaggtggtggcccccaccatcagcagccctgtgtgccaggagcagctggtggaggccggccgcctggtggccaaggctgtggagggctgtgtgtctgccagccaggccgccacagaagatggccagctgctgcggggcgtgggcgccgccgccacagctgtgacccaggccctgaatgagctgctgcagcacgtgaaggcccacgccaccggggccggccctgctggccgctatgaccaggccacagacaccatcctgactgtgacagagaacatcttcagctccatgggagatgctggggagatggtgcggcaggcccgcatcctggcccaggccaccagtgacctggtgaatgccatcaaggcagatgctgagggggagagtgacctggagaacagcaggaagctgctgtctgctgccaagatcctggctgatgccacagccaagatggtggaggccgccaagggagctgctgcccacccagattctgaggagcagcagcagaggctgcgggaggccgctgagggcctgaggatggccaccaatgctgctgcccagaatgccatcaagaagaagctggtgcagaggctggagcacgccgccaagcaggccgccgccagcgccacccagaccatcgccgccgcccagcacgccgccagcacccccaaggccagcgctggcccccagcccctgctggtgcagagctgcaaggctgtggccgagcagatccccctgctggtgcagggcgtgcggggcagccaggcccagcctgacagccccagcgcccagctggccctgattgctgccagccagagcttcctgcagcccggcggcaagatggtggccgccgccaaggcctctgtgcccaccatccaggaccaggccagcgccatgcagctgagccagtgtgccaagaacctgggcacagccctggccgagctgaggacagctgcccagaaggcccaggaggcctgtggccccctggagatggacagcgccctgtctgtggtgcagaacctggagaaggacctgcaggaggtgaaggccgccgccagagatggcaagctgaagcccctgcccggggagaccatggagaagtgcacccaggacctgggcaacagcaccaaggctgtgagcagcgccatcgcccagctgctgggggaggtggcccagggcaatgaaaattatgccggcattgctgccagagatgtggccggcggcctgcggagcctggcccaggccgcccggggcgtggccgccctgaccagtgaccctgctgtgcaggccatcgtgctggacacagccagtgatgtgctggacaaggccagcagcctcatcgaggaggccaagaaggctgctggccaccctggggaccctgagagccagcagaggctggcccaggtggccaaggctgtgacccaggccctgaacagatgtgtgtcctgcctgcccggccagagagatgtggacaatgccctgcgggctgtgggagatgccagcaagaggctgctgagtgacagcctgccccccagcacaggcaccttccaggaggcccagagccggctgaatgaagctgctgctggcctgaaccaggccgccacagagctggtgcaggccagccggggcaccccccaggacctggcccgggccagcggccgcttcggccaggacttcagcaccttcctggaggccggcgtggagatggccggccaggcccccagccaggaggaccgggcccaggtggtgagcaacctgaagggcatctccatgagcagcagcaagctgctgctggccgccaaggccctgagcacagatcctgctgcccccaacctgaagagccagctggccgccgccgcccgggctgtgacagacagcatcaaccagctgatcaccatgtgcacccagcaggcccctggccagaaggaatgtgacaatgccctgcgggagctggagaccgtgcgggagctgctggagaaccctgtgcagcccatcaatgacatgagctacttcggctgcctggacagcgtgatggagaacagcaaggtgctgggggaggccatgacaggcatcagccagaatgccaagaatggaaacctgcctgagtttggagatgccatcagcacagccagcaaggccctgtgtggcttcacagaagctgctgcccaggccgcctacctggtgggcgtgtctgaccccaacagccaggccggccagcagggcctggtggagcccacccagtttgcccgggccaaccaggccatccagatggcctgccagagcctgggggagcccggctgcacccaggcccaggtgctgtctgctgccaccatcgtggccaagcacaccagcgccctgtgcaacagctgccgcctggccagcgcccggaccaccaaccccacagccaagaggcagtttgtgcagagcgccaaggaggtggccaacagcacagccaacctggtgaagaccatcaaggccctggatggagccttcacagaagaaaatagagcccagtgccgggccgccacagcccccctgctggaggccgtggacaacctgagcgcctttgccagcaaccctgagttcagcagcatcccagcccagatcagccctgagggccgggccgccatggagcccatcgtcatcagcgccaagaccatgctggagagcgctgggggcctcatccagacagcccgggccctggccgtgaacccccgggaccccccatcctggagcgtgctggccggccacagcaggacagtgtctgacagcatcaagaagctgatcacctccatgagggacaaggcccctggccagctggagtgtgaaacagccatcgccgccctgaacagctgcctgcgggacctggaccaggccagcctggccgctgtgtcccagcagctggcccccctgcaggagatcagccacctgattgagcccctggccaatgctgcccgggcagaggccagccagctgggccacaaggtgtcccagatggcccagtactttgagcccctgaccctggccgctgtgggcgccgccagcaagaccctgagccacccccagcagatggccctgctggaccagaccaagaccctggccgagagcgccctgcagctgctgtacacagccaaggaggccggcggcaaccccaagctggatgagggccccatgggagagcctgagggcagctttgtggactaccagaccaccatggtgaggacagccaaggccatcgctgtgacagtgcaggagatgattggcagccacatcaagcaccgggtgcaggagctgggccacggctgtgccgccctggtgaccaaggccggggccctgcagtgcagccccagtgatgcctacaccaagaaggagctgattgaatgtgccaggagagtgtctgagaaggtgagccacgtgctggccgccctgcaggccggcaacagaggcacccaggcctgcatcacagctgccagcgctgtgtctggcatcatcgctgacctggacaccaccatcatgtttgccacagctggcaccctgaaccgggagggcacagagacctttgctgaccaccgggagggcatcctgaagacagccaaggtgctggtggaggacaccaaggtgctggtgcagaatgctgctggcagccaggagaagctggcccaggccgcccagagctctgtggccaccatcacccggctggctgatgtggtgaagctgggcgccgccagcctgggcgctgaggaccctgagacccaggtggtgctgatcaatgctgtgaaggatgtggccaaggccctgggggacctgatcagcgccaccaaggctgctgctgggaaggtgggagatgatcctgctgtgtggcagctgaagaacagcgccaaggtgatggtgaccaacgtgaccagcctgctgaagacagtgaaggctgtggaggatgaggccaccaagggcacccgggccctggaggccaccacagagcacatccggcaggagctggcccccccagccaagaccagcaccccagaggacttcatccgcatgaccaagggcatcaccatggccacagccaaggctgtggccgccggcaacagctgccggcaggaggatgtgattgccacagccaacctgagcagaagagccatcgctgacatgctgcgggcctgcaaggaggccgcctaccaccctgaggtggccccagatgtgcggctgcgggccctgcactacggccgggagtgtgccaacggctacctggagctgctggaccacgtgctgctgaccctgcagaagcccagccctgagctgaagcagcagctgaccggccacagcaagagggtggccggctctgtgacagagctgatccaggccgctgaggccatgaagggcacagagtgggtggaccctgaggaccccaccgtgattgctgaaaatgagctgctgggcgctgctgctgccatcgaggccgccgccaagaagctggagcagctgaagccccgggccaagcccaaggaggctgatgagagcctgaactttgaggagcagatcctggaggccgccaagagcattgctgctgccaccagcgccctggtgaaggccgccagcgctgcccagcgggagctggtggcccagggcaaggtgggcgccatcccagccaatgccctggatgatggccagtggagccagggcctcatctctgctgccaggatggtggccgccgccaccaacaacctgtgtgaggccgccaatgctgctgtgcagggccacgccagccaggagaagctgatcagcagcgccaagcaggtggccgccagcacagcccagctgctggtggcctgcaaggtgaaggctgaccaggacagcgaggccatgaagaggctgcaggccgctggaaatgctgtgaagagggccagtgacaacctggtgaaggccgcccagaaggccgccgcctttgaggagcaggagaatgaaacagtggtggtgaaggagaagatggtgggcggcatcgcccagatcatcgccgcccaggaggagatgctgaggaaggagcgggagctggaggaggccaggaagaagctggcccagatccggcagcagcagtacaagttcctgcccagcgagctgagagatgagcactag

SEQ ID NO: 22070 - DNA, 3984 bp, Artificial Sequence
  Description of Artificial Sequence: Synthetic coding sequence
atggccgccagcagaagaagccagcaccaccaccaccaccaccagcagcagctgcagcctgcccctggggccagcgcccctcctcctcctcctcctccacccctgagccctggcctggcccctggcaccaccccagccagccccacagccagcggcctggccccctttgccagccccaggcatggcctggccctgcctgaaggagatggcagccgggaccccccagaccggcccaggagcccagaccctgtggatggcaccagctgctgcagcaccaccagcaccatctgcaccgtggccgccgcccctgtggtgcctgctgtgtccaccagcagcgctgctggggtggcccccaacccagctggcagcggcagcaacaacagccccagcagcagcagcagccccaccagcagcagcagcagcagccccagcagccctggcagcagcctggccgagagccctgaggccgccggcgtgagcagcacagcccccctgggccctggagctgctggccctggcaccggggtgcctgctgtgtctggggccctgcgggagctgctggaggcctgcagaaatggagatgtgtcccgggtgaagaggctggtggatgctgccaacgtgaatgccaaggacatggccggcaggaagagcagccccctgcactttgctgctggcttcggcaggaaggatgtggtggagcacctgctgcagatgggcgccaacgtgcacgccagagatgatggcggcctcatccccctgcacaatgcctgcagctttggacatgctgaggtggtgtccctgctgctgtgccagggcgctgaccccaatgcccgggacaactggaactacacccccctgcatgaagctgccatcaagggcaagattgatgtgtgcatcgtgctgctgcagcacggggctgaccccaacatccggaacacagatggcaagagcgccctggacctggccgaccccagcgccaaggctgtgctgactggagagtacaagaaggatgagctgctggaggccgcccggtctggaaatgaggagaagctgatggccctgctgacccccctgaatgtgaactgccacgccagtgatggcaggaagagcacccccctgcacctggccgccggctacaacagagtgcgcatcgtgcagctgctgctgcagcacggggctgatgtgcacgccaaggacaagggcggcctggtgcccctgcacaatgcctgcagctatggccactatgaggtgacagagctgctgctgaagcacggggcctgtgtgaatgccatggacctgtggcagttcacccccctgcacgaggccgccagcaagaacagagtggaggtgtgcagcctgctgctgagccatggagctgaccccaccctggtgaactgccacggcaagtctgctgtggacatggcccccaccccagagctgcgggagcggctgacctatgagttcaagggccacagcctgctgcaggccgcccgggaggccgacctggccaaggtgaagaagaccctggccctggagatcatcaacttcaagcagccccagagccatgaaacagccctgcactgtgctgtggccagcctgcaccccaagaggaagcaggtgacagagctgctgctgaggaaaggagccaacgtgaatgagaagaacaaggacttcatgacccccctgcacgtggccgctgagcgggcccacaatgatgtgatggaggtgctgcacaagcacggggccaagatgaatgccctggacaccctgggccagacagccctgcaccgggccgccctggccggccacctgcagacctgccgcctgctgctgtcctatggcagtgaccccagcatcatcagcctgcagggcttcaccgctgcccagatgggaaatgaggccgtgcagcagatcctgtctgagagcacccccatccgcaccagtgatgtggactaccgcctgctggaggccagcaaggccggggacctggagaccgtgaagcagctgtgcagcagccagaatgtgaactgccgggacctggagggccgccacagcacccccctgcactttgctgctggctacaacagagtgtctgtggtggagtacctgctgcaccacggggctgatgtgcacgccaaggacaagggcggcctggtgcccctgcacaatgcctgcagctatggccactatgaggtggccgagctgctggtgagacatggagcctctgtgaatgtggccgacctgtggaagttcacccccctgcatgaagctgctgccaagggcaagtatgagatctgcaagctgctgctgaagcacggggctgaccccaccaagaagaacagagatggcaacacccccctggacctggtgaaggagggggacacagacatccaggacctgctgcggggagatgctgccctgctggatgctgccaagaagggctgcctggcccgggtgcagaagctgtgcaccccagagaacatcaactgccgggacacccagggcaggaacagcacccccctgcacctggccgccggctacaacaacctggaggtggccgagtacctgctggagcacggggctgatgtgaatgcccaggacaagggcggcctcatccccctgcacaatgctgccagctatggccacgtggacattgctgccctgctgatcaagtacaacacctgtgtgaatgccacagacaagtgggccttcacccccctgcacgaggccgcccagaagggccgcacccagctgtgtgccctgctgctggcccatggagctgaccccaccatgaagaaccaggagggccagacccccctggacctggccacagcagatgacatccgggccctgctgattgatgccatgcctcctgaggccctgcccacctgcttcaagccccaggccaccgtggtgtctgccagcctcatcagccctgccagcacccccagctgcctgtctgctgccagcagcattgacaacctgaccggccccctggccgagctggccgtgggcggggccagcaatgctggagatggagctgctggaacagagaggaaggagggggaggtggccggcctggacatgaacatcagccagttcctgaagagcctgggcctggagcacctgcgggacatctttgaaacagagcagatcaccctggatgtgctggccgacatgggccacgaggagctgaaggagatcggcatcaatgcctacggccaccgccacaagctgatcaagggcgtggagcggctgctgggcggccagcagggcaccaacccctacctgaccttccactgtgtgaaccagggcaccatcctgctggacctggcccctgaggacaaggagtaccagagcgtggaggaggagatgcagagcaccatccgggagcacagagatggcggcaatgctgggggcatcttcaaccgctacaacgtcatccgcatccagaaggtggtgaacaagaagctgcgggagcgcttctgccaccggcagaaggaggtgtctgaggagaaccacaaccaccacaatgaaagaatgctgttccacggcagccccttcatcaatgccatcatccacaagggctttgatgaaagacatgcctacatcggcggcatgtttggagctggcatctactttgctgagaacagcagcaagagcaaccagtatgtgtatggcatcggcggcggcaccggctgccccacccacaaggacaggagctgctacatctgccaccggcagatgctgttctgccgggtgaccctgggcaagagcttcctgcagttcagcaccatgaagatggcccacgcccctcctggccaccacagcgtgattggccggcccagcgtgaatggcctggcctatgcagaatatgtgatctacagaggagagcaggcctacccagagtacctgatcacctaccagatcatgaagccagaggcccccagccagacagccacagctgctgagcagaagacctag

SEQ ID NO: 22071 - DNA, 3501 bp, Artificial Sequence
  Description of Artificial Sequence: Synthetic coding sequence
atgagcggccgccgctgtgccggcggcggggccgcctgtgccagcgctgctgctgaggccgtggagcctgctgcccgggagctgtttgaggcctgcagaaatggagatgtggagcgggtgaagaggctggtgaccccagagaaggtgaacagccgggacacagctggcaggaagagcacccccctgcactttgctgctggcttcggcaggaaggatgtggtggagtacctgctgcagaatggagccaacgtgcaggccagagatgatggcggcctcatccccctgcacaatgcctgcagctttggacatgctgaggtggtgaacctgctgctgcggcatggagctgaccccaatgcccgggacaactggaactacacccccctgcatgaagctgccatcaagggcaagattgatgtgtgcatcgtgctgctgcagcacggggctgagcccaccatccggaacacagatggccgcacagccctggacctggccgaccccagcgccaaggctgtgctgactggagagtacaagaaggatgagctgctggagagcgcccggtctggaaatgaggagaagatgatggccctgctgacccccctgaatgtgaactgccacgccagtgatggcaggaagagcacccccctgcacctggccgccggctacaacagagtgaagatcgtgcagctgctgctgcagcacggggctgatgtgcacgccaaggacaagggggacctggtgcccctgcacaatgcctgcagctatggccactatgaggtgacagagctgctggtgaagcacggggcctgtgtgaatgccatggacctgtggcagttcacccccctgcacgaggccgccagcaagaacagagtggaggtgtgcagcctgctgctgtcctatggagctgaccccaccctgctgaactgccacaacaagagcgccatcgacctggcccccaccccccagctgaaggagcggctggcctatgagttcaagggccacagcctgctgcaggccgcccgggaggctgatgtgacccgcatcaagaagcacctgagcctggagatggtgaacttcaagcacccccagacccatgaaacagccctgcactgtgccgccgccagcccctaccccaagaggaagcagatctgtgagctgctgctgaggaaaggagccaacatcaatgagaagaccaaggagttcctgacccccctgcacgtggccagcgagaaggcccacaatgatgtggtggaggtggtggtgaagcatgaggccaaggtgaatgccctggacaacctgggccagaccagcctgcaccgggccgcctactgcggccacctgcagacctgccgcctgctgctgtcctatggctgtgaccccaacatcatcagcctgcagggcttcaccgccctgcagatgggaaatgaaaatgtgcagcagctgctgcaggagggcatcagcctgggcaacagcgaggccgaccggcagctgctggaggccgccaaggctggagatgtggagaccgtgaagaagctgtgcaccgtgcagagcgtgaactgccgggacatcgagggccggcagagcacccccctgcactttgctgctggctacaacagagtgtctgtggtggagtacctgctgcagcacggggctgatgtgcacgccaaggacaagggcggcctggtgcccctgcacaatgcctgcagctatggccactatgaggtggccgagctgctggtgaagcatggagctgtggtgaatgtggccgacctgtggaagttcacccccctgcatgaagctgctgccaagggcaagtatgagatctgcaagctgctgctgcagcacggggctgaccccaccaagaagaacagagatggcaacacccccctggacctggtgaaggatggagacacagacatccaggacctgctgcggggagatgctgccctgctggatgctgccaagaagggctgcctggcccgggtgaagaagctgagcagcccagacaacgtgaactgccgggacacccagggccgccacagcacccccctgcacctggccgccggctacaacaacctggaggtggccgagtacctgctgcagcacggggctgatgtgaatgcccaggacaagggcggcctcatccccctgcacaatgctgccagctatggccacgtggatgtggccgccctgctgatcaagtacaatgcctgtgtgaatgccacagacaagtgggccttcacccccctgcacgaggccgcccagaagggccgcacccagctgtgtgccctgctgctggcccatggagctgaccccaccctgaagaaccaggagggccagacccccctggacctggtgtctgcagatgatgtgtctgccctgctgacagctgccatgcctccttctgccctgcccagctgctacaagccccaggtgctgaatggagtgcgcagccctggggccacagcagatgccctgagcagcggccccagcagccccagcagcctgtctgctgccagcagcctggacaacctgagcggcagcttcagcgagctgagctctgtggtgagcagcagcggcacagagggcgccagcagcctggagaagaaggaggtgcctggggtggacttcagcatcacccagtttgtgaggaacctgggcctggagcacctgatggacatctttgagcgggagcagatcaccctggatgtgctggtggagatgggccacaaggagctgaaggagatcggcatcaatgcctacggccaccgccacaagctgatcaagggcgtggagcggctcatcagcggccagcagggcctgaacccctacctgaccctgaacaccagcggcagcggcaccatcctgattgacctgagcccagatgacaaggagttccagagcgtggaggaggagatgcagagcacagtgcgggagcacagagatggcggccatgctgggggcatcttcaaccgctacaacatcctgaagatccagaaggtgtgcaacaagaagctgtgggagcgctacacccacaggaggaaggaggtgtctgaggagaaccacaaccacgccaatgaaagaatgctgttccacggcagcccctttgtgaatgccatcatccacaagggctttgatgaaagacatgcctacatcggcggcatgtttggagctggcatctactttgctgagaacagcagcaagagcaaccagtatgtgtatggaattggaggcggcaccggctgccctgtgcacaaggacaggagctgctacatctgccaccggcagctgctcttctgccgggtgaccctgggcaagagcttcctgcagttcagcgccatgaagatggcccacagccccccaggccaccacagcgtgacaggccggcccagcgtgaatggcctggccctggccgagtatgtgatctacagaggagagcaggcctacccagagtacctgatcacctaccagatcatgaggcctgagggcatggtggatggatag

SEQ ID NO: 22072 - DNA, 2139 bp, Artificial Sequence
  Description of Artificial Sequence: Synthetic coding sequence
atgagggagcccgccctggccgccagcgccatggcctaccaccccttccacgcccccaggcctgctgacttccccatgtctgccttcctggccgccgcccagcccagcttcttccctgccctggccctgcccccaggggccctggccaagcccctgcctgaccccggcctggccggggctgctgctgctgctgctgctgctgctgctgctgctgaggccggcctgcacgtgtctgccctgggcccccaccccccagctgcccacctgcggagcctgaagagcctggagccagaagatgaggtggaggatgaccccaaggtgaccctggaggccaaggagctgtgggaccagttccacaagctgggcacagagatggtgatcaccaagagcggccgcaggatgttcccccccttcaaggtgcgggtgtctggcctggacaagaaggccaagtacatcctgctgatggacatcgtggccgcagatgactgccgctacaagttccacaacagccgctggatggtggccggcaaggctgaccctgagatgcccaagaggatgtacatccacccagacagccctgccactggagagcagtggatggccaagcctgtggccttccacaagctgaagctgaccaacaacatcagtgacaagcacggcttcaccatcctgaacagcatgcacaagtaccagccccgcttccacatcgtgcgggccaatgacatcctgaagctgccctacagcaccttccgcacctacgtgtttcctgagacagacttcatcgctgtgacagcctaccagaatgacaagatcacccagctgaagattgacaacaacccctttgccaagggcttccgggacacaggaaatggccggcgggagaagaggaagcagctgaccctgcccagcctgcggctgtatgaggagcactgcaagccagagagagatggagctgagagtgatgccagcagctgtgaccccccaccagcccgggagccccccaccagccctggagctgcccccagccccctgcggctgcaccgggcccgggcagaggagaagagctgtgccgctgacagcgaccctgagcctgagcggctgtctgaggagcgggccggggcccccctgggccgcagccctgccccagacagcgccagccccacccggctgacagagcctgagcgggcccgggagaggaggagccctgagcggggcaaggagcctgctgagagcggaggagatggccccttcggcctgcggagcctggagaaggagagagctgaggcccggaggaaggatgagggcaggaaggaggccgctgagggcaaggagcagggcctggcccccctggtggtgcagacagacagcgccagccccctgggcgccggccacctgcccggcctggccttcagcagccacctgcacggccagcagttcttcggccccctgggcgccggccagcccctcttcctgcaccctggccagttcaccatgggccctggggccttcagcgccatgggcatgggccacctgctggcctctgtggccggcggcggcaatggaggcggcggcggccctggaacagctgctggcctggatgctgggggcctgggccctgctgccagcgctgccagcacagctgcccccttccccttccacctgagccagcacatgctggccagccagggcatccccatgcccacctttggaggcctcttcccctacccctacacctacatggctgctgctgctgctgctgccagcgccctgcctgccaccagcgctgctgctgctgctgctgctgctgctggcagcctgagccgcagccccttcctgggcagcgcccggccccggctgcgcttcagcccctaccagatccctgtgaccatcccccccagcaccagcctgctgaccaccggcctggccagcgagggcagcaaggctgctgggggcaacagccgggagcccagccccctgcctgagctggccctgaggaaggtgggcgcccccagcagaggagccctgagccccagcggcagcgccaaggaggccgccaatgagctgcagagcatccagaggctggtgtctggcctggagagccagagggccctgagccctggccgggagagccccaagtag

SEQ ID NO: 22073 - DNA, 981 bp, Artificial Sequence
  Description of Artificial Sequence: Synthetic coding sequence
atgtctgccttcctggccgccgcccagcccagcttcttccctgccctggccctgcccccaggggccctggccaagcccctgcctgaccccggcctggccggggctgctgctgctgctgctgctgctgctgctgctgctgaggccggcctgcacgtgtctgccctgggcccccaccccccagctgcccacctgcggagcctgaagagcctggagccagaagatgaggtggaggatgaccccaaggtgaccctggaggccaaggagctgtgggaccagttccacaagctgggcacagagatggtgatcaccaagtctggaagaaggatgtttcctcccttcaaggtgcgggtgtctggcctggacaagaaggccaagtacatcctgctgatggacatcgtggccgcagatgactgccgctacaagttccacaacagccgctggatggtggccggcaaggctgaccctgagatgcccaagaggatgtacatccacccagacagccctgccaccggggagcagtggatggccaagcctgtggccttccacaagctgaagctgaccaacaacatcagtgacaagcacggcttcaccatcctgaacagcatgcacaagtaccagccccgcttccacatcgtgcgggccaatgacatcctgaagctgccctacagcaccttccgcacctacgtgtttcctgagacagacttcatcgctgtgacagcctaccagaatgacaagatcacccagctgaagattgacaacaacccctttgccaagggcttccgggacacaggaaatggaagaagagagaagaggaagcagctgaccctgcccagcctgcggctgtatgaggagcactgcaagccagagagagatggagctgagagtgatgccagcagctgtgaccccccaccagcccgggagccccccaccagccctggggccgcccccagccccctgcggctgcaccgggcccggggctag

SEQ ID NO: 22074 - DNA, 996 bp, Artificial Sequence
  Description of Artificial Sequence: Synthetic coding sequence
atgacagagaggcctccttctgaggccgcccggagtgacccccagctggagggcagagatgctgctgaggcctccatggccccaccccacctggtgctgctgaatggagtggccaaggagaccagcagagctgctgctgctgagccccctgtgattgagctgggcgcccggggcggccctgggggcggccctgctgggggcggcggggccgcccgggacctgaagggcagagatgctgccacagctgaggcccggcaccgggtgcccaccacagagctgtgccggcccccaggccctgccccagccccagccccagcctctgtgacagctgagctgcctggagatggccgcatggtgcagctgagccccccagccctggccgccccagctgcccctggccgggccctgctgtacagcctgagccagcccctggccagcctgggcagcggcttcttcggggagccagatgccttccccatgttcaccaccaacaacagagtgaagagaagacccagcccctatgagatggagatcacagatggcccccacaccaaggtggtgcggcgcatcttcaccaacagccgggagcgctggaggcagcagaatgtgaatggagcctttgctgagctgaggaagctgatccccacccaccccccagacaagaagctgagcaagaatgagatcctgcggctggccatgaagtacatcaacttcctggccaagctgctgaatgaccaggaggaggagggcacccagagggccaagacaggcaaggaccctgtggtgggcgctgggggcggcggcggcggcggcggcggcggggcccccccagatgacctgctgcaggatgtgctgagccccaacagcagctgtggcagcagcctggatggagctgccagcccagacagctacacagaggagcccgcccccaagcacacagcccggagcctgcacccagccatgctgcctgctgctgatggagctggccccaggtag

SEQ ID NO: 22075 - DNA, 1002 bp, Artificial Sequence
  Description of Artificial Sequence: Synthetic coding sequence
atgacagagaggcctccttctgaggccgcccggagtgacccccagctggagggcagagatgctgctgaggcctccatggccccaccccacctggtgctgctgaatggagtggccaaggagaccagcagagctgctgctgctgagccccctgtgattgagctgggcgcccggggcggccctgggggcggccctgctgggggcggcggggccgcccgggacctgaagggcagagatgctgccacagctgaggcccggcaccgggtgcccaccacagagctgtgccggcccccaggccctgccccagccccagccccagcctctgtgacagctgagctgcctggagatggccgcatggtgcagctgagccccccagccctggccgccccagctgcccctggccgggccctgctgtacagcctgagccagcccctggccagcctgggcagccacagcggcttcttcggggagccagatgccttccccatgttcaccaccaacaacagagtgaagagaagacccagcccctatgagatggagatcacagatggcccccacaccaaggtggtgcggcgcatcttcaccaacagccgggagcgctggaggcagcagaatgtgaatggagcctttgctgagctgaggaagctgatccccacccaccccccagacaagaagctgagcaagaatgagatcctgcggctggccatgaagtacatcaacttcctggccaagctgctgaatgaccaggaggaggagggcacccagagggccaagacaggcaaggaccctgtggtgggcgctgggggcggcggcggcggcggcggcggcggggcccccccagatgacctgctgcaggatgtgctgagccccaacagcagctgtggcagcagcctggatggagctgccagcccagacagctacacagaggagcccgcccccaagcacacagcccggagcctgcacccagccatgctgcctgctgctgatggagctggccccaggtag

SEQ ID NO: 22076 - DNA, 996 bp, Artificial Sequence; identical to SEQ ID NO: 22074
  Description of Artificial Sequence: Synthetic coding sequence

SEQ ID NO: 22077 - DNA, 993 bp, Artificial Sequence
  Description of Artificial Sequence: Synthetic coding sequence
atggagcacctgggcccccaccacctgcaccctggccacgccgagcccatcagctttggaattgaccagatcctgaacagcccagaccagggcggctgcatgggccctgccagccggctgcaggatggagaatatggcctgggctgcctggtgggcggggcctacacctatggaggcggcggcagcgctgctgccaccggggccggcggggccggggcctacggcaccggcggccctgggggccctgggggccctgctgggggcggcggggcctgcagcatgggccccctgaccggcagctacaacgtgaacatggccctggccggcggccctggccctgggggcggcggcggcagcagcggcggggccggggccctgtctgctgctggggtcatccgggtgcctgcccaccggcccctggccggggctgtggcccacccccagcccctggccaccggcctgcccaccgtgcccagcgtgcctgccatgcctggggtgaacaacctgaccggcctgaccttcccctggatggagagcaacagacgctacaccaaggaccgcttcaccggccacccctaccagaacagaacaccacccaagaagaagaagcccaggaccagcttcacccggctgcagatctgtgagctggagaagcgcttccaccggcagaagtacctggccagcgctgagcgggccgccctggccaaggccctgaagatgacagatgcccaggtgaagacctggttccagaacagaaggaccaagtggaggcggcagacagctgaggagcgggaggccgagcggcagcaggccaaccgcatcctgctgcagctgcagcaggaggccttccagaagagcctggcccagcccctgcctgctgaccccctgtgtgtgcacaacagcagcctgtttgccctgcagaacctgcagccctggagcgatgacagcaccaagatcacctctgtgacctctgtggccagcgcctgtgagtag

SEQ ID NO: 22078 - DNA, 774 bp, Artificial Sequence
  Description of Artificial Sequence: Synthetic coding sequence
atggagcacctgggcccccaccacctgcaccctggccacgccgagcccatcagctttggaattgaccagatcctgaacagcccagaccagggcggctgcatgggccctgccagccggctgcaggatggagaatatggcctgggctgcctggtgggcggggcctacacctatggaggcggcggcagcgctgctgccaccggggccggcggggccggggcctacggcaccggcggccctgggggccctgggggccctgctgggggcggcggggcctgcagcatgggccccctgaccggcagctacaacgtgaacatggccctggccggcggccctggccctgggggcggcggcggcagcagcggcggggccggggccctgtctgctgctggggtcatccgggtgcctgcccaccggcccctggccggggctgtggcccacccccagcccctggccaccggcctgcccaccgtgcccagcgtgcctgccatgcctggggtgaacaacctgaccggcctgaccttcccctggatggagagcaacagacgctacaccaaggaccgcttcaccggccacccctaccagaacagaacaccacccaagaagaagaagcccaggaccagcttcacccggctgcagatctgtgagctggagaagcgcttccaccggcagaagtacctggccagcgctgagcgggccgccctggccaaggccctgaagatgacagatgcccaggtgaagacctggttccagaacagaaggaccaagtggaggtag

SEQ ID NO: 22079 - DNA, 345 bp, Artificial Sequence
  Description of Artificial Sequence: Synthetic coding sequence
atggctgaatgtcccaccctgggggaggccgtgacagaccacccagaccggctgtgggcctgggagaagtttgtgtacctggatgagaagcagcacgcctggctgcccctgaccatcgagatcaaggaccggctgcagctgcgggtgctgctgcggcgggaggatgtggtgctgggccggcccatgacccccacccagatcggccccagcctgctgcccatcatgtggcagctgtacccagatggccgctaccgcagcagtgacagcagcttctggaggctggtgtaccacatcaagattgatggagtggaggacatgctgctggagctgctgcctgatgactag

SEQ ID NO: 22080 - DNA, 345 bp, Artificial Sequence; identical to SEQ ID NO: 22079
  Description of Artificial Sequence: Synthetic coding sequence

SEQ ID NO: 22081 - DNA, 345 bp, Artificial Sequence; identical to SEQ ID NO: 22079
  Description of Artificial Sequence: Synthetic coding sequence

SEQ ID NO: 22082 - DNA, 345 bp, Artificial Sequence; identical to SEQ ID NO: 22079
  Description of Artificial Sequence: Synthetic coding sequence

SEQ ID NO: 22083 - DNA, 1407 bp, Artificial Sequence
  Description of Artificial Sequence: Synthetic coding sequence
atggacagcctggccagcctggtgctgtgtggggtgtccctgctgctgtctggaacagtggagggcgccatggacctgatcctgatcaacagcctgcccctggtgtctgatgctgagaccagcctgacctgcatcgccagcggctggaggcctcatgagcccatcaccatcggccgggactttgaggccctgatgaaccagcaccaggaccccctggaggtgacccaggatgtgacccgggagtgggccaagaaggtggtgtggaagcgggagaaggccagcaagatcaatggagcctacttctgtgagggccgggtgcggggggaggccatccgcatccgcaccatgaagatgaggcagcaggccagcttcctgcctgccaccctgaccatgacagtggacaagggggacaacgtgaacatctccttcaagaaggtgctgatcaaggaggaggatgctgtgatctacaagaatggcagcttcatccacagcgtgcccaggcatgaggtgcctgacatcctggaggtgcacctgccccacgcccagccccaggatgctggggtgtacagcgcccgctacatcggcggcaacctcttcaccagcgccttcacccggctgattgtgagaagatgtgaggcccagaagtggggccctgagtgcaaccacctgtgcacagcctgcatgaacaacggggtgtgccatgaagatactggagagtgcatctgccccccaggcttcatgggccgcacctgtgagaaggcctgtgagctgcacaccttcggccgcacctgcaaggagcgctgcagcggccaggagggctgcaagagctatgtgttctgcctgcctgacccctacggctgcagctgtgccaccggctggaagggcctgcagtgcaatgaaggcatccagaggatgacccccaagatcgtggacctgcctgaccacatcgaggtgaacagcggcaagttcaaccccatctgcaaggccagcggctggcccctgcccaccaatgaggagatgaccctggtgaagccagatggcaccgtgctgcaccccaaggacttcaaccacacagaccacttctctgtggccatcttcaccatccaccgcatcctgcccccagacagcggcgtgtgggtgtgcagcgtgaacacagtggccggcatggtggagaagcccttcaacatctctgtgaaggtgctgcccaagcccctgaatgccccaaatgtgattgacaccggccacaactttgctgtgatcaacatcagcagcgagccctactttggagatggccccatcaagagcaagaagctgctgtacaagcctgtgaaccactatgaggcctggcagcacatccaggtgtccatggagaagcagaggctgaccaaggccaacagcgacatctag

SEQ ID NO: 22084 - DNA, 3375 bp, Artificial Sequence
  Description of Artificial Sequence: Synthetic coding sequence
atggacagcctggccagcctggtgctgtgtggggtgtccctgctgctgtctggaacagtggagggcgccatggacctgatcctgatcaacagcctgcccctggtgtctgatgctgagaccagcctgacctgcatcgccagcggctggaggcctcatgagcccatcaccatcggccgggactttgaggccctgatgaaccagcaccaggaccccctggaggtgacccaggatgtgacccgggagtgggccaagaaggtggtgtggaagcgggagaaggccagcaagatcaatggagcctacttctgtgagggccgggtgcggggggaggccatccgcatccgcaccatgaagatgaggcagcaggccagcttcctgcctgccaccctgaccatgacagtggacaagggggacaacgtgaacatctccttcaagaaggtgctgatcaaggaggaggatgctgtgatctacaagaatggcagcttcatccacagcgtgcccaggcatgaggtgcctgacatcctggaggtgcacctgccccacgcccagccccaggatgctggggtgtacagcgcccgctacatcggcggcaacctcttcaccagcgccttcacccggctgattgtgagaagatgtgaggcccagaagtggggccctgagtgcaaccacctgtgcacagcctgcatgaacaacggggtgtgccatgaagatactggagagtgcatctgccccccaggcttcatgggccgcacctgtgagaaggcctgtgagctgcacaccttcggccgcacctgcaaggagcgctgcagcggccaggagggctgcaagagctatgtgttctgcctgcctgacccctacggctgcagctgtgccaccggctggaagggcctgcagtgcaatgaggcctgccaccctggcttctacggccctgactgcaagctgcgctgcagctgcaacaatggagagatgtgtgaccgcttccagggctgcctgtgcagccctggctggcagggcctgcagtgtgagcgggagggcatccagaggatgacccccaagatcgtggacctgcctgaccacatcgaggtgaacagcggcaagttcaaccccatctgcaaggccagcggctggcccctgcccaccaatgaggagatgaccctggtgaagccagatggcaccgtgctgcaccccaaggacttcaaccacacagaccacttctctgtggccatcttcaccatccaccgcatcctgcccccagattctggagtgtgggtgtgcagcgtgaacacagtggccggcatggtggagaagcccttcaacatctctgtgaaggtgctgcccaagcccctgaatgcccccaacgtcatcgacaccggccacaactttgctgtgatcaacatcagcagcgagccctactttggagatggccccatcaagagcaagaagctgctgtacaagcctgtgaaccactatgaggcctggcagcacatccaggtgaccaatgaaattgtgaccctgaactacctggagcccaggacagaatatgagctgtgtgtgcagctggtgagaagaggagagggcggggagggccaccctggccctgtgcggcgcttcaccacagccagcatcggcctgcccccaccccggggcctgaacctgctgcccaagagccagaccaccctgaacctgacctggcagcccatcttccccagcagtgaagatgacttctacgtggaggtggagcggcgctctgtgcagaagagtgaccagcagaacatcaaggtgcccggcaacctgacctctgtgctgctgaacaacctgcacccccgggagcagtatgtggtgcgggcccgggtgaacaccaaggcccagggcgagtggagcgaggacctgacagcctggaccctgagtgacatcctgcccccccagcctgagaacatcaagatcagcaacatcacccacagcagcgctgtgatctcctggaccatcctggatggctacagcatcagcagcatcaccatccgctacaaggtgcagggcaagaatgaagaccagcacgtggatgtgaagatcaagaatgccaccatcacccagtaccagctgaagggcctggagcctgagacagcctaccaggtggacatctttgctgagaacaacatcggcagcagcaacccagccttcagccatgagctggtgaccctgcctgagagccaggccccagctgacctgggcggcggcaagatgctgctgattgccatcctgggcagcgctggcatgacctgcctgactgtgctgctggccttcctgatcatcctgcagctgaagagggccaacgtgcagaggaggatggcccaggccttccagaatgtgcgggaggagcctgctgtgcagttcaacagcggcaccctggccctgaacaggaaggtgaagaacaacccagaccccaccatctaccctgtgctggactggaatgacatcaagttccaggacgtcatcggggagggcaactttggccaggtgctgaaggcccgcatcaagaaggatggcctgaggatggatgctgccatcaagaggatgaaggagtatgccagcaaggatgaccaccgggactttgctggggagctggaggtgctgtgcaagctgggccaccaccccaacatcatcaacctgctgggcgcctgtgagcaccggggctacctgtacctggccatcgagtatgcccctcatggcaacctgctggacttcctgaggaagagccgggtgctggagacagatcctgcctttgccatcgccaacagcacagccagcaccctgagcagccagcagctgctgcactttgctgctgatgtggcccggggcatggactacctgagccagaagcagttcatccaccgggacctggccgccaggaacatcctggtgggggagaactacgtggccaagattgctgactttggcctgagccggggccaggaggtgtatgtgaagaagaccatgggccgcctgcctgtgcgctggatggccatcgagagcctgaactacagcgtgtacaccaccaacagtgatgtgtggagctatggagtgctgctgtgggagatcgtgtccctgggcggcaccccctactgcggcatgacctgtgccgagctgtatgagaagctgccccagggctaccgcctggagaagcccctgaactgtgatgatgaggtgtatgacctgatgaggcagtgctggagggagaagccctatgaaagacccagctttgcccagatcctggtgtccctgaacaggatgctggaggagaggaagacctacgtgaacaccaccctgtatgagaagttcacctacgccggcatcgactgcagcgctgaggaggccgcctag

SEQ ID NO: 22085 - DNA, 3246 bp, Artificial Sequence
  Description of Artificial Sequence: Synthetic coding sequence
atggacagcctggccagcctggtgctgtgtggggtgtccctgctgctgtctggaacagtggagggcgccatggacctgatcctgatcaacagcctgcccctggtgtctgatgctgagaccagcctgacctgcatcgccagcggctggaggcctcatgagcccatcaccatcggccgggactttgaggccctgatgaaccagcaccaggaccccctggaggtgacccaggatgtgacccgggagtgggccaagaaggtggtgtggaagcgggagaaggccagcaagatcaatggagcctacttctgtgagggccgggtgcggggggaggccatccgcatccgcaccatgaagatgaggcagcaggccagcttcctgcctgccaccctgaccatgacagtggacaagggggacaacgtgaacatctccttcaagaaggtgctgatcaaggaggaggatgctgtgatctacaagaatggcagcttcatccacagcgtgcccaggcatgaggtgcctgacatcctggaggtgcacctgccccacgcccagccccaggatgctggggtgtacagcgcccgctacatcggcggcaacctcttcaccagcgccttcacccggctgattgtgagaagatgtgaggcccagaagtggggccctgagtgcaaccacctgtgcacagcctgcatgaacaacggggtgtgccatgaagatactggagagtgcatctgccccccaggcttcatgggccgcacctgtgagaaggcctgtgagctgcacaccttcggccgcacctgcaaggagcgctgcagcggccaggagggctgcaagagctatgtgttctgcctgcctgacccctacggctgcagctgtgccaccggctggaagggcctgcagtgcaatgaaggcatccagaggatgacccccaagatcgtggacctgcctgaccacatcgaggtgaacagcggcaagttcaaccccatctgcaaggccagcggctggcccctgcccaccaatgaggagatgaccctggtgaagccagatggcaccgtgctgcaccccaaggacttcaaccacacagaccacttctctgtggccatcttcaccatccaccgcatcctgcccccagacagcggcgtgtgggtgtgcagcgtgaacacagtggccggcatggtggagaagcccttcaacatctctgtgaaggtgctgcccaagcccctgaatgccccaaatgtgattgacaccggccacaactttgctgtgatcaacatcagcagcgagccctactttggagatggccccatcaagagcaagaagctgctgtacaagcctgtgaaccactatgaggcctggcagcacatccaggtgaccaatgagatcgtgaccctgaactacctggagcccaggacagaatatgagctgtgtgtgcagctggtgcggcggggggagggcggggagggccaccctggccctgtgcggcgcttcaccacagccagcatcggcctgcccccaccccggggcctgaacctgctgcccaagagccagaccaccctgaacctgacctggcagcccatcttccccagcagtgaagatgacttctacgtggaggtggagaggagatctgtgcagaagagtgaccagcagaacatcaaggtgcccggcaacctgacctctgtgctgctgaacaacctgcacccccgggagcagtatgtggtgcgggcccgggtgaacaccaaggcccagggcgagtggagcgaggacctgacagcctggaccctgagtgacatcctgcccccccagcctgagaacatcaagatcagcaacatcacccacagcagcgctgtgatctcctggaccatcctggatggctacagcatcagcagcatcaccatccgctacaaggtgcagggcaagaatgaagaccagcacgtggatgtgaagatcaagaatgccaccatcacccagtaccagctgaagggcctggagcctgagacagcctaccaggtggacatctttgctgagaacaacatcggcagcagcaacccagccttcagccatgagctggtgaccctgcctgagagccaggccccagctgacctgggcggcggcaagatgctgctgattgccatcctgggcagcgctggcatgacctgcctgactgtgctgctggccttcctgatcatcctgcagctgaagagggccaacgtgcagaggaggatggcccaggccttccagaatgtgcgggaggagcctgctgtgcagttcaacagcggcaccctggccctgaacaggaaggtgaagaacaacccagaccccaccatctaccctgtgctggactggaatgacatcaagttccaggatgtgattggagagggcaactttggccaggtgctgaaggcccgcatcaagaaggatggcctgaggatggatgctgccatcaagaggatgaaggagtatgccagcaaggatgaccaccgggactttgctggggagctggaggtgctgtgcaagctgggccaccaccccaacatcatcaacctgctgggcgcctgtgagcaccggggctacctgtacctggccattgaatatgccccccacggcaacctgctggacttcctgaggaagagccgggtgctggagacagatcctgcctttgccatcgccaacagcacagccagcaccctgagcagccagcagctgctgcactttgctgctgatgtggcccggggcatggactacctgagccagaagcagttcatccaccgggacctggccgccaggaacatcctggtgggagaaaattatgtggccaagattgctgactttggcctgagccggggccaggaggtgtatgtgaagaagaccatgggccgcctgcctgtgcgctggatggccatcgagagcctgaactacagcgtgtacaccaccaacagtgatgtgtggagctatggagtgctgctgtgggagatcgtgtccctgggcggcaccccctactgcggcatgacctgtgccgagctgtatgagaagctgccccagggctaccgcctggagaagcccctgaactgtgatgatgaggtgtatgacctgatgaggcagtgctggagggagaagccctatgagcggcccagctttgcccagatcctggtgtccctgaacaggatgctggaggagaggaagacctacgtgaacaccaccctgtatgagaagttcacctacgccggcatcgactgcagcgctgaggaggccgcctag

SEQ ID NO: 22086 - DNA, 3375 bp, Artificial Sequence; identical to SEQ ID NO: 22084
  Description of Artificial Sequence: Synthetic coding sequence

SEQ ID NO: 22087 - DNA, 2931 bp, Artificial Sequence
  Description of Artificial Sequence: Synthetic coding sequence
atggacagcctggccagcctggtgctgtgtggggtgtccctgctgctgagcgccagcttcctgcctgccaccctgaccatgacagtggacaagggggacaacgtgaacatctccttcaagaaggtgctgatcaaggaggaggatgctgtgatctacaagaatggcagcttcatccacagcgtgcccaggcatgaggtgcctgacatcctggaggtgcacctgccccacgcccagccccaggatgctggggtgtacagcgcccgctacatcggcggcaacctcttcaccagcgccttcacccggctgattgtgagaagatgtgaggcccagaagtggggccctgagtgcaaccacctgtgcacagcctgcatgaacaacggggtgtgccatgaagatactggagagtgcatctgccccccaggcttcatgggccgcacctgtgagaaggcctgtgagctgcacaccttcggccgcacctgcaaggagcgctgcagcggccaggagggctgcaagagctatgtgttctgcctgcctgacccctacggctgcagctgtgccaccggctggaagggcctgcagtgcaatgaaggcatccagaggatgacccccaagatcgtggacctgcctgaccacatcgaggtgaacagcggcaagttcaaccccatctgcaaggccagcggctggcccctgcccaccaatgaggagatgaccctggtgaagccagatggcaccgtgctgcaccccaaggacttcaaccacacagaccacttctctgtggccatcttcaccatccaccgcatcctgcccccagacagcggcgtgtgggtgtgcagcgtgaacacagtggccggcatggtggagaagcccttcaacatctctgtgaaggtgctgcccaagcccctgaatgccccaaatgtgattgacaccggccacaactttgctgtgatcaacatcagcagcgagccctactttggagatggccccatcaagagcaagaagctgctgtacaagcctgtgaaccactatgaggcctggcagcacatccaggtgaccaatgagatcgtgaccctgaactacctggagcccaggacagaatatgagctgtgtgtgcagctggtgcggcggggggagggcggggagggccaccctggccctgtgcggcgcttcaccacagccagcatcggcctgcccccaccccggggcctgaacctgctgcccaagagccagaccaccctgaacctgacctggcagcccatcttccccagcagtgaagatgacttctacgtggaggtggagaggagatctgtgcagaagagtgaccagcagaacatcaaggtgcccggcaacctgacctctgtgctgctgaacaacctgcacccccgggagcagtatgtggtgcgggcccgggtgaacaccaaggcccagggcgagtggagcgaggacctgacagcctggaccctgagtgacatcctgcccccccagcctgagaacatcaagatcagcaacatcacccacagcagcgctgtgatctcctggaccatcctggatggctacagcatcagcagcatcaccatccgctacaaggtgcagggcaagaatgaagaccagcacgtggatgtgaagatcaagaatgccaccatcacccagtaccagctgaagggcctggagcctgagacagcctaccaggtggacatctttgctgagaacaacatcggcagcagcaacccagccttcagccatgagctggtgaccctgcctgagagccaggccccagctgacctgggcggcggcaagatgctgctgattgccatcctgggcagcgctggcatgacctgcctgactgtgctgctggccttcctgatcatcctgcagctgaagagggccaacgtgcagaggaggatggcccaggccttccagaaccgggaggagcctgctgtgcagttcaacagcggcaccctggccctgaacaggaaggtgaagaacaacccagaccccaccatctaccctgtgctggactggaatgacatcaagttccaggacgtcatcggggagggcaactttggccaggtgctgaaggcccgcatcaagaaggatggcctgaggatggatgctgccatcaagaggatgaaggagtatgccagcaaggatgaccaccgggactttgctggggagctggaggtgctgtgcaagctgggccaccaccccaacatcatcaacctgctgggcgcctgtgagcaccggggctacctgtacctggccatcgagtatgcccctcatggcaacctgctggacttcctgaggaagagccgggtgctggagacagatcctgcctttgccatcgccaacagcacagccagcaccctgagcagccagcagctgctgcactttgctgctgatgtggcccggggcatggactacctgagccagaagcagttcatccaccgggacctggccgccaggaacatcctggtgggggagaactacgtggccaagattgctgactttggcctgagccggggccaggaggtgtatgtgaagaagaccatgggccgcctgcctgtgcgctggatggccatcgagagcctgaactacagcgtgtacaccaccaacagtgatgtgtggagctatggagtgctgctgtgggagatcgtgtccctgggcggcaccccctactgcggcatgacctgtgccgagctgtatgagaagctgccccagggctaccgcctggagaagcccctgaactgtgatgatgaggtgtatgacctgatgaggcagtgctggagggagaagccctatgaaagacccagctttgcccagatcctggtgtccctgaacaggatgctggaggagaggaagacctacgtgaacaccaccctgtatgagaagttcacctacgccggcatcgactgcagcgctgaggaggccgcctag

SEQ ID NO: 22088 - DNA, 7884 bp, Artificial Sequence
  Description of Artificial Sequence: Synthetic coding sequence
atggagaagctgcacggccacgtgtctgcccacccagacatcctgagcctggagaaccgctgcctggccatgctgcctgacctgcagcccctggagaagctgcaccagcacgtgtccacccacagcgacatcctgagcctgaagaaccagtgcctggccaccctgcctgacctgaagaccatggagaagccccacggctacgtgtctgcccacccagacatcctgagcctggagaaccagtgcctggccaccctgagtgacctgaagaccatggagaagccccacggccacgtgtctgcccacccagacatcctgagcctggagaaccgctgcctggccaccctgagcagcctgaagagcacagtgtctgccagccccctcttccagagcctgcagatcagccacatgacccaggccgacctgtacagagtgaacaacagcaactgcctgctgtctgagccccccagctggagggcccagcacttcagcaagggcctggacctgagcacctgccccatcgccctgaagagcatcagcgccacagaaacagcccaggaggccaccctgggccgctggtttgattctgaggagaagaagggagctgagacccagatgcccagctacagcctgagcctgggggaggaggaggaggtggaggacctggccgtgaagctgaccagcggggacagcgagagccaccctgagcccacagaccacgtgctgcaggagaagaagatggccctgctgagcctgctgtgcagcaccctggtgtctgaggtgaacatgaacaacaccagtgaccccaccctggccgccatctttgagatctgccgggagctggccctgctggagcctgagttcatcctgaaggccagcctgtatgcccggcagcagctgaatgtgagaaatgtggccaacaacatcctggccatcgccgccttcctgcctgcctgccggccccacctgcggcgctacttctgtgccatcgtgcagctgcccagcgactggatccaggtggccgagctgtaccagagcctggccgagggggacaagaacaagctggtgcccctgcctgcctgcctgaggacagccatgacagacaagtttgcccagtttgatgagtaccagctggccaagtacaaccccaggaagcaccgggccaagaggcacccccggcggccccccaggagccctggcatggagccccccttcagccaccgctgcttcccccgctacatcggcttcctgcgggaggagcagaggaagtttgagaaggccggggacacagtgtctgagaagaagaaccccccacgcttcaccctgaagaagctggtgcagaggctgcacatccacaagccagcccagcacgtgcaggccctgctgggctaccgctaccccagcaacctgcagctgttcagccgcagccggctgcccggcccctgggacagcagccgggccggcaagaggatgaagctgagcaggcctgagacctgggagcgggagctgagcctgcggggcaacaaggcctctgtgtgggaggagctgattgaaaatggcaagctgcccttcatggccatgctgaggaacctgtgcaacctgctgcgggtgggcatcagcagccgccaccacgagctgatcctgcagaggctgcagcacgccaagagcgtcatccacagccggcagttccccttccgcttcctgaatgcccatgatgccattgatgccctggaggcccagctgaggaaccaggccctgcccttccccagcaacatcaccctgatgaggcgcatcctgaccagaaatgagaagaaccggccccggcggcgcttcctgtgccacctgagccggcagcagctgaggatggccatgagaattcctgtgctgtatgagcagctgaagcgggagaagctgcgggtgcacaaggcccggcagtggaagtatgatggagagatgctgaaccgctaccggcaggccctggagacagctgtgaacctgtctgtgaagcacagcctgcccctgctgcccggccgcacagtgctggtgtacctgacagatgccaatgctgaccggctgtgccccaagagcaacccccagggcccccccctgaactatgccctgctgctgattggcatgatgatcaccagggctgagcaggtggatgtggtgctgtgtggcggggacaccctgaagacagctgtgctgaaggccgaggagggcatcctgaagacagccatcaagctgcaggcccaggtgcaggagtttgatgaaaatgatggctggagcctgaacaccttcggcaagtacctgctgagcctggccggccagagggtgcctgtggacagagtcatcctgctgggccagagcatggatgatggcatgatcaacgtggccaagcagctgtactggcagagggtgaacagcaagtgcctgtttgtgggcatcctgctgcggcgggtgcagtacctgagcacagacctgaaccccaatgatgtgaccctgagcggctgcacagatgccatcctgaagttcatcgccgagcacggggccagccacctgctggagcacgtgggccagatggacaagatcttcaagatccccccacctcctgggaagacaggagtgcagagcctgcggcccctggaggaggacacccccagccccctggcccctgtgtcccagcagggctggaggagcatccgcctcttcatcagcagcaccttccgggacatgcatggagagcgggacctgctgctgcggtctgtgctgcctgccctgcaggcccgggccgccccccaccgcatcagcctgcatggaattgacctgcgctggggcgtgacagaggaggagaccaggaggaaccggcagctggaggtgtgcctgggggaggtggagaatgcccagctgtttgtgggcatcctgggcagccgctatggctacatccccccatcctacaacctgcctgaccacccccacttccactgggcccagcagtaccccagcggccgctctgtgacagagatggaggtgatgcagttcctgaacagaaaccagaggctgcagcccagcgcccaggccctgatctacttccgggacagcagcttcctgagctctgtgcctgatgcctggaagagtgactttgtgtctgagagcgaggaggccgcccggcgcatcagcgagctgaagagctacctgagccggcagaagggcatcacctgccgccgctacccctgtgagtggggcggcgtggccgccggccggccctacgtgggcggcctggaggagtttggccagctggtgctgcaggatgtgtggaacatgatccagaagctgtacctgcagcccggggccctgctggagcagcctgtgtccatcccagatgatgacctggtgcaggccaccttccagcagctgcagaagccacccagccctgcccggccccggctgctgcaggacacagtgcagaggctgatgctgccccacggccgcctgagcctggtgacaggccagagcggccagggcaagacagccttcctggccagcctggtgtctgccctgcaggccccagatggagccaaggtggccagcctggtgttcttccacttcagcggggcccggccagaccagggcctggccctgaccctgctgcggcggctgtgcacctacctgcggggccagctgaaggagcccggggccctgcccagcacctaccgcagcctggtgtgggagctgcagcagaggctgctgcccaagtctgctgagagcctgcaccctggccagacccaggtgctgatcattgatggagctgaccggctggtggaccagaatggccagctgatcagtgactggatccccaagaagctgccccgctgtgtgcacctggtgctgtctgtgtccagtgatgctggcctgggggagaccctggagcagagccagggcgcccacgtgctggccctgggccccctggaggccagcgcccgggcccggctggtgcgggaggagctggccctgtatggcaagaggctggaggagagccccttcaacaaccagatgaggctgctgctggtgaagcgggagagcggccggcccctgtacctgcggctggtgacagaccacctgcggctcttcaccctgtatgagcaggtgtctgagcggctgcggaccctgcctgccaccgtgcccctgctgctgcagcacatcctgagcaccctggagaaggagcacggcccagatgtgctgccccaggccctgacagccctggaggtgaccaggagcggcctgactgtggaccagctgcacggcgtgctgtctgtgtggaggaccctgcccaagggcaccaagtcctgggaggaggccgtggccgccggcaacagcggggacccctaccccatgggcccctttgcctgcctggtgcagagcctgcggagcctgctgggggagggccccctggagaggcctggggcccggctgtgcctgcctgatggccccctgaggacagctgccaagcgctgctacggcaagaggcctggcctggaggacacagcccacatcctgattgctgcccagctgtggaagacctgtgatgctgatgccagcggcaccttccgcagctgccccccagaggccctgggggacctgccctaccacctgctgcagagcggcaacagaggcctgctgagcaagttcctgaccaacctgcacgtggtggccgcccacctggagctgggcctggtgtcccggctgctggaggcccacgccctgtatgccagctctgtgcccaaggaggagcagaagctgcctgaggctgatgtggccgtgttccgcaccttcctgcggcagcaggccagcatcctgagccagtacccccggctgctgccccagcaggccgccaaccagcccctggacagccccctgtgccaccaggccagcctgctgagccgccgctggcacctgcagcacaccctgcgctggctgaacaagcccaggaccatgaagaaccagcagagcagcagcctgagcctggccgtgagcagcagccccacagctgtggccttcagcaccaacggccagagagctgctgtgggcacagccaatggaacagtgtacctgctggacctgcggacctggcaggaggagaagtctgtggtgtctggctgtgatggcatcagcgcctgcctcttcctgagtgatgacaccctcttcctgacagcctttgatggcctgctggagctgtgggacctgcagcacggctgccgggtgctgcagaccaaggcccaccagtaccagatcaccggctgctgcctgagcccagactgccgcctgctggccaccgtgtgcctgggcggctgcctgaagctgtgggacacagtgcggggccagctggccttccagcacacctaccccaagagcctgaactgtgtggccttccaccctgagggccaggtgattgccaccggctcctgggccggcagcatctccttcttccaggtggatggcctgaaggtgaccaaggacctgggcgcccctggggccagcatccgcaccctggccttcaacgtgcctggaggagtggtggccgtgggccgcctggacagcatggtggagctgtgggcctggagggagggcgcccggctggccgccttccctgcccaccacggctttgtggccgccgccctcttcctgcatgctggctgccagctgctgacagctggggaggatggcaaggtgcaggtgtggagcggcagcctgggccggccccggggccacctgggcagcctgagcctgagccctgccctgtctgtggccctgagcccagatggagacagagtggccgtgggctacagagcagatggcatccgcatctacaagatcagcagcggcagccagggcgcccagggccaggccctggatgtggccgtgtctgccctggcctggctgagccccaaggtgctggtgtctggagcagaagatggcagcctgcagggctgggccctgaaggaatgttccctgcagagcctgtggctgctgagccgcttccagaagcctgtgctgggcctggccaccagccaggagctgctggccagcgccagcgaggacttcaccgtgcagctgtggccccggcagctgctgacccggccccacaaggccgaggacttcccctgtggcacagagctgcggggccacgagggccctgtgtcctgctgcagcttcagcacagatggcggcagcctggccaccggcggccgggacaggagcctgctgtgctgggatgtgaggacccccaagacccctgtgctgatccacagcttccctgcctgccaccgggactgggtgacaggctgtgcctggaccaaggacaacctgctgatcagctgcagcagtgatggctctgtgggcctgtgggaccctgagagcggccagaggctgggccagttcctgggccaccagagcgctgtgtctgctgtggccgctgtggaggagcacgtggtgtctgtgtccagagatggcaccctgaaggtgtgggaccaccagggcgtggagctgaccagcatcccagcccacagcggccccatcagccactgtgccgccgccatggagcccagggctgctggccagcccggcagcgagctgctggtggtgacagtgggcctggatggagccacccggctgtggcaccccctgctggtgtgccagacccacaccctgctgggccacagcggccctgtgcgggctgctgctgtgtctgagaccagcggcctgatgctgacagcctctgaagatggctctgtgcggctgtggcaggtgcccaaggaggctgatgacacctgcatccccaggagcagcgctgctgtgacagctgtggcctgggccccagatggctccatggctgtgtctggcaaccaggccggggagctgatcctgtggcaggaggccaaggctgtggccacagcccaggcccctggccacatcggggccctgatctggagcagcgcccacaccttctttgtgctgtctgcagatgagaagatcagcgagtggcaggtgaagctgaggaaaggaagtgcccctggcaacctgagcctgcacctgaaccgcatcctgcaggaggacctgggcgtgctgaccagcctggactgggccccagatggccacttcctgatcctggccaaggctgacctgaagctgctgtgcatgaagccaggagatgcccccagcgagatctggagcagctacacagagaaccccatgatcctgagcacccacaaggagtatggcatctttgtgctgcagcccaaggaccccggggtgctgtccttcctgcggcagaaggagagcggggagtttgaggagcggctgaactttgacatcaacctggagaaccccagcaggaccctcatcagcatcacccaggccaagccagagagcgagagcagcttcctgtgtgccagcagtgatggcatcctgtggaacctggccaagtgcagccctgagggggagtggaccactggaaacatgtggcagaagaaggccaacaccccagagacccagaccccaggcacagaccccagcacctgccgggagagtgatgcctccatggacagtgatgcctccatggattctgagcccaccccccacctgaagacccggcagaggaggaagatccacagcggctctgtgacagccctgcacgtgctgcctgagctgctggtgacagccagcaaggacagagatgtgaagctgtgggagcggcccagcatgcagctgctgggcctcttccgctgtgagggctctgtgtcctgcctggagccctggctgggcgccaacagcaccctgcagctggccgtgggagatgtgcagggcaatgtgtacttcctgaactgggagtag

SEQ ID NO: 22089 - DNA, 7860 bp, Artificial Sequence
  Description of Artificial Sequence: Synthetic coding sequence
atggagaagctgcacggccacgtgtctgcccacccagacatcctgagcctggagaaccgctgcctggccatgctgcctgacctgcagcccctggagaagctgcaccagcacgtgtccacccacagcgacatcctgagcctgaagaaccagtgcctggccaccctgcctgacctgaagaccatggagaagccccacggctacgtgtctgcccacccagacatcctgagcctggagaaccagtgcctggccaccctgagtgacctgaagaccatggagaagccccacggccacgtgtctgcccacccagacatcctgagcctggagaaccgctgcctggccaccctgagcagcctgaagagcacagtgtctgccagccccctcttccagagcctgcagatcagccacatgacccaggccgacctgtacagagtgaacaacagcaactgcctgctgtctgagccccccagctggagggcccagcacttcagcaagggcctggacctgagcacctgccccatcgccctgaagagcatcagcgccacagaaacagcccaggaggccaccctgggccgctggtttgattctgaggagaagaagggagctgagacccagatgcccagctacagcctgagcctgggggaggaggaggaggtggaggacctggccgtgaagctgaccagcggggacagcgagagccaccctgagcccacagaccacgtgctgcaggagaagaagatggccctgctgagcctgctgtgcagcaccctggtgtctgaggtgaacatgaacaacaccagtgaccccaccctggccgccatctttgagatctgccgggagctggccctgctggagcctgagttcatcctgaaggccagcctgtatgcccggcagcagctgaatgtgagaaatgtggccaacaacatcctggccatcgccgccttcctgcctgcctgccggccccacctgcggcgctacttctgtgccatcgtgcagctgcccagcgactggatccaggtggccgagctgtaccagagcctggccgagggggacaagaacaagctggtgcccctgcctgcctgcctgaggacagccatgacagacaagtttgcccagtttgatgagtaccagctggccaagtacaaccccaggaagcaccgggccaagaggcacccccggcggccccccaggagccctggcatggagccccccttcagccaccgctgcttcccccgctacatcggcttcctgcgggaggagcagaggaagtttgagaaggccggggacacagtgtctgagaagaagaaccccccacgcttcaccctgaagaagctggtgcagaggctgcacatccacaagccagcccagcacgtgcaggccctgctgggctaccgctaccccagcaacctgcagctgttcagccgcagccggctgcccggcccctgggacagcagccgggccggcaagaggatgaagctgagcaggcctgagacctgggagcgggagctgagcctgcggggcaacaaggcctctgtgtgggaggagctgattgaaaatggcaagctgcccttcatggccatgctgaggaacctgtgcaacctgctgcgggtgggcatcagcagccgccaccacgagctgatcctgcagaggctgcagcacgccaagagcgtcatccacagccggcagttccccttccgcttcctgaatgcccatgatgccattgatgccctggaggcccagctgaggaaccaggccctgcccttccccagcaacatcaccctgatgaggcgcatcctgaccagaaatgagaagaaccggccccggcggcgcttcctgtgccacctgagccggcagcagctgaggatggccatgagaattcctgtgctgtatgagcagctgaagcgggagaagctgcgggtgcacaaggcccggcagtggaagtatgatggagagatgctgaaccgctaccggcaggccctggagacagctgtgaacctgtctgtgaagcacagcctgcccctgctgcccggccgcacagtgctggtgtacctgacagatgccaatgctgaccggctgtgccccaagagcaacccccagggcccccccctgaactatgccctgctgctgattggcatgatgatcaccagggctgagcaggtggatgtggtgctgtgtggcggggacaccctgaagacagctgtgctgaaggccgaggagggcatcctgaagacagccatcaagctgcaggcccaggtgcaggagtttgatgaaaatgatggctggagcctgaacaccttcggcaagtacctgctgagcctggccggccagagggtgcctgtggacagagtcatcctgctgggccagagcatggatgatggcatgatcaacgtggccaagcagctgtactggcagagggtgaacagcaagtgcctgtttgtgggcatcctgctgcggcgggtgcagtacctgagcacagacctgaaccccaatgatgtgaccctgagcggctgcacagatgccatcctgaagttcatcgccgagcacggggccagccacctgctggagcacgtgggccagatggacaagatcttcaagatccccccacctcctgggaagacaggagtgcagagcctgcggcccctggaggaggacacccccagccccctggcccctgtgtcccagcagggctggaggagcatccgcctcttcatcagcagcaccttccgggacatgcatggagagcgggacctgctgctgcggtctgtgctgcctgccctgcaggcccgggccgccccccaccgcatcagcctgcatggaattgacctgcgctggggcgtgacagaggaggagaccaggaggaaccggcagctggaggtgtgcctgggggaggtggagaatgcccagctgtttgtgggcatcctgggcagccgctatggctacatccccccatcctacaacctgcctgaccacccccacttccactgggcccagcagtaccccagcggccgctctgtgacagagatggaggtgatgcagttcctgaacagaaaccagaggctgcagcccagcgcccaggccctgatctacttccgggacagcagcttcctgagctctgtgcctgatgcctggaagagtgactttgtgtctgagagcgaggaggccgcccggcgcatcagcgagctgaagagctacctgagccggcagaagggcatcacctgccgccgctacccctgtgagtggggcggcgtggccgccggccggccctacgtgggcggcctggaggagtttggccagctggtgctgcaggatgtgtggaacatgatccagaagctgtacctgcagcccggggccctgctggagcagcctgtgtccatcccagatgatgacctggtgcaggccaccttccagcagctgcagaagccacccagccctgcccggccccggctgctgcaggacacagtgcagaggctgatgctgccccacggccgcctgagcctggtgacaggccagagcggccagggcaagacagccttcctggccagcctggtgtctgccctgcaggccccagatggagccaaggtggccagcctggtgttcttccacttcagcggggcccggccagaccagggcctggccctgaccctgctgcggcggctgtgcacctacctgcggggccagctgaaggagcccggggccctgcccagcacctaccgcagcctggtgtgggagctgcagcagaggctgctgcccaagtctgctgagagcctgcaccctggccagacccaggtgctgatcattgatggagctgaccggctggtggaccagaatggccagctgatcagtgactggatccccaagaagctgccccgctgtgtgcacctggtgctgtctgtgtccagtgatgctggcctgggggagaccctggagcagagccagggcgcccacgtgctggccctgggccccctggaggccagcgcccgggcccggctggtgcgggaggagctggccctgtatggcaagaggctggaggagagccccttcaacaaccagatgaggctgctgctggtgaagcgggagagcggccggcccctgtacctgcggctggtgacagaccacctgcggctcttcaccctgtatgagcaggtgtctgagcggctgcggaccctgcctgccaccgtgcccctgctgctgcagcacatcctgagcaccctggagaaggagcacggcccagatgtgctgccccaggccctgacagccctggaggtgaccaggagcggcctgactgtggaccagctgcacggcgtgctgtctgtgtggaggaccctgcccaagggcaccaagtcctgggaggaggccgtggccgccggcaacagcggggacccctaccccatgggcccctttgcctgcctggtgcagagcctgcggagcctgctgggggagggccccctggagaggcctggggcccggctgtgcctgcctgatggccccctgaggacagctgccaagcgctgctacggcaagaggcctggcctggaggacacagcccacatcctgattgctgcccagctgtggaagacctgtgatgctgatgccagcggcaccttccgcagctgccccccagaggccctgggggacctgccctaccacctgctgcagagcggcaacagaggcctgctgagcaagttcctgaccaacctgcacgtggtggccgcccacctggagctgggcctggtgtcccggctgctggaggcccacgccctgtatgccagctctgtgcccaaggaggagcagaagctgcctgaggctgatgtggccgtgttccgcaccttcctgcggcagcaggccagcatcctgagccagtacccccggctgctgccccagcaggccgccaaccagcccctggacagccccctgtgccaccaggccagcctgctgagccgccgctggcacctgcagcacaccctgcgctggctgaacaagcccaggaccatgaagaaccagcagagcagcagcctgagcctggccgtgagcagcagccccacagctgtggccttcagcaccaacggccagagagctgctgtgggcacagccaatggaacagtgtacctgctggacctgcggacctggcaggaggagaagtctgtggtgtctggctgtgatggcatcagcgcctgcctcttcctgagtgatgacaccctcttcctgacagcctttgatggcctgctggagctgtgggacctgcagcacggctgccgggtgctgcagaccaaggcccaccagtaccagatcaccggctgctgcctgagcccagactgccgcctgctggccaccgtgtgcctgggcggctgcctgaagctgtgggacacagtgcggggccagctggccttccagcacacctaccccaagagcctgaactgtgtggccttccaccctgagggccaggtgattgccaccggctcctgggccggcagcatctccttcttccaggtggatggcctgaaggtgaccaaggacctgggcgcccctggggccagcatccgcaccctggccttcaacgtgcctggaggagtggtggccgtgggccgcctggacagcatggtggagctgtgggcctggagggagggcgcccggctggccgccttccctgcccaccacggctttgtggccgccgccctcttcctgcatgctggctgccagctgctgacagctggggaggatggcaaggtgcaggtgtggagcggcagcctgggccggccccggggccacctgggcagcctgagcctgagccctgccctgtctgtggccctgagcccagatggagacagagtggccgtgggctacagagcagatggcatccgcatctacaagatcagcagcggcagccagggcgcccagggccaggccctggatgtggccgtgtctgccctggcctggctgagccccaaggtgctggtgtctggagcagaagatggcagcctgcagggctgggccctgaaggaatgttccctgcagagcctgtggctgctgagccgcttccagaagcctgtgctgggcctggccaccagccaggagctgctggccagcgccagcgaggacttcaccgtgcagctgtggccccggcagctgctgacccggccccacaaggccgaggacttcccctgtggcacagagctgcggggccacgagggccctgtgtcctgctgcagcttcagcacagatggcggcagcctggccaccggcggccgggacaggagcctgctgtgctgggatgtgaggacccccaagacccctgtgctgatccacagcttccctgcctgccaccgggactgggtgacaggctgtgcctggaccaaggacaacctgctgatcagctgcagcagtgatggctctgtgggcctgtgggaccctgagagcggccagaggctgggccagttcctgggccaccagagcgctgtgtctgctgtggccgctgtggaggagcacgtggtgtctgtgtccagagatggcaccctgaaggtgtgggaccaccagggcgtggagctgaccagcatcccagcccacagcggccccatcagccactgtgccgccgccatggagcccagggctgctggccagcccggcagcgagctgctggtggtgacagtgggcctggatggagccacccggctgtggcaccccctgctggtgtgccagacccacaccctgctgggccacagcggccctgtgcgggctgctgctgtgtctgagaccagcggcctgatgctgacagcctctgaagatggctctgtgcggctgtggcaggtgcccaaggaggctgatgacacctgcatccccaggagcagcgctgctgtgacagctgtggcctgggccccagatggctccatggctgtgtctggcaaccaggccggggagctgatcctgtggcaggaggccaaggctgtggccacagcccaggcccctggccacatcggggccctgatctggagcagcgcccacaccttctttgtgctgtctgcagatgagaagatcagcgagtggcaggtgaagctgaggaaaggaagtgcccctggcaacctgagcctgcacctgaaccgcatcctgcaggaggacctgggcgtgctgaccagcctggactgggccccagatggccacttcctgatcctggccaaggctgacctgaagctgctgtgcatgaagccaggagatgcccccagcgagatctggagcagctacacagagaaccccatgatcctgagcacccacaaggagtatggcatctttgtgctgcagcccaaggaccccggggtgctgtccttcctgcggcagaaggagagcggggagtttgaggagcggctgaactttgacatcaacctggagaaccccagcaggaccctcatcagcatcacccaggccaagccagagagcgccctgatgggcagctatggcacctggcccaatgctgcccagaaggaaaatggcccccaggtgacctgtggcaggaagaagaacaccccagagacccagaccccaggcacagaccccagcacctgccgggagagtgatgcctccatggacagtgatgcctccatggattctgagcccaccccccacctgaagacccggcagaggaggaagatccacagcggctctgtgacagccctgcacgtgctgcctgagctgctggtgacagccagcaaggacagagatgtgaagctgtgggagcggcccagcatgcagctgctgggcctcttccgctgtgagggctctgtgtcctgcctggagccctggctgggcgccaacagcaccctgcagctggccgtgggagatgtgcagggcaatgtgtacttcctgaactgggagtag

SEQ ID NO: 22090 - DNA, 2031 bp, Artificial Sequence
  Description of Artificial Sequence: Synthetic coding sequence
atgaagaaccagcagagcagcagcctgagcctggccgtgagcagcagccccacagctgtggccttcagcaccaacggccagagagctgctgtgggcacagccaatggaacagtgtacctgctggacctgcggacctggcaggaggagaagtctgtggtgtctggctgtgatggcatcagcgcctgcctcttcctgagtgatgacaccctcttcctgacagcctttgatggcctgctggagctgtgggacctgcagcacggctgccgggtgctgcagaccaaggcccaccagtaccagatcaccggctgctgcctgagcccagactgccgcctgctggccaccgtgtgcctgggcggctgcctgaagctgtgggacacagtgcggggccagctggccttccagcacacctaccccaagagcctgaactgtgtggccttccaccctgagggccaggtgattgccaccggctcctgggccggcagcatctccttcttccaggtggatggcctgaaggtgaccaaggacctgggcgcccctggggccagcatccgcaccctggccttcaacgtgcctggaggagtggtggccgtgggccgcctggacagcatggtggagctgtgggcctggagggagggcgcccggctggccgccttccctgcccaccacggctttgtggccgccgccctcttcctgcatgctggctgccagctgctgacagctggggaggatggcaaggtgcaggtgtggagcggcagcctgggccggccccggggccacctgggcagcctgagcctgagccctgccctgtctgtggccctgagcccagatggagacagagtggccgtgggctacagagcagatggcatccgcatctacaagatcagcagcggcagccagggcgcccagggccaggccctggatgtggccgtgtctgccctggcctggctgagccccaaggtgctggtgtctggagcagaagatggcagcctgcagggctgggccctgaaggaatgttccctgcagagcctgtggctgctgagccgcttccagaagcctgtgctgggcctggccaccagccaggagctgctggccagcgccagcgaggacttcaccgtgcagctgtggccccggcagctgctgacccggccccacaaggccgaggacttcccctgtggcacagagctgcggggccacgagggccctgtgtcctgctgcagcttcagcacagatggcggcagcctggccaccggcggccgggacaggagcctgctgtgctgggatgtgaggacccccaagacccctgtgctgatccacagcttccctgcctgccaccgggactgggtgacaggctgtgcctggaccaaggacaacctgctgatcagctgcagcagtgatggctctgtgggcctgtgggaccctgagagcggccagaggctgggccagttcctgggccaccagagcgctgtgtctgctgtggccgctgtggaggagcacgtggtgtctgtgtccagagatggcaccctgaaggtgtgggaccaccagggcgtggagctgaccagcatcccagcccacagcggccccatcagccactgtgccgccgccatggagcccagggctgctggccagcccggcagcgagctgctggtggtgacagtgggcctggatggagccacccggctgtggcaccccctgctggtgtgccagacccacaccctgctgggccacagcggccctgtgcgggctgctgctgtgtctgagaccagcggcctgatgctgacagcctctgaagatggctctgtgcggctgtggcaggtgcccaaggaggctgatgacacctgcatccccaggagcagcgctgctgtgacagctgtggcctgggccccagatggctccatggctgtgtctggcaaccaggccggggagctgatcctgtggcaggaggccaaggctgtggccacagcccagagcagccctgagcccaacagcactggaggcctgcggggagctgacaagagcggcctgggcagctag

SEQ ID NO: 22091 - DNA, 501 bp, Artificial Sequence
  Description of Artificial Sequence: Synthetic coding sequence
atggagaagctgcacggccacgtgtctgcccacccagacatcctgagcctggagaaccgctgcctggccatgctgcctgacctgcagcccctggagaagctgcaccagcacgtgtccacccacagcgacatcctgagcctgaagaaccagtgcctggccaccctgcctgacctgaagaccatggagaagccccacggctacgtgtctgcccacccagacatcctgagcctggagaaccagtgcctggccaccctgagtgacctgaagaccatggagaagccccacggccacgtgtctgcccacccagacatcctgagcctggagaaccgctgcctggccaccctgagcagcctgaagagcacagtgtctgccagccccctcttccagagcctgcagatcagccacatgacccaggccgacctgtacagagtgaacaacagcaactgcctgctgtctgagccccccagctggagggcccagcacttcagcaagggcctgtag

SEQ ID NO: 22092 - DNA, 1260 bp, Artificial Sequence
  Description of Artificial Sequence: Synthetic coding sequence
atggctgaagatgtgtcctctgctgcccccagcccccggggctgtgctgatggaagagatgctgaccccacagaggagcagatggccgagacagaaagaaatgatgaggagcagtttgagtgccaggagctgctggagtgccaggtgcaggtgggcgcccctgaggaggaggaggaggaggaggaggatgctggcctggtggccgaggccgaggccgtggccgccggctggatgctggacttcctgtgcctgagcctgtgccgggccttcagagatggccgctctgaggacttccggaggaccaggaacagcgctgaggccatcatccacggcctgagcagcctgacagcctgccagctgcggaccatctacatctgccagttcctgaccagaattgctgctgggaagaccctggatgcccagtttgaaaatgatgagcgcatcacccccctggagagcgccctgatgatctggggcagcattgagaaggagcatgacaagctgcacgaggagatccagaacctgatcaagatccaggccatcgctgtgtgcatggagaatggaaacttcaaggaggccgaggaggtgtttgagcgcatctttggagaccccaacagccacatgcccttcaagagcaagctgctgatgatcatcagccagaaggacaccttccacagcttcttccagcacttctcctacaaccacatgatggagaagatcaagagctatgtgaactacgtgctgtctgagaagagcagcaccttcctgatgaaggccgccgccaaggtggtggagagcaagaggaccaggaccatcaccagccaggacaagcccagcggaaatgatgtggagatggagacagaggccaacctggacaccaggaagaggagccacaagaacctcttcctgagcaagctgcagcacggcacccagcagcaggacctgaacaagaaggagcggcgggtgggcaccccccagagcaccaagaagaagaaggagagcagaagagccacagagagccgcatccctgtgtccaagagccagcctgtgaccccagagaagcaccgggccaggaagaggcaggcctggctgtgggaggaggacaagaacctgcggtctggagtgaggaagtacggggagggcaactggagcaagatcctgctgcactacaagttcaacaacagaacatctgtgatgctgaaggaccgctggaggaccatgaagaagctgaagctgatcagcagtgacagcgaggactag

SEQ ID NO: 22093 - DNA, 1320 bp, Artificial Sequence
  Description of Artificial Sequence: Synthetic coding sequence
atggctgaagatgtgtcctctgctgcccccagcccccggggctgtgctgatggaagagatgctgaccccacagaggagcagatggccgagacagaaagaaatgatgaggagcagtttgagtgccaggagctgctggagtgccaggtgcaggtgggcgcccctgaggaggaggaggaggaggaggaggatgctggcctggtggccgaggccgaggccgtggccgccggctggatgctggacttcctgtgcctgagcctgtgccgggccttcagagatggccgctctgaggacttccggaggaccaggaacagcgctgaggccatcatccacggcctgagcagcctgacagcctgccagctgcggaccatctacatctgccagttcctgaccagaattgctgctgggaagaccctggatgcccagtttgaaaatgatgagcgcatcacccccctggagagcgccctgatgatctggggcagcattgagaaggagcatgacaagctgcacgaggagatccagaacctgatcaagatccaggccatcgctgtgtgcatggagaatggaaacttcaaggaggccgaggaggtgtttgagcgcatctttggagaccccaacagccacatgcccttcaagagcaagctgctgatgatcatcagccagaaggacaccttccacagcttcttccagcacttctcctacaaccacatgatggagaagatcaagagctatgtgaactacgtgctgtctgagaagagcagcaccttcctgatgaaggccgccgccaaggtggtggagagcaagaggaccaggaccatcaccagccaggacaagcccagcggaaatgatgtggagatggagacagaggccaacctggacaccaggaagtctgtgtctgacaagcagagcgctgtgacagagagcagcgagggcaccgtgtccctgctgcggagccacaagaacctcttcctgagcaagctgcagcacggcacccagcagcaggacctgaacaagaaggagcggcgggtgggcaccccccagagcaccaagaagaagaaggagagcagaagagccacagagagccgcatccctgtgtccaagagccagcctgtgaccccagagaagcaccgggccaggaagaggcaggcctggctgtgggaggaggacaagaacctgcggtctggagtgaggaagtacggggagggcaactggagcaagatcctgctgcactacaagttcaacaacagaacatctgtgatgctgaaggaccgctggaggaccatgaagaagctgaagctgatcagcagtgacagcgaggactag

SEQ ID NO: 22094 - DNA, 153 bp, Artificial Sequence
  Description of Artificial Sequence: Synthetic coding sequence
atcttcagcatcatccacggcctgagcagcctgacagcctgccagctgcggaccatctacatctgccagttcctgaccagaattgctgctgggaagaccctggatgcccagtttgaaaatgatgagcgcatcacccccctggagagcgcctag

SEQ ID NO: 22095 - DNA, 1503 bp, Artificial Sequence
  Description of Artificial Sequence: Synthetic coding sequence
atggccggcggcggcggcagcagtgatggcagcggccgggctgctggaagaagagccagccgcagcagcggccgggcccggcggggcagacatgagcccggcctgggcggccctgctgagagaggagctggggaggcccggctggaggaggccgtgaaccgctgggtgctgaagttctacttccacgaggccctgcgggccttccggggcagccgctatggagacttccggcagatccgggacatcatgcaggccctgctggtgcggcccctgggcaaggagcacacagtgtcccggctgctgcgggtgatgcagtgcctgagccgcatcgaggagggggagaacctggactgcagctttgacatggaggccgagctgacccccctggagagcgccatcaacgtgctggagatgatcaagacagagttcaccctgacagaggccgtggtggagagcagcaggaagctggtgaaggaggccgctgtgatcatctgcatcaagaacaaggagtttgagaaggccagcaagatcctgaagaagcacatgagcaaggaccccaccacccagaagctgagaaatgacctgctgaacatcatccgggagaagaacctggcccaccctgtgatccagaacttctcctatgagaccttccagcagaagatgctgcgcttcctggagagccacctggatgatgctgagccctacctgctgaccatggccaagaaggccctgaagtctgagagcgctgccagcagcacaggcaaggaggacaagcagcctgcccctggccctgtggagaagccaccccgggagcccgcccggcagctgagaaatccacccaccaccatcggcatgatgaccctgaaggccgccttcaagaccctgagcggggcccaggacagcgaggccgcctttgccaagctggaccagaaggacctggtgctgcccacccaggccctgcctgccagccctgccctgaagaacaagaggcccaggaaggatgaaaatgaatcttctgccccagcagatggagagggcggcagcgagctgcagcccaagaacaagaggatgaccatcagccggctggtgctggaggaggacagccagagcacagagcccagcgctggcctgaacagcagccaggaggccgccagcgccccacccagcaagcccaccgtgctgaaccagcccctgcctggagagaagaaccccaaggtgcccaagggcaagtggaacagcagcaatggagtggaggagaaggagacctgggtggaggaggatgagctgttccaggtgcaggccgccccagatgaggacagcaccaccaacatcaccaagaagcagaagtggacagtggaggagagcgagtgggtgaaggccggcgtgcagaagtatggagagggcaactgggccgccatcagcaagaactacccctttgtgaacagaacagctgtgatgatcaaggaccgctggaggaccatgaagaggctgggcatgaactag

SEQ ID NO: 22096 - DNA, 1200 bp, Artificial Sequence
  Description of Artificial Sequence: Synthetic coding sequence
atggccgaggccatggacctgggcaaggaccccaacggccccacccacagcagcaccctgtttgtgagagatgatggcagctccatgtccttctacgtgcggcccagccctgccaagaggcggctgagcaccctcatcctgcacggcggcggcaccgtgtgccgggtgcaggagcctggagctgtgctgctggcccagcctggagaggccctggccgaggccagcggggacttcatcagcacccagtacatcctggactgtgtggagagaaatgaaaggctggagctggaggcctaccgcctgggccctgccagcgctgctgacaccggcagcgaggccaagccaggggccctggccgagggcgctgctgagcctgagccccagagacatgctggccgcatcgccttcacagatgctgatgatgtggccatcctgacctacgtgaaggaaaatgcccggagccccagctctgtgactggaaatgccctgtggaaggccatggagaagagcagcctgacccagcacagctggcagagcctgaaggaccgctacctgaagcacctgcggggccaggagcacaagtacctgctgggagatgcccctgtgagccccagcagccagaagctgaagaggaaggccgaggaggaccctgaggccgctgacagcggggagccccagaacaagaggaccccagacctgcctgaggaggagtatgtgaaggaggagatccaggagaatgaggaggccgtgaagaagatgctggtggaggccacccgggagtttgaggaggtggtggtggatgagagccccccagactttgagatccacatcaccatgtgtgatgatgacccccccaccccagaagaagattctgagacccagccagatgaggaggaggaggaggaggaggagaaggtgtcccagcctgaggtgggcgccgccatcaagatcatccggcagctgatggagaagttcaacctggacctgagcacagtgacccaggccttcctgaagaacagcggggagctggaggccaccagcgccttcctggccagcggccagagagcagatggctaccccatctggagccggcaggatgacatcgacctgcagaaggatgatgaggacacccgggaggccctggtgaagaagtttggagcccagaatgtggcccggcgcatcgagttcaggaagaagtag

SEQ ID NO: 22097 - DNA, 12735 bp, Artificial Sequence
  Description of Artificial Sequence: Synthetic coding sequence
atgatgcctgcccagtatgccctgaccagcagcctggtgctgctggtgctgctgagcacagcccgggccggccccttcagcagccgcagcaatgtgaccctgcctgccccccggcccccaccccagcccggcggccacacagtgggcgctggggtgggcagccccagcagccagctgtatgagcacacagtggagggcggggagaagcaggtggtgttcacccaccgcatcaacctgccccccagcacaggctgcggctgccccccaggcacagagccccctgtgctggccagcgaggtgcaggccctgcgggtgcggctggagatcctggaggagctggtgaagggcctgaaggagcagtgcaccggcggctgctgcccagccagcgcccaggccggcaccggccagacagatgtgaggaccctgtgcagcctgcacggcgtgtttgacctgagccgctgcacctgcagctgtgagcccggctggggcggccccacctgcagcgaccccacagatgctgagatcccccccagcagcccccccagcgccagcggcagctgcccagatgactgcaatgaccagggccgctgtgtgcggggccgctgtgtgtgcttccctggctacacaggccccagctgtggctggcccagctgccctggggactgccagggccggggccgctgtgtgcagggcgtgtgtgtgtgcagagctggcttcagcggccctgactgcagccagaggagctgcccccggggctgcagccagaggggccgctgtgagggcggccgctgtgtgtgtgaccccggctacacaggagatgactgtggcatgaggagctgcccccggggctgcagccagaggggccgctgtgaaaatggccgctgtgtgtgcaaccctggctacaccggggaggactgtggggtgcgcagctgcccccggggctgcagccagaggggccgctgcaaggatggccgctgtgtgtgtgaccccggctacacaggagaggactgtggcaccaggagctgcccctgggactgtggggagggcggccgctgtgtggatggccgctgtgtgtgctggccaggctacaccggggaggactgcagcaccaggacctgcccccgggactgccggggccggggccgctgtgaagatggagagtgcatctgtgacaccggctacagcggagatgactgtggggtgcgcagctgccctggggactgcaaccagaggggccgctgtgaagatggccgctgtgtgtgctggccaggctacacaggaacagactgtggcagccgggcctgcccccgggactgccggggccggggccgctgtgaaaatggagtgtgtgtgtgcaatgccggctacagcggggaggactgtggggtgcgcagctgccctggggactgccggggccggggccgctgtgagagcggccgctgcatgtgctggccaggctacacaggccgggactgtggcacccgggcctgccctggggactgccggggccggggccgctgtgtggatggccgctgtgtgtgcaaccctggcttcaccggggaggactgtggcagccgccgctgccctggggactgccggggccacggcctgtgtgaagatggagtgtgtgtgtgtgatgctggctacagcggggaggactgcagcaccaggagctgccctgggggctgccggggccggggccagtgcctggatggccgctgtgtgtgtgaagatggctacagcggggaggactgtggggtgcggcagtgccccaatgactgcagccagcacggcgtgtgccaggatggagtgtgcatctgctgggagggctacgtgtctgaggactgcagcatccgcacctgccccagcaactgccacggccggggccgctgtgaggagggccgctgcctgtgtgaccccggctacacaggccccacctgtgccaccaggatgtgcccagctgactgccggggccggggccgctgtgtgcagggcgtgtgcctgtgccacgtgggctatggaggagaggactgtggccaggaggagcccccagccagcgcctgccctgggggctgcggcccccgggagctgtgccgggccggccagtgtgtgtgtgtggagggcttccggggccctgactgtgccatccagacctgccctggggactgccggggccgcggggagtgccatgatggcagctgtgtgtgcaaggatggctatgctggggaggactgtggggaggaggtgcccaccatcgagggcatgaggatgcacctgctggaggagaccaccgtgaggacagagtggaccccagcccctggccctgtggatgcctatgagatccagttcatccccaccacagaaggagccagcccccccttcaccgcccgggtgcccagcagcgccagcgcctatgaccagaggggcctggcccctggccaggagtaccaggtgacagtgcgggccctgcggggcacctcctggggcctgcctgccagcaagaccatcaccaccatgattgatggcccccaggacctgcgggtggtggccgtgacccccaccaccctggagctgggctggctgcggccccaggccgaggtggacagatttgtggtgtcctatgtgtctgctggcaaccagagggtgcggctggaggtgcccccagaggctgatggcaccctgctgacagacctgatgcctggggtggagtatgtggtgacagtgacagctgagcggggccgggctgtgtcctacccagcctctgtgcgggccaacacaggcagcagccccctgggcctgctgggcaccacagatgagcccccaccttctggccccagcaccacccagggcgcccaggcccccctgctgcagcagaggccccaggagctgggggagctgcgggtgctgggcagagatgagaccggccgcctgcgggtggtgtggacagcccagcctgacacctttgcctacttccagctgaggatgagggtgcctgagggccctggggcccacgaggaggtgctgcctggagatgtgcggcaggccctggtgcccccacctcctcctggcaccccctatgagctgagcctgcatggagtgcccccaggcggcaagcccagcgaccccatcatctaccagggcatcatggacaaggatgaggagaagccaggcaagagcagcggccccccccggctgggggagctgactgtgacagacaggaccagtgacagcctgctgctgcgctggacagtgcctgagggggagtttgacagctttgtgatccagtacaaggacagagatggccagccccaggtggtgcctgtggagggcccccagaggtctgctgtgatcaccagcctggaccccggcaggaagtacaagtttgtgctgtatggctttgtgggcaagaagagacatggccccctggtggccgaggccaagatcctgccccagagcgaccccagccctggcaccccaccccacctgggcaacctgtgggtgacagaccccaccccagacagcctgcacctgtcctggacagtgcctgagggccagtttgacaccttcatggtgcagtacagagacagagatggccggccccaggtggtgcctgtggagggccctgagaggagctttgtggtgagcagcctggaccctgaccacaagtaccgcttcaccctgtttggcatcgccaacaagaagagatatggccccctgacagcagatggcaccacagcccctgagaggaaggaggagccccccaggcctgagttcctggagcagcccctgctgggggagctgactgtgactggagtgaccccagacagcctgcggctgtcctggacagtggcccagggcccctttgacagcttcatggtgcagtacaaggatgcccagggccagccccaggccgtgcctgtggccggagatgaaaatgaggtgacagtgcccggcctggaccctgacaggaagtacaagatgaacctgtatggcctgcggggccggcagagggtgggccctgagagcgtggtggccaagacagccccccaggaggatgtggatgagacccccagccccacagagctgggcacagaggcccctgagagccctgaggagcccctgctgggggagctgactgtgacaggcagcagcccagacagcctgagcctcttctggacagtgccccagggcagctttgacagcttcaccgtgcagtacaaggacagagatggccggcccagggctgtgcgggtgggcggcaaggagagcgaggtgacagtgggcggcctggagcccggccacaagtacaagatgcacctgtatggcctgcacgagggccagagggtgggccctgtgtctgctgtgggcgtgacagccccccagcaggaggagaccccaccagccacagagagccccctggagccccggctgggggagctgactgtgacagatgtgacccccaacagcgtgggcctgtcctggacagtgcctgagggccagtttgacagcttcatcgtgcagtacaaggacaaggatggccagccccaggtggtgcctgtggccgctgaccagcgggaggtgacagtgtacaacctggagcctgagaggaagtacaagatgaacatgtatggcctgcatgatggccagaggatgggccccctgtctgtggtgattgtgacagcccccctgcccccagccccagccacagaggccagcaagccacccctggagccccggctgggggagctgactgtgacagacatcaccccagacagcgtgggcctgtcctggacagtgcctgagggggagtttgacagctttgtggtgcagtacaaggacagagatggccagccccaggtggtgcctgtggccgctgaccagcgggaggtgaccatcccagacctggagcccagcaggaagtacaagttcctgctgtttggcatccaggacggcaagagaagaagccctgtgtctgtggaggccaagacagtggcccggggagatgccagccctggggccccaccccggctgggggagctgtgggtgacagaccccaccccagacagcctgcggctgtcctggacagtgcctgagggccagtttgacagctttgtggtgcagttcaaggacaaggatggcccccaggtggtgcctgtggagggccacgagaggtctgtgacagtgacccccctggatgctggcaggaagtaccgcttcctgctgtatggcctgctgggcaagaagagacatggccccctgacagcagatggcaccacagaggcccggagcgccatggatgacaccggcaccaagaggcctcccaagccccggctgggggaggagctgcaggtgaccaccgtgacccagaacagcgtgggcctgtcctggacagtgcctgagggccagtttgacagctttgtggtgcagtacaaggacagagatggccagccccaggtggtgcctgtggagggcagcctgcgggaggtgtctgtgcccggcctggaccctgcccaccgctacaagctgctgctgtatggcctgcaccacggcaagagggtgggccccatctctgctgtggccatcacagctggccgggaggagacagaaacagagaccacagcccccaccccaccagcccctgagccccacctgggggagctgactgtggaggaggccaccagccacaccctgcacctgtcctggatggtgacagaaggagaatttgacagctttgagatccagtacacagacagagatggccagctgcagatggtgagaattggaggagacagaaatgacatcaccctgagcggcctggagagtgaccaccgctacctggtgaccctgtatggcttcagtgatggcaagcacgtgggccctgtgcacgtggaggccctgactgtgcctgaggaggagaagcccagcgagcccccaacagccaccccagagccccccatcaagccccggctgggggagctgactgtgacagatgccaccccagacagcctgagcctgtcctggacagtgcctgagggccagtttgaccacttcctggtgcagtacagaaatggagatggccagcccaaggctgtgcgggtgcccggccacgaggagggcgtgaccatcagcggcctggagccagaccacaagtacaagatgaacctgtatggcttccatggaggccagaggatgggccctgtgtctgtggtgggcgtgacagctgctgaggaggagacccccagccccacagagcccagcatggaggcccctgagcctgctgaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtctgctgtgggcgtgacagcccctgaggaggagagcccagatgcccccctggccaagctgcggctgggccagatgacagtgcgggacatcaccagtgacagcctgagcctgtcctggacagtgcctgagggccagtttgaccacttcctggtgcagttcaagaatggagatggccagcccaaggctgtgcgggtgcccggccatgaagatggagtgaccatcagcggcctggagccagaccacaagtacaagatgaacctgtatggcttccacggcggccagagggtgggccctgtgtctgctgtgggcctgacagcccctgggaaggatgaggagatggccccagccagcacagagccccccaccccagagccccccatcaagccccggctggaggagctgactgtgacagatgccaccccagacagcctgagcctgtcctggacagtgcctgagggccagtttgaccacttcctggtgcagtacaagaatggagatggccagcccaaggccaccagggtgcccggccatgaagatagagtgaccatcagcggcctggagccagacaacaagtacaagatgaacctgtatggcttccatggaggccagagggtgggccctgtgtctgccatcggcgtgacagctgctgaggaggagacccccagccccacagagcccagcatggaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtccacagtgggcgtgacagccccccaggaggatgtggatgagacccccagccccacagagcccggcacagaggcccctggccccccagaggagcccctgctgggggagctgactgtgacaggcagcagcccagacagcctgagcctgtcctggacagtgccccagggccgctttgacagcttcaccgtgcagtacaaggacagagatggccggccccaggccgtgcgggtgggcggccaggagagcaaggtgacagtgcggggcctggagcccggcaggaagtacaagatgcacctgtatggcctgcacgagggccgccgcctgggccctgtgtctgctgtgggcgtgacagaagatgaggccgagaccacccaggccgtgcccaccatgaccccagagccccccatcaagccccggctgggggagctgaccatgacagatgccaccccagacagcctgagcctgtcctggacagtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccccatctctgtgattggagtgacagctgctgaggaggagacccccagccccacagagctgagcacagaggcccctgagcccccagaggagcccctgctgggggagctgactgtgacaggcagcagcccagacagcctgagcctgtcctggaccatcccccagggccactttgacagcttcaccgtgcagtacaaggacagagatggccggccccaggtgatgagggtgcggggggaggagagcgaggtgacagtgggcggcctggagcccggcaggaagtacaagatgcacctgtatggcctgcacgagggcagaagagtgggccctgtgtccacagtgggcgtgacagccccagaagatgaggccgagaccacccaggccgtgcccaccaccaccccagagccccccaacaagccccggctgggggagctgactgtgacagatgccaccccagacagcctgagcctgtcctggatggtgcctgagggccagtttgaccacttcctggtgcagtacagaaatggagatggccagcccaaggtggtgcgggtgcccggccatgaagatggagtgaccatcagcggcctggagccagaccacaagtacaagatgaacctgtatggcttccacggcggccagagggtgggccccatctctgtgattggagtgacagctgctgaggaggagaccccagcccccacagagcccagcacagaggcccctgagcccccagaggagcccctgctgggggagctgactgtgacaggcagcagcccagacagcctgagcctgtcctggaccatcccccagggccgctttgacagcttcaccgtgcagtacaaggacagagatggccggccccaggtggtgcgggtgcggggggaggagagcgaggtgacagtgggcggcctggagcccggctgcaagtacaagatgcacctgtatggcctgcacgagggccagagggtgggccctgtgtctgctgtgggcgtgacagcccccaaggatgaggccgagaccacccaggccgtgcccaccatgaccccagagccccccatcaagccccggctgggggagctgactgtgacagatgccaccccagacagcctgagcctgtcctggatggtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccctgtgtctgccatcggcgtgacagaggaggagacccccagccccacagagcccagcacagaggcccctgaggcccctgaggagcccctgctgggggagctgactgtgacaggcagcagcccagacagcctgagcctgtcctggacagtgccccagggccgctttgacagcttcaccgtgcagtacaaggacagagatggccagccccaggtggtgcgggtgcggggggaggagagcgaggtgacagtgggcggcctggagcccggcaggaagtacaagatgcacctgtatggcctgcacgagggccagagggtgggccctgtgtccacagtgggcatcacagcccccctgcccacccccctgcctgtggagccccggctgggggagctggccgtggccgctgtgaccagtgacagcgtgggcctgtcctggacagtggcccagggcccctttgacagcttcctggtgcagtacagagatgcccagggccagccccaggccgtgcctgtgtctggggacctgcgggctgtggccgtgtctggcctggaccctgccaggaagtacaagttcctgctgtttggcctgcagaatggcaagagacatggccctgtgcctgtggaggccaggacagccccagacaccaagcccagcccccggctgggggagctgactgtgacagatgccaccccagacagcgtgggcctgtcctggacagtgcctgagggggagtttgacagctttgtggtgcagtacaaggacaaggatggccgcctgcaggtggtgcctgtggccgccaaccagcgggaggtgacagtgcagggcctggagcccagcaggaagtaccgcttcctgctgtatggcctgagcggcaggaagaggctgggccccatctctgctgacagcaccacagcccccctggagaaggagctgcccccccacctgggggagctgactgtggccgaggagaccagcagcagcctgcggctgtcctggacagtggcccagggcccctttgacagctttgtggtgcagtacagagacacagatggccagcccagggctgtgcctgtggccgctgaccagaggacagtgacagtggaggacctggagcccgggaagaagtacaagttcctgctgtatggcctgctgggcggcaagaggctgggccctgtgtctgccctgggcatgacagcccctgaggaggacaccccagcccctgagctggcccctgaggcccctgagcccccagaggagccccggctgggcgtgctgactgtgacagacaccaccccagacagcatgaggctgtcctggagcgtggcccagggcccctttgacagctttgtggtgcagtatgaggacaccaacggccagccccaggccctgctggtggatggagaccagagcaagatcctgatcagcggcctggagcccagcaccccctaccgcttcctgctgtatggcctgcacgagggcaagaggctgggccccctgtctgctgagggcaccaccggcctggccccagctggccagaccagcgaggagagccggccccggctgagccagctgtctgtgacagatgtgaccaccagcagcctgcggctgaactgggaggcccctcctggggcctttgacagcttcctgctgcgctttggagtgcccagccccagcaccctggagccccacccccggcccctgctgcagcgggagctgatggtgcccggcaccaggcacagcgctgtgctgcgggacctgcggagcggcaccctgtacagcctgaccctgtatggcctgcggggcccccacaaggctgacagcatccagggcacagcccggaccctgagccctgtgctggagagcccccgggacctgcagttcagcgagatccgggagaccagcgccaaggtgaactggatgcccccacccagcagagctgacagcttcaaggtgtcctaccagctggctgatggaggagagccccagagcgtgcaggtggatggccaggcccggacccagaagctgcagggcctcatccctggggcccgctatgaggtgacagtggtgtctgtgcggggctttgaggagagcgagcccctgaccggcttcctgaccaccgtgcctgatggccccacccagctgcgggccctgaacctgacagagggctttgctgtgctgcactggaagccaccccagaaccctgtggacacctatgatgtgcaggtgacagcccctggggccccacccctgcaggccgagaccccaggcagcgctgtggactaccccctgcatgacctggtgctgcacaccaactacacagccaccgtgcggggcctgcggggccccaacctgaccagccctgccagcatcaccttcaccaccggcctggaggccccccgggacctggaggccaaggaggtgacccccaggacagccctgctgacctggacagagccccctgtgcggcctgctggctacctgctgtccttccacacccctgggggccagaaccaggagatcctgctgcccggcggcatcaccagccaccagctgctgggcctcttccccagcaccagctacaatgcccggctgcaggccatgtggggccagagcctgctgccccctgtgtccaccagcttcaccactggaggcctgcgcatccccttcccccgggactgtggggaggagatgcagaatggagctggggccagcaggaccagcaccatcttcctgaatggaaaccgggagcggcccctgaatgtgttctgtgacatggagacagatggcggcggctggctggtgttccagaggaggatggatggccagacagacttctggagggactgggaggactatgcccacggctttggaaacatctctggagagttctggctgggcaatgaggccctgcacagcctgacccaggccggggactacagcatgagggtggacctgcgggctggagatgaggccgtgtttgcccagtatgacagcttccacgtggacagcgctgctgagtactaccgcctgcacctggagggctaccatggaacagctggggacagcatgagctaccacagcggcagcgtcttcagcgcccgggaccgggaccccaacagcctgctgatcagctgtgctgtgtcctacagaggagcctggtggtacagaaactgccactacgccaacctgaatggcctgtatggcagcacagtggaccaccagggcgtgtcctggtaccactggaagggctttgagttctctgtgcccttcacagagatgaagctgcggcccaggaacttccgcagccctgctgggggcggctag

SEQ ID NO: 22098 - DNA, 12729 bp, Artificial Sequence
  Description of Artificial Sequence: Synthetic coding sequence
atgatgcctgcccagtatgccctgaccagcagcctggtgctgctggtgctgctgagcacagcccgggccggccccttcagcagccgcagcaatgtgaccctgcctgccccccggcccccaccccagcccggcggccacacagtgggcgctggggtgggcagccccagcagccagctgtatgagcacacagtggagggcggggagaagcaggtggtgttcacccaccgcatcaacctgccccccagcacaggctgcggctgccccccaggcacagagccccctgtgctggccagcgaggtgcaggccctgcgggtgcggctggagatcctggaggagctggtgaagggcctgaaggagcagtgcaccggcggctgctgcccagccagcgcccaggccggcaccggccagacagatgtgaggaccctgtgcagcctgcacggcgtgtttgacctgagccgctgcacctgcagctgtgagcccggctggggcggccccacctgcagcgaccccacagatgctgagatcccccccagcagcccccccagcgccagcggcagctgcccagatgactgcaatgaccagggccgctgtgtgcggggccgctgtgtgtgcttccctggctacacaggccccagctgtggctggcccagctgccctggggactgccagggccggggccgctgtgtgcagggcgtgtgtgtgtgcagagctggcttcagcggccctgactgcagccagaggagctgcccccggggctgcagccagaggggccgctgtgagggcggccgctgtgtgtgtgaccccggctacacaggagatgactgtggcatgaggagctgcccccggggctgcagccagaggggccgctgtgaaaatggccgctgtgtgtgcaaccctggctacaccggggaggactgtggggtgcgcagctgcccccggggctgcagccagaggggccgctgcaaggatggccgctgtgtgtgtgaccccggctacacaggagaggactgtggcaccaggagctgcccctgggactgtggggagggcggccgctgtgtggatggccgctgtgtgtgctggccaggctacaccggggaggactgcagcaccaggacctgcccccgggactgccggggccggggccgctgtgaagatggagagtgcatctgtgacaccggctacagcggagatgactgtggggtgcgcagctgccctggggactgcaaccagaggggccgctgtgaagatggccgctgtgtgtgctggccaggctacacaggaacagactgtggcagccgggcctgcccccgggactgccggggccggggccgctgtgaaaatggagtgtgtgtgtgcaatgccggctacagcggggaggactgtggggtgcgcagctgccctggggactgccggggccggggccgctgtgagagcggccgctgcatgtgctggccaggctacacaggccgggactgtggcacccgggcctgccctggggactgccggggccggggccgctgtgtggatggccgctgtgtgtgcaaccctggcttcaccggggaggactgtggcagccgccgctgccctggggactgccggggccacggcctgtgtgaagatggagtgtgtgtgtgtgatgctggctacagcggggaggactgcagcaccaggagctgccctgggggctgccggggccggggccagtgcctggatggccgctgtgtgtgtgaagatggctacagcggggaggactgtggggtgcggcagtgccccaatgactgcagccagcacggcgtgtgccaggatggagtgtgcatctgctgggagggctacgtgtctgaggactgcagcatccgcacctgccccagcaactgccacggccggggccgctgtgaggagggccgctgcctgtgtgaccccggctacacaggccccacctgtgccaccaggatgtgcccagctgactgccggggccggggccgctgtgtgcagggcgtgtgcctgtgccacgtgggctatggaggagaggactgtggccaggaggagcccccagccagcgcctgccctgggggctgcggcccccgggagctgtgccgggccggccagtgtgtgtgtgtggagggcttccggggccctgactgtgccatccagacctgccctggggactgccggggccgcggggagtgccatgatggcagctgtgtgtgcaaggatggctatgctggggaggactgtggggaggaggtgcccaccatcgagggcatgaggatgcacctgctggaggagaccaccgtgaggacagagtggaccccagcccctggccctgtggatgcctatgagatccagttcatccccaccacagaaggagccagcccccccttcaccgcccgggtgcccagcagcgccagcgcctatgaccagaggggcctggcccctggccaggagtaccaggtgacagtgcgggccctgcggggcacctcctggggcctgcctgccagcaagaccatcaccaccatgattgatggcccccaggacctgcgggtggtggccgtgacccccaccaccctggagctgggctggctgcggccccaggccgaggtggacagatttgtggtgtcctatgtgtctgctggcaaccagagggtgcggctggaggtgcccccagaggctgatggcaccctgctgacagacctgatgcctggggtggagtatgtggtgacagtgacagctgagcggggccgggctgtgtcctacccagcctctgtgcgggccaacacaggcagcagccccctgggcctgctgggcaccacagatgagcccccaccttctggccccagcaccacccagggcgcccaggcccccctgctgcagcagaggccccaggagctgggggagctgcgggtgctgggcagagatgagaccggccgcctgcgggtggtgtggacagcccagcctgacacctttgcctacttccagctgaggatgagggtgcctgagggccctggggcccacgaggaggtgctgcctggagatgtgcggcaggccctggtgcccccacctcctcctggcaccccctatgagctgagcctgcatggagtgcccccaggcggcaagcccagcgaccccatcatctaccagggcatcatggacaaggatgaggagaagccaggcaagagcagcggccccccccggctgggggagctgactgtgacagacaggaccagtgacagcctgctgctgcgctggacagtgcctgagggggagtttgacagctttgtgatccagtacaaggacagagatggccagccccaggtggtgcctgtggagggcccccagaggtctgctgtgatcaccagcctggaccccggcaggaagtacaagtttgtgctgtatggctttgtgggcaagaagagacatggccccctggtggccgaggccaagatcctgccccagagcgaccccagccctggcaccccaccccacctgggcaacctgtgggtgacagaccccaccccagacagcctgcacctgtcctggacagtgcctgagggccagtttgacaccttcatggtgcagtacagagacagagatggccggccccaggtggtgcctgtggagggccctgagaggagctttgtggtgagcagcctggaccctgaccacaagtaccgcttcaccctgtttggcatcgccaacaagaagagatatggccccctgacagcagatggcaccacagcccctgagaggaaggaggagccccccaggcctgagttcctggagcagcccctgctgggggagctgactgtgactggagtgaccccagacagcctgcggctgtcctggacagtggcccagggcccctttgacagcttcatggtgcagtacaaggatgcccagggccagccccaggccgtgcctgtggccggagatgaaaatgaggtgacagtgcccggcctggaccctgacaggaagtacaagatgaacctgtatggcctgcggggccggcagagggtgggccctgagagcgtggtggccaagacagccccccaggaggatgtggatgagacccccagccccacagagctgggcacagaggcccctgagagccctgaggagcccctgctgggggagctgactgtgacaggcagcagcccagacagcctgagcctcttctggacagtgccccagggcagctttgacagcttcaccgtgcagtacaaggacagagatggccggcccagggctgtgcgggtgggcggcaaggagagcgaggtgacagtgggcggcctggagcccggccacaagtacaagatgcacctgtatggcctgcacgagggccagagggtgggccctgtgtctgctgtgggcgtgacagccccccagcaggaggagaccccaccagccacagagagccccctggagccccggctgggggagctgactgtgacagatgtgacccccaacagcgtgggcctgtcctggacagtgcctgagggccagtttgacagcttcatcgtgcagtacaaggacaaggatggccagccccaggtggtgcctgtggccgctgaccagcgggaggtgacagtgtacaacctggagcctgagaggaagtacaagatgaacatgtatggcctgcatgatggccagaggatgggccccctgtctgtggtgattgtgacagcccccctgcccccagccccagccacagaggccagcaagccacccctggagccccggctgggggagctgactgtgacagacatcaccccagacagcgtgggcctgtcctggacagtgcctgagggggagtttgacagctttgtggtgcagtacaaggacagagatggccagccccaggtggtgcctgtggccgctgaccagcgggaggtgaccatcccagacctggagcccagcaggaagtacaagttcctgctgtttggcatccaggacggcaagagaagaagccctgtgtctgtggaggccaagacagtggcccggggagatgccagccctggggccccaccccggctgggggagctgtgggtgacagaccccaccccagacagcctgcggctgtcctggacagtgcctgagggccagtttgacagctttgtggtgcagttcaaggacaaggatggcccccaggtggtgcctgtggagggccacgagaggtctgtgacagtgacccccctggatgctggcaggaagtaccgcttcctgctgtatggcctgctgggcaagaagagacatggccccctgacagcagatggcaccacagaggcccggagcgccatggatgacaccggcaccaagaggcctcccaagccccggctgggggaggagctgcaggtgaccaccgtgacccagaacagcgtgggcctgtcctggacagtgcctgagggccagtttgacagctttgtggtgcagtacaaggacagagatggccagccccaggtggtgcctgtggagggcagcctgcgggaggtgtctgtgcccggcctggaccctgcccaccgctacaagctgctgctgtatggcctgcaccacggcaagagggtgggccccatctctgctgtggccatcacagctggccgggaggagacagaaacagagaccacagcccccaccccaccagcccctgagccccacctgggggagctgactgtggaggaggccaccagccacaccctgcacctgtcctggatggtgacagaaggagaatttgacagctttgagatccagtacacagacagagatggccagctgcagatggtgagaattggaggagacagaaatgacatcaccctgagcggcctggagagtgaccaccgctacctggtgaccctgtatggcttcagtgatggcaagcacgtgggccctgtgcacgtggaggccctgactgtgcctgaggaggagaagcccagcgagcccccaacagccaccccagagccccccatcaagccccggctgggggagctgactgtgacagatgccaccccagacagcctgagcctgtcctggacagtgcctgagggccagtttgaccacttcctggtgcagtacagaaatggagatggccagcccaaggctgtgcgggtgcccggccacgaggagggcgtgaccatcagcggcctggagccagaccacaagtacaagatgaacctgtatggcttccatggaggccagaggatgggccctgtgtctgtggtgggcgtgacagctgctgaggaggagacccccagccccacagagcccagcatggaggcccctgagcctgctgaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtctgctgtgggcgtgacagcccctgaggaggagagcccagatgcccccctggccaagctgcggctgggccagatgacagtgcgggacatcaccagtgacagcctgagcctgtcctggacagtgcctgagggccagtttgaccacttcctggtgcagttcaagaatggagatggccagcccaaggctgtgcgggtgcccggccatgaagatggagtgaccatcagcggcctggagccagaccacaagtacaagatgaacctgtatggcttccacggcggccagagggtgggccctgtgtctgctgtgggcctgacagcccctgggaaggatgaggagatggccccagccagcacagagccccccaccccagagccccccatcaagccccggctggaggagctgactgtgacagatgccaccccagacagcctgagcctgtcctggacagtgcctgagggccagtttgaccacttcctggtgcagtacaagaatggagatggccagcccaaggccaccagggtgcccggccatgaagatagagtgaccatcagcggcctggagccagacaacaagtacaagatgaacctgtatggcttccatggaggccagagggtgggccctgtgtctgccatcggcgtgacagctgctgaggaggagacccccagccccacagagcccagcatggaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtccacagtgggcgtgacagccccccaggaggatgtggatgagacccccagccccacagagcccggcacagaggcccctggccccccagaggagcccctgctgggggagctgactgtgacaggcagcagcccagacagcctgagcctgtcctggacagtgccccagggccgctttgacagcttcaccgtgcagtacaaggacagagatggccggccccaggccgtgcgggtgggcggccaggagagcaaggtgacagtgcggggcctggagcccggcaggaagtacaagatgcacctgtatggcctgcacgagggccgccgcctgggccctgtgtctgctgtgggcgtgacagaagatgaggccgagaccacccaggccgtgcccaccatgaccccagagccccccatcaagccccggctgggggagctgaccatgacagatgccaccccagacagcctgagcctgtcctggacagtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccccatctctgtgattggagtgacagctgctgaggaggagacccccagccccacagagctgagcacagaggcccctgagcccccagaggagcccctgctgggggagctgactgtgacaggcagcagcccagacagcctgagcctgtcctggaccatcccccagggccactttgacagcttcaccgtgcagtacaaggacagagatggccggccccaggtgatgagggtgcggggggaggagagcgaggtgacagtgggcggcctggagcccggcaggaagtacaagatgcacctgtatggcctgcacgagggcagaagagtgggccctgtgtccacagtgggcgtgacagaagatgaggccgagaccacccaggccgtgcccaccaccaccccagagccccccaacaagccccggctgggggagctgactgtgacagatgccaccccagacagcctgagcctgtcctggatggtgcctgagggccagtttgaccacttcctggtgcagtacagaaatggagatggccagcccaaggtggtgcgggtgcccggccatgaagatggagtgaccatcagcggcctggagccagaccacaagtacaagatgaacctgtatggcttccacggcggccagagggtgggccccatctctgtgattggagtgacagctgctgaggaggagaccccagcccccacagagcccagcacagaggcccctgagcccccagaggagcccctgctgggggagctgactgtgacaggcagcagcccagacagcctgagcctgtcctggaccatcccccagggccgctttgacagcttcaccgtgcagtacaaggacagagatggccggccccaggtggtgcgggtgcggggggaggagagcgaggtgacagtgggcggcctggagcccggctgcaagtacaagatgcacctgtatggcctgcacgagggccagagggtgggccctgtgtctgctgtgggcgtgacagcccccaaggatgaggccgagaccacccaggccgtgcccaccatgaccccagagccccccatcaagccccggctgggggagctgactgtgacagatgccaccccagacagcctgagcctgtcctggatggtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccctgtgtctgccatcggcgtgacagaggaggagacccccagccccacagagcccagcacagaggcccctgaggcccctgaggagcccctgctgggggagctgactgtgacaggcagcagcccagacagcctgagcctgtcctggacagtgccccagggccgctttgacagcttcaccgtgcagtacaaggacagagatggccagccccaggtggtgcgggtgcggggggaggagagcgaggtgacagtgggcggcctggagcccggcaggaagtacaagatgcacctgtatggcctgcacgagggccagagggtgggccctgtgtccacagtgggcatcacagcccccctgcccacccccctgcctgtggagccccggctgggggagctggccgtggccgctgtgaccagtgacagcgtgggcctgtcctggacagtggcccagggcccctttgacagcttcctggtgcagtacagagatgcccagggccagccccaggccgtgcctgtgtctggggacctgcgggctgtggccgtgtctggcctggaccctgccaggaagtacaagttcctgctgtttggcctgcagaatggcaagagacatggccctgtgcctgtggaggccaggacagccccagacaccaagcccagcccccggctgggggagctgactgtgacagatgccaccccagacagcgtgggcctgtcctggacagtgcctgagggggagtttgacagctttgtggtgcagtacaaggacaaggatggccgcctgcaggtggtgcctgtggccgccaaccagcgggaggtgacagtgcagggcctggagcccagcaggaagtaccgcttcctgctgtatggcctgagcggcaggaagaggctgggccccatctctgctgacagcaccacagcccccctggagaaggagctgcccccccacctgggggagctgactgtggccgaggagaccagcagcagcctgcggctgtcctggacagtggcccagggcccctttgacagctttgtggtgcagtacagagacacagatggccagcccagggctgtgcctgtggccgctgaccagaggacagtgacagtggaggacctggagcccgggaagaagtacaagttcctgctgtatggcctgctgggcggcaagaggctgggccctgtgtctgccctgggcatgacagcccctgaggaggacaccccagcccctgagctggcccctgaggcccctgagcccccagaggagccccggctgggcgtgctgactgtgacagacaccaccccagacagcatgaggctgtcctggagcgtggcccagggcccctttgacagctttgtggtgcagtatgaggacaccaacggccagccccaggccctgctggtggatggagaccagagcaagatcctgatcagcggcctggagcccagcaccccctaccgcttcctgctgtatggcctgcacgagggcaagaggctgggccccctgtctgctgagggcaccaccggcctggccccagctggccagaccagcgaggagagccggccccggctgagccagctgtctgtgacagatgtgaccaccagcagcctgcggctgaactgggaggcccctcctggggcctttgacagcttcctgctgcgctttggagtgcccagccccagcaccctggagccccacccccggcccctgctgcagcgggagctgatggtgcccggcaccaggcacagcgctgtgctgcgggacctgcggagcggcaccctgtacagcctgaccctgtatggcctgcggggcccccacaaggctgacagcatccagggcacagcccggaccctgagccctgtgctggagagcccccgggacctgcagttcagcgagatccgggagaccagcgccaaggtgaactggatgcccccacccagcagagctgacagcttcaaggtgtcctaccagctggctgatggaggagagccccagagcgtgcaggtggatggccaggcccggacccagaagctgcagggcctcatccctggggcccgctatgaggtgacagtggtgtctgtgcggggctttgaggagagcgagcccctgaccggcttcctgaccaccgtgcctgatggccccacccagctgcgggccctgaacctgacagagggctttgctgtgctgcactggaagccaccccagaaccctgtggacacctatgatgtgcaggtgacagcccctggggccccacccctgcaggccgagaccccaggcagcgctgtggactaccccctgcatgacctggtgctgcacaccaactacacagccaccgtgcggggcctgcggggccccaacctgaccagccctgccagcatcaccttcaccaccggcctggaggccccccgggacctggaggccaaggaggtgacccccaggacagccctgctgacctggacagagccccctgtgcggcctgctggctacctgctgtccttccacacccctgggggccagaaccaggagatcctgctgcccggcggcatcaccagccaccagctgctgggcctcttccccagcaccagctacaatgcccggctgcaggccatgtggggccagagcctgctgccccctgtgtccaccagcttcaccactggaggcctgcgcatccccttcccccgggactgtggggaggagatgcagaatggagctggggccagcaggaccagcaccatcttcctgaatggaaaccgggagcggcccctgaatgtgttctgtgacatggagacagatggcggcggctggctggtgttccagaggaggatggatggccagacagacttctggagggactgggaggactatgcccacggctttggaaacatctctggagagttctggctgggcaatgaggccctgcacagcctgacccaggccggggactacagcatgagggtggacctgcgggctggagatgaggccgtgtttgcccagtatgacagcttccacgtggacagcgctgctgagtactaccgcctgcacctggagggctaccatggaacagctggggacagcatgagctaccacagcggcagcgtcttcagcgcccgggaccgggaccccaacagcctgctgatcagctgtgctgtgtcctacagaggagcctggtggtacagaaactgccactacgccaacctgaatggcctgtatggcagcacagtggaccaccagggcgtgtcctggtaccactggaagggctttgagttctctgtgcccttcacagagatgaagctgcggcccaggaacttccgcagccctgctgggggcggctag

SEQ ID NO: 22099 - DNA, 2022 bp, Artificial Sequence
  Description of Artificial Sequence: Synthetic coding sequence
atgaggctgtcctggagcgtggcccagggcccctttgacagctttgtggtgcagtatgaggacaccaacggccagccccaggccctgctggtggatggagaccagagcaagatcctgatcagcggcctggagcccagcaccccctaccgcttcctgctgtatggcctgcacgagggcaagaggctgggccccctgtctgctgagggcaccaccggcctggccccagctggccagaccagcgaggagagccggccccggctgagccagctgtctgtgacagatgtgaccaccagcagcctgcggctgaactgggaggcccctcctggggcctttgacagcttcctgctgcgcttcggcgtgcccagccccagcaccctggagccccacccccggcccctgctgcagcgggagctgatggtgcccggcaccaggcacagcgctgtgctgcgggacctgcggagcggcaccctgtacagcctgaccctgtatggcctgcggggcccccacaaggctgacagcatccagggcacagcccggaccctgagccctgtgctggagagcccccgggacctgcagttcagcgagatccgggagaccagcgccaaggtgaactggatgcccccacccagcagagctgacagcttcaaggtgtcctaccagctggctgatggaggagagccccagagcgtgcaggtggatggccaggcccggacccagaagctgcagggcctcatccctggggcccgctatgaggtgacagtggtgtctgtgcggggctttgaggagagcgagcccctgaccggcttcctgaccaccgtgcctgatggccccacccagctgcgggccctgaacctgacagagggctttgctgtgctgcactggaagccaccccagaaccctgtggacacctatgatgtgcaggtgacagcccctggggccccacccctgcaggccgagaccccaggcagcgctgtggactaccccctgcatgacctggtgctgcacaccaactacacagccaccgtgcggggcctgcggggccccaacctgaccagccctgccagcatcaccttcaccaccggcctggaggccccccgggacctggaggccaaggaggtgacccccaggacagccctgctgacctggacagagccccctgtgcggcctgctggctacctgctgtccttccacaccccaggcggccagaaccaggagatcctgctgcccggcggcatcaccagccaccagctgctgggcctcttccccagcaccagctacaatgcccggctgcaggccatgtggggccagagcctgctgccccctgtgtccaccagcttcaccaccggcggcctgcgcatccccttcccccgggactgtggggaggagatgcagaatggagctggggccagcaggaccagcaccatcttcctgaatggaaaccgggagcggcccctgaatgtgttctgtgacatggagacagatggcggcggctggctggtgttccagaggaggatggatggccagacagacttctggagggactgggaggactatgcccacggcttcggcaacatcagcggggagttctggctgggcaatgaggccctgcacagcctgacccaggccggggactacagcatgagggtggacctgcgggctggagatgaagctgtgtttgcccagtatgacagcttccacgtggacagcgctgctgagtactaccgcctgcacctggagggctaccacggcacagctggggacagcatgagctaccacagcggctctgtgttcagcgcccgggaccgggaccccaacagcctgctgatcagctgtgctgtgtcctacagaggagcctggtggtacagaaactgccactacgccaacctgaatggcctgtatggcagcacagtggaccaccagggcgtgtcctggtaccactggaagggctttgagttctctgtgcccttcacagagatgaagctgcggcccaggaacttccgcagccctgctgggggcggctag

SEQ ID NO: 22100 - DNA, 954 bp, Artificial Sequence
  Description of Artificial Sequence: Synthetic coding sequence
atggccaagaaccccccagagaactgtgaggactgccacatcctgaatgctgaggccttcaagagcaagaagatctgcaagagcctgaagatctgtggcctggtgtttggcatcctggccctgaccctcatcgtgctcttctggggcagcaagcacttctggccagaggtgcccaagaaggcctatgacatggagcacaccttctacagcaatggagagaagaagaagatctacatggagattgatcctgtgaccaggacagagatcttccgctctggaaatggaacagatgagaccctggaggtgcatgacttcaagaatggctacacaggcatctactttgtgggcctgcagaagtgcttcatcaagacccagatcaaggtgattcctgagttcagcgagcctgaggaggagattgatgaaaatgaggagatcaccaccaccttctttgagcagagcgtcatctgggtgcctgctgagaagcccatcgagaacagagacttcctgaagaacagcaagatcctggagatctgtgacaacgtgaccatgtactggatcaaccccaccctcatctctgtgtctgagctgcaggactttgaggaggagggggaggacctgcacttccctgccaatgagaagaagggcatcgagcagaatgagcagtgggtggtgccccaggtgaaggtggagaagaccaggcatgcccggcaggccagcgaggaggagctgcccatcaatgactacacagaaaatggaattgaatttgaccccatgctggatgagcggggctactgctgcatctactgccggcggggcaaccgctactgcagaagagtgtgtgagcccctgctgggctactacccctacccctactgctaccagggcggccgggtcatctgcagggtcatcatgccctgcaactggtgggtggccaggatgctgggccgggtgtag

SEQ ID NO: 22101 - DNA, 1356 bp, Artificial Sequence
  Description of Artificial Sequence: Synthetic coding sequence
atggccacccccctggtggccggccctgctgccctgcgctttgctgctgctgcctcctggcaggtggtgcggggccgctgtgtggagcacttcccccgggtgctggagttcctgcggagcctgcgggctgtggcccctggcctggtgcgctaccgccaccacgagcggctgtgcatgggcctgaaggccaaggtggtggtggagctgatcctgcagggccggccctgggcccaggtgctgaaggccctgaaccaccacttccctgagagcggccccatcgtgcgggaccccaaggccaccaagcaggacctgaggaagatcctggaggcccaggagaccttctaccagcaggtgaagcagctgtctgaggcccctgtggacctggccagcaagctgcaggagctggagcaggagtatggagagcccttcctggccgccatggagaagctgctgtttgagtacctgtgccagctggagaaggccctgcccaccccccaggcccagcagctgcaggatgtgctgtcctggatgcagcccggggtgtccatcaccagcagcctggcctggaggcagtatggagtggacatgggctggctgctgcctgagtgcagcgtgacagacagcgtgaacctggccgagcccatggagcagaaccccccccagcagcagaggctggccctgcacaaccccctgcccaaggccaagccaggcacccacctgccccagggccccagcagcaggacccaccctgagcccctggccggccgccacttcaacctggcccccctgggcagaagaagagtgcagagccagtgggccagcacccggggcggccacaaggagcggcccaccgtgatgctgttccccttcaggaacctgggcagccccacccaggtgatcagcaagccagagagcaaggaggagcacgccatctacacagctgacctggccatgggcacccgggccgccagcacaggcaagagcaagagcccctgccagaccctgggcggccgggccctgaaggagaaccctgtggacctgcctgccacagagcagaaggagaactgcctggactgctacatggaccccctgcggctgagcctgctgcccccccgggccaggaagcctgtgtgcccccccagcctgtgcagcagcgtcatcaccatcggggacctggtgctggacagtgatgaggaggagaatggccagggcgagggcaaggagagcctggagaactaccagaagaccaagtttgacaccctcatccccaccctgtgtgagtacctgccccccagcggccacggggccatccctgtgagcagctgtgactgccgggacagcagccggcccctgtag

SEQ ID NO: 22102 - DNA, 1065 bp, Artificial Sequence
  Description of Artificial Sequence: Synthetic coding sequence
atggccacccccctggtggccggccctgctgccctgcgctttgctgctgctgcctcctggcaggtggtgcggggccgctgtgtggagcacttcccccgggtgctggagttcctgcggagcctgcgggctgtggcccctggcctggtgcgctaccgccaccacgagcggctgtgcatgggcctgaaggccaaggtggtggtggagctgatcctgcagggccggccctgggcccaggtgctgaaggccctgaaccaccacttccctgagagcggccccatcgtgcgggaccccaaggccaccaagcaggacctgaggaagatcctggaggcccaggagaccttctaccagcaggtgaagcagctgtctgaggcccctgtggacctggccagcaagctgcaggagctggagcaggagtatggagagcccttcctggccgccatggagaagctgctgtttgagtacctgtgccagctggagaaggccctgcccaccccccaggcccagcagctgcaggatgtgctgtcctggatgcagcccggggtgtccatcaccagcagcctggcctggaggcagtatggagtggacatgggctggctgctgcctgagtgcagcgtgacagacagcgtgaacctggccgagcccatggagcagaaccccccccagcagcagaggctggccctgcacaaccccctgcccaaggccaagccaggcacccacctgccccagggccccagcagcaggacccaccctgagcccctggccggccgccacttcaacctggcccccctgggcagaagaagagtgcagagccagtgggccagcacccggggcggccacaaggagcggcccaccgtgatgctgttccccttcaggaacctgggcagccccacccaggtgatcagcaagccagagagcaaggaggagcacgccatctacacagctgacctggccatgggcacccgggccgccagcacaggcaagagcaagagcccctgccagaccctgggcggccgggccctgaaggagaaccctgtggacctgcctgccacagagcagaaggagtag

SEQ ID NO: 22103 - DNA, 423 bp, Artificial Sequence
  Description of Artificial Sequence: Synthetic coding sequence
atggagcagaaccccccccagcagcagaggctggccctgcacaaccccctgcccaaggccaagccaggcacccacctgccccagggccccagcagcaggacccaccctgagcccctggccggccgccacttcaacctggcccccctgggcagaagaagagtgcagagccagtgggccagcacccggggcggccacaaggagcggcccaccgtgatgctgttccccttcaggaacctgggcagccccacccaggtgatcagcaagccagagagcaaggaggagcacgccatctacacagctgacctggccatgggcacccgggccgccagcacaggcaagagcaagagcccctgccagaccctgggcggccgggccctgaaggagaaccctgtggacctgcctgccacagagcagaaggagtag

SEQ ID NO: 22104 - DNA, 1251 bp, Artificial Sequence
  Description of Artificial Sequence: Synthetic coding sequence
atggccacccccctggtggccggccctgctgccctgcgctttgctgctgctgcctcctggcaggtggtgcggggccgctgtgtggagcacttcccccgggtgctggagttcctgcggagcctgcgggctgtggcccctggcctggtgcgctaccgccaccacgagcggctgtgcatgggcctgaaggccaagaccaagcaggacctgaggaagatcctggaggcccaggagaccttctaccagcaggtgaagcagctgtctgaggcccctgtggacctggccagcaagctgcaggagctggagcaggagtatggagagcccttcctggccgccatggagaagctgctgtttgagtacctgtgccagctggagaaggccctgcccaccccccaggcccagcagctgcaggatgtgctgtcctggatgcagcccggggtgtccatcaccagcagcctggcctggaggcagtatggagtggacatgggctggctgctgcctgaatgttctgtgacagattctgtgaacctggccgagcccatggagcagaaccccccccagcagcagaggctggccctgcacaaccccctgcccaaggccaagccaggcacccacctgccccagggccccagcagcaggacccaccctgagcccctggccggccgccacttcaacctggcccccctgggcagaagaagagtgcagagccagtgggccagcacccggggcggccacaaggagcggcccaccgtgatgctgttccccttcaggaacctgggcagccccacccaggtgatcagcaagccagagagcaaggaggagcacgccatctacacagctgacctggccatgggcaccagggctgccagcacaggcaagagcaagagcccctgccagaccctgggcggccgggccctgaaggaaaatcctgtggacctgcctgccacagagcagaaggagaactgcctggactgctacatggaccccctgcggctgagcctgctgcccccccgggccaggaagcctgtgtgcccccccagcctgtgcagcagcgtcatcaccatcggggacctggtgctggacagtgatgaggaggagaatggccagggcgagggcaaggagagcctggagaactaccagaagaccaagtttgacaccctcatccccaccctgtgtgagtacctgcccccatctggccatggagccatccctgtgagcagctgtgactgccgggacagcagccggcccctgtag

SEQ ID NO: 22105 - DNA, 3498 bp, Artificial Sequence
  Description of Artificial Sequence: Synthetic coding sequence
atggagcaggacaggaccaaccacgtggagggcaaccggctgagccccttcctgatccccagcccccccatctgccagacagagcccctggccaccaagctgcagaatggcagccccctgcctgagcgggcccaccctgaggtgaatggagacaccaagtggcacagcttcaagagctactacggcatcccctgcatgaagggcagccagaacagccgggtgtccccagacttcacccaggagagccggggctacagcaagtgcctgcagaatggaggcatcaagaggacagtgtctgagcccagcctgagcggcctgctgcagatcaagaagctgaagcaggaccagaaggccaatggagagaggaggaactttggagtgtcccaggagagaaatcctggagagagcagccagcccaacgtgtctgacctgagtgacaagaaggagagcgtgtcctctgtggcccaggagaatgctgtgaaggacttcaccagcttcagcacccacaactgcagcggcccagaaaatcctgagctgcagatcctgaatgagcaggagggcaagagcgccaactaccatgacaagaacatcgtgctgctgaagaacaaggctgtgctgatgcccaatggagccaccgtgtctgccagctctgtggagcacacccacggggagctgctggagaagaccctgagccagtactacccagactgtgtgtccattgctgtgcagaagaccaccagccacatcaatgccatcaacagccaggccaccaatgagctgagctgtgagatcacccaccccagccacaccagcggccagatcaacagcgcccagaccagcaacagcgagctgccccccaagccagctgctgtggtgtctgaggcctgtgatgctgatgatgctgacaatgccagcaagctggccgccatgctgaacacctgcagcttccagaagccagagcagctgcagcagcagaagtctgtgtttgagatctgccccagccctgctgagaacaacatccagggcaccaccaagctggccagcggggaggagttctgcagcggcagcagcagcaacctgcaggcccctgggggcagcagcgagcgctacctgaagcagaatgagatgaatggagcctacttcaagcagagctctgtgttcaccaaggacagcttcagcgccaccaccaccccacctccacccagccagctgctgctgagccccccaccacccctgccccaggtgccccagctgcccagcgagggcaagagcaccctgaatggaggagtgctggaggagcaccaccactaccccaaccagagcaacaccaccctgctgcgggaggtgaagattgagggcaagccagaggccccacccagccagagccccaaccccagcacccacgtgtgcagccccagccccatgctgtctgagcggccccagaacaactgtgtgaacagaaatgacatccagacagctggcaccatgacagtgcccctgtgcagcgagaagacccggcccatgtctgagcacctgaagcacaacccccccatcttcggcagcagcggggagctgcaggacaactgccagcagctgatgaggaacaaggagcaggagatcctgaagggccgggacaaggagcagacccgggacctggtgccccccacccagcactacctgaagccaggctggattgagctgaaggccccccgcttccaccaggccgagagccacctgaagagaaatgaggccagcctgcccagcatcctgcagtaccagcccaacctgagcaaccagatgaccagcaagcagtacacaggcaacagcaacatgcctgggggcctgccccggcaggcctacacccagaagaccacccagctggagcacaagagccagatgtaccaggtggagatgaaccagggccagagccagggcaccgtggaccagcacctgcagttccagaagcccagccaccaggtgcacttcagcaagacagaccacctgcccaaggcccacgtgcagagcctgtgtggcacccgcttccacttccagcagagagctgacagccagacagagaagctgatgagccctgtgctgaagcagcacctgaaccagcaggccagcgagacagagcccttcagcaacagccacctgctgcagcacaagccccacaagcaggccgcccagacccagcccagccagagcagccacctgccccagaaccagcagcagcagcagaagctgcagatcaagaacaaggaggagatcctgcagaccttcccccacccccagagcaacaatgaccagcagcgggagggcagcttcttcggccagaccaaggtggaggagtgcttccacggggagaaccagtacagcaagagcagcgagtttgagacccacaacgtgcagatgggcctggaggaggtgcagaacatcaacagaagaaacagcccctacagccagaccatgaagagcagcgcctgcaagatccaggtgtcctgcagcaacaacacccacctggtgtctgagaacaaggagcagaccacccaccctgagctgtttgctggcaacaagacccagaacctgcaccacatgcagtacttccccaacaacgtcatccccaagcaggacctgctgcaccgctgcttccaggagcaggagcagaagagccagcaggcctctgtgctgcagggctacaagaacagaaaccaggacatgagcggccagcaggccgcccagctggcccagcagcgctacctgatccacaaccacgccaacgtgtttcctgtgcctgaccagggcggcagccacacccagaccccaccccagaaggacacccagaagcacgccgccctgcgctggcacctgctgcagaagcaggagcagcagcagacccagcagccccagacagagagctgccacagccagatgcaccggcccatcaaggtggagcccggctgcaagccccacgcctgcatgcacacagcccccccagagaacaagacctggaagaaggtgaccaagcaggagaaccccccagccagctgtgacaacgtgcagcagaagagcatcatcgagaccatggagcagcacctgaagcagttccacgccaagagcctgtttgaccacaaggccctgaccctgaagagccagaagcaggtgaaggtggagatgagcggccctgtgacagtgctgacccggcagaccacagctgctgagctggacagccacaccccagccctggagcagcagaccaccagcagcgagaagacccccaccaagaggacagctgcctctgtgctgaacaacttcatcgagagccccagcaagctgctggacacccccatcaagaacctgctggacacccctgtgaagacccagtatgacttccccagctgccgctgtgtgggcaagtgccagaagtgcacagagacccacggcgtgtacccagagctggccaacctgagcagtgacatgggcttctccttcttcttctag

SEQ ID NO: 22106 - DNA, 6009 bp, Artificial Sequence
  Description of Artificial Sequence: Synthetic coding sequence
atggagcaggacaggaccaaccacgtggagggcaaccggctgagccccttcctgatccccagcccccccatctgccagacagagcccctggccaccaagctgcagaatggcagccccctgcctgagcgggcccaccctgaggtgaatggagacaccaagtggcacagcttcaagagctactacggcatcccctgcatgaagggcagccagaacagccgggtgtccccagacttcacccaggagagccggggctacagcaagtgcctgcagaatggaggcatcaagaggacagtgtctgagcccagcctgagcggcctgctgcagatcaagaagctgaagcaggaccagaaggccaatggagagaggaggaactttggagtgtcccaggagagaaatcctggagagagcagccagcccaacgtgtctgacctgagtgacaagaaggagagcgtgtcctctgtggcccaggagaatgctgtgaaggacttcaccagcttcagcacccacaactgcagcggcccagaaaatcctgagctgcagatcctgaatgagcaggagggcaagagcgccaactaccatgacaagaacatcgtgctgctgaagaacaaggctgtgctgatgcccaatggagccaccgtgtctgccagctctgtggagcacacccacggggagctgctggagaagaccctgagccagtactacccagactgtgtgtccattgctgtgcagaagaccaccagccacatcaatgccatcaacagccaggccaccaatgagctgagctgtgagatcacccaccccagccacaccagcggccagatcaacagcgcccagaccagcaacagcgagctgccccccaagccagctgctgtggtgtctgaggcctgtgatgctgatgatgctgacaatgccagcaagctggccgccatgctgaacacctgcagcttccagaagccagagcagctgcagcagcagaagtctgtgtttgagatctgccccagccctgctgagaacaacatccagggcaccaccaagctggccagcggggaggagttctgcagcggcagcagcagcaacctgcaggcccctgggggcagcagcgagcgctacctgaagcagaatgagatgaatggagcctacttcaagcagagctctgtgttcaccaaggacagcttcagcgccaccaccaccccacctccacccagccagctgctgctgagccccccaccacccctgccccaggtgccccagctgcccagcgagggcaagagcaccctgaatggaggagtgctggaggagcaccaccactaccccaaccagagcaacaccaccctgctgcgggaggtgaagattgagggcaagccagaggccccacccagccagagccccaaccccagcacccacgtgtgcagccccagccccatgctgtctgagcggccccagaacaactgtgtgaacagaaatgacatccagacagctggcaccatgacagtgcccctgtgcagcgagaagacccggcccatgtctgagcacctgaagcacaacccccccatcttcggcagcagcggggagctgcaggacaactgccagcagctgatgaggaacaaggagcaggagatcctgaagggccgggacaaggagcagacccgggacctggtgccccccacccagcactacctgaagccaggctggattgagctgaaggccccccgcttccaccaggccgagagccacctgaagagaaatgaggccagcctgcccagcatcctgcagtaccagcccaacctgagcaaccagatgaccagcaagcagtacacaggcaacagcaacatgcctgggggcctgccccggcaggcctacacccagaagaccacccagctggagcacaagagccagatgtaccaggtggagatgaaccagggccagagccagggcaccgtggaccagcacctgcagttccagaagcccagccaccaggtgcacttcagcaagacagaccacctgcccaaggcccacgtgcagagcctgtgtggcacccgcttccacttccagcagagagctgacagccagacagagaagctgatgagccctgtgctgaagcagcacctgaaccagcaggccagcgagacagagcccttcagcaacagccacctgctgcagcacaagccccacaagcaggccgcccagacccagcccagccagagcagccacctgccccagaaccagcagcagcagcagaagctgcagatcaagaacaaggaggagatcctgcagaccttcccccacccccagagcaacaatgaccagcagcgggagggcagcttcttcggccagaccaaggtggaggagtgcttccacggggagaaccagtacagcaagagcagcgagtttgagacccacaacgtgcagatgggcctggaggaggtgcagaacatcaacagaagaaacagcccctacagccagaccatgaagagcagcgcctgcaagatccaggtgtcctgcagcaacaacacccacctggtgtctgagaacaaggagcagaccacccaccctgagctgtttgctggcaacaagacccagaacctgcaccacatgcagtacttccccaacaacgtcatccccaagcaggacctgctgcaccgctgcttccaggagcaggagcagaagagccagcaggcctctgtgctgcagggctacaagaacagaaaccaggacatgagcggccagcaggccgcccagctggcccagcagcgctacctgatccacaaccacgccaacgtgtttcctgtgcctgaccagggcggcagccacacccagaccccaccccagaaggacacccagaagcacgccgccctgcgctggcacctgctgcagaagcaggagcagcagcagacccagcagccccagacagagagctgccacagccagatgcaccggcccatcaaggtggagcccggctgcaagccccacgcctgcatgcacacagcccccccagagaacaagacctggaagaaggtgaccaagcaggagaaccccccagccagctgtgacaacgtgcagcagaagagcatcatcgagaccatggagcagcacctgaagcagttccacgccaagagcctgtttgaccacaaggccctgaccctgaagagccagaagcaggtgaaggtggagatgagcggccctgtgacagtgctgacccggcagaccacagctgctgagctggacagccacaccccagccctggagcagcagaccaccagcagcgagaagacccccaccaagaggacagctgcctctgtgctgaacaacttcatcgagagccccagcaagctgctggacacccccatcaagaacctgctggacacccctgtgaagacccagtatgacttccccagctgccgctgtgtggagcagatcatcgagaaggatgagggccccttctacacccacctgggcgccggccccaacgtggccgccatccgggagatcatggaggagcgcttcggccagaagggcaaggccatcagaattgaaagagtcatctacacaggcaaggagggcaagagcagccagggctgccccatcgccaagtgggtggtgagaagaagcagcagcgaggagaagctgctgtgcctggtgcgggagagagctggccacacctgtgaggccgccgtcatcgtcatcctgatcctggtgtgggagggcatccccctgagcctggccgacaagctgtacagcgagctgacagagaccctgaggaaatatggcaccctgaccaacagaagatgtgccctgaatgaggagaggacctgtgcctgccagggcctggaccctgagacctgtggggccagcttctcctttggctgctcctggagcatgtactacaacggctgcaagtttgcccggagcaagatccccaggaagttcaagctgctgggagatgaccccaaggaggaggagaagctggagagccacctgcagaacctgagcaccctgatggcccccacctacaagaagctggccccagatgcctacaacaaccagattgaatatgagcaccgggccccagaatgtcggctgggcctgaaggagggccggcccttctctggagtgacagcctgcctggacttctgtgcccacgcccaccgggacctgcacaacatgcagaatggcagcaccctggtgtgcaccctgacccgggaggacaaccgggagtttggaggcaagccagaagatgagcagctgcacgtgctgcccctgtacaaggtgtctgatgtggatgaatttggatctgtggaggcccaggaggagaagaagaggtctggggccatccaggtgctgagcagcttccggaggaaggtgaggatgctggccgagcctgtgaagacctgccggcagaggaagctggaggccaagaaggctgctgctgagaagctgagcagcctggagaacagcagcaacaagaatgagaaggagaagagcgcccccagcaggaccaagcagacagaaaatgccagccaggccaagcagctggccgagctgctgcggctgagcggccctgtgatgcagcagagccagcagccccagcccctgcagaagcagcccccccagccccagcagcagcagaggccccagcagcagcagccccaccacccccagacagagagcgtgaacagctacagcgccagcggcagcaccaacccctacatgagaagacccaaccctgtgagcccctaccccaacagcagccacaccagtgacatctacggcagcaccagccccatgaacttctacagcaccagcagccaggccgccggcagctacctgaacagcagcaaccccatgaacccctacccaggcctgctgaaccagaacacccagtaccccagctaccagtgcaatggaaacctgtctgtggacaactgcagcccctacctgggcagctacagcccccagagccagcccatggacctgtaccgctaccccagccaggaccccctgagcaagctgagcctgccccccatccacaccctgtaccagcccaggtttggaaacagccagagcttcaccagcaagtacctgggctacggcaaccagaacatgcagggagatggcttcagcagctgcaccatccggcccaacgtgcaccacgtgggcaagctgcccccctaccccacccatgagatggatggccacttcatgggcgccaccagccggctgccccccaacctgagcaaccccaacatggactacaagaatggagagcaccacagccccagccacatcatccacaactacagcgctgcccctggcatgttcaacagcagcctgcacgccctgcacctgcagaacaaggaaaatgacatgctgagccacacagccaacggcctgagcaagatgctgcctgccctgaaccacgacagaacagcctgtgtgcagggcggcctgcacaagctgagtgatgccaacggccaggagaagcagcccctggccctggtgcagggcgtggccagcggggctgaagataatgatgaggtgtggagcgacagcgagcagagcttcctggaccctgacattggaggagtggccgtggcccccacccacggcagcatcctgattgaatgtgccaagcgggagctgcacgccaccacccccctgaagaaccccaacagaaaccaccccacccgcatcagcctggtgttctaccagcacaagtccatgaatgagcccaagcacggcctggccctgtgggaggccaagatggccgagaaggcccgggagaaggaggaggagtgtgagaagtatggccctgactatgtgccccagaagagccacggcaagaaggtgaagcgggagcctgctgagccccatgagaccagcgagcccacctacctgcgcttcatcaagagcctggccgagaggaccatgtctgtgaccacagacagcacagtgaccaccagcccctatgccttcaccagggtgacaggcccctacaaccgctacatctag

SEQ ID NO: 22107 - DNA, 3498 bp, Artificial Sequence; identical to SEQ ID NO: 22105
  Description of Artificial Sequence: Synthetic coding sequence

SEQ ID NO: 22108 - DNA, 333 bp, Artificial Sequence
  Description of Artificial Sequence: Synthetic coding sequence
atggagcaggacaggaccaaccacgtggagggcaaccggctgagccccttcctgatccccagcccccccatctgccagacagagcccctggccaccaagctgcagaatggcagccccctgcctgagcgggcccaccctgaggtgaatggagacaccaagtggcacagcttcaagagctactacggcatcccctgcatgaagggcagccagaacagccgggtgtccccagacttcacccaggagagccggggctacagcaagtgcctgcagaatggaggcatcaagaggacagtgtctgagcccagcctgagcggcctgctgcagatcaagtag

SEQ ID NO: 22109 - DNA, 1914 bp, Artificial Sequence
  Description of Artificial Sequence: Synthetic coding sequence
atggagcaggacaggaccaaccacgtggagggcaaccggctgagccccttcctgatccccagcccccccatctgccagacagagcccctggccaccaagctgcagaatggcagccccctgcctgagcgggcccaccctgaggtgaatggagacaccaagtggcacagcttcaagagctactacggcatcccctgcatgaagggcagccagaacagccgggtgtccccagacttcacccaggagagccggggctacagcaagtgcctgcagaatggaggcatcaagaggacagtgtctgagcccagcctgagcggcctgctgcagatcaagaagctgaagcaggaccagaaggccaatggagagaggaggaactttggagtgtcccaggagagaaatcctggagagagcagccagcccaacgtgtctgacctgagtgacaagaaggagagcgtgtcctctgtggcccaggagaatgctgtgaaggacttcaccagcttcagcacccacaactgcagcggcccagaaaatcctgagctgcagatcctgaatgagcaggagggcaagagcgccaactaccatgacaagaacatcgtgctgctgaagaacaaggctgtgctgatgcccaatggagccaccgtgtctgccagctctgtggagcacacccacggggagctgctggagaagaccctgagccagtactacccagactgtgtgtccattgctgtgcagaagaccaccagccacatcaatgccatcaacagccaggccaccaatgagctgagctgtgagatcacccaccccagccacaccagcggccagatcaacagcgcccagaccagcaacagcgagctgccccccaagccagctgctgtggtgtctgaggcctgtgatgctgatgatgctgacaatgccagcaagctggccgccatgctgaacacctgcagcttccagaagccagagcagctgcagcagcagaagtctgtgtttgagatctgccccagccctgctgagaacaacatccagggcaccaccaagctggccagcggggaggagttctgcagcggcagcagcagcaacctgcaggcccctgggggcagcagcgagcgctacctgaagcagaatgagatgaatggagcctacttcaagcagagctctgtgttcaccaaggacagcttcagcgccaccaccaccccacctccacccagccagctgctgctgagccccccaccacccctgccccaggtgccccagctgcccagcgagggcaagagcaccctgaatggaggagtgctggaggagcaccaccactaccccaaccagagcaacaccaccctgctgcgggaggtgaagattgagggcaagccagaggccccacccagccagagccccaaccccagcacccacgtgtgcagccccagccccatgctgtctgagcggccccagaacaactgtgtgaacagaaatgacatccagacagctggcaccatgacagtgcccctgtgcagcgagaagacccggcccatgtctgagcacctgaagcacaacccccccatcttcggcagcagcggggagctgcaggacaactgccagcagctgatgaggaacaaggagcaggagatcctgaagggccgggacaaggagcagacccgggacctggtgccccccacccagcactacctgaagccaggctggattgagctgaaggccccccgcttccaccaggccgagagccacctgaagagaaatgaggccagcctgcccagcatcctgcagtaccagcccaacctgagcaaccagatgaccagcaagcagtacacaggcaacagcaacatgcctgggggcctgccccggcaggcctacacccagaagaccacccagctgagcaccagccacaagtgcaccaagctgaagtag

SEQ ID NO: 22110 - DNA, 6009 bp, Artificial Sequence; identical to SEQ ID NO: 22106
  Description of Artificial Sequence: Synthetic coding sequence

SEQ ID NO: 22111 - DNA, 3585 bp, Artificial Sequence
  Description of Artificial Sequence: Synthetic coding sequence
atggagcaggacaggaccaaccacgtggagggcaaccggctgagccccttcctgatccccagcccccccatctgccagacagagcccctggccaccaagctgcagaatggcagccccctgcctgagcgggcccaccctgaggtgaatggagacaccaagtggcacagcttcaagagctactacggcatcccctgcatgaagggcagccagaacagccgggtgtccccagacttcacccaggagagccggggctacagcaagtgcctgcagaatggaggcatcaagaggacagtgtctgagcccagcctgagcggcctgctgcagatcaagaagctgaagcaggaccagaaggccaatggagagaggaggaactttggagtgtcccaggagagaaatcctggagagagcagccagcccaacgtgtctgacctgagtgacaagaaggagagcgtgtcctctgtggcccaggagaatgctgtgaaggacttcaccagcttcagcacccacaactgcagcggcccagaaaatcctgagctgcagatcctgaatgagcaggagggcaagagcgccaactaccatgacaagaacatcgtgctgctgaagaacaaggctgtgctgatgcccaatggagccaccgtgtctgccagctctgtggagcacacccacggggagctgctggagaagaccctgagccagtactacccagactgtgtgtccattgctgtgcagaagaccaccagccacatcaatgccatcaacagccaggccaccaatgagctgagctgtgagatcacccaccccagccacaccagcggccagatcaacagcgcccagaccagcaacagcgagctgccccccaagccagctgctgtggtgtctgaggcctgtgatgctgatgatgctgacaatgccagcaagctggccgccatgctgaacacctgcagcttccagaagccagagcagctgcagcagcagaagtctgtgtttgagatctgccccagccctgctgagaacaacatccagggcaccaccaagctggccagcggggaggagttctgcagcggcagcagcagcaacctgcaggcccctgggggcagcagcgagcgctacctgaagcagaatgagatgaatggagcctacttcaagcagagctctgtgttcaccaaggacagcttcagcgccaccaccaccccacctccacccagccagctgctgctgagccccccaccacccctgccccaggtgccccagctgcccagcgagggcaagagcaccctgaatggaggagtgctggaggagcaccaccactaccccaaccagagcaacaccaccctgctgcgggaggtgaagattgagggcaagccagaggccccacccagccagagccccaaccccagcacccacgtgtgcagccccagccccatgctgtctgagcggccccagaacaactgtgtgaacagaaatgacatccagacagctggcaccatgacagtgcccctgtgcagcgagaagacccggcccatgtctgagcacctgaagcacaacccccccatcttcggcagcagcggggagctgcaggacaactgccagcagctgatgaggaacaaggagcaggagatcctgaagggccgggacaaggagcagacccgggacctggtgccccccacccagcactacctgaagccaggctggattgagctgaaggccccccgcttccaccaggccgagagccacctgaagagaaatgaggccagcctgcccagcatcctgcagtaccagcccaacctgagcaaccagatgaccagcaagcagtacacaggcaacagcaacatgcctgggggcctgccccggcaggcctacacccagaagaccacccagctggagcacaagagccagatgtaccaggtggagatgaaccagggccagagccagggcaccgtggaccagcacctgcagttccagaagcccagccaccaggtgcacttcagcaagacagaccacctgcccaaggcccacgtgcagagcctgtgtggcacccgcttccacttccagcagagagctgacagccagacagagaagctgatgagccctgtgctgaagcagcacctgaaccagcaggccagcgagacagagcccttcagcaacagccacctgctgcagcacaagccccacaagcaggccgcccagacccagcccagccagagcagccacctgccccagaaccagcagcagcagcagaagctgcagatcaagaacaaggaggagatcctgcagaccttcccccacccccagagcaacaatgaccagcagcgggagggcagcttcttcggccagaccaaggtggaggagtgcttccacggggagaaccagtacagcaagagcagcgagtttgagacccacaacgtgcagatgggcctggaggaggtgcagaacatcaacagaagaaacagcccctacagccagaccatgaagagcagcgcctgcaagatccaggtgtcctgcagcaacaacacccacctggtgtctgagaacaaggagcagaccacccaccctgagctgtttgctggcaacaagacccagaacctgcaccacatgcagtacttccccaacaacgtcatccccaagcaggacctgctgcaccgctgcttccaggagcaggagcagaagagccagcaggcctctgtgctgcagggctacaagaacagaaaccaggacatgagcggccagcaggccgcccagctggcccagcagcgctacctgatccacaaccacgccaacgtgtttcctgtgcctgaccagggcggcagccacacccagaccccaccccagaaggacacccagaagcacgccgccctgcgctggcacctgctgcagaagcaggagcagcagcagacccagcagccccagacagagagctgccacagccagatgcaccggcccatcaaggtggagcccggctgcaagccccacgcctgcatgcacacagcccccccagagaacaagacctggaagaaggtgaccaagcaggagaaccccccagccagctgtgacaacgtgcagcagaagagcatcatcgagaccatggagcagcacctgaagcagttccacgccaagagcctgtttgaccacaaggccctgaccctgaagagccagaagcaggtgaaggtggagatgagcggccctgtgacagtgctgacccggcagaccacagctgctgagctggacagccacaccccagccctggagcagcagaccaccagcagcgagaagacccccaccaagaggacagctgcctctgtgctgaacaacttcatcgagagccccagcaagctgctggacacccccatcaagaacctgctggacacccctgtgaagacccagtatgacttccccagctgccgctgtgtgggcctggaccggcgggtgaagctgctgggcctgaaggagagcagcatcctggtgaagaaggccaaggtgctgagagatgtgctgctgctgagcggctggtttgctgaggccgctgtgaagaggagctactgtgtgtggtgtggcagcgagctggccacccctgtgcggctgcagtag

SEQ ID NO: 22112 - DNA, 6072 bp, Artificial Sequence
  Description of Artificial Sequence: Synthetic coding sequence
atgatccaggaggagcagatccagctggagggcagcctggtggatggccctgaggccagcctgatggagcaggacaggaccaaccacgtggagggcaaccggctgagccccttcctgatccccagcccccccatctgccagacagagcccctggccaccaagctgcagaatggcagccccctgcctgagcgggcccaccctgaggtgaatggagacaccaagtggcacagcttcaagagctactacggcatcccctgcatgaagggcagccagaacagccgggtgtccccagacttcacccaggagagccggggctacagcaagtgcctgcagaatggaggcatcaagaggacagtgtctgagcccagcctgagcggcctgctgcagatcaagaagctgaagcaggaccagaaggccaacggggagaggaggaactttggagtgtcccaggagaggaaccctggagagagcagccagcccaacgtgtctgacctgagtgacaagaaggagagcgtgtcctctgtggcccaggagaatgctgtgaaggacttcaccagcttcagcacccacaactgcagcggccctgagaaccctgagctgcagatcctgaatgagcaggagggcaagagcgccaactaccatgacaagaacatcgtgctgctgaagaacaaggctgtgctgatgcccaacggggccaccgtgtctgccagctctgtggagcacacccatggagagctgctggagaagaccctgagccagtactacccagactgtgtgtccattgctgtgcagaagaccaccagccacatcaatgccatcaacagccaggccaccaatgagctgagctgtgagatcacccaccccagccacaccagcggccagatcaacagcgcccagaccagcaacagcgagctgccccccaagccagctgctgtggtgtctgaggcctgtgatgctgatgatgctgacaatgccagcaagctggccgccatgctgaacacctgcagcttccagaagccagagcagctgcagcagcagaagtctgtgtttgagatctgccccagccctgctgagaacaacatccagggcaccaccaagctggccagcggggaggagttctgcagcggcagcagcagcaacctgcaggcccctgggggcagcagcgagcgctacctgaagcagaatgagatgaatggagcctacttcaagcagagcagcgtcttcaccaaggacagcttcagcgccaccaccaccccacctccacccagccagctgctgctgagccccccaccacccctgccccaggtgccccagctgcccagcgagggcaagagcaccctgaatggaggagtgctggaggagcaccaccactaccccaaccagagcaacaccaccctgctgcgggaggtgaagattgagggcaagccagaggccccacccagccagagccccaaccccagcacccacgtgtgcagccccagccccatgctgtctgagcggccccagaacaactgtgtgaacagaaatgacatccagacagctggcaccatgacagtgcccctgtgcagcgagaagacccggcccatgtctgagcacctgaagcacaacccccccatcttcggcagcagtggagagctgcaggacaactgccagcagctgatgaggaacaaggagcaggagatcctgaagggccgggacaaggagcagacccgggacctggtgccccccacccagcactacctgaagccaggctggattgagctgaaggccccccgcttccaccaggccgagagccacctgaagagaaatgaggccagcctgcccagcatcctgcagtaccagcccaacctgagcaaccagatgaccagcaagcagtacacaggcaacagcaacatgcctgggggcctgccccggcaggcctacacccagaagaccacccagctggagcacaagagccagatgtaccaggtggagatgaaccagggccagagccagggcaccgtggaccagcacctgcagttccagaagcccagccaccaggtgcacttcagcaagacagaccacctgcccaaggcccacgtgcagagcctgtgtggcacccgcttccacttccagcagagagctgacagccagacagagaagctgatgagccctgtgctgaagcagcacctgaaccagcaggccagcgagacagagcccttcagcaacagccacctgctgcagcacaagccccacaagcaggccgcccagacccagcccagccagagcagccacctgccccagaaccagcagcagcagcagaagctgcagatcaagaacaaggaggagatcctgcagaccttcccccacccccagagcaacaatgaccagcagcgggagggcagcttcttcggccagaccaaggtggaggagtgcttccatggagagaaccagtacagcaagagcagcgagtttgagacccacaacgtgcagatgggcctggaggaggtgcagaacatcaacagaagaaacagcccctacagccagaccatgaagagcagcgcctgcaagatccaggtgtcctgcagcaacaacacccacctggtgtctgagaacaaggagcagaccacccaccctgagctgtttgctggcaacaagacccagaacctgcaccacatgcagtacttccccaacaacgtcatccccaagcaggacctgctgcaccgctgcttccaggagcaggagcagaagagccagcaggcctctgtgctgcagggctacaagaacagaaaccaggacatgagcggccagcaggccgcccagctggcccagcagcgctacctgatccacaaccacgccaacgtgtttcctgtgcctgaccagggcggcagccacacccagaccccaccccagaaggacacccagaagcatgctgccctgcgctggcacctgctgcagaagcaggagcagcagcagacccagcagccccagacagagagctgccacagccagatgcaccggcccatcaaggtggagcccggctgcaagccccacgcctgcatgcacacagcccctcctgagaacaagacctggaagaaggtgaccaagcaggagaaccccccagccagctgtgacaacgtgcagcagaagagcatcatcgagaccatggagcagcacctgaagcagttccacgccaagagcctgtttgaccacaaggccctgaccctgaagagccagaagcaggtgaaggtggagatgagcggccctgtgacagtgctgacccggcagaccacagctgctgagctggacagccacaccccagccctggagcagcagaccaccagcagcgagaagacccccaccaagaggacagctgcctctgtgctgaacaacttcatcgagagccccagcaagctgctggacacccccatcaagaacctgctggacacccctgtgaagacccagtatgacttccccagctgccgctgtgtggagcagatcatcgagaaggatgagggccccttctacacccacctgggcgccggccccaacgtggccgccatccgggagatcatggaggagagatttggccagaagggcaaggccatccgcatcgagagggtcatctacaccgggaaggagggcaagagcagccagggctgccccatcgccaagtgggtggtgcggcgcagcagcagcgaggagaagctgctgtgcctggtgcgggagcgggccggccacacctgtgaggccgctgtgattgtcatcctgatcctggtgtgggagggcatccccctgagcctggccgacaagctgtacagcgagctgacagagaccctgaggaaatatggcaccctgaccaacagaagatgtgccctgaatgaggagaggacctgtgcctgccagggcctggaccctgagacctgtggggccagcttctcctttggctgctcctggagcatgtactacaacggctgcaagtttgcccggagcaagatccccaggaagttcaagctgctgggagatgaccccaaggaggaggagaagctggagagccacctgcagaacctgagcaccctgatggcccccacctacaagaagctggccccagatgcctacaacaaccagatcgagtatgagcaccgggcccctgagtgccgcctgggcctgaaggagggccggcccttcagcggcgtgacagcctgcctggacttctgtgcccacgcccaccgggacctgcacaacatgcagaatggcagcaccctggtgtgcaccctgacccgggaggacaaccgggagtttggaggcaagccagaagatgagcagctgcacgtgctgcccctgtacaaggtgtctgatgtggatgaatttggatctgtggaggcccaggaggagaagaagaggtctggggccatccaggtgctgagcagcttccggaggaaggtgaggatgctggccgagcctgtgaagacctgccggcagaggaagctggaggccaagaaggctgctgctgagaagctgagcagcctggagaacagcagcaacaagaatgagaaggagaagagcgcccccagcaggaccaagcagacagaaaatgccagccaggccaagcagctggccgagctgctgcggctgagcggccctgtgatgcagcagagccagcagccccagcccctgcagaagcagcccccccagccccagcagcagcagaggccccagcagcagcagccccaccacccccagacagaatctgtgaacagctacagcgccagcggcagcaccaacccctacatgaggcggcccaaccctgtgagcccctaccccaacagcagccacaccagtgacatctacggcagcaccagccccatgaacttctacagcaccagcagccaggccgccggcagctacctgaacagcagcaaccccatgaacccctacccaggcctgctgaaccagaacacccagtaccccagctaccagtgcaatggaaacctgtctgtggacaactgcagcccctacctgggcagctacagcccccagagccagcccatggacctgtaccgctaccccagccaggaccccctgagcaagctgagcctgccccccatccacaccctgtaccagccccgcttcggcaacagccagagcttcaccagcaagtacctgggctacggcaaccagaacatgcagggagatggcttcagcagctgcaccatccggcccaacgtgcaccacgtgggcaagctgcccccctaccccacccatgagatggatggccacttcatgggcgccaccagccggctgccccccaacctgagcaaccccaacatggactacaagaatggagagcaccacagccccagccacatcatccacaactacagcgctgcccctggcatgttcaacagcagcctgcacgccctgcacctgcagaacaaggaaaatgacatgctgagccacacagccaacggcctgagcaagatgctgcctgccctgaaccacgacagaacagcctgtgtgcagggcggcctgcacaagctgagtgatgccaacggccaggagaagcagcccctggccctggtgcagggcgtggccagcggggctgaggacaatgatgaggtgtggagcgacagcgagcagagcttcctggaccctgacatcggcggcgtggccgtggcccccacccacggcagcatcctgattgaatgtgccaagcgggagctgcacgccaccacccccctgaagaaccccaacagaaaccaccccacccgcatcagcctggtgttctaccagcacaagtccatgaatgagcccaagcacggcctggccctgtgggaggccaagatggccgagaaggcccgggagaaggaggaggagtgtgagaagtatggccctgactatgtgccccagaagagccacggcaagaaggtgaagcgggagcctgctgagccccatgagaccagcgagcccacctacctgcgcttcatcaagagcctggccgagaggaccatgtctgtgaccacagacagcacagtgaccaccagcccctatgccttcaccagggtgacaggcccctacaaccgctacatctag

SEQ ID NO: 22113 - DNA, 615 bp, Artificial Sequence
  Description of Artificial Sequence: Synthetic coding sequence
atggtgtgtggcggctttgcctgcagcaagaactgcctgtgtgccctgaacctgctgtacaccctggtgtccctgctgctgattggaattgctgcctggggcattggatttggcctcatcagcagcctgcgggtggtgggcgtggtgattgctgtgggcatcttcctgttcctgattgccctggtgggcctgattggagctgtgaagcaccaccaggtgctgctcttcttctacatgatcatcctgctgctggtgttcatcgtgcagttctctgtgtcctgtgcctgcctggccctgaaccaggagcagcagggccagctgctggaggtgggctggaacaacacagccagcgccagaaatgacatccagaggaacctgaactgctgcggcttccgctctgtgaaccccaatgacacctgcctggccagctgtgtgaagagtgaccacagctgcagcccctgtgcccccatcatcggggagtatgctggggaggtgctgcgctttgtgggcggcatcggcctcttcttctccttcacagagatcctgggcgtgtggctgacctaccgctacagaaaccagaaggacccccgggccaaccccagcgccttcctgtag

SEQ ID NO: 22114 - DNA, 738 bp, Artificial Sequence
  Description of Artificial Sequence: Synthetic coding sequence
atggccagccccagccggcggctgcagaccaagcctgtgatcacctgcttcaagtctgtgctgctgatctacaccttcatcttctggatcactggagtcatcctgctggccgtgggcatctggggcaaggtgtccctggagaactacttcagcctgctgaatgagaaggccaccaacgtgccctttgtgctgattgccactggaacagtcatcatcctgctgggcaccttcggctgctttgccacctgccgggccagcgcctggatgctgaagctgtatgccatgttcctgaccctggtgttcctggtggagctggtggccgccatcgtgggctttgtgttcagacatgagatcaagaacagcttcaagaacaactatgagaaggccctgaagcagtacaacagcactggagactaccgcagccatgctgtggacaagatccagaacaccctgcactgctgcggcgtgacagactacagagactggacagacaccaactactacagcgagaagggcttccccaagagctgctgcaagctggaggactgcaccccccagagagatgctgacaaggtgaacaatgaaggctgcttcatcaaggtgatgaccatcattgaaagtgagatgggcgtggtggccggcatcagctttggagtggcctgcttccagctgattggcatcttcctggcctactgcctgagccgggccatcaccaacaaccagtatgagatcgtgtag

SEQ ID NO: 22115 - DNA, 684 bp, Artificial Sequence
  Description of Artificial Sequence: Synthetic coding sequence
atggccagccccagccggcggctgcagaccaagcctgtgatcacctgcttcaagtctgtgctgctgatctacaccttcatcttctggatcactggagtcatcctgctggccgtgggcatctggggcaaggtgtccctggagaactacttcagcctgctgaatgagaaggccaccttcggctgctttgccacctgccgggccagcgcctggatgctgaagctgtatgccatgttcctgaccctggtgttcctggtggagctggtggccgccatcgtgggctttgtgttcagacatgagatcaagaacagcttcaagaacaactatgagaaggccctgaagcagtacaacagcactggagactaccgcagccatgctgtggacaagatccagaacaccctgcactgctgcggcgtgacagactacagagactggacagacaccaactactacagcgagaagggcttccccaagagctgctgcaagctggaggactgcaccccccagagagatgctgacaaggtgaacaatgaaggctgcttcatcaaggtgatgaccatcattgaaagtgagatgggcgtggtggccggcatcagctttggagtggcctgcttccagctgattggcatcttcctggcctactgcctgagccgggccatcaccaacaaccagtatgagatcgtgtag

SEQ ID NO: 22116 - DNA, 669 bp, Artificial Sequence
  Description of Artificial Sequence: Synthetic coding sequence
atggagaggaagggcagcgctgctggggccaagggcaaccccagccccccagctgctggggagggccagaggcctcctccacccctgtgtgtgcctgggggcggcggcggggccccagcccggggccaggtgggcgctgctgctgagcctgctgagctgatcagaagagcccacgagttcaagagccagggcgcccagtgctacaaggacaagaagttccgggaggccatcggcaagtaccaccgggccctgctggagctgaagggcctgctgcccccacctggagagcgggagcgggacagcaggcctgccagccctgctggggccctgaagccaggccgcctgtctgaggagcagagcaagacagtggaggccatcgagattgactgctacaacagcctggccgcctgcctgctgcaggccgagctggtgaactatgaaagagtgaaggagtactgcctgaaggtgctgaagaaggagggggagaacttcaaggccctgtaccgcagcggcgtggccttctaccacctgggggactatgacaaggccctgtactacctgaaggaggcccggacccagcagcccacagacaccaacgtcatccgctacatccagctgacagagatgaagctgagccgctgcagccagcgggagaaggaggccatgtag

SEQ ID NO: 22117 - DNA, 258 bp, Artificial Sequence
  Description of Artificial Sequence: Synthetic coding sequence
atggtgaagcagatcgagagcaagacagccttccaggaggccctggatgctgctggggacaagctggtggtggtggacttcagcgccacctggtgtggcccctgcaagatgatcaagcccttcttccatgatgtggcctctgaatgtgaggtgaagtgcatgcccaccttccagttcttcaagaagggccagaaggtgggggagttcagcggggccaacaaggagaagctggaggccaccatcaatgagctggtgtag

SEQ ID NO: 22118 - DNA, 318 bp, Artificial Sequence
  Description of Artificial Sequence: Synthetic coding sequence
atggtgaagcagatcgagagcaagacagccttccaggaggccctggatgctgctggggacaagctggtggtggtggacttcagcgccacctggtgtggcccctgcaagatgatcaagcccttcttccacagcctgtctgagaagtacagcaatgtcatcttcctggaggtggatgtggatgactgccaggatgtggcctctgaatgtgaggtgaagtgcatgcccaccttccagttcttcaagaagggccagaaggtgggggagttcagcggggccaacaaggagaagctggaggccaccatcaatgagctggtgtag

SEQ ID NO: 22119 - DNA, 1176 bp, Artificial Sequence
  Description of Artificial Sequence: Synthetic coding sequence
atggtgatgttcaagaagatcaagagctttgaggtggtgttcaatgaccctgagaaggtgtatggcagcggggagaaggtggccggccgggtcatcgtggaggtgtgtgaggtgaccagggtgaaggctgtgcgcatcctggcctgtggggtggccaaggtgctgtggatgcagggcagccagcagtgcaagcagaccagcgagtacctgcgctatgaggacaccctgctgctggaggaccagcccactggagaaaatgagatggtgatcatgaggcctggcaacaagtatgagtacaagtttggatttgagctgccccagggccccctgggcaccagcttcaagggcaagtatggctgtgtggactactgggtgaaggccttcctggaccggcccagccagcccacccaggagaccaagaagaactttgaggtggtggacctggtggatgtgaacaccccagacctgatggcccctgtgtctgccaagaaggagaagaaggtgtcctgcatgttcatcccagatggccgggtgtctgtgtctgccagaattgacaggaagggcttctgtgaaggagatgagatcagcatccatgctgactttgagaacacctgcagccgcatcgtggtgcccaaggccgccatcgtggcccggcacacctacctggccaacggccagaccaaggtgctgacccagaagctgagctctgtgcggggcaaccacatcatcagcggcacctgtgcctcctggaggggcaagagcctgcgggtgcagaagatccggcccagcatcctgggctgcaacatcctgcgggtggagtacagcctgctgatctacgtgtctgtgcccggcagcaagaaggtgatcctggacctgcccctggtgattggcagccgcagcggcctgagcagcaggaccagctccatggccagcaggaccagcagcgagatgtcctgggtggacctgaacatcccagacaccccagaggccccaccctgctacatggatgtgattcctgaggaccaccggctggagagccccaccacccccctgctggatgacatggatggcagccaggacagccccatcttcatgtatgcccctgagttcaagttcatgcccccacccacctacacagaggtggacccctgcatcctgaacaacaacgtgcagtag

SEQ ID NO: 22120 - DNA, 1494 bp, Artificial Sequence
  Description of Artificial Sequence: Synthetic coding sequence
atgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcaggaactacggctggaaggtggaggagaccgtgaagcatgactgggacaggatgattgaggccgtgcagaaccacatcggcagcctgaactggggctacagagtggccctgcgggagaagaaggtggtgtatgaaaatgcctacggccagttcatcggcccccaccgcatcaaggccaccaacaacaagggcaaggagaagatctacagcgctgagcgcttcctgattgccactggagagcggccccgctacctgggcatccctggggacaaggagtactgcatcagcagtgatgacctcttcagcctgccctactgccctgggaagaccctggtggtgggcgccagctatgtggccctggagtgtgccggcttcctggccggcatcggcctggatgtgacagtgatggtgcgcagcatcctgctgcggggctttgaccaggacatggccaacaagatcggggagcacatggaggagcacggcatcaagttcatccggcagtttgtgcccatcaaggtggagcagattgaagctggcaccccaggccgcctgcgggtggtggcccagagcaccaacagcgaggagatcatcgagggggagtacaacacagtgatgctggccatcggcagagatgcctgcaccaggaagattggcctggagaccgtgggcgtgaagatcaatgagaagacaggcaagatccctgtgacagatgaggagcagaccaacgtgccctacatctatgccatcggggacatcctggaggacaaggtggagctgacccctgtggccatccaggccggccgcctgctggcccagaggctgtatgccggcagcacagtgaagtgtgactatgaaaatgtgcccaccaccgtcttcacccccctggagtatggagcctgtggcctgtctgaggagaaggctgtggagaagtttggagaagaaaatattgaggtgtaccacagctacttctggcccctggagtggaccatccccagccgggacaacaacaagtgctacgccaagatcatctgcaacaccaaggacaatgaaagagtggtgggcttccacgtgctgggccccaatgctggggaggtgacccagggctttgctgctgccctgaagtgtggcctgaccaagaagcagctggacagcaccatcggcatccaccctgtgtgtgccgaggtgttcaccaccctgtctgtgaccaagaggtctggggccagcatcctgcaggccggctgctag

SEQ ID NO: 22121 - DNA, 1746 bp, Artificial Sequence
  Description of Artificial Sequence: Synthetic coding sequence
atgcagcaggtgatgctgacctgcaagggcgtgaacagaggacatgctgtgcctgctggccctggcaggaagccccggccccggcgcagcagccggctgctggccggggagaagcacctgaccaggtctgccctgctgctgtgccacacagaagatggccgggccctggagggcaccctgtctgagctggccgctgagacagacctgcctgtggtgtttgtgaagcagaggaagattggaggccacggccccaccctgaaggcctaccaggagggccgcctgcagaagctgctgaagatgaatggacctgaggacctgcccaagagctatgactatgacctgatcatcattggaggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcagaaattatggctggaaggtggaggagaccgtgaagcatgactgggacaggatgattgaagctgtgcagaaccacatcggcagcctgaactggggctacagagtggccctgcgggagaagaaggtggtgtatgaaaatgcctacggccagttcatcggcccccaccgcatcaaggccaccaacaacaagggcaaggagaagatctacagcgctgagcgcttcctgattgccaccggggagcggccccgctacctgggcatccctggggacaaggagtactgcatcagcagtgatgacctcttcagcctgccctactgccctgggaagaccctggtggtgggcgccagctatgtggccctggagtgtgccggcttcctggccggcatcggcctggatgtgacagtgatggtgcgcagcatcctgctgcggggctttgaccaggacatggccaacaagattggagagcacatggaggagcacggcatcaagttcatccggcagtttgtgcccatcaaggtggagcagatcgaggccggcaccccaggccgcctgcgggtggtggcccagagcaccaacagcgaggagatcattgaaggagagtacaacacagtgatgctggccatcggcagagatgcctgcaccaggaagattggcctggagaccgtgggcgtgaagatcaatgagaagacaggcaagatccctgtgacagatgaggagcagaccaacgtgccctacatctatgccatcggggacatcctggaggacaaggtggagctgacccctgtggccatccaggccggccgcctgctggcccagaggctgtatgccggcagcacagtgaagtgtgactatgaaaatgtgcccaccaccgtcttcacccccctggagtatggagcctgtggcctgtctgaggagaaggctgtggagaagtttggagaggagaacatcgaggtgtaccacagctacttctggcccctggagtggaccatccccagccgggacaacaacaagtgctacgccaagatcatctgcaacaccaaggacaatgaaagagtggtgggcttccacgtgctgggccccaatgctggggaggtgacccagggctttgctgctgccctgaagtgtggcctgaccaagaagcagctggacagcaccatcggcatccaccctgtgtgtgccgagttcttctccttcatctag

SEQ ID NO: 22122 - DNA, 1650 bp, Artificial Sequence
  Description of Artificial Sequence: Synthetic coding sequence
atgagctgtgaagatggccgggccctggagggcaccctgtctgagctggccgctgagacagacctgcctgtggtgtttgtgaagcagaggaagattggaggccacggccccaccctgaaggcctaccaggagggccgcctgcagaagctgctgaagatgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcaggaactacggctggaaggtggaggagaccgtgaagcatgactgggacaggatgattgaggccgtgcagaaccacatcggcagcctgaactggggctacagagtggccctgcgggagaagaaggtggtgtatgaaaatgcctacggccagttcatcggcccccaccgcatcaaggccaccaacaacaagggcaaggagaagatctacagcgctgagcgcttcctgattgccactggagagcggccccgctacctgggcatccctggggacaaggagtactgcatcagcagtgatgacctcttcagcctgccctactgccctgggaagaccctggtggtgggcgccagctatgtggccctggagtgtgccggcttcctggccggcatcggcctggatgtgacagtgatggtgcgcagcatcctgctgcggggctttgaccaggacatggccaacaagatcggggagcacatggaggagcacggcatcaagttcatccggcagtttgtgcccatcaaggtggagcagattgaagctggcaccccaggccgcctgcgggtggtggcccagagcaccaacagcgaggagatcatcgagggggagtacaacacagtgatgctggccatcggcagagatgcctgcaccaggaagattggcctggagaccgtgggcgtgaagatcaatgagaagacaggcaagatccctgtgacagatgaggagcagaccaacgtgccctacatctatgccatcggggacatcctggaggacaaggtggagctgacccctgtggccatccaggccggccgcctgctggcccagaggctgtatgccggcagcacagtgaagtgtgactatgaaaatgtgcccaccaccgtcttcacccccctggagtatggagcctgtggcctgtctgaggagaaggctgtggagaagtttggagaagaaaatattgaggtgtaccacagctacttctggcccctggagtggaccatccccagccgggacaacaacaagtgctacgccaagatcatctgcaacaccaaggacaatgaaagagtggtgggcttccacgtgctgggccccaatgctggggaggtgacccagggctttgctgctgccctgaagtgtggcctgaccaagaagcagctggacagcaccatcggcatccaccctgtgtgtgccgaggtgttcaccaccctgtctgtgaccaagaggtctggggccagcatcctgcaggccggctgctag

SEQ ID NO: 22123 - DNA, 1626 bp, Artificial Sequence
  Description of Artificial Sequence: Synthetic coding sequence
atgctgagccggctggtgctgaacagctgggcccaggccatcatccggcccaggcctcccaaggtgctgggcctgcaggtgaccaccttcagcgaggcctaccaggagggccgcctgcagaagctgctgaagatgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcaggaactacggctggaaggtggaggagaccgtgaagcatgactgggacaggatgattgaggccgtgcagaaccacatcggcagcctgaactggggctacagagtggccctgcgggagaagaaggtggtgtatgaaaatgcctacggccagttcatcggcccccaccgcatcaaggccaccaacaacaagggcaaggagaagatctacagcgctgagcgcttcctgattgccactggagagcggccccgctacctgggcatccctggggacaaggagtactgcatcagcagtgatgacctcttcagcctgccctactgccctgggaagaccctggtggtgggcgccagctatgtggccctggagtgtgccggcttcctggccggcatcggcctggatgtgacagtgatggtgcgcagcatcctgctgcggggctttgaccaggacatggccaacaagatcggggagcacatggaggagcacggcatcaagttcatccggcagtttgtgcccatcaaggtggagcagattgaagctggcaccccaggccgcctgcgggtggtggcccagagcaccaacagcgaggagatcatcgagggggagtacaacacagtgatgctggccatcggcagagatgcctgcaccaggaagattggcctggagaccgtgggcgtgaagatcaatgagaagacaggcaagatccctgtgacagatgaggagcagaccaacgtgccctacatctatgccatcggggacatcctggaggacaaggtggagctgacccctgtggccatccaggccggccgcctgctggcccagaggctgtatgccggcagcacagtgaagtgtgactatgaaaatgtgcccaccaccgtcttcacccccctggagtatggagcctgtggcctgtctgaggagaaggctgtggagaagtttggagaagaaaatattgaggtgtaccacagctacttctggcccctggagtggaccatccccagccgggacaacaacaagtgctacgccaagatcatctgcaacaccaaggacaatgaaagagtggtgggcttccacgtgctgggccccaatgctggggaggtgacccagggctttgctgctgccctgaagtgtggcctgaccaagaagcagctggacagcaccatcggcatccaccctgtgtgtgccgaggtgttcaccaccctgtctgtgaccaagaggtctggggccagcatcctgcaggccggctgctag

SEQ ID NO: 22124 - DNA, 1839 bp, Artificial Sequence
  Description of Artificial Sequence: Synthetic coding sequence
atgcctgtggatgactactggctgtgcctgcctgccagctgtgcccggccctttgtgcagacagtgcgggtggtgcagagctgcccccactgctgctggttccctggggtgctgcccagcgtgcctgagcccctgaggatgcctgccatgctgcccaccggcagccacagcgctgtgctgccccccagccactgcagcacagccccacccagcaccagccaggagcccagcagcagcgctgaccccaagctgtgcctgagcccccccaccagtgacagccggcaggagagaaatgtgcagtttggcctggcctaccaggagggccgcctgcagaagctgctgaagatgaatggacctgaggacctgcccaagagctatgactatgacctgatcatcattggaggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcagaaattatggctggaaggtggaggagaccgtgaagcatgactgggacaggatgattgaagctgtgcagaaccacatcggcagcctgaactggggctacagagtggccctgcgggagaagaaggtggtgtatgaaaatgcctacggccagttcatcggcccccaccgcatcaaggccaccaacaacaagggcaaggagaagatctacagcgctgagcgcttcctgattgccaccggggagcggccccgctacctgggcatccctggggacaaggagtactgcatcagcagtgatgacctcttcagcctgccctactgccctgggaagaccctggtggtgggcgccagctatgtggccctggagtgtgccggcttcctggccggcatcggcctggatgtgacagtgatggtgcgcagcatcctgctgcggggctttgaccaggacatggccaacaagattggagagcacatggaggagcacggcatcaagttcatccggcagtttgtgcccatcaaggtggagcagatcgaggccggcaccccaggccgcctgcgggtggtggcccagagcaccaacagcgaggagatcattgaaggagagtacaacacagtgatgctggccatcggcagagatgcctgcaccaggaagattggcctggagaccgtgggcgtgaagatcaatgagaagacaggcaagatccctgtgacagatgaggagcagaccaacgtgccctacatctatgccatcggggacatcctggaggacaaggtggagctgacccctgtggccatccaggccggccgcctgctggcccagaggctgtatgccggcagcacagtgaagtgtgactatgaaaatgtgcccaccaccgtcttcacccccctggagtatggagcctgtggcctgtctgaggagaaggctgtggagaagtttggagaggagaacatcgaggtgtaccacagctacttctggcccctggagtggaccatccccagccgggacaacaacaagtgctacgccaagatcatctgcaacaccaaggacaatgaaagagtggtgggcttccacgtgctgggccccaatgctggggaggtgacccagggctttgctgctgccctgaagtgtggcctgaccaagaagcagctggacagcaccatcggcatccaccctgtgtgtgccgaggtgttcaccaccctgtctgtgaccaagaggtctggggccagcatcctgcaggccggctgctag

SEQ ID NO: 22125 - DNA, 1944 bp, Artificial Sequence
  Description of Artificial Sequence: Synthetic coding sequence
atgggctgtgccgagggcaaggctgtggccgccgccgcccccacagagctgcagaccaagggcaagaatggagatggaagaagaagaagtgccaaggaccaccaccctgggaagaccctgcctgagaacccagctggcttcaccagcacagccacagctgacagccgggccctgctgcaggcctacattgatggccacagcgtggtgatcttcagccgcagcacctgcacccgctgcacagaggtgaagaagctgttcaagagcctgtgtgtgccctactttgtgctggagctggaccagacagaagatggccgggccctggagggcaccctgtctgagctggccgctgagacagacctgcctgtggtgtttgtgaagcagaggaagattggaggccacggccccaccctgaaggcctaccaggagggccgcctgcagaagctgctgaagatgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcaggaactacggctggaaggtggaggagaccgtgaagcatgactgggacaggatgattgaggccgtgcagaaccacatcggcagcctgaactggggctacagagtggccctgcgggagaagaaggtggtgtatgaaaatgcctacggccagttcatcggcccccaccgcatcaaggccaccaacaacaagggcaaggagaagatctacagcgctgagcgcttcctgattgccactggagagcggccccgctacctgggcatccctggggacaaggagtactgcatcagcagtgatgacctcttcagcctgccctactgccctgggaagaccctggtggtgggcgccagctatgtggccctggagtgtgccggcttcctggccggcatcggcctggatgtgacagtgatggtgcgcagcatcctgctgcggggctttgaccaggacatggccaacaagatcggggagcacatggaggagcacggcatcaagttcatccggcagtttgtgcccatcaaggtggagcagattgaagctggcaccccaggccgcctgcgggtggtggcccagagcaccaacagcgaggagatcatcgagggggagtacaacacagtgatgctggccatcggcagagatgcctgcaccaggaagattggcctggagaccgtgggcgtgaagatcaatgagaagacaggcaagatccctgtgacagatgaggagcagaccaacgtgccctacatctatgccatcggggacatcctggaggacaaggtggagctgacccctgtggccatccaggccggccgcctgctggcccagaggctgtatgccggcagcacagtgaagtgtgactatgaaaatgtgcccaccaccgtcttcacccccctggagtatggagcctgtggcctgtctgaggagaaggctgtggagaagtttggagaagaaaatattgaggtgtaccacagctacttctggcccctggagtggaccatccccagccgggacaacaacaagtgctacgccaagatcatctgcaacaccaaggacaatgaaagagtggtgggcttccacgtgctgggccccaatgctggggaggtgacccagggctttgctgctgccctgaagtgtggcctgaccaagaagcagctggacagcaccatcggcatccaccctgtgtgtgccgaggtgttcaccaccctgtctgtgaccaagaggtctggggccagcatcctgcaggccggctgctag

SEQ ID NO: 22126 - DNA, 1494 bp, Artificial Sequence
  Description of Artificial Sequence: Synthetic coding sequence
atgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcaggaactacggctggaaggtggaggagaccgtgaagcatgactgggacaggatgattgaggccgtgcagaaccacatcggcagcctgaactggggctacagagtggccctgcgggagaagaaggtggtgtatgaaaatgcctacggccagttcatcggcccccaccgcatcaaggccaccaacaacaagggcaaggagaagatctacagcgctgagcgcttcctgattgccactggagagcggccccgctacctgggcatccctggggacaaggagtactgcatcagcagtgatgacctcttcagcctgccctactgccctgggaagaccctggtggtgggcgccagctatgtggccctggagtgtgccggcttcctggccggcatcggcctggatgtgacagtgatggtgcgcagcatcctgctgcggggctttgaccaggacatggccaacaagatcggggagcacatggaggagcacggcatcaagttcatccggcagtttgtgcccatcaaggtggagcagattgaagctggcaccccaggccgcctgcgggtggtggcccagagcaccaacagcgaggagatcatcgagggggagtacaacacagtgatgctggccatcggcagagatgcctgcaccaggaagattggcctggagaccgtgggcgtgaagatcaatgagaagacaggcaagatccctgtgacagatgaggagcagaccaacgtgccctacatctatgccatcggggacatcctggaggacaaggtggagctgacccctgtggccatccaggccggccgcctgctggcccagaggctgtatgccggcagcacagtgaagtgtgactatgaaaatgtgcccaccaccgtcttcacccccctggagtatggagcctgtggcctgtctgaggagaaggctgtggagaagtttggagaagaaaatattgaggtgtaccacagctacttctggcccctggagtggaccatccccagccgggacaacaacaagtgctacgccaagatcatctgcaacaccaaggacaatgaaagagtggtgggcttccacgtgctgggccccaatgctggggaggtgacccagggctttgctgctgccctgaagtgtggcctgaccaagaagcagctggacagcaccatcggcatccaccctgtgtgtgccgaggtgttcaccaccctgtctgtgaccaagaggtctggggccagcatcctgcaggccggcggctag

SEQ ID NO: 22127 - DNA, 1494 bp, Artificial Sequence; identical to SEQ ID NO: 22126
  Description of Artificial Sequence: Synthetic coding sequence

SEQ ID NO: 22128 - DNA, 1944 bp, Artificial Sequence
  Description of Artificial Sequence: Synthetic coding sequence
atgggctgtgccgagggcaaggctgtggccgccgccgcccccacagagctgcagaccaagggcaagaatggagatggaagaagaagaagtgccaaggaccaccaccctgggaagaccctgcctgagaacccagctggcttcaccagcacagccacagctgacagccgggccctgctgcaggcctacattgatggccacagcgtggtgatcttcagccgcagcacctgcacccgctgcacagaggtgaagaagctgttcaagagcctgtgtgtgccctactttgtgctggagctggaccagacagaagatggccgggccctggagggcaccctgtctgagctggccgctgagacagacctgcctgtggtgtttgtgaagcagaggaagattggaggccacggccccaccctgaaggcctaccaggagggccgcctgcagaagctgctgaagatgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcaggaactacggctggaaggtggaggagaccgtgaagcatgactgggacaggatgattgaggccgtgcagaaccacatcggcagcctgaactggggctacagagtggccctgcgggagaagaaggtggtgtatgaaaatgcctacggccagttcatcggcccccaccgcatcaaggccaccaacaacaagggcaaggagaagatctacagcgctgagcgcttcctgattgccactggagagcggccccgctacctgggcatccctggggacaaggagtactgcatcagcagtgatgacctcttcagcctgccctactgccctgggaagaccctggtggtgggcgccagctatgtggccctggagtgtgccggcttcctggccggcatcggcctggatgtgacagtgatggtgcgcagcatcctgctgcggggctttgaccaggacatggccaacaagatcggggagcacatggaggagcacggcatcaagttcatccggcagtttgtgcccatcaaggtggagcagattgaagctggcaccccaggccgcctgcgggtggtggcccagagcaccaacagcgaggagatcatcgagggggagtacaacacagtgatgctggccatcggcagagatgcctgcaccaggaagattggcctggagaccgtgggcgtgaagatcaatgagaagacaggcaagatccctgtgacagatgaggagcagaccaacgtgccctacatctatgccatcggggacatcctggaggacaaggtggagctgacccctgtggccatccaggccggccgcctgctggcccagaggctgtatgccggcagcacagtgaagtgtgactatgaaaatgtgcccaccaccgtcttcacccccctggagtatggagcctgtggcctgtctgaggagaaggctgtggagaagtttggagaagaaaatattgaggtgtaccacagctacttctggcccctggagtggaccatccccagccgggacaacaacaagtgctacgccaagatcatctgcaacaccaaggacaatgaaagagtggtgggcttccacgtgctgggccccaatgctggggaggtgacccagggctttgctgctgccctgaagtgtggcctgaccaagaagcagctggacagcaccatcggcatccaccctgtgtgtgccgaggtgttcaccaccctgtctgtgaccaagaggtctggggccagcatcctgcaggccggcggctag

SEQ ID NO: 22129 - DNA, 213 bp, Artificial Sequence
  Description of Artificial Sequence: Synthetic coding sequence
atgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgtag

SEQ ID NO: 22130 - DNA, 1626 bp, Artificial Sequence
  Description of Artificial Sequence: Synthetic coding sequence
atgctgagccggctggtgctgaacagctgggcccaggccatcatccggcccaggcctcccaaggtgctgggcctgcaggtgaccaccttcagcgaggcctaccaggagggccgcctgcagaagctgctgaagatgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcaggaactacggctggaaggtggaggagaccgtgaagcatgactgggacaggatgattgaggccgtgcagaaccacatcggcagcctgaactggggctacagagtggccctgcgggagaagaaggtggtgtatgaaaatgcctacggccagttcatcggcccccaccgcatcaaggccaccaacaacaagggcaaggagaagatctacagcgctgagcgcttcctgattgccactggagagcggccccgctacctgggcatccctggggacaaggagtactgcatcagcagtgatgacctcttcagcctgccctactgccctgggaagaccctggtggtgggcgccagctatgtggccctggagtgtgccggcttcctggccggcatcggcctggatgtgacagtgatggtgcgcagcatcctgctgcggggctttgaccaggacatggccaacaagatcggggagcacatggaggagcacggcatcaagttcatccggcagtttgtgcccatcaaggtggagcagattgaagctggcaccccaggccgcctgcgggtggtggcccagagcaccaacagcgaggagatcatcgagggggagtacaacacagtgatgctggccatcggcagagatgcctgcaccaggaagattggcctggagaccgtgggcgtgaagatcaatgagaagacaggcaagatccctgtgacagatgaggagcagaccaacgtgccctacatctatgccatcggggacatcctggaggacaaggtggagctgacccctgtggccatccaggccggccgcctgctggcccagaggctgtatgccggcagcacagtgaagtgtgactatgaaaatgtgcccaccaccgtcttcacccccctggagtatggagcctgtggcctgtctgaggagaaggctgtggagaagtttggagaagaaaatattgaggtgtaccacagctacttctggcccctggagtggaccatccccagccgggacaacaacaagtgctacgccaagatcatctgcaacaccaaggacaatgaaagagtggtgggcttccacgtgctgggccccaatgctggggaggtgacccagggctttgctgctgccctgaagtgtggcctgaccaagaagcagctggacagcaccatcggcatccaccctgtgtgtgccgaggtgttcaccaccctgtctgtgaccaagaggtctggggccagcatcctgcaggccggcggctag

SEQ ID NO: 22131 - DNA, 315 bp, Artificial Sequence
  Description of Artificial Sequence: Synthetic coding sequence
atgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcaggaactacggctggaaggtggaggagaccgtgaagcatgactgggacaggatgattgaggcctag

SEQ ID NO: 22132 - DNA, 1650 bp, Artificial Sequence
  Description of Artificial Sequence: Synthetic coding sequence
atgagctgtgaagatggccgggccctggagggcaccctgtctgagctggccgctgagacagacctgcctgtggtgtttgtgaagcagaggaagattggaggccacggccccaccctgaaggcctaccaggagggccgcctgcagaagctgctgaagatgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcaggaactacggctggaaggtggaggagaccgtgaagcatgactgggacaggatgattgaggccgtgcagaaccacatcggcagcctgaactggggctacagagtggccctgcgggagaagaaggtggtgtatgaaaatgcctacggccagttcatcggcccccaccgcatcaaggccaccaacaacaagggcaaggagaagatctacagcgctgagcgcttcctgattgccactggagagcggccccgctacctgggcatccctggggacaaggagtactgcatcagcagtgatgacctcttcagcctgccctactgccctgggaagaccctggtggtgggcgccagctatgtggccctggagtgtgccggcttcctggccggcatcggcctggatgtgacagtgatggtgcgcagcatcctgctgcggggctttgaccaggacatggccaacaagatcggggagcacatggaggagcacggcatcaagttcatccggcagtttgtgcccatcaaggtggagcagattgaagctggcaccccaggccgcctgcgggtggtggcccagagcaccaacagcgaggagatcatcgagggggagtacaacacagtgatgctggccatcggcagagatgcctgcaccaggaagattggcctggagaccgtgggcgtgaagatcaatgagaagacaggcaagatccctgtgacagatgaggagcagaccaacgtgccctacatctatgccatcggggacatcctggaggacaaggtggagctgacccctgtggccatccaggccggccgcctgctggcccagaggctgtatgccggcagcacagtgaagtgtgactatgaaaatgtgcccaccaccgtcttcacccccctggagtatggagcctgtggcctgtctgaggagaaggctgtggagaagtttggagaagaaaatattgaggtgtaccacagctacttctggcccctggagtggaccatccccagccgggacaacaacaagtgctacgccaagatcatctgcaacaccaaggacaatgaaagagtggtgggcttccacgtgctgggccccaatgctggggaggtgacccagggctttgctgctgccctgaagtgtggcctgaccaagaagcagctggacagcaccatcggcatccaccctgtgtgtgccgaggtgttcaccaccctgtctgtgaccaagaggtctggggccagcatcctgcaggccggcggctag

SEQ ID NO: 22133 - DNA, 1701 bp, Artificial Sequence
  Description of Artificial Sequence: Synthetic coding sequence
atgcctgccatgctgcccaccggcagccacagcgctgtgctgccccccagccactgcagcacagccccacccagcaccagccaggagcccagcagcagcgctgaccccaagctgtgcctgagcccccccaccagtgacagccggcaggagagaaatgtgcagtttggcctggcctaccaggagggccgcctgcagaagctgctgaagatgaatggacctgaggacctgcccaagagctatgactatgacctgatcatcattggaggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcagaaattatggctggaaggtggaggagaccgtgaagcatgactgggacaggatgattgaagctgtgcagaaccacatcggcagcctgaactggggctacagagtggccctgcgggagaagaaggtggtgtatgaaaatgcctacggccagttcatcggcccccaccgcatcaaggccaccaacaacaagggcaaggagaagatctacagcgctgagcgcttcctgattgccaccggggagcggccccgctacctgggcatccctggggacaaggagtactgcatcagcagtgatgacctcttcagcctgccctactgccctgggaagaccctggtggtgggcgccagctatgtggccctggagtgtgccggcttcctggccggcatcggcctggatgtgacagtgatggtgcgcagcatcctgctgcggggctttgaccaggacatggccaacaagattggagagcacatggaggagcacggcatcaagttcatccggcagtttgtgcccatcaaggtggagcagatcgaggccggcaccccaggccgcctgcgggtggtggcccagagcaccaacagcgaggagatcattgaaggagagtacaacacagtgatgctggccatcggcagagatgcctgcaccaggaagattggcctggagaccgtgggcgtgaagatcaatgagaagacaggcaagatccctgtgacagatgaggagcagaccaacgtgccctacatctatgccatcggggacatcctggaggacaaggtggagctgacccctgtggccatccaggccggccgcctgctggcccagaggctgtatgccggcagcacagtgaagtgtgactatgaaaatgtgcccaccaccgtcttcacccccctggagtatggagcctgtggcctgtctgaggagaaggctgtggagaagtttggagaggagaacatcgaggtgtaccacagctacttctggcccctggagtggaccatccccagccgggacaacaacaagtgctacgccaagatcatctgcaacaccaaggacaatgaaagagtggtgggcttccacgtgctgggccccaatgctggggaggtgacccagggctttgctgctgccctgaagtgtggcctgaccaagaagcagctggacagcaccatcggcatccaccctgtgtgtgccgaggtgttcaccaccctgtctgtgaccaagaggtctggggccagcatcctgcaggccggctgctag

SEQ ID NO: 22134 - DNA, 528 bp, Artificial Sequence
  Description of Artificial Sequence: Synthetic coding sequence
atgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcaggaactacggctggaaggtggaggagaccgtgaagcatgactgggacaggatgattgaggccgtgcagaaccacatcggcagcctgaactggggctacagagtggccctgcgggagaagaaggtggtgtatgaaaatgcctacggccagttcatcggcccccaccgcatcaaggccaccaacaacaagggcaaggagaagatctacagcgctgagcgcttcctgattgccactggagagcggccccgctacctgggcatccctggggacaaggagtag

SEQ ID NO: 22135 - DNA, 162 bp, Artificial Sequence
  Description of Artificial Sequence: Synthetic coding sequence
atgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggtag

SEQ ID NO: 22136 - DNA, 219 bp, Artificial Sequence
  Description of Artificial Sequence: Synthetic coding sequence
atgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccagtag

SEQ ID NO: 22137 - DNA, 420 bp, Artificial Sequence
  Description of Artificial Sequence: Synthetic coding sequence
atgctgagccggctggtgctgaacagctgggcccaggccatcatccggcccaggcctcccaaggtgctgggcctgcaggtgaccaccttcagcgaggcctaccaggagggccgcctgcagaagctgctgaagatgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcaggaactacggctggaaggtggaggagaccggcatgtag

SEQ ID NO: 22138 - DNA, 1380 bp, Artificial Sequence
  Description of Artificial Sequence: Synthetic coding sequence
atggtgctggactttgtgacccccacccccctgggcacccgctggggcctgggcggcacctgtgtgaatgtgggctgcatccccaagaagctgatgcaccaggccgccctgctgggccaggccctgcaggacagcaggaactacggctggaaggtggaggagaccgtgaagcatgactgggacaggatgattgaggccgtgcagaaccacatcggcagcctgaactggggctacagagtggccctgcgggagaagaaggtggtgtatgaaaatgcctacggccagttcatcggcccccaccgcatcaaggccaccaacaacaagggcaaggagaagatctacagcgctgagcgcttcctgattgccactggagagcggccccgctacctgggcatccctggggacaaggagtactgcatcagcagtgatgacctcttcagcctgccctactgccctgggaagaccctggtggtgggcgccagctatgtggccctggagtgtgccggcttcctggccggcatcggcctggatgtgacagtgatggtgcgcagcatcctgctgcggggctttgaccaggacatggccaacaagatcggggagcacatggaggagcacggcatcaagttcatccggcagtttgtgcccatcaaggtggagcagattgaagctggcaccccaggccgcctgcgggtggtggcccagagcaccaacagcgaggagatcatcgagggggagtacaacacagtgatgctggccatcggcagagatgcctgcaccaggaagattggcctggagaccgtgggcgtgaagatcaatgagaagacaggcaagatccctgtgacagatgaggagcagaccaacgtgccctacatctatgccatcggggacatcctggaggacaaggtggagctgacccctgtggccatccaggccggccgcctgctggcccagaggctgtatgccggcagcacagtgaagtgtgactatgaaaatgtgcccaccaccgtcttcacccccctggagtatggagcctgtggcctgtctgaggagaaggctgtggagaagtttggagaagaaaatattgaggtgtaccacagctacttctggcccctggagtggaccatccccagccgggacaacaacaagtgctacgccaagatcatctgcaacaccaaggacaatgaaagagtggtgggcttccacgtgctgggccccaatgctggggaggtgacccagggctttgctgctgccctgaagtgtggcctgaccaagaagcagctggacagcaccatcggcatccaccctgtgtgtgccgaggtgttcaccaccctgtctgtgaccaagaggtctggggccagcatcctgcaggccggctgctag

SEQ ID NO: 22139 - DNA, 1644 bp, Artificial Sequence
  Description of Artificial Sequence: Synthetic coding sequence
atggaggatggccgggccctggagggcaccctgtctgagctggccgctgagacagacctgcctgtggtgtttgtgaagcagaggaagattggaggccacggccccaccctgaaggcctaccaggagggccgcctgcagaagctgctgaagatgaatggacctgaggacctgcccaagagctatgactatgacctgatcatcatcggcggcggcagcggcggcctggccgccgccaaggaggccgcccagtatggcaagaaggtgatggtgctggactttgtgacccccacccccctgggcacccgctggggcctgggcggcacctgtgtgaatgtgggctgcatccccaagaagctgatgcaccaggccgccctgctgggccaggccctgcaggacagcaggaactacggctggaaggtggaggagaccgtgaagcatgactgggacaggatgattgaggccgtgcagaaccacatcggcagcctgaactggggctacagagtggccctgcgggagaagaaggtggtgtatgaaaatgcctacggccagttcatcggcccccaccgcatcaaggccaccaacaacaagggcaaggagaagatctacagcgctgagcgcttcctgattgccactggagagcggccccgctacctgggcatccctggggacaaggagtactgcatcagcagtgatgacctcttcagcctgccctactgccctgggaagaccctggtggtgggcgccagctatgtggccctggagtgtgccggcttcctggccggcatcggcctggatgtgacagtgatggtgcgcagcatcctgctgcggggctttgaccaggacatggccaacaagatcggggagcacatggaggagcacggcatcaagttcatccggcagtttgtgcccatcaaggtggagcagattgaagctggcaccccaggccgcctgcgggtggtggcccagagcaccaacagcgaggagatcatcgagggggagtacaacacagtgatgctggccatcggcagagatgcctgcaccaggaagattggcctggagaccgtgggcgtgaagatcaatgagaagacaggcaagatccctgtgacagatgaggagcagaccaacgtgccctacatctatgccatcggggacatcctggaggacaaggtggagctgacccctgtggccatccaggccggccgcctgctggcccagaggctgtatgccggcagcacagtgaagtgtgactatgaaaatgtgcccaccaccgtcttcacccccctggagtatggagcctgtggcctgtctgaggagaaggctgtggagaagtttggagaagaaaatattgaggtgtaccacagctacttctggcccctggagtggaccatccccagccgggacaacaacaagtgctacgccaagatcatctgcaacaccaaggacaatgaaagagtggtgggcttccacgtgctgggccccaatgctggggaggtgacccagggctttgctgctgccctgaagtgtggcctgaccaagaagcagctggacagcaccatcggcatccaccctgtgtgtgccgaggtgttcaccaccctgtctgtgaccaagaggtctggggccagcatcctgcaggccggctgctag

SEQ ID NO: 22140 - DNA, 945 bp, Artificial Sequence
  Description of Artificial Sequence: Synthetic coding sequence
atgggcagccaggccctgcccccaggccccatgcagaccctcatcttctttgacatggaggccaccggcctgcccttcagccagcccaaggtgacagagctgtgcctgctggccgtgcaccgctgtgccctggagagcccccccaccagccagggccccccacccaccgtgcccccaccaccccgggtggtggacaagctgagcctgtgtgtggcccctgggaaggcctgcagccctgctgccagcgagatcaccggcctgagcacagctgtgctggccgcccacggccggcagtgctttgatgacaacctggccaacctgctgctggccttcctgcggcggcagccccagccctggtgcctggtggcccacaatggagacagatatgacttccccctgctgcaggccgagctggccatgctgggcctgaccagcgccctggatggagccttctgtgtggacagcatcacagccctgaaggccctggagcgggccagcagccccagcgagcacggccccaggaagagctacagcctgggcagcatctacacccggctgtatggccagagccccccagacagccacacagcagaaggagatgtgctggccctgctgagcatctgccagtggaggccccaggccctgctgcgctgggtggatgcccacgcccggcccttcggcaccatccggcccatgtatggagtgacagccagcgcccggaccaagccccggcccagcgctgtgaccaccacagcccacctggccaccaccaggaacaccagccccagcctgggggagagccggggcaccaaggacctgccccctgtgaaggaccccggggccctgagccgggagggcctgctggcccccctgggcctgctggccatcctgaccctggccgtggccaccctgtatggcctgagcctggccaccccaggagagtag

SEQ ID NO: 22141 - DNA, 1110 bp, Artificial Sequence
  Description of Artificial Sequence: Synthetic coding sequence
atgggccctggggcccggcggcagggcagaattgtgcagggccggcctgagatgtgcttctgccccccacccacccccctgccccccctgcgcatcctgaccctgggcacccacacccccaccccctgcagcagccctggcagcgctgctggcacctaccccaccatgggcagccaggccctgcccccaggccccatgcagaccctcatcttctttgacatggaggccaccggcctgcccttcagccagcccaaggtgacagagctgtgcctgctggccgtgcaccgctgtgccctggagagcccccccaccagccagggccccccacccaccgtgcccccaccaccccgggtggtggacaagctgagcctgtgtgtggcccctgggaaggcctgcagccctgctgccagcgagatcaccggcctgagcacagctgtgctggccgcccacggccggcagtgctttgatgacaacctggccaacctgctgctggccttcctgcggcggcagccccagccctggtgcctggtggcccacaacggggacagatatgacttccccctgctgcaggccgagctggccatgctgggcctgaccagcgccctggatggagccttctgtgtggacagcatcacagccctgaaggccctggagcgggccagcagccccagcgagcacggccccaggaagagctacagcctgggcagcatctacacccggctgtatggccagagccccccagacagccacacagcagaaggagatgtgctggccctgctgagcatctgccagtggaggccccaggccctgctgcgctgggtggatgcccacgcccggcccttcggcaccatccggcccatgtatggagtgacagccagcgcccggaccaagccccggcccagcgctgtgaccaccacagcccacctggccaccaccaggaacaccagccccagcctgggggagagccggggcaccaaggacctgccccctgtgaaggaccccggggccctgagccgggagggcctgctggcccccctgggcctgctggccatcctgaccctggccgtggccaccctgtatggcctgagcctggccaccccaggagagtag

SEQ ID NO: 22142 - DNA, 528 bp, Artificial Sequence
  Description of Artificial Sequence: Synthetic coding sequence
atgctgggcctgaccagcgccctggatggagccttctgtgtggacagcatcacagccctgaaggccctggagcgggccagcagccccagcgagcacggccccaggaagagctacagcctgggcagcatctacacccggctgtatggccagagccccccagacagccacacagcagaaggagatgtgctggccctgctgagcatctgccagtggaggccccaggccctgctgcgctgggtggatgcccacgcccggcccttcggcaccatccggcccatgtatggagtgacagccagcgcccggaccaagccccggcccagcgctgtgaccaccacagcccacctggccaccaccaggaacaccagccccagcctgggggagagccggggcaccaaggacctgccccctgtgaaggaccccggggccctgagccgggagggcctgctggcccccctgggcctgctggccatcctgaccctggccgtggccaccctgtatggcctgagcctggccaccccaggagagtag

SEQ ID NO: 22143 - DNA, 945 bp, Artificial Sequence; identical to SEQ ID NO: 22140
  Description of Artificial Sequence: Synthetic coding sequence

SEQ ID NO: 22144 - DNA, 915 bp, Artificial Sequence
  Description of Artificial Sequence: Synthetic coding sequence
atgcagaccctcatcttctttgacatggaggccaccggcctgcccttcagccagcccaaggtgacagagctgtgcctgctggccgtgcaccgctgtgccctggagagcccccccaccagccagggccccccacccaccgtgcccccaccaccccgggtggtggacaagctgagcctgtgtgtggcccctgggaaggcctgcagccctgctgccagcgagatcaccggcctgagcacagctgtgctggccgcccacggccggcagtgctttgatgacaacctggccaacctgctgctggccttcctgcggcggcagccccagccctggtgcctggtggcccacaatggagacagatatgacttccccctgctgcaggccgagctggccatgctgggcctgaccagcgccctggatggagccttctgtgtggacagcatcacagccctgaaggccctggagcgggccagcagccccagcgagcacggccccaggaagagctacagcctgggcagcatctacacccggctgtatggccagagccccccagacagccacacagcagaaggagatgtgctggccctgctgagcatctgccagtggaggccccaggccctgctgcgctgggtggatgcccacgcccggcccttcggcaccatccggcccatgtatggagtgacagccagcgcccggaccaagccccggcccagcgctgtgaccaccacagcccacctggccaccaccaggaacaccagccccagcctgggggagagccggggcaccaaggacctgccccctgtgaaggaccccggggccctgagccgggagggcctgctggcccccctgggcctgctggccatcctgaccctggccgtggccaccctgtatggcctgagcctggccaccccaggagagtag

SEQ ID NO: 22145 - DNA, 528 bp, Artificial Sequence; identical to SEQ ID NO: 22142
  Description of Artificial Sequence: Synthetic coding sequence

SEQ ID NO: 22146 - DNA, 3513 bp, Artificial Sequence
  Description of Artificial Sequence: Synthetic coding sequence
atgggcctggcctggggcctgggcgtgctcttcctgatgcacgtgtgtggcaccaaccgcatccctgagagcggcggggacaacagcgtgtttgacatctttgagctgactggagctgccaggaagggcagcggccggcggctggtgaagggccctgaccccagcagccctgccttcagaattgaagatgccaacctgatcccccctgtgcctgatgacaagttccaggacctggtggatgctgtgcgggcagagaagggcttcctgctgctggccagcctgcggcagatgaagaagacccggggcaccctgctggccctggagaggaaggaccacagcggccaggtgttttctgtggtgtccaatggcaaggccggcaccctggacctgagcctgactgtgcagggcaagcagcacgtggtgtctgtggaggaggccctgctggccaccggccagtggaagagcatcaccctgtttgtgcaggaggaccgggcccagctgtacatcgactgtgagaagatggagaatgctgagctggatgtgcccatccagagcgtcttcacccgggacctggccagcatcgcccggctgagaattgccaagggcggcgtgaatgacaacttccagggcgtgctgcagaatgtgcgctttgtgtttggcaccaccccagaggacatcctgaggaacaagggctgcagcagcagcacctctgtgctgctgaccctggacaacaacgtggtgaatggcagcagccctgccatccgcaccaactacatcggccacaagaccaaggacctgcaggccatctgtggcatcagctgtgatgagctgagctccatggtgctggagctgcggggcctgcggaccatcgtgaccaccctgcaggacagcatcaggaaggtgacagaggagaacaaggagctggccaatgagctgcggcggccccccctgtgctaccacaatggagtgcagtacagaaataatgaggagtggacagtggacagctgcacagagtgccactgccagaacagcgtgaccatctgcaagaaggtgtcctgccccatcatgccctgcagcaatgccaccgtgcctgatggagagtgctgcccccgctgctggcccagcgacagcgcagatgatggctggagcccctggagcgagtggaccagctgcagcaccagctgtggaaatggcatccagcagaggggccgcagctgtgacagcctgaacaacagatgtgagggcagctctgtgcagaccaggacctgccacatccaggagtgtgacaagcgcttcaagcaggacggcggctggagccactggagcccctggagcagctgcagcgtgacctgtggagatggagtcatcacccgcatccggctgtgcaacagccccagcccccagatgaatggcaagccctgtgagggggaggcccgggagaccaaggcctgcaagaaggatgcctgccccatcaatggaggctggggcccctggagcccctgggacatctgcagcgtgacctgtggcggcggcgtgcagaagaggagccggctgtgcaacaaccccaccccccagtttggaggcaaggactgtgtgggagatgtgacagagaaccagatctgcaacaagcaggactgccccattgatggctgcctgagcaacccctgctttgctggggtgaagtgcaccagctacccagatggctcctggaagtgtggggcctgccccccaggctacagcggaaatggcatccagtgcacagatgtggatgagtgcaaggaggtgcctgatgcctgcttcaaccacaatggagagcaccgctgtgaaaatacagatcctggctacaactgcctgccctgccccccacgcttcaccggcagccagcccttcggccagggcgtggagcacgccacagccaacaagcaggtgtgcaagcccaggaacccctgcacagatggcacccatgactgcaacaagaatgccaagtgcaactacctgggccactacagcgaccccatgtaccgctgtgagtgcaagccaggctatgctggaaatggcatcatctgtggggaggacacagacctggatggctggcccaatgaaaacctggtgtgtgtggccaatgccacctaccactgcaagaaggacaactgccccaacctgcccaacagcggccaggaggactatgacaaggatggcattggagatgcctgtgatgatgatgatgacaatgacaagatcccagatgaccgggacaactgccccttccactacaacccagcccagtatgactatgacagagatgatgtgggggacagatgtgacaactgcccctacaaccacaacccagaccaggccgacacagacaacaatggagaaggagatgcctgtgccgctgacattgatggagatggcatcctgaatgaaagagacaactgccagtatgtgtacaacgtggaccagagggacacagacatggatggagtgggggaccagtgtgacaactgccccctggagcacaacccagaccagctggacagcgacagcgaccgcatcggggacacctgtgacaacaaccaggacattgatgaagatggccaccagaacaacctggacaactgcccctacgtgcccaatgccaaccaggccgaccatgacaaggatggaaaaggagatgcctgtgaccatgatgatgacaatgatggcatcccagatgacaaggacaactgccgcctggtgcccaacccagaccagaaggacagtgatggagatggaagaggagatgcctgcaaggatgactttgaccatgacagcgtgcctgacattgatgacatctgcccagaaaatgtggacatcagcgagacagacttccgccgcttccagatgatccccctggaccccaagggcaccagccagaatgaccccaactgggtggtgcgccaccagggcaaggagctggtgcagacagtgaactgtgaccccggcctggccgtgggctatgatgagttcaatgctgtggacttcagcggcaccttcttcatcaacacagaaagagatgatgattatgccggctttgtgtttggctaccagagcagcagccgcttctacgtggtgatgtggaagcaggtgacccagagctactgggacaccaaccccacccgggcccagggctacagcggcctgtctgtgaaggtggtgaacagcaccaccggccctggagagcacctgagaaatgccctgtggcacactggaaacaccccaggccaggtgaggaccctgtggcatgaccccaggcacatcggctggaaggacttcaccgcctaccgctggaggctgagccaccggcccaagacaggcttcatccgggtggtgatgtatgagggcaagaagatcatggctgacagcggccccatctatgacaagacctacgccggcggccgcctgggcctgtttgtgttcagccaggagatggtgttcttcagtgacctgaagtatgagtgccgggacccctag

SEQ ID NO: 22147 - DNA, 285 bp, Artificial Sequence
  Description of Artificial Sequence: Synthetic coding sequence
atgggcctggcctggggcctgggcgtgctcttcctgatgcacgtgtgtggcaccaaccgcatccctgagagcggcggggacaacagcgtgtttgacatctttgagctgactggagctgccaggaagggcagcggccggcggctggtgaagggccctgaccccagcagccctgccttcagaattgaagatgccaacctgatcccccctgtgcctgatgacaagttccaggacctggtggatgctgtgcgggcagagaagggcttcctgctgctggccagcctgtag

SEQ ID NO: 22148 - DNA, 501 bp, Artificial Sequence
  Description of Artificial Sequence: Synthetic coding sequence
atggctgctggaaatgtggtgctggtgcccctggtgacagtggagatggccagcagcgcccagatgctgatgtctgccaagaagtgcctgatgcctgccagcaccaccatggagagcactggagtgaggaccaggaccccagccaccacagcctgcccagccccccacgccagccctgcccacagccccagcgcccgggtgagcaacatgccccggcccaccaacagatgtgccagccccatccccctgtgcctgtgccacagagctggctgctactgtgaggccatcagcgagcagtggacccagaagcacttccaggcctgccagaggcgggaggacagcctggagctggccaacaagaccaccctgaccagcagcttcaggaacacaggcagccggggccagagcaccaagggccgggcccacaccagagatgactgcatgaagaagatctggaggaactgctacatgtttggcaccaagagcttcagcggggactag

SEQ ID NO: 22149 - DNA, 3519 bp, Artificial Sequence
  Description of Artificial Sequence: Synthetic coding sequence
atggtgtggaggctggtgctgctggccctgtgggtgtggcccagcacccaggccggccaccaggacaaggacaccacctttgacctcttcagcatcagcaacatcaacaggaagaccatcggggccaagcagttccggggccctgaccccggggtgcctgcctacagatttgtgcgctttgactacatcccccctgtgaatgctgatgacctgagcaagatcaccaagatcatgaggcagaaggagggcttcttcctgacagcccagctgaagcaggacggcaagagccggggcaccctgctggccctggagggccctggcctgagccagaggcagtttgaaattgtgtccaatggacctgctgacaccctggacctgacctactggattgatggcaccaggcatgtggtgtccctggaggatgtgggcctggccgacagccagtggaagaatgtgacagtgcaggtggccggggagacctacagcctgcacgtgggctgtgacctgattgacagctttgccctggatgagcccttctatgagcacctgcaggccgagaagagcaggatgtatgtggccaagggcagcgcccgggagagccacttccggggcctgctgcagaatgtgcacctggtgtttgagaacagcgtggaggacatcctgagcaagaagggctgccagcagggccagggcgctgagatcaatgccatcagtgaaaatacagagaccctgcggctgggcccccacgtgaccacagaatatgtgggccccagcagcgagaggaggcctgaggtgtgtgagaggagctgtgaggagctgggcaacatggtgcaggagctgagcggcctgcacgtgctggtgaaccagctgtctgagaacctgaagagggtgtccaatgacaaccagttcctgtgggagctgattggaggcccccccaagaccaggaacatgtctgcctgctggcaggacggccgcttctttgctgaaaatgagacctgggtggtggacagctgcaccacctgcacctgcaagaagttcaagaccatctgccaccagatcacctgccccccagccacctgtgccagccccagctttgtggagggggagtgctgccccagctgcctgcacagcgtggatggagaggagggctggagcccctgggccgagtggacccagtgcagcgtgacctgtggcagcggcacccagcagaggggccgcagctgtgatgtgaccagcaacacctgcctgggccccagcatccagacccgggcctgcagcctgagcaaatgtgacacccgcatccggcaggacggcggctggagccactggagcccctggagcagctgcagcgtgacctgtggggtgggcaacatcacccgcatccggctgtgcaacagccctgtgccccagatgggcggcaagaactgcaagggcagcggccgggagaccaaggcctgccagggcgccccctgccccattgatggccgctggagcccctggagcccctggagcgcctgcaccgtgacctgtgccggcggcatccgggagaggaccagggtgtgcaacagccctgagccccagtatggaggcaaggcctgtgtgggagatgtgcaggagcggcagatgtgcaacaagaggagctgccctgtggatggctgcctgagcaacccctgcttccctggggcccagtgcagcagcttcccagatggctcctggagctgtggcagctgccctgtgggcttcctgggcaatggcacccactgtgaggacctggatgaatgtgccctggtgcctgacatctgcttcagcaccagcaaggtgccccgctgtgtgaacacccagcccggcttccactgcctgccctgccccccacgctaccggggcaaccagcctgtgggcgtgggcctggaggccgccaagacagagaagcaggtgtgtgagcctgagaacccctgcaaggacaagacccacaactgccacaagcatgctgagtgcatctacctgggccacttcagtgaccccatgtacaagtgtgagtgccagacaggctatgctggagatggcctcatctgtggagaagattctgacctggatggctggcccaacctgaacctggtgtgtgccaccaatgccacctaccactgcatcaaggacaactgcccccacctgcccaacagcggccaggaggactttgacaaggatggcattggagatgcctgtgatgatgatgatgacaatgatggagtgacagatgagaaggacaactgccagctgctcttcaacccccggcaggccgactatgacaaggatgaggtgggggacagatgtgacaactgcccctacgtgcacaacccagcccagattgacacagacaacaatggagaaggagatgcctgcagcgtggacattgatggagatgatgtgttcaatgaaagagacaactgcccctacgtgtacaacacagaccagagggacacagatggagatggagtgggggaccactgtgacaactgccccctggtgcacaacccagaccagacagatgtggacaatgacctggtgggggaccagtgtgacaacaatgaagatattgatgatgatggccaccagaacaaccaggacaactgcccctacatcagcaatgccaaccaggccgaccatgacagagatggccagggagatgcctgtgaccctgatgatgacaatgatggagtgcctgatgaccgggacaactgccgcctggtgttcaacccagaccaggaggacctggatggagatggccgcggggacatctgcaaggatgactttgacaatgacaacatcccagacattgatgatgtgtgcccagagaacaatgccatcagcgagacagacttcaggaacttccagatggtgcccctggaccccaagggcaccacccagattgaccccaactgggtgatccgccaccagggcaaggagctggtgcagacagccaacagcgaccccggcattgctgtgggctttgatgaatttggatctgtggacttcagcggcaccttctacgtgaacacagacagagatgatgattatgccggctttgtgtttggctaccagagcagcagccgcttctacgtggtgatgtggaagcaggtgacccagacctactgggaggaccagcccacccgggcctacggctacagcggcgtgtccctgaaggtggtgaacagcaccaccggcaccggggagcacctgagaaatgccctgtggcacactggaaacaccccaggccaggtgaggaccctgtggcatgaccccaggaacatcggctggaaggactacacagcctaccgctggcacctgacccaccggcccaagacaggctacatccgggtgctggtgcatgagggcaagcaggtgatggctgacagcggccccatctatgaccagacctacgccggcggccgcctgggcctgtttgtgttcagccaggagatggtgtacttcagtgacctgaagtatgagtgccgggacatctag

SEQ ID NO: 22150 - DNA, 1293 bp, Artificial Sequence
  Description of Artificial Sequence: Synthetic coding sequence
gatgatgacaatgatggagtgacagatgagaaggacaactgccagctgctcttcaacccccggcaggccgactatgacaaggatgaggtgggggacagatgtgacaactgcccctacgtgcacaacccagcccagattgacacagacaacaatggagaaggagatgcctgcagcgtggacattgatggagatgatgtgttcaatgaaagagacaactgcccctacgtgtacaacacagaccagagggacacagatggagatggagtgggggaccactgtgacaactgccccctggtgcacaacccagaccagacagatgtggacaatgacctggtgggggaccagtgtgacaacaatgaagatattgatgatgatggccaccagaacaaccaggacaactgcccctacatcagcaatgccaaccaggccgaccatgacagagatggccagggagatgcctgtgaccctgatgatgacaatgatggagtgcctgatgaccgggacaactgccgcctggtgttcaacccagaccaggaggacctggatggagatggccgcggggacatctgcaaggatgactttgacaatgacaacatcccagacattgatgatgtgtgcccagagaacaatgccatcagcgagacagacttcaggaacttccagatggtgcccctggaccccaagggcaccacccagattgaccccaactgggtgatccgccaccagggcaaggagctggtgcagacagccaacagcgaccccggcattgctgtgggctttgatgaatttggatctgtggacttcagcggcaccttctacgtgaacacagacagagatgatgattatgccggctttgtgtttggctaccagagcagcagccgcttctacgtggtgatgtggaagcaggtgacccagacctactgggaggaccagcccacccgggcctacggctacagcggcgtgtccctgaaggtggtgaacagcaccaccggcaccggggagcacctgagaaatgccctgtggcacactggaaacaccccaggccaggtgaggaccctgtggcatgaccccaggaacatcggctggaaggactacacagcctaccgctggcacctgacccaccggcccaagacaggctacatccgggtgctggtgcatgagggcaagcaggtgatggctgacagcggccccatctatgaccagacctacgccggcggccgcctgggcctgtttgtgttcagccaggagatggtgtacttcagtgacctgaagtatgagtgcagggtcatctag

SEQ ID NO: 22151 - DNA, 252 bp, Artificial Sequence
  Description of Artificial Sequence: Synthetic coding sequence
atggtgtggaggctggtgctgctggccctgtgggtgtggcccagcacccaggccggccaccaggacaaggacaccacctttgacctcttcagcatcagcaacatcaacaggaagaccatcggggccaagcagttccggggccctgaccccggggtgcctgcctacagatttgtgcgctttgactacatcccccctgtgaatgctgatgacctgagcaagatcaccaagatcatgaggcagaaggagggctag

SEQ ID NO: 22152 - DNA, 1449 bp, Artificial Sequence
  Description of Artificial Sequence: Synthetic coding sequence
atggccgccctgatgaccccaggcactggagcccccccagcccctggggacttctctggagagggcagccagggcctgcctgaccccagccctgagcccaagcagctgcctgagctgatccgcatgaagagagatggcggccgcctgtctgaggccgacatccggggctttgtggccgctgtggtgaatggaagtgcccagggcgcccagattggagccatgctgatggccatccggctgcggggcatggacctggaggagacctctgtgctgacccaggccctggcccagagcggccagcagctggagtggccagaggcctggaggcagcagctggtggacaagcacagcactggaggagtgggggacaaggtgtccctggtgctggccccagccctggccgcctgtggctgcaaggtgcccatgatcagcggccggggcctgggccacactggaggcaccctggacaagctggagagcatccctggcttcaacgtcatccagagccctgagcagatgcaggtgctgctggaccaggccggctgctgcatcgtgggccagagcgagcagctggtgcctgcagatggcatcctgtatgctgccagagatgtgacagccaccgtggacagcctgcccctcatcacagccagcatcctgagcaagaagctggtggagggcctgagcgccctggtggtggatgtgaagtttggaggagctgctgtgttccccaaccaggagcaggcccgggagctggccaagaccctggtgggcgtgggcgccagcctgggcctgcgggtggccgccgccctgacagccatggacaagcccctgggccgctgtgtgggccacgccctggaggtggaggaggccctgctgtgcatggatggagctggccccccagacctgcgggacctggtgaccaccctgggcggggccctgctgtggctgagcggccacgccggcacccaggcccagggcgccgcccgggtggccgccgccctggatgatggcagcgccctgggccgctttgagaggatgctggccgcccagggcgtggaccccggcctggcccgggccctgtgcagcggcagccctgctgagcggcggcagctgctgccccgggcccgggagcaggaggagctgctggccccagcagatggcaccgtggagctggtgcgggccctgcccctggccctggtgctgcacgagctgggcgccggccgcagcagagctggggagcccctgcggctgggcgtgggcgctgagctgctggtggatgtgggccagaggctgcggcggggcaccccctggctgcgggtgcacagagatggccctgccctgagcggcccccagagccgggccctgcaggaggccctggtgctgagtgaccgggccccctttgctgcccccagcccctttgctgagctggtgctgcccccccagcagtag

SEQ ID NO: 22153 - DNA, 1449 bp, Artificial Sequence; identical to SEQ ID NO: 22152
  Description of Artificial Sequence: Synthetic coding sequence

SEQ ID NO: 22154 - DNA, 1449 bp, Artificial Sequence; identical to SEQ ID NO: 22152
  Description of Artificial Sequence: Synthetic coding sequence

SEQ ID NO: 22155 - DNA, 1233 bp, Artificial Sequence
  Description of Artificial Sequence: Synthetic coding sequence
atggaggccgagaatgccggcagctacagcctgcagcaggcccaggccttctacaccttccccttccagcagctgatggccgaggcccccaacatggctgtggtgaatgagcagcagatgcctgaggaggtgcctgccccagccccagcccaggagcctgtgcaggaggcccccaagggcaggaagaggaagcccaggaccacagagcccaagcagcctgtggagcccaagaagcctgtggagagcaagaagagcggcaagagcgccaagagcaaggagaagcaggagaagatcacagacaccttcaaggtgaagaggaaggtggaccgcttcaacggggtgtctgaggccgagctgctgaccaagaccctgcctgacatcctgaccttcaacctggacatcgtcatcatcggcatcaaccctggcctgatggccgcctacaagggccaccactacccaggccctggcaaccacttctggaagtgcctcttcatgagcggcctgtctgaggtgcagctgaaccacatggatgaccacaccctgcccgggaagtatggaattggcttcaccaacatggtggagaggaccaccccaggcagcaaggacctgagcagcaaggagttccgggagggcggccgcatcctggtgcagaagctgcagaagtaccagcccagaattgctgtgttcaacgggaagtgcatctatgagatcttcagcaaggaggtgtttggagtgaaggtgaagaacctggagtttggcctgcagccccacaagatcccagacacagagaccctgtgctacgtgatgcccagcagcagcgcccgctgtgcccagttcccccgggcccaggacaaggtgcactactacatcaagctgaaggacctgcgggaccagctgaagggcatcgagaggaacatggatgtgcaggaggtgcagtacacctttgacctgcagctggcccaggaggatgccaagaagatggctgtgaaggaggagaagtatgaccccggctatgaggccgcctacggcggggcctacggggagaacccctgcagcagcgagccctgtggcttcagcagcaatggcctcatcgagagcgtggagctgcggggggagagcgccttcagcggcatccccaacggccagtggatgacccagagcttcacagaccagatccccagcttcagcaaccactgcggcacccaggagcaggaggaggagagccacgcctag

SEQ ID NO: 22156 - DNA, 621 bp, Artificial Sequence
  Description of Artificial Sequence: Synthetic coding sequence
atgatcaccctgtaccagggctccatggtgctggacctgcccacctggtggaagggccccaggcctgctgccaagatcagccctggcatctatgagatcttcagcaaggaggtgtttggagtgaaggtgaagaacctggagtttggcctgcagccccacaagatcccagacacagagaccctgtgctacgtgatgcccagcagcagcgcccgctgtgcccagttcccccgggcccaggacaaggtgcactactacatcaagctgaaggacctgcgggaccagctgaagggcatcgagaggaacatggatgtgcaggaggtgcagtacacctttgacctgcagctggcccaggaggatgccaagaagatggctgtgaaggaggagaagtatgaccccggctatgaggccgcctacggcggggcctacggggagaacccctgcagcagcgagccctgtggcttcagcagcaatggcctcatcgagagcgtggagctgcggggggagagcgccttcagcggcatccccaacggccagtggatgacccagagcttcacagaccagatccccagcttcagcaaccactgcggcacccaggagcaggaggaggagagccacgcctag

SEQ ID NO: 22157 - DNA, 3294 bp, Artificial Sequence
  Description of Artificial Sequence: Synthetic coding sequence
atgagcagctgccgcagcctgtgctgcggggacatcagccagagcgctgtgctcttcctgtgccagggcaccctggccatgctggactggcagaatggctccatgggccgcagcggggaggccctgctgctggacacagcccacgtgctcttcaccctgagcagccagatcaaggagcccaccctggagatgttcctgagccgcatcctggcctcctggaccaacagcgccatccaggtgctggagagcagcagccccagcctgacagacagcctgaatggaaacagcagcatcgtgggccgcctgctggagtatgtgtacacccactgggagcaccccctggatgccctgcggcaccagaccaagatcatgttcaagaacctgctgcagatgcaccggctgactgtggagggcgctgactttgtgcctgaccccttctttgtggagctgacagagagcctgctgcggctggagtggcacatcaagggcaagtacacctgcctgggctgcctggtggagtgcattggagtggagcacatcctggccatcgacaagaccatccccagccagatcctggaggtgatgggagaccagagcctggtgccctatgccagtgacctgctggagaccatgttcaggaaccacaagagccacctgaagagccagacagctgagagctcctggattgaccagtggcatgagacctgggtgagccccctgctcttcatcctgtgtgagggcaacctggaccagaagagctatgtgattgactactacctgcccaagctgctgagctacagccctgagagcctgcagtacatggtgaagatcctgcagaccagcattgatgccaagacaggccaggagcagagcttccccagcctgggcagctgcaacagcagaggagccctgggcgccctgatggcctgcctgagaattgcccgggcccacggccacctgcagagcgccacagacacctgggagaacctggtgtctgatgcccgcatcaagcagggcctcatccaccagcactgccaggtgagaattgacaccctgggcctgctgtgtgagagcaacagaagcacagagatcgtgtccatggaggagatgcagtggatccagttcttcatcacctacaacctgaacagccagagccctggggtgcggcagcagatctgcagcctgctgaagaagctgttctgccgcatccaggagagcagccaggtgctgtacaagctggagcagagcaagagcaagcgggagccagaaaatgagctgaccaagcagcaccccagcgtgtccctgcagcagtacaagaacttcatgagcagcatctgcaacagcctgtttgaggccctcttccctggcagcagctacagcacccgcttcagcgccctgaccatcctgggcagcattgctgaggtgttccacgtgcctgagggccgcatctacacagtgtaccagctgagccatgacattgatgtgggccgcttccagaccctgatggagtgcttcaccagcacctttgaagatgtgaagatcctggcctttgacctgctgatgaagctgagcaagacagctgtgcacttccaggacagcggcaagctgcagggcctcttccaggccgccctggagctgagcaccagcaccaagccctatgactgtgtgacagccagctacctgctgaacttcctgatctggcaggatgccctgcccagcagcctgagcgcctacctgacccagcaggtggcctgtgacaatggagacaggcctgctgctgtggtggagaggaacaccctgatggtgatcaagtgcctgatggagaacctggaggaggaggtgtcccaggccgagaacagcctgctgcaggccgccgccgccttccccatgtatggccgggtgcactgcatcaccggggccctgcagaagctgagcctgaacagcctgcagctggtgtctgagtggaggcctgtggtggagaagctgctgctgatgagctaccgcctgagcacagtggtgtcccctgtgatccagagcagcagccctgagggcctcatccccatggacacagacagcgagagcgccagccggctgcagatgatcctgaatgagatccagccccgggacaccaatgactacttcaaccaggccaagatcctgaaggagcatgacagctttgacatgaaggacctgaatgcctctgtggtgaacatcgacaccagcacagagatcaagggcaaggaggtgaagacctgtgatgtgacagcccagatggtgctggtgtgctgctggaggtccatgaaggaggtggccctgctgctgggcatgctgtgccagctgctgcccatgcagcctgtgcctgagagcagtgatggcctgctgactgtggagcaggtgaaggagatcggggactacttcaagcagcacctgctgcagagccgccacagaggagcctttgagctggcctacacaggctttgtgaagctgacagaggtgctgaaccgctgccccaacgtgtccctgcagaagctgcctgagcagtggctgtggagcgtgctggaggagatcaagtgcagcgaccccagcagcaagctgtgtgccaccaggagatctgctggcatccccttctacatccaggccctgctggccagcgagcccaagaagggccgcatggacctgctgaagatcaccatgaaggagctgatcagcctggccggccccacagatgacatccagagcacagtgccccaggtgcacgccctgaacatcctgcgggccctcttccgggacacccggctgggggagaacatcatcccctacgtggctgatggagccaaggccgccatcctgggcttcaccagccctgtgtgggccgtgaggaacagcagcaccctgctcttcagcgccctgatcacccgcatctttggagtgaagagggccaaggatgagcacagcaagaccaacaggatgacaggccgggagttcttcagccgcttccctgagctgtaccccttcctgctgaagcagctggagaccgtggccaacacagtggacagcgacatgggagagcccaacagacaccccagcatgttcctgctgctgctggtgctggagcggctgtatgccagccccatggatggcaccagcagcgccctgtccatgggcccctttgtgcccttcatcatgagggtgctgctgtgctgccccggctggagcgctgtggcccggagccagctgacagccaccagcacctcctgggtgcaggccatcctgctgccccagcccccagagtag

SEQ ID NO: 22158 - DNA, 5643 bp, Artificial Sequence
  Description of Artificial Sequence: Synthetic coding sequence
atgggcgtgaagaagaagaaggagatgcaggtggccgccctgaccatctgccaccaggacctggagaccctgaagagctttgctgatgtggagggcaagaacctggccagcctgctgctgcactgtgtgcagctgacagatggagtgtcccagatccactacatcaagcagatcgtgcccctgctggagaaggctgacaagaatggcatgtgtgaccccaccatccagagctgcctggacatcctggccggcatctacctgagcctgagcctgaagaaccccctgaagaaggtgctggccagcagcctgaacagcctgcctgacttcttcctgcctgaggccatgcaccgcttcaccagccggctgcaggaggagctgaacaccacagacctgtacagctacaggaaggtgacagacaacatcagcagctgcatggagaacttcaacctgggccgggcctctgtgaacaacctgctgaagaatgtgctgcacttcctgcagaagagcctgattgagatcctggaggagaacagaaaatgtgccggcaaccacatcatccagacccagctgatgaatgacctgctggtgggcatccgggtgtccatgatgctggtgcagaaggtgcaggacttccagggcaacctgtggaagaccagtgacagccccatctggcagaacatgtgtggcctgctgagcatcttcaccaaggtgctgagtgatgatgacctgctgcagacagtgcagagcaccagcggcctggccatcatcctcttcatcaagaccatgttccaccccagcgagaagatcccccacctgatcagctctgtgctgctgcggtctgtggactgcacctctgtgcctgagtggttcatgagcagctgccgcagcctgtgctgcggggacatcagccagagcgctgtgctcttcctgtgccagggcaccctggccatgctggactggcagaatggctccatgggccgcagcggggaggccctgctgctggacacagcccacgtgctcttcaccctgagcagccagatcaaggagcccaccctggagatgttcctgagccgcatcctggcctcctggaccaacagcgccatccaggtgctggagagcagcagccccagcctgacagacagcctgaatggaaacagcagcatcgtgggccgcctgctggagtatgtgtacacccactgggagcaccccctggatgccctgcggcaccagaccaagatcatgttcaagaacctgctgcagatgcaccggctgactgtggagggcgctgactttgtgcctgaccccttctttgtggagctgacagagagcctgctgcggctggagtggcacatcaagggcaagtacacctgcctgggctgcctggtggagtgcattggagtggagcacatcctggccatcgacaagaccatccccagccagatcctggaggtgatgggagaccagagcctggtgccctatgccagtgacctgctggagaccatgttcaggaaccacaagagccacctgaagagccagacagctgagagctcctggattgaccagtggcatgagacctgggtgagccccctgctcttcatcctgtgtgagggcaacctggaccagaagagctatgtgattgactactacctgcccaagctgctgagctacagccctgagagcctgcagtacatggtgaagatcctgcagaccagcattgatgccaagacaggccaggagcagagcttccccagcctgggcagctgcaacagcagaggagccctgggcgccctgatggcctgcctgagaattgcccgggcccacggccacctgcagagcgccacagacacctgggagaacctggtgtctgatgcccgcatcaagcagggcctcatccaccagcactgccaggtgagaattgacaccctgggcctgctgtgtgagagcaacagaagcacagagatcgtgtccatggaggagatgcagtggatccagttcttcatcacctacaacctgaacagccagagccctggggtgcggcagcagatctgcagcctgctgaagaagaagctgttctgccgcatccaggagagcagccaggtgctgtacaagctggagcagagcaagagcaagcgggagccagaaaatgagctgaccaagcagcaccccagcgtgtccctgcagcagtacaagaacttcatgagcagcatctgcaacagcctgtttgaggccctcttccctggcagcagctacagcacccgcttcagcgccctgaccatcctgggcagcattgctgaggtgttccacgtgcctgagggccgcatctacacagtgtaccagctgagccatgacattgatgtgggccgcttccagaccctgatggagtgcttcaccagcacctttgaagatgtgaagatcctggcctttgacctgctgatgaagctgagcaagacagctgtgcacttccaggacagcggcaagctgcagggcctcttccaggccgccctggagctgagcaccagcaccaagccctatgactgtgtgacagccagctacctgctgaacttcctgatctggcaggatgccctgcccagcagcctgagcgcctacctgacccagcaggtggcctgtgacaacggggacaggcctgctgctgtggtggagaggaacaccctgatggtgatcaagtgcctgatggagaacctggaggaggaggtgtcccaggccgagaacagcctgctgcaggccgctgctgccttccccatgtatggccgggtgcactgcatcactggagccctgcagaagctgagcctgaacagcctgcagctggtgtctgagtggaggcctgtggtggagaagctgctgctgatgagctaccgcctgagcacagtggtgtcccctgtgatccagagcagcagccctgagggcctcatccccatggacacagattctgagagcgccagccggctgcagatgatcctgaatgagatccagccccgggacaccaatgactacttcaaccaggccaagatcctgaaggagcatgacagctttgacatgaaggacctgaatgcctctgtggtgaacatcgacaccagcacagagatcaagggcaaggaggtgaagacctgtgatgtgacagcccagatggtgctggtgtgctgctggaggtccatgaaggaggtggccctgctgctgggcatgctgtgccagctgctgcccatgcagcctgtgcctgagagcagtgatggcctgctgactgtggagcaggtgaaggagattggagactacttcaagcagcacctgctgcagagccgccacagaggagcctttgagctggcctacacaggctttgtgaagctgacagaggtgctgaaccgctgccccaacgtgtccctgcagaagctgcctgagcagtggctgtggagcgtgctggaggagatcaagtgcagcgaccccagcagcaagctgtgtgccacccggcgctctgctggcatccccttctacatccaggccctgctggccagcgagcccaagaagggccgcatggacctgctgaagatcaccatgaaggagctgatcagcctggccggccccacagatgacatccagagcacagtgccccaggtgcacgccctgaacatcctgcgggccctcttccgggacacccggctgggggagaacatcatcccctacgtggctgatggagccaaggccgccatcctgggcttcaccagccctgtgtgggccgtgaggaacagcagcaccctgctcttcagcgccctgatcacccgcatcttcggcgtgaagagggccaaggatgagcacagcaagaccaacagatgtggccacagccctgtgtaccacagccgggagatggccgcccgggccctggtgccctttgtgatgattgaccacatccccaacaccatccgcaccctgctgagcaccctgcccagctgcacagaccagtgcttccggcagaaccacatccacggcaccctgctgcaggtgttccacctgctgcaggcctacagcgacagcaagcacggcaccaacagcgacttccagcacgagctgacagacatcaccgtgtgcaccaaggccaagctgtggctggccaagaggcagaacccctgcctggtgaccagggctgtgtacatcgacatcctcttcctgctgacctgctgcctgaacagaagtgccaaggacaaccagcctgtgctggagagcctgggcttctgggaggaggtgcggggcatcatcagcggcagcgagctgatcaccggcttcccctgggccttcaaggtgcccggcctgccccagtacctgcagagcctgacccggctggccatcgctgctgtgtgggccgccgccgccaagtctggagagcgggagaccaacgtgcccatctccttcagccagctgctggagagcgccttccctgaggtgcgcagcctgaccctggaggccctgctggagaagttcctggccgccgccagcggcctgggggagaagggcgtgccccccctgctgtgcaacatgggagagaagttcctgctgctggccatgaaggagaaccaccctgagtgcttctgcaagatcctgaagatcctgcactgcatggaccctggagagtggctgccccagacagagcactgtgtgcacctgacccccaaggagttcctgatctggaccatggacatcgccagcaatgaaagaagtgagatccagagcgtggccctgcggctggccagcaaggtgatcagccaccacatgcagacctgtgtggagaaccgggagctgattgctgctgagctgaagcagtgggtgcagctggtgatcctgagctgtgaggaccacctgcccacagagagccggctggccgtggtggaggtgctgaccagcaccacccccctcttcctgaccaacccccaccccatcctggagctgcaggacaccctggccctgtggaagtgtgtgctgaccctgctgcagagcgaggagcaggccgtgagagatgctgccacagagaccgtgaccacagccatgagccaggagaacacctgccagagcacagaatttgccttctgccaggtggatgccagcatcgccctggccctggccctggccgtgctgtgtgacctgctgcagcagtgggaccagctggcccctggcctgcccatcctgctgggctggctgctgggggagagtgatgacctggtggcctgtgtggagagcatgcaccaggtggaggaggactacctgtttgagaaggccgaggtgaacttctgggccgagaccctcatctttgtgaagtacctgtgcaagcacctgttctgcctgctgagcaagagcggctggaggcctcccagccctgagatgctgtgccacctgcagaggatggtgtctgagcagtgccacctgctgagccagttcttccgggagctgcccccagctgctgagtttgtgaagacagtggagttcacccggctgcgcatccaggaggagaggaccctggcctgcctgcggctgctggccttcctggagggcaaggagggggaggacaccctggtgctgtctgtgtgggacagctatgcagagagccggcagctgaccctgcccaggacagaggccgcctgctag

SEQ ID NO: 22159 - DNA, 5862 bp, Artificial Sequence
  Description of Artificial Sequence: Synthetic coding sequence
atgggcgtgaagaagaagaaggagatgcaggtggccgccctgaccatctgccaccaggacctggagaccctgaagagctttgctgatgtggagggcaagaacctggccagcctgctgctgcactgtgtgcagctgacagatggagtgtcccagatccactacatcaagcagatcgtgcccctgctggagaaggctgacaagaatggcatgtgtgaccccaccatccagagctgcctggacatcctggccggcatctacctgagcctgagcctgaagaaccccctgaagaaggtgctggccagcagcctgaacagcctgcctgacttcttcctgcctgaggccatgcaccgcttcaccagccggctgcaggaggagctgaacaccacagacctgtacagctacaggaaggtgacagacaacatcagcagctgcatggagaacttcaacctgggccgggcctctgtgaacaacctgctgaagaatgtgctgcacttcctgcagaagagcctgattgagatcctggaggagaacagaaaatgtgccggcaaccacatcatccagacccagctgatgaatgacctgctggtgggcatccgggtgtccatgatgctggtgcagaaggtgcaggacttccagggcaacctgtggaagaccagtgacagccccatctggcagaacatgtgtggcctgctgagcatcttcaccaaggtgctgagtgatgatgacctgctgcagacagtgcagagcaccagcggcctggccatcatcctcttcatcaagaccatgttccaccccagcgagaagatcccccacctgatcagctctgtgctgctgcggtctgtggactgcacctctgtgcctgagtggttcatgagcagctgccgcagcctgtgctgcggggacatcagccagagcgctgtgctcttcctgtgccagggcaccctggccatgctggactggcagaatggctccatgggccgcagcggggaggccctgctgctggacacagcccacgtgctcttcaccctgagcagccagatcaaggagcccaccctggagatgttcctgagccgcatcctggcctcctggaccaacagcgccatccaggtgctggagagcagcagccccagcctgacagacagcctgaatggaaacagcagcatcgtgggccgcctgctggagtatgtgtacacccactgggagcaccccctggatgccctgcggcaccagaccaagatcatgttcaagaacctgctgcagatgcaccggctgactgtggagggcgctgactttgtgcctgaccccttctttgtggagctgacagagagcctgctgcggctggagtggcacatcaagggcaagtacacctgcctgggctgcctggtggagtgcattggagtggagcacatcctggccatcgacaagaccatccccagccagatcctggaggtgatgggagaccagagcctggtgccctatgccagtgacctgctggagaccatgttcaggaaccacaagagccacctgaagagccagacagctgagagctcctggattgaccagtggcatgagacctgggtgagccccctgctcttcatcctgtgtgagggcaacctggaccagaagagctatgtgattgactactacctgcccaagctgctgagctacagccctgagagcctgcagtacatggtgaagatcctgcagaccagcattgatgccaagacaggccaggagcagagcttccccagcctgggcagctgcaacagcagaggagccctgggcgccctgatggcctgcctgagaattgcccgggcccacggccacctgcagagcgccacagacacctgggagaacctggtgtctgatgcccgcatcaagcagggcctcatccaccagcactgccaggtgagaattgacaccctgggcctgctgtgtgagagcaacagaagcacagagatcgtgtccatggaggagatgcagtggatccagttcttcatcacctacaacctgaacagccagagccctggggtgcggcagcagatctgcagcctgctgaagaagctgttctgccgcatccaggagagcagccaggtgctgtacaagctggagcagagcaagagcaagcgggagccagaaaatgagctgaccaagcagcaccccagcgtgtccctgcagcagtacaagaacttcatgagcagcatctgcaacagcctgtttgaggccctcttccctggcagcagctacagcacccgcttcagcgccctgaccatcctgggcagcattgctgaggtgttccacgtgcctgagggccgcatctacacagtgtaccagctgagccatgacattgatgtgggccgcttccagaccctgatggagtgcttcaccagcacctttgaagatgtgaagatcctggcctttgacctgctgatgaagctgagcaagacagctgtgcacttccaggacagcggcaagctgcagggcctcttccaggccgccctggagctgagcaccagcaccaagccctatgactgtgtgacagccagctacctgctgaacttcctgatctggcaggatgccctgcccagcagcctgagcgcctacctgacccagcaggtggcctgtgacaatggagacaggcctgctgctgtggtggagaggaacaccctgatggtgatcaagtgcctgatggagaacctggaggaggaggtgtcccaggccgagaacagcctgctgcaggccgccgccgccttccccatgtatggccgggtgcactgcatcaccggggccctgcagaagctgagcctgaacagcctgcagctggtgtctgagtggaggcctgtggtggagaagctgctgctgatgagctaccgcctgagcacagtggtgtcccctgtgatccagagcagcagccctgagggcctcatccccatggacacagacagcgagagcgccagccggctgcagatgatcctgaatgagatccagccccgggacaccaatgactacttcaaccaggccaagatcctgaaggagcatgacagctttgacatgaaggacctgaatgcctctgtggtgaacatcgacaccagcacagagatcaagggcaaggaggtgaagacctgtgatgtgacagcccagatggtgctggtgtgctgctggaggtccatgaaggaggtggccctgctgctgggcatgctgtgccagctgctgcccatgcagcctgtgcctgagagcagtgatggcctgctgactgtggagcaggtgaaggagatcggggactacttcaagcagcacctgctgcagagccgccacagaggagcctttgagctggcctacacaggctttgtgaagctgacagaggtgctgaaccgctgccccaacgtgtccctgcagaagctgcctgagcagtggctgtggagcgtgctggaggagatcaagtgcagcgaccccagcagcaagctgtgtgccaccaggagatctgctggcatccccttctacatccaggccctgctggccagcgagcccaagaagggccgcatggacctgctgaagatcaccatgaaggagctgatcagcctggccggccccacagatgacatccagagcacagtgccccaggtgcacgccctgaacatcctgcgggccctcttccgggacacccggctgggggagaacatcatcccctacgtggctgatggagccaaggccgccatcctgggcttcaccagccctgtgtgggccgtgaggaacagcagcaccctgctcttcagcgccctgatcacccgcatctttggagtgaagagggccaaggatgagcacagcaagaccaacaggatgacaggccgggagttcttcagccgcttccctgagctgtaccccttcctgctgaagcagctggagaccgtggccaacacagtggacagcgacatgggagagcccaacagacaccccagcatgttcctgctgctgctggtgctggagcggctgtatgccagccccatggatggcaccagcagcgccctgtccatgggcccctttgtgcccttcatcatgagatgtggccacagccctgtgtaccacagccgggagatggccgcccgggccctggtgccctttgtgatgattgaccacatccccaacaccatccgcaccctgctgagcaccctgcccagctgcacagaccagtgcttccggcagaaccacatccacggcaccctgctgcaggtgttccacctgctgcaggcctacagcgacagcaagcacggcaccaacagcgacttccagcacgagctgacagacatcaccgtgtgcaccaaggccaagctgtggctggccaagaggcagaacccctgcctggtgaccagggctgtgtacatcgacatcctcttcctgctgacctgctgcctgaacagaagtgccaaggacaaccagcctgtgctggagagcctgggcttctgggaggaggtgcggggcatcatcagcggcagcgagctgatcaccggcttcccctgggccttcaaggtgcccggcctgccccagtacctgcagagcctgacccggctggccatcgctgctgtgtgggccgctgctgccaagagcggggagcgggagaccaacgtgcccatctccttcagccagctgctggagagcgccttccctgaggtgcgcagcctgaccctggaggccctgctggagaagttcctggccgccgccagcggcctgggggagaagggcgtgccccccctgctgtgcaacatgggagagaagttcctgctgctggccatgaaggagaaccaccctgagtgcttctgcaagatcctgaagatcctgcactgcatggaccccggggagtggctgccccagacagagcactgtgtgcacctgacccccaaggagttcctgatctggaccatggacatcgccagcaatgaaagaagtgagatccagagcgtggccctgcggctggccagcaaggtgatcagccaccacatgcagacctgtgtggagaaccgggagctgattgctgctgagctgaagcagtgggtgcagctggtgatcctgagctgtgaggaccacctgcccacagagagccggctggccgtggtggaggtgctgaccagcaccacccccctcttcctgaccaacccccaccccatcctggagctgcaggacaccctggccctgtggaagtgtgtgctgaccctgctgcagagcgaggagcaggccgtgagagatgctgccacagaaacagtgaccacagccatgagccaggagaacacctgccagagcacagaatttgccttctgccaggtggatgccagcatcgccctggccctggccctggccgtgctgtgtgacctgctgcagcagtgggaccagctggcccctggcctgcccatcctgctgggctggctgctgggggagagtgatgacctggtggcctgtgtggagagcatgcaccaggtggaggaggactacctgtttgagaaggccgaggtgaacttctgggccgagaccctcatctttgtgaagtacctgtgcaagcacctgttctgcctgctgagcaagagcggctggaggcctcccagccctgagatgctgtgccacctgcagaggatggtgtctgagcagtgccacctgctgagccagttcttccgggagctgcccccagctgctgagtttgtgaagacagtggagttcacccggctgcgcatccaggaggagaggaccctggcctgcctgcggctgctggccttcctggagggcaaggagggggaggacaccctggtgctgtctgtgtgggacagctatgcagagagccggcagctgaccctgcccaggacagaagctgcctgctag

SEQ ID NO: 22160 - DNA, 5862 bp, Artificial Sequence; identical to SEQ ID NO: 22159
  Description of Artificial Sequence: Synthetic coding sequence

SEQ ID NO: 22161 - DNA, 4905 bp, Artificial Sequence
  Description of Artificial Sequence: Synthetic coding sequence
atgagcagctgccgcagcctgtgctgcggggacatcagccagagcgctgtgctcttcctgtgccagggcaccctggccatgctggactggcagaatggctccatgggccgcagcggggaggccctgctgctggacacagcccacgtgctcttcaccctgagcagccagatcaaggagcccaccctggagatgttcctgagccgcatcctggcctcctggaccaacagcgccatccaggtgctggagagcagcagccccagcctgacagacagcctgaatggaaacagcagcatcgtgggccgcctgctggagtatgtgtacacccactgggagcaccccctggatgccctgcggcaccagaccaagatcatgttcaagaacctgctgcagatgcaccggctgactgtggagggcgctgactttgtgcctgaccccttctttgtggagctgacagagagcctgctgcggctggagtggcacatcaagggcaagtacacctgcctgggctgcctggtggagtgcattggagtggagcacatcctggccatcgacaagaccatccccagccagatcctggaggtgatgggagaccagagcctggtgccctatgccagtgacctgctggagaccatgttcaggaaccacaagagccacctgaagagccagacagctgagagctcctggattgaccagtggcatgagacctgggtgagccccctgctcttcatcctgtgtgagggcaacctggaccagaagagctatgtgattgactactacctgcccaagctgctgagctacagccctgagagcctgcagtacatggtgaagatcctgcagaccagcattgatgccaagacaggccaggagcagagcttccccagcctgggcagctgcaacagcagaggagccctgggcgccctgatggcctgcctgagaattgcccgggcccacggccacctgcagagcgccacagacacctgggagaacctggtgtctgatgcccgcatcaagcagggcctcatccaccagcactgccaggtgagaattgacaccctgggcctgctgtgtgagagcaacagaagcacagagatcgtgtccatggaggagatgcagtggatccagttcttcatcacctacaacctgaacagccagagccctggggtgcggcagcagatctgcagcctgctgaagaagctgttctgccgcatccaggagagcagccaggtgctgtacaagctggagcagagcaagagcaagcgggagccagaaaatgagctgaccaagcagcaccccagcgtgtccctgcagcagtacaagaacttcatgagcagcatctgcaacagcctgtttgaggccctcttccctggcagcagctacagcacccgcttcagcgccctgaccatcctgggcagcattgctgaggtgttccacgtgcctgagggccgcatctacacagtgtaccagctgagccatgacattgatgtgggccgcttccagaccctgatggagtgcttcaccagcacctttgaagatgtgaagatcctggcctttgacctgctgatgaagctgagcaagacagctgtgcacttccaggacagcggcaagctgcagggcctcttccaggccgccctggagctgagcaccagcaccaagccctatgactgtgtgacagccagctacctgctgaacttcctgatctggcaggatgccctgcccagcagcctgagcgcctacctgacccagcaggtggcctgtgacaatggagacaggcctgctgctgtggtggagaggaacaccctgatggtgatcaagtgcctgatggagaacctggaggaggaggtgtcccaggccgagaacagcctgctgcaggccgccgccgccttccccatgtatggccgggtgcactgcatcaccggggccctgcagaagctgagcctgaacagcctgcagctggtgtctgagtggaggcctgtggtggagaagctgctgctgatgagctaccgcctgagcacagtggtgtcccctgtgatccagagcagcagccctgagggcctcatccccatggacacagacagcgagagcgccagccggctgcagatgatcctgaatgagatccagccccgggacaccaatgactacttcaaccaggccaagatcctgaaggagcatgacagctttgacatgaaggacctgaatgcctctgtggtgaacatcgacaccagcacagagatcaagggcaaggaggtgaagacctgtgatgtgacagcccagatggtgctggtgtgctgctggaggtccatgaaggaggtggccctgctgctgggcatgctgtgccagctgctgcccatgcagcctgtgcctgagagcagtgatggcctgctgactgtggagcaggtgaaggagatcggggactacttcaagcagcacctgctgcagagccgccacagaggagcctttgagctggcctacacaggctttgtgaagctgacagaggtgctgaaccgctgccccaacgtgtccctgcagaagctgcctgagcagtggctgtggagcgtgctggaggagatcaagtgcagcgaccccagcagcaagctgtgtgccaccaggagatctgctggcatccccttctacatccaggccctgctggccagcgagcccaagaagggccgcatggacctgctgaagatcaccatgaaggagctgatcagcctggccggccccacagatgacatccagagcacagtgccccaggtgcacgccctgaacatcctgcgggccctcttccgggacacccggctgggggagaacatcatcccctacgtggctgatggagccaaggccgccatcctgggcttcaccagccctgtgtgggccagccagatgacaggccgggagttcttcagccgcttccctgagctgtaccccttcctgctgaagcagctggagaccgtggccaacacagtggacagcgacatgggagagcccaacagacaccccagcatgttcctgctgctgctggtgctggagcggctgtatgccagccccatggatggcaccagcagcgccctgtccatgggcccctttgtgcccttcatcatgagatgtggccacagccctgtgtaccacagccgggagatggccgcccgggccctggtgccctttgtgatgattgaccacatccccaacaccatccgcaccctgctgagcaccctgcccagctgcacagaccagtgcttccggcagaaccacatccacggcaccctgctgcaggtgttccacctgctgcaggcctacagcgacagcaagcacggcaccaacagcgacttccagcacgagctgacagacatcaccgtgtgcaccaaggccaagctgtggctggccaagaggcagaacccctgcctggtgaccagggctgtgtacatcgacatcctcttcctgctgacctgctgcctgaacagaagtgccaaggacaaccagcctgtgctggagagcctgggcttctgggaggaggtgcggggcatcatcagcggcagcgagctgatcaccggcttcccctgggccttcaaggtgcccggcctgccccagtacctgcagagcctgacccggctggccatcgctgctgtgtgggccgccgccgccaagtctggagagcgggagaccaacgtgcccatctccttcagccagctgctggagagcgccttccctgaggtgcgcagcctgaccctggaggccctgctggagaagttcctggccgccgccagcggcctgggggagaagggcgtgccccccctgctgtgcaacatgggagagaagttcctgctgctggccatgaaggagaaccaccctgagtgcttctgcaagatcctgaagatcctgcactgcatggaccctggagagtggctgccccagacagagcactgtgtgcacctgacccccaaggagttcctgatctggaccatggacatcgccagcaatgaaagaagtgagatccagagcgtggccctgcggctggccagcaaggtgatcagccaccacatgcagacctgtgtggagaaccgggagctgattgctgctgagctgaagcagtgggtgcagctggtgatcctgagctgtgaggaccacctgcccacagagagccggctggccgtggtggaggtgctgaccagcaccacccccctcttcctgaccaacccccaccccatcctggagctgcaggacaccctggccctgtggaagtgtgtgctgaccctgctgcagagcgaggagcaggccgtgagagatgctgccacagagaccgtgaccacagccatgagccaggagaacacctgccagagcacagaatttgccttctgccaggtggatgccagcatcgccctggccctggccctggccgtgctgtgtgacctgctgcagcagtgggaccagctggcccctggcctgcccatcctgctgggctggctgctgggggagagtgatgacctggtggcctgtgtggagagcatgcaccaggtggaggaggactacctgtttgagaaggccgaggtgaacttctgggccgagaccctcatctttgtgaagtacctgtgcaagcacctgttctgcctgctgagcaagagcggctggaggcctcccagccctgagatgctgtgccacctgcagaggatggtgtctgagcagtgccacctgctgagccagttcttccgggagctgcccccagctgctgagtttgtgaagacagtggagttcacccggctgcgcatccaggaggagaggaccctggcctgcctgcggctgctggccttcctggagggcaaggagggggaggacaccctggtgctgtctgtgtgggacagctatgcagagagccggcagctgaccctgcccaggacagaggccgcctgctag

SEQ ID NO: 22162 - DNA, 2685 bp, Artificial Sequence
  Description of Artificial Sequence: Synthetic coding sequence
atgggcgtgaagaagaagaaggagatgcaggtggccgccctgaccatctgccaccaggacctggagaccctgaagagctttgctgatgtggagggcaagaacctggccagcctgctgctgcactgtgtgcagctgacagatggagtgtcccagatccactacatcaagcagatcgtgcccctgctggagaaggctgacaagaatggcatgtgtgaccccaccatccagagctgcctggacatcctggccggcatctacctgagcctgagcctgaagaaccccctgaagaaggtgctggccagcagcctgaacagcctgcctgacttcttcctgcctgaggccatgcaccgcttcaccagccggctgcaggaggagctgaacaccacagacctgtacagctacaggaaggtgacagacaacatcagcagctgcatggagaacttcaacctgggccgggcctctgtgaacaacctgctgaagaatgtgctgcacttcctgcagaagagcctgattgagatcctggaggagaacagaaaatgtgccggcaaccacatcatccagacccagctgatgaatgacctgctggtgggcatccgggtgtccatgatgctggtgcagaaggtgcaggacttccagggcaacctgtggaagaccagtgacagccccatctggcagaacatgtgtggcctgctgagcatcttcaccaaggtgctgagtgatgatgacctgctgcagacagtgcagagcaccagcggcctggccatcatcctcttcatcaagaccatgttccaccccagcgagaagatcccccacctgatcagctctgtgctgctgcggtctgtggactgcacctctgtgcctgagtggttcatgagcagctgccgcagcctgtgctgcggggacatcagccagagcgctgtgctcttcctgtgccagggcaccctggccatgctggactggcagaatggctccatgggccgcagcggggaggccctgctgctggacacagcccacgtgctcttcaccctgagcagccagatcaaggagcccaccctggagatgttcctgagccgcatcctggcctcctggaccaacagcgccatccaggtgctggagagcagcagccccagcctgacagacagcctgaatggaaacagcagcatcgtgggccgcctgctggagtatgtgtacacccactgggagcaccccctggatgccctgcggcaccagaccaagatcatgttcaagaacctgctgcagatgcaccggctgactgtggagggcgctgactttgtgcctgaccccttctttgtggagctgacagagagcctgctgcggctggagtggcacatcaagggcaagtacacctgcctgggctgcctggtggagtgcattggagtggagcacatcctggccatcgacaagaccatccccagccagatcctggaggtgatgggagaccagagcctggtgccctatgccagtgacctgctggagaccatgttcaggaaccacaagagccacctgaagagccagacagctgagagctcctggattgaccagtggcatgagacctgggtgagccccctgctcttcatcctgtgtgagggcaacctggaccagaagagctatgtgattgactactacctgcccaagctgctgagctacagccctgagagcctgcagtacatggtgaagatcctgcagaccagcattgatgccaagacaggccaggagcagagcttccccagcctgggcagctgcaacagcagaggagccctgggcgccctgatggcctgcctgagaattgcccgggcccacggccacctgcagagcgccacagacacctgggagaacctggtgtctgatgcccgcatcaagcagggcctcatccaccagcactgccaggtgagaattgacaccctgggcctgctgtgtgagagcaacagaagcacagagatcgtgtccatggaggagatgcagtggatccagttcttcatcacctacaacctgaacagccagagccctggggtgcggcagcagatctgcagcctgctgaagaagctgttctgccgcatccaggagagcagccaggtgctgtacaagctggagcagagcaagagcaagcgggagccagaaaatgagctgaccaagcagcaccccagcgtgtccctgcagcagtacaagaacttcatgagcagcatctgcaacagcctgtttgaggccctcttccctggcagcagctacagcacccgcttcagcgccctgaccatcctgggcagcattgctgaggtgttccacgtgcctgagggccgcatctacacagtgtaccagctgagccatgacattgatgtgggccgcttccagaccctgatggagtgcttcaccagcacctttgaagatgtgaagatcctggcctttgacctgctgatgaagctgagcaagacagctgtgcacttccaggacagcggcaagctgcagggcctcttccaggccgccctggagctgagcaccagcaccaagccctatgactgtgtgacagccagctacctgctgaacttcctgatctggcaggatgccctgcccagcagcctgagcgcctacctgacccagcaggtggcctgtgacaatggagacaggcctgctgctgtggtggagaggaacaccctgatgggcctgtactag

SEQ ID NO: 22163 - DNA, 2268 bp, Artificial Sequence
  Description of Artificial Sequence: Synthetic coding sequence
atgagcggcaccaacctggatggaaatgatgaatttgatgagcagctgaggatgcaggagctgtatggagatggcaaggatggagacacccagacagatgctggaggagagccagacagcctgggccagcagcccacagacaccccctatgagtgggacctggacaagaaggcctggttccccaagatcacagaggacttcatcgccacctaccaggccaactacggcttcagcaatgatggagccagcagcagcacagccaacgtggaggatgtgcacgccaggacagctgaggagcccccccaggagaaggcccctgagcccacagatgccaggaagaagggggagaagaggaaggccgagagcggctggttccacgtggaggaggacaggaacaccaacgtgtatgtgtctggcctgcccccagacatcaccgtggatgagttcatccagctgatgagcaagtttggcatcatcatgagggacccccagacagaggagttcaaggtgaagctgtacaaggacaaccagggcaacctgaagggagatggcctgtgctgctacctgaagcgggagagcgtggagctggccctgaagctgctggatgaagatgagatccggggctacaagctgcacgtggaggtggccaagttccagctgaagggggagtatgatgccagcaagaagaagaagaagtgcaaggactacaagaagaagctgtccatgcagcagaagcagctggactggaggcctgagaggagagctggccccagcaggatgagacatgagcgggtggtgatcatcaagaacatgttccaccccatggactttgaagatgaccccctggtgctgaatgagatccgggaggacctgcgggtggagtgcagcaagtttggccagatcaggaagctgctgctgtttgacagacacccagatggagtggcctctgtgtccttccgggaccctgaggaggccgactactgcatccagaccctggatggccgctggtttggaggccggcagatcacagcccaggcctgggatggcaccacagactaccaggtggaggagaccagccgggagcgggaggagcggctgcggggctgggaggccttcctgaatgcccctgaggccaacagaggcctgcggcggagtgacagcgtgtctgccagcgagcgggccggccccagccgggcccggcacttcagcgagcaccccagcaccagcaagatgaatgcccaggagacagccaccggcatggcctttgaggagcccattgatgagaagaagtttgagaagacagaagatggaggagaatttgaggagggcgccagcgagaacaatgccaaggagagcagccctgagaaggaggccgaggagggctgcccagagaaggagagcgaggagggctgccccaagaggggctttgagggcagctgcagccagaaggagagcgaggagggcaaccctgtgcggggcagcgaggaggacagccccaagaaggagagcaagaagaagaccctgaagaatgactgtgaggagaatggcctggccaaggagagtgaagatgacctgaacaaggagagcgaggaggaggtgggccccaccaaggagagtgaagaagatgacagcgagaaggagagtgatgaggactgcagcgagaagcagagtgaagatggcagcgagcgggagtttgaagaaaatggcctggagaaggacctggatgaggagggcagcgagaaggagctgcatgaaaatgtgctggacaaggagctggaggagaatgattctgagaacagcgagtttgaagatgatggcagcgagaaggtgctggatgaggagggcagcgagcgggagtttgatgaggacagtgatgagaaggaggaggaggaggacacctatgagaaggtgtttgatgatgaaagtgatgagaaggaggatgaggagtatgcagatgagaagggcctggaggccgctgacaagaaggccgaggagggagatgctgatgagaagctgtttgaggagagtgatgacaaggaggatgaagatgctgatggcaaggaggtggaggatgctgatgagaagctgtttgaagatgatgacagcaatgagaagctgtttgatgaggaggaggacagcagcgagaagctgtttgatgacagtgatgagcggggcaccctgggcggcttcggctctgtggaggagggccccctgagcacaggcagcagcttcatcctgagcagtgatgatgatgatgatgacatctag

SEQ ID NO: 22164 - DNA, 432 bp, Artificial Sequence
  Description of Artificial Sequence: Synthetic coding sequence
atgaccaagatgtacaagggcttccaggccctgggagatgctgctgacatccgctttgtgtacaccccagccatggagagcgtgtgtggctacttccacaggagccacaacagaagtgaggagttcctgattgctgggaagctgcaggacggcctgctgcacatcaccacctgcagctttgtggccccctggaacagcctgagcctggcccagaggcggggcttcaccaagacctacacagtgggctgtgaagaatgtactgtgttcccctgcctgagcatcccctgcaagctgcagagcggcacccactgcctgtggacagaccagctgctgcagggcagcgagaagggcttccagagccgccacctggcctgcctgccccgggagcccggcctgtgcacctggcagagcctgcggagccagatcgcctag

SEQ ID NO: 22165 - DNA, 786 bp, Artificial Sequence
  Description of Artificial Sequence: Synthetic coding sequence
atgcccctgaccagcggcagcagcaccccaccaccctggagggtgtctgctgacaccagcacaggccccaccacagctgcccgctccttcagcctgctggtgcgccaccggccccgggccctgtgccacaccaaccagagcctgggccggggcctggccaccacccggggccggggcagtgatggaaatggccccactggaaatggagaccaccccaacttcagcctgtctgagggccgggccttcggcagcctggccgcccagcccatcaccagctgcctgtctgtgcctgccccacccttcagcctgggcaagctgcaggacggcctgctgcacatcaccacctgcagctttgtggccccctggaacagcctgagcctggcccagaggcggggcttcaccaagacctacacagtgggctgtgaagaatgtactgtgtctgcctggaccctgaccagcaatggccgctccttccctggccccttccccaagtcctgggcctgcttcctgctgcccctggccatcctgtgcccctgtggctgcagccccaccctgcgggctgtgcctgacctgagctgctacttccccaagccagagacagcccccctgcagatcctggccgcccccttcccctgtgtgcagtacagagtcatcacctgccccagcctggtgcccctcatcctgccctgtgactacagcgtcatccccctgcctgtgcctgagcccccaggcctcttcctgggcagcccagaatgtagccccaggacccagagcgctgtgccctag

SEQ ID NO: 22166 - DNA, 291 bp, Artificial Sequence
  Description of Artificial Sequence: Synthetic coding sequence
atgcctgtgtacagcgcctggccagctgagcccaccatggccccctttgagcccctggccagcggcatcctgctgctgctgtggctgattgcccccagccgggcctgcacctgtgtgcccccccacccccagacagccttctgcaacagcgacctggtgatccgggccaagtttgtgggcaccccagaggtgaaccagaccaccctgtaccagagatatgagatcaagatgaccaagatgtacaagggcttccaggccctgggagatgctgctgacatccgctttgtgtag

SEQ ID NO: 22167 - DNA, 498 bp, Artificial Sequence
  Description of Artificial Sequence: Synthetic coding sequence
tgaccccgggccctgtgccacaccaaccagagcctgggccggggcctggccaccacccggggccggggcagtgatggaaatggccccactggaaatggagaccaccccaacttcagcctgtctgagggccgggccttcggcagcctggccgcccagcccatcaccagctgcctgtctgtgcctgccccacccttcagcctgggcaagctgcaggacggcctgctgcacatcaccacctgcagctttgtggccccctggaacagcctgagcctggcccagaggcggggcttcaccaagacctacacagtgggctgtgaagaatgtactgtgttcccctgcctgagcatcccctgcaagctgcagagcggcacccactgcctgtggacagaccagctgctgcagggcagcgagaagggcttccagagccgccacctggcctgcctgccccgggagcccggcctgtgcacctggcagagcctgcggagccagatcgcctag

SEQ ID NO: 22168 - DNA, 411 bp, Artificial Sequence
  Description of Artificial Sequence: Synthetic coding sequence
atggccccctttgagcccctggccagcggcatcctgctgctgctgtggctgattgcccccagccgggcctgcacctgtgtgcccccccacccccagacagccttctgcaacagcgacctggtgatccgggccaagtttgtgggcaccccagaggtgaaccagaccaccctgtaccagagatatgagatcaagatgaccaagatgtacaagggcttccaggccctgggagatgctgctgacatccgctttgtgtacaccccagccatggagagcgtgtgtggctacttccacaggagccacaacagaagtgaggagttcctgattgctggggaggcccccagccccaggcctgtgccccaccagcctgtgcctggggcccggcccagcaaccatgaaggagcccggctgtag

SEQ ID NO: 22169 - DNA, 663 bp, Artificial Sequence
  Description of Artificial Sequence: Synthetic coding sequence
atgggcgccgccgcccggaccctgcggctggccctgggcctgctgctgctggccaccctgctgcggccagcagatgcctgcagctgcagccctgtgcacccccagcaggccttctgcaatgctgatgtggtgatccgggccaaggctgtgtctgagaaggaggtggacagcggaaatgacatctacggcaaccccatcaagaggatccagtatgagatcaagcagatcaagatgttcaagggccctgagaaggacatcgagttcatctacacagcccccagcagcgctgtgtgtggggtgtccctggatgtgggcggcaagaaggagtacctgattgctgggaaggccgagggagatggcaagatgcacatcaccctgtgtgacttcatcgtgccctgggacaccctgagcaccacccagaagaagagcctgaaccaccgctaccagatgggctgtgagtgcaagatcacccgctgccccatgatcccctgctacatcagcagcccagatgaatgtctgtggatggactgggtgacagagaagaacatcaatggccaccaggccaagttctttgcctgcatcaagagaagtgatggcagctgtgcctggtacagaggagctgccccacccaagcaggagttcctggacatcgaggacccctag

SEQ ID NO: 22170 - DNA, 432 bp, Artificial Sequence
  Description of Artificial Sequence: Synthetic coding sequence
atgtttaaaggacctgagaaggacatcgagttcatctacacagcccccagcagcgctgtgtgtggggtgtccctggatgtgggcggcaagaaggagtacctgattgctgggaaggccgagggagatggcaagatgcacatcaccctgtgtgacttcatcgtgccctgggacaccctgagcaccacccagaagaagagcctgaaccaccgctaccagatgggctgtgagtgcaagatcacccgctgccccatgatcccctgctacatcagcagcccagatgagtgcctgtggatggactgggtgacagagaagaacatcaatggccaccaggccaagttctttgcctgcatcaagagaagtgatggcagctgtgcctggtacagaggagctgccccacccaagcaggagttcctggacatcgaggacccctag

SEQ ID NO: 22171 - DNA, 636 bp, Artificial Sequence
  Description of Artificial Sequence: Synthetic coding sequence
atgaccccctggctgggcctcatcgtgctgctgggctcctggagcctgggggactggggcgctgaggcctgcacctgcagccccagccacccccaggatgccttctgcaacagcgacatcgtcatccgggccaaggtggtgggcaagaagctggtgaaggagggccccttcggcaccctggtgtacaccatcaagcagatgaagatgtaccggggcttcaccaagatgccccacgtgcagtacatccacacagaggccagcgagagcctgtgtggcctgaagctggaggtgaacaagtaccagtacctgctgaccggccgggtgtatgatggcaagatgtacacaggcctgtgcaactttgtggagcgctgggaccagctgaccctgagccagaggaagggcctgaactaccgctaccacctgggctgcaactgcaagatcaagagctgctactacctgccctgctttgtgaccagcaagaatgaatgtctgtggacagacatgctgagcaactttggctacccaggctaccagagcaagcactacgcctgcatccggcagaagggcggctactgctcctggtaccggggctgggcccccccagacaagagcatcatcaatgccacagacccctag

SEQ ID NO: 22172 - DNA, 438 bp, Artificial Sequence
  Description of Artificial Sequence: Synthetic coding sequence
atgaagatgtaccggggcttcaccaagatgccccacgtgcagtacatccacacagaggccagcgagagcctgtgtggcctgaagctggaggtgaacaagtaccagtacctgctgaccggccgggtgtatgatggcaagatgtacacaggcctgtgcaactttgtggagcgctgggaccagctgaccctgagccagaggaagggcctgaactaccgctaccacctgggctgcaactgcaagatcaagagctgctactacctgccctgctttgtgaccagcaagaatgaatgtctgtggacagacatgctgagcaactttggctacccaggctaccagagcaagcactacgcctgcatccggcagaagggcggctactgctcctggtaccggggctgggcccccccagacaagagcatcatcaatgccacagacccctag

SEQ ID NO: 22173 - DNA, 675 bp, Artificial Sequence
  Description of Artificial Sequence: Synthetic coding sequence
atgcctggcagccccaggcctgcccccagctgggtgctgctgctgcggctgctggccctgctgcggcccccaggcctgggggaggcctgcagctgtgccccagcccacccccagcagcacatctgccacagcgccctggtgatccgggccaagatcagcagcgagaaggtggtgcctgccagcgctgaccctgctgacacagagaagatgctgcgctatgagatcaagcagatcaagatgttcaagggctttgagaaggtgaaggatgtgcagtacatctacaccccatttgacagcagcctgtgtggggtgaagctggaggccaacagccagaagcagtacctgctgaccggccaggtgctgagtgatggcaaggtgttcatccacctgtgcaactacatcgagccctgggaggacctgagcctggtgcagcgggagagcctgaaccaccactaccacctgaactgtggctgccagatcaccacctgctacacagtgccctgcaccatcagcgccccaaatgaatgtctgtggacagactggctgctggagaggaagctgtatggctaccaggcccagcactacgtgtgcatgaagcacgtggatggcacctgctcctggtaccggggccacctgcccctgaggaaggagtttgtggacatcgtgcagccctag

SEQ ID NO: 22174 - DNA, 1164 bp, Artificial Sequence
  Description of Artificial Sequence: Synthetic coding sequence
atggtgcactgcagctgtgtgctcttcagaaaatatggcaacttcatcgacaagctgcggctcttcacccggggcggcagcggcggcatgggctacccccggctgggcggggagggcggcaaaggaggagatgtgtgggtggtggcccagaacaggatgaccctgaagcagctgaaggaccgctaccccaggaagagatttgtggccggcgtgggcgccaacagcaagatcagcgccctgaagggcagcaagggcaaggactgtgagatccctgtgcctgtgggcatctctgtgacagatgaaaatggcaagatcatcggggagctgaacaaggaaaatgaccgcatcctggtggcccagggcggcctgggcggcaagctgctgaccaacttcctgcccctgaagggccagaagaggatcatccacctggacctgaagctgattgctgatgtgggcctggtgggcttccccaatgccggcaagagcagcctgctgagctgtgtgagccacgccaagccagccatcgctgactatgccttcaccaccctgaagccagagctgggcaagatcatgtacagcgacttcaagcagatctctgtggccgacctgcccggcctgattgaaggagcccacatgaacaagggcatgggccacaagttcctgaagcacatcgagaggacccggcagctgctgtttgtggtggacatcagcggcttccagctgagcagccacacccagtacagaacagcctttgagaccatcatcctgctgaccaaggagctggagctgtacaaggaggagctgcagaccaagccagccctgctggccgtgaacaagatggacctgcctgatgcccaggacaagttccacgagctgatgagccagctgcagaaccccaaggacttcctgcacctgtttgagaagaacatgatccctgagaggacagtggagttccagcacatcatccccatctctgctgtgactggagagggcatcgaggagctgaagaactgcatcaggaagagcctggatgagcaggccaaccaggagaatgatgccctgcacaagaagcagctgctgaacctgtggatcagtgacaccatgagcagcacagagccccccagcaagcatgctgtgaccaccagcaagatggacatcatctag

SEQ ID NO: 22175 - DNA, 375 bp, Artificial Sequence
  Description of Artificial Sequence: Synthetic coding sequence
atggaccctgcccggcccctgggcctgagcatcctgctgctcttcctgacagaagctgccctgggagatgctgcccaggagcccactggaaataatgctgagatctgcctgctgcccctggactatggcccctgccgggccctgctgctgcgctactactatgaccgctacacccagagctgccggcagttcctgtatggaggctgtgagggcaatgccaacaacttctacacctgggaggcctgtgatgatgcctgctggagaattgagaaggtgcccaagctgagctccatgaccagcctgaagaagaagaagaagatgcccaagctgcgctttgccagccgcatcaggaagatcaggaagaagcagttctag

SEQ ID NO: 22176 - DNA, 1506 bp, Artificial Sequence
  Description of Artificial Sequence: Synthetic coding sequence
atggctgctgcctctgtgaccccacctggcagcctggagctgctgcagcccggcttcagcaagaccctgctgggcaccaagctggaggccaagtacctgtgcagcgcctgcagaaatgtgctgcggcggcccttccaggcccagtgtggccaccgctactgcagcttctgcctggccagcatcctgagcagcggcccccagaactgtgccgcctgtgtgcatgagggcatctatgaggagggcatcagcatcctggagagcagcagcgccttcccagacaatgctgcccggcgggaggtggagagcctgcctgctgtgtgccccagtgatggctgcacctggaagggcaccctgaaggagtatgagagctgccacgagggccgctgccccctgatgctgacagaatgtcctgcctgcaagggcctggtgcggctgggggagaaggagcggcacctggagcatgaatgtcctgagaggagcctgagctgccgccactgccgggccccctgctgcggggctgatgtgaaggcccaccacgaggtgtgccccaagttccccctgacctgtgatggctgtgggaagaagaagatcccccgggagaagttccaggaccacgtgaagacctgtgggaaatgtcgggtgccctgccgcttccacgccatcggctgcctggagaccgtggagggggagaagcagcaggagcacgaggtgcagtggctgcgggagcacctggccatgctgctgagctctgtgctggaggccaagcccctgctgggggaccagagccacgccggcagcgagctgctgcagagatgtgagagcctggagaagaagacagccacctttgaaaatattgtgtgtgtgctgaaccgggaggtggagcgggtggccatgacagctgaggcctgcagccggcagcaccggctggaccaggacaagattgaggccctgagcagcaaggtgcagcagctggagaggagcatcggcctgaaggacctggccatggctgacctggagcagaaggtgctggagatggaggccagcacctatgatggagtcttcatctggaagatcagtgactttgccaggaagaggcaggaggccgtggccggccgcatcccagccatcttctccccagccttctacaccagccgctatggctacaagatgtgcctgcgcatctacctgaatggagatggcaccggccggggcacccacctgagcctcttctttgtggtgatgaagggccccaatgatgccctgctgcgctggcccttcaaccagaaggtgaccctgatgctgctggaccagaacaaccgggagcacgtgattgatgccttccggccagatgtgaccagcagcagcttccagaggcctgtgaatgacatgaacatcgccagcggctgccccctcttctgccctgtgtccaagatggaggccaagaacagctatgtgagagatgatgccatcttcatcaaggccatcgtggacctgaccggcctgtag

SEQ ID NO: 22177 - DNA, 1662 bp, Artificial Sequence
  Description of Artificial Sequence: Synthetic coding sequence
atggctgctgcctctgtgaccccacctggcagcctggagctgctgcagcccggcttcagcaagaccctgctgggcaccaagctggaggccaagtacctgtgcagcgcctgcagaaatgtgctgcggcggcccttccaggcccagtgtggccaccgctactgcagcttctgcctggccagcatcctgagcagcggcccccagaactgtgccgcctgtgtgcatgagggcatctatgaggagggcatcagcatcctggagagcagcagcgccttcccagacaatgctgcccggcgggaggtggagagcctgcctgctgtgtgccccagtgatggctgcacctggaagggcaccctgaaggagtatgaggtgaagatgcctgcctgtggcatggtgacagaggccccagctgtgggcagccggcccaggagccccagcagctatgacctggtgctgcacgtgcccctgaccggggctgaggcctgcctgatgtctgtggaggaggagacagagctgctgctgcggagctgccacgagggccgctgccccctgatgctgacagaatgtcctgcctgcaagggcctggtgcggctgggggagaaggagcggcacctggagcatgaatgtcctgagaggagcctgagctgccgccactgccgggccccctgctgcggggctgatgtgaaggcccaccacgaggtgtgccccaagttccccctgacctgtgatggctgtgggaagaagaagatcccccgggagaagttccaggaccacgtgaagacctgtgggaaatgtcgggtgccctgccgcttccacgccatcggctgcctggagaccgtggagggggagaagcagcaggagcacgaggtgcagtggctgcgggagcacctggccatgctgctgagctctgtgctggaggccaagcccctgctgggggaccagagccacgccggcagcgagctgctgcagagatgtgagagcctggagaagaagacagccacctttgaaaatattgtgtgtgtgctgaaccgggaggtggagcgggtggccatgacagctgaggcctgcagccggcagcaccggctggaccaggacaagattgaggccctgagcagcaaggtgcagcagctggagaggagcatcggcctgaaggacctggccatggctgacctggagcagaaggtgctggagatggaggccagcacctatgatggagtcttcatctggaagatcagtgactttgccaggaagaggcaggaggccgtggccggccgcatcccagccatcttctccccagccttctacaccagccgctatggctacaagatgtgcctgcgcatctacctgaatggagatggcaccggccggggcacccacctgagcctcttctttgtggtgatgaagggccccaatgatgccctgctgcgctggcccttcaaccagaaggtgaccctgatgctgctggaccagaacaaccgggagcacgtgattgatgccttccggccagatgtgaccagcagcagcttccagaggcctgtgaatgacatgaacatcgccagcggctgccccctcttctgccctgtgtccaagatggaggccaagaacagctatgtgagagatgatgccatcttcatcaaggccatcgtggacctgaccggcctgtag

SEQ ID NO: 22178 - DNA, 1269 bp, Artificial Sequence
  Description of Artificial Sequence: Synthetic coding sequence
atggctgctgcctctgtgaccccacctggcagcctggagctgctgcagcccggcttcagcaagaccctgctgggcaccaagctggaggccaagtacctgtgcagcgcctgcagaaatgtgctgcggcggcccttccaggcccagtgtggccaccgctactgcagcttctgcctggccagcatcctgagcagcggcccccagaactgtgccgcctgtgtgcatgagggcatctatgaggagggcatcagcatcctggagagcagcagcgccttcccagacaatgctgcccggcgggaggtggagagcctgcctgctgtgtgccccagtgatggctgcacctggaagggcaccctgaaggagtatgaggtgaagatgcctgcctgtggcatggtgacagaggccccagctgtgggcagccggcccaggagccccagcagctatgacctggtgctgcacgtgcccctgaccggggctgaggcctgcctgatgtctgtggaggaggagacagagctgctgctgcggagctgccacgagggccgctgccccctgatgctgacagaatgtcctgcctgcaagggcctggtgcggctgggggagaaggagcggcacctggagcatgaatgtcctgagaggagcctgagctgccgccactgccgggccccctgctgcggggctgatgtgaagaggctggaccaggacaagattgaggccctgagcagcaaggtgcagcagctggagaggagcatcggcctgaaggacctggccatggctgacctggagcagaaggtgctggagatggaggccagcacctatgatggagtcttcatctggaagatcagtgactttgccaggaagaggcaggaggccgtggccggccgcatcccagccatcttcagccctgccttctacaccagccgctatggctacaagatgtgcctgcgcatctacctgaatggagatggcaccggccggggcacccacctgagcctcttctttgtggtgatgaagggccccaatgatgccctgctgcgctggcccttcaaccagaaggtgaccctgatgctgctggaccagaacaaccgggagcacgtgattgatgccttccggccagatgtgaccagcagcagcttccagaggcctgtgaatgacatgaacatcgccagcggctgccccctcttctgccctgtgtccaagatggaggccaagaacagctatgtgagagatgatgccatcttcatcaaggccatcgtggacctgaccggcctgtag

SEQ ID NO: 22179 - DNA, 366 bp, Artificial Sequence
  Description of Artificial Sequence: Synthetic coding sequence
atggctgctgcctctgtgaccccacctggcagcctggagctgctgcagcccggcttcagcaagaccctgctgggcaccaagctggaggccaagtacctgtgcagcgcctgcagaaatgtgctgcggcggcccttccaggcccagtgtggccaccgctactgcagcttctgcctggccagcatcctgagcagcggcccccagaactgtgccgcctgtgtgcatgagggcatctatgaggagggcatcagcatcctggagagcagcagcgccttcccagacaatgctgcccggcgggaggtggagagcctgcctgctgtgtgccccagtgatggctgcacctggaagggcaccctgaaggagtactag

SEQ ID NO: 22180 - DNA, 519 bp, Artificial Sequence
  Description of Artificial Sequence: Synthetic coding sequence
atggctgctgcctctgtgaccccacctggcagcctggagctgctgcagcccggcttcagcaagaccctgctgggcaccaagctggaggccaagtacctgtgcagcgcctgcagaaatgtgctgcggcggcccttccaggcccagtgtggccaccgctactgcagcttctgcctggccagcatcctgagcagcggcccccagaactgtgccgcctgtgtgcatgagggcatctatgaggagggcatcagcatcctggagagcagcagcgccttcccagacaatgctgcccggcgggaggtggagagcctgcctgctgtgtgccccagtgatggctgcacctggaagggcaccctgaaggagtatgagagctgccacgagggccgctgccccctgatgctgacagaatgtcctgcctgcaagggcctggtgcggctgggggagaaggagcggcacctggagcatgaatgtcctgagaggagcctgagctgccgccactgccgggccccctgctgcggctag

SEQ ID NO: 22181 - DNA, 582 bp, Artificial Sequence
  Description of Artificial Sequence: Synthetic coding sequence
atggctgctgcctctgtgaccccacctggcagcctggagctgctgcagcccggcttcagcaagaccctgctgggcaccaagctggaggccaagtacctgtgcagcgcctgcagaaatgtgctgcggcggcccttccaggcccagtgtggccaccgctactgcagcttctgcctggccagcatcctgagcagcggcccccagaactgtgccgcctgtgtgcatgagggcatctatgaggagggcatcagcatcctggagagcagcagcgccttcccagacaatgctgcccggcgggaggtggagagcctgcctgctgtgtgccccagtgatggctgcacctggaagggcaccctgaaggagtatgagagctgccacgagggccgctgccccctgatgctgacagaatgtcctgcctgcaagggcctggtgcggctgggggagaaggagcggcacctggagcatgaatgtcctgagaggagcctgagctgccgccactgccgggccccctgctgcggggctgatgtgaaggcccaccacgaggtgtgccccaagttccccctgacctgtgatggctgcggctag

SEQ ID NO: 22182 - DNA, 1503 bp, Artificial Sequence
  Description of Artificial Sequence: Synthetic coding sequence
gtggccggccgggccctgagcagcggccgggccgccaccgtgggcgccctgtttgctggggtgacagccctgatggctgctgcctctgtgaccccacctggcagcctggagctgctgcagcccggcttcagcaagaccctgctgggcaccaagctggaggccaagtacctgtgcagcgcctgcagaaatgtgctgcggcggcccttccaggcccagtgtggccaccgctactgcagcttctgcctggccagcatcctgagcagcggcccccagaactgtgccgcctgtgtgcatgagggcatctatgaggagggcatcagcatcctggagagcagcagcgccttcccagacaatgctgcccggcgggaggtggagagcctgcctgctgtgtgccccagtgatggctgcacctggaagggcaccctgaaggagtatgagagctgccacgagggccgctgccccctgatgctgacagaatgtcctgcctgcaagggcctggtgcggctgggggagaaggagcggcacctggagcatgaatgtcctgagaggagcctgagctgccgccactgccgggccccctgctgcggggctgatgtgaagttccaggaccacgtgaagacctgtgggaagtgccgggtgccctgccgcttccacgccatcggctgcctggagaccgtggagggggagaagcagcaggagcacgaggtgcagtggctgcgggagcacctggccatgctgctgagctctgtgctggaggccaagcccctgctgggggaccagagccatgctggcagcgagctgctgcagagatgtgagagcctggagaagaagacagccacctttgagaacatcgtgtgtgtgctgaaccgggaggtggagcgggtggccatgacagctgaggcctgcagccggcagcaccggctggaccaggacaagattgaggccctgagcagcaaggtgcagcagctggagaggagcatcggcctgaaggacctggccatggctgacctggagcagaaggtgctggagatggaggccagcacctatgatggagtcttcatctggaagatcagtgactttgccaggaagaggcaggaggccgtggccggccgcatcccagccatcttcagccctgccttctacaccagccgctatggctacaagatgtgcctgcgcatctacctgaatggagatggcaccggccggggcacccacctgagcctcttctttgtggtgatgaagggccccaatgatgccctgctgcgctggcccttcaaccagaaggtgaccctgatgctgctggaccagaacaaccgggagcacgtgattgatgccttccggccagatgtgaccagcagcagcttccagaggcctgtgaatgacatgaacatcgccagcggctgccccctcttctgccctgtgtccaagatggaggccaagaacagctatgtgagagatgatgccatcttcatcaaggccatcgtggacctgaccggcctgtag

SEQ ID NO: 22183 - DNA, 1506 bp, Artificial Sequence; identical to SEQ ID NO: 22176
  Description of Artificial Sequence: Synthetic coding sequence

SEQ ID NO: 22184 - DNA, 1632 bp, Artificial Sequence
  Description of Artificial Sequence: Synthetic coding sequence
atggagagcagcaagaagatggacagccctggggccctgcagaccaacccccccctgaagctgcacacagacagatctgctggcacccctgtgtttgtgcctgagcagggcggctacaaggagaagtttgtgaagacagtggaggacaagtacaagtgtgagaagtgccacctggtgctgtgcagccccaagcagacagaatgtggccaccgcttctgtgagagctgcatggccgccctgctgagcagcagcagccccaagtgcacagcctgccaggagagcatcgtgaaggacaaggtgttcaaggacaactgctgcaagcgggagatcctggccctgcagatctactgcagaaatgaaagccggggctgtgccgagcagctgatgctgggccacctgctggtgcacctgaagaatgactgccactttgaggagctgccctgtgtgcggccagactgcaaggagaaggtgctgaggaaggacctgcgggaccacgtggagaaggcctgcaagtaccgggaggccacctgcagccactgcaagagccaggtgcccatgattgccctgcagaagcatgaggacacagactgcccctgtgtggtggtgtcctgcccccacaagtgcagcgtgcagaccctgctgcggtctgagggcaccaaccagcagatcaaggcccacgaggccagcagcgctgtgcagcacgtgaacctgctgaaggagtggagcaacagcctggagaagaaggtgtccctgctgcagaatgaatctgtggagaagaacaagagcatccagagcctgcacaaccagatctgcagctttgaaattgaaattgagcggcagaaggagatgctgagaaataatgaaagcaagatcctgcacctgcagagggtcatcgacagccaggccgagaagctgaaggagctggacaaggagatccggcccttccggcagaactgggaggaggccgacagcatgaagagctctgtggagagcctgcagaacagagtgacagagctggagagcgtggacaagtctgctggccaggtggccaggaacacaggcctgctggagagccagctgagcagacatgaccagatgctgtctgtgcatgacatccggctggccgacatggacctgcgcttccaggtgctggagacagccagctacaacggggtgctgatctggaagatccgggactacaagaggaggaagcaggaggccgtgatgggcaagaccctgagcctgtacagccagcccttctacacaggctacttcggctacaagatgtgtgcccgggtgtacctgaatggagatggcatgggcaagggcacccacctgagcctcttcttcgtcatcatgagaggagaatatgatgccctgctgccctggcccttcaagcagaaggtgaccctgatgctgatggaccagggcagcagccgccgccacctgggagatgccttcaagccagaccccaacagcagcagcttcaagaagcccaccggggagatgaacatcgccagcggctgccctgtgtttgtggcccagacagtgctggagaatggcacctacatcaaggatgacaccatcttcatcaaggtgattgtggacaccagtgacctgcctgacccctag

SEQ ID NO: 22185 - DNA, 1632 bp, Artificial Sequence; identical to SEQ ID NO: 22184
  Description of Artificial Sequence: Synthetic coding sequence

SEQ ID NO: 22186 - DNA, 1707 bp, Artificial Sequence
  Description of Artificial Sequence: Synthetic coding sequence
atggagagcagcaagaagatggacagccctggggccctgcagaccaacccccccctgaagctgcacacagacagatctgctggcacccctgtgtttgtgcctgagcagggcggctacaaggagaagtttgtgaagacagtggaggacaagtacaagtgtgagaagtgccacctggtgctgtgcagccccaagcagacagaatgtggccaccgcttctgtgagagctgcatggccgccctgctgagcagcagcagccccaagtgcacagcctgccaggagagcatcgtgaaggacaaggtgttcaaggacaactgctgcaagcgggagatcctggccctgcagatctactgcagaaatgaaagccggggctgtgccgagcagctgatgctgggccacctgctggtgcacctgaagaatgactgccactttgaggagctgccctgtgtgcggccagactgcaaggagaaggtgctgaggaaggacctgcgggaccacgtggagaaggcctgcaagtaccgggaggccacctgcagccactgcaagagccaggtgcccatgattgccctgcagaagcatgaggacacagactgcccctgtgtggtggtgtcctgcccccacaagtgcagcgtgcagaccctgctgcggtctgagctgagcgcccacctgtctgaatgtgtgaatgcccccagcacctgcagcttcaagagatatggctgtgtgttccagggcaccaaccagcagatcaaggcccacgaggccagcagcgctgtgcagcacgtgaacctgctgaaggagtggagcaacagcctggagaagaaggtgtccctgctgcagaatgaatctgtggagaagaacaagagcatccagagcctgcacaaccagatctgcagctttgaaattgaaattgaaaggcagaaggagatgctgaggaacaatgaaagcaagatcctgcacctgcagagggtgattgacagccaggccgagaagctgaaggagctggacaaggagatccggcccttccggcagaactgggaggaggccgacagcatgaagagctctgtggagagcctgcagaacagagtgacagagctggagagcgtggacaagtctgctggccaggtggccaggaacacaggcctgctggagagccagctgagcagacatgaccagatgctgtctgtgcatgacatccggctggccgacatggacctgcgcttccaggtgctggagacagccagctacaatggagtgctgatctggaagatccgggactacaagaggaggaagcaggaggccgtgatgggcaagaccctgagcctgtacagccagcccttctacacaggctacttcggctacaagatgtgtgcccgggtgtacctgaatggagatggcatgggcaagggcacccacctgagcctcttctttgtgatcatgagaggagaatatgatgccctgctgccctggcccttcaagcagaaggtgaccctgatgctgatggaccagggcagcagcagaagacacctgggagatgccttcaagccagaccccaacagcagcagcttcaagaagcccactggagagatgaacatcgccagcggctgccctgtgtttgtggcccagacagtgctggagaatggcacctacatcaaggatgacaccatcttcatcaaggtgattgtggacaccagtgacctgcctgacccctag

SEQ ID NO: 22187 - DNA, 1458 bp, Artificial Sequence
  Description of Artificial Sequence: Synthetic coding sequence
atggagagcagcaagaagatggacagccctggggccctgcagaccaacccccccctgaagctgcacacagacagatctgctggcacccctgtgtttgtgcctgagcagggcggctacaaggagaagtttgtgaagacagtggaggacaagtacaagtgtgagaagtgccacctggtgctgtgcagccccaagcagacagaatgtggccaccgcttctgtgagagctgcatggccgccctgctgagcagcagcagccccaagtgcacagcctgccaggagagcatcgtgaaggacaaggtgttcaaggacaactgctgcaagcgggagatcctggccctgcagatctactgcagaaatgaaagccggggctgtgccgagcagctgatgctgggccacctgctggtgcacctgaagaatgactgccactttgaggagctgccctgtgtgcggccagactgcaaggagaaggtgctgaggaaggacctgcgggaccacgtggagaaggcctgcaagtaccgggaggccacctgcagccactgcaagagccaggtgcccatgattgccctgcaggtgtccctgctgcagaatgaatctgtggagaagaacaagagcatccagagcctgcacaaccagatctgcagctttgaaattgaaattgagcggcagaaggagatgctgagaaataatgaaagcaagatcctgcacctgcagagggtcatcgacagccaggccgagaagctgaaggagctggacaaggagatccggcccttccggcagaactgggaggaggccgacagcatgaagagctctgtggagagcctgcagaacagagtgacagagctggagagcgtggacaagtctgctggccaggtggccaggaacacaggcctgctggagagccagctgagcagacatgaccagatgctgtctgtgcatgacatccggctggccgacatggacctgcgcttccaggtgctggagacagccagctacaacggggtgctgatctggaagatccgggactacaagaggaggaagcaggaggccgtgatgggcaagaccctgagcctgtacagccagcccttctacacaggctacttcggctacaagatgtgtgcccgggtgtacctgaatggagatggcatgggcaagggcacccacctgagcctcttcttcgtcatcatgagaggagaatatgatgccctgctgccctggcccttcaagcagaaggtgaccctgatgctgatggaccagggcagcagccgccgccacctgggagatgccttcaagccagaccccaacagcagcagcttcaagaagcccaccggggagatgaacatcgccagcggctgccctgtgtttgtggcccagacagtgctggagaatggcacctacatcaaggatgacaccatcttcatcaaggtgattgtggacaccagtgacctgcctgacccctag

SEQ ID NO: 22188 - DNA, 1707 bp, Artificial Sequence; identical to SEQ ID NO: 22186
  Description of Artificial Sequence: Synthetic coding sequence

SEQ ID NO: 22189 - DNA, 285 bp, Artificial Sequence
  Description of Artificial Sequence: Synthetic coding sequence
atggagagcagcaagaagatggacagccctggggccctgcagaccaacccccccctgaagctgcacacagacagatctgctggcacccctgtgtttgtgcctgagcagggcggctacaaggagaagtttgtgaagacagtggaggacaagtacaagtgtgagaagtgccacctggtgctgtgcagccccaagcagacagaatgtggccaccgcttctgtgagagctgcatggccgccctgctgagcagcagcagccccaagtgcacagcctgccaggagagctag

SEQ ID NO: 22190 - DNA, 939 bp, Artificial Sequence
  Description of Artificial Sequence: Synthetic coding sequence
atggctgctggccagaatggccacgaggagtgggtgggcagcgcctacctgtttgtggagagcagcctggacaaggtggtgctgagtgatgcctatgcccacccccagcagaaggtggccgtgtaccgggccctgcaggccgccctggccgagagcggcggcagcccagatgtgctgcagatgctgaagatccacagaagtgacccccagctgattgtgcagctgcgcttctgtggccggcagccctgtggccgcttcctgcgggcctaccgggagggcgccctgcgggccgccctgcagaggagcctggccgccgccctggcccagcacagcgtgcccctgcagctggagctgcgggccggggctgagcggctggatgccctgctggctgatgaggagcgctgcctgagctgcatcctggcccagcagcctgaccggctgagagatgaggagctggccgagctggaggatgccctgaggaacctgaagtgtggcagcggggcccggggaggagatggagaggtggccagcgcccccctgcagccccctgtgcccagcctgtctgaggtgaagcccccacctcctcctcctccagcccagaccttcctgttccagggccagcctgtggtgaaccggcccctgagcctgaaggaccagcagacctttgcccggtctgtgggcctgaagtggaggaaggtgggccgcagcctgcagaggggctgccgggccctgcgggaccctgccctggacagcctggcctatgaatatgaaagagagggcctgtatgagcaggccttccagctgctgcggagatttgtgcaggccgagggccggcgggccaccctgcagaggctggtggaggccctggaggagaatgagctgaccagcctggccgaggacctgctgggcctgacagaccccaacggcggcctggcctag

SEQ ID NO: 22191 - DNA, 825 bp, Artificial Sequence
  Description of Artificial Sequence: Synthetic coding sequence
atggccaccaccgtgtccacccagaggggccctgtgtacatcggggagctgccccaggacttcctgcgcatcacccccacccagcagcagaggcaggtgcagctggatgcccaggccgcccagcagctgcagtatggaggagctgtgggcaccgtgggccgcctgaacatcaccgtggtgcaggccaagctggccaagaactacggcatgaccaggatggacccctactgccgcctgcggctgggctatgctgtgtatgagacccccacagcccacaatggagccaagaacccccgctggaacaaggtgatccactgcaccgtgcccccaggagtggacagcttctacctggagatctttgatgagcgggccttctccatggatgacagaattgcctggacccacatcaccatccctgagagcctgcggcagggcaaggtggaggacaagtggtacagcctgagcggccggcagggagatgacaaggagggcatgatcaacctggtgatgtcctatgccctgctgcctgctgccatggtgatgccaccccagcctgtggtgctgatgcccaccgtgtaccagcagggcgtgggctacgtgcccatcaccggcatgcctgctgtgtgcagccctggcatggtgcctgtggccctgcccccagctgctgtgaatgcccagccccgctgcagcgaggaggacctgaaggccatccaggacatgttccccaacatggaccaggaggtgatccgctctgtgctggaggcccagaggggcaacaaggatgctgccatcaacagcctgctgcagatgggagaggagccctag

SEQ ID NO: 22192 - DNA, 1059 bp, Artificial Sequence
  Description of Artificial Sequence: Synthetic coding sequence
cagctgagccccagccaggccccagctggggcccaggaggtggcccggcgggtgacagtgggcagcgccagccatggaggccgccgcagcaccatggccaccaccgtgtccacccagaggggccctgtgtacatcggggagctgccccaggacttcctgcgcatcacccccacccagcagcagaggcaggtgcagctggatgcccaggccgcccagcagctgcagtatggaggagctgtgggcaccgtgggccgcctgaacatcaccgtggtgcaggccaagctggccaagaactacggcatgaccaggatggacccctactgccgcctgcggctgggctatgctgtgtatgagacccccacagcccacaacggggccaagaacccccgctggaacaaggtgatccactgcaccgtgcccccaggagtggacagcttctacctggagatctttgatgagcgggccttctccatggatgaccgcatcgcctggacccacatcaccatccctgagagcctgcggcagggcaaggtggaggacaagtggtacagcctgagcggccggcagggagatgacaaggagggcatgatcaacctggtgatgtcctatgccctgctgcctgctgccatggtgatgccaccccagcctgtggtgctgatgcccaccgtgtaccagcagggcgtgggctacgtgcccatcaccggcatgcctgctgtgtgcagccctggcatggtgcctgtggccctgcccccagctgctgtgaatgcccagccccgctgcagcgaggaggacctgaaggccatccaggacatgttccccaacatggaccaggaggtgatccgctctgtgctggaggcccagaggggcaacaaggatgctgccatccccagccacctggtgctgggcggcctgagcgccctgagctgcccctgggatgtgcggctgtccttcagctgccgcagcggcaagtgcagctgctgccgggagcagctgctgctgcccggctgctggcgctggtggagcgccttccgcttccacagctggcactttgtgatgtag

SEQ ID NO: 22193 - DNA, 675 bp, Artificial Sequence
  Description of Artificial Sequence: Synthetic coding sequence
atggccaccaccgtgtccacccagaggggccctgccaagctggccaagaactacggcatgaccaggatggacccctactgccgcctgcggctgggctatgctgtgtatgagacccccacagcccacaatggagccaagaacccccgctggaacaaggtgatccactgcaccgtgcccccaggagtggacagcttctacctggagatctttgatgagcgggccttctccatggatgacagaattgcctggacccacatcaccatccctgagagcctgcggcagggcaaggtggaggacaagtggtacagcctgagcggccggcagggagatgacaaggagggcatgatcaacctggtgatgtcctatgccctgctgcctgctgccatggtgatgccaccccagcctgtggtgctgatgcccaccgtgtaccagcagggcgtgggctacgtgcccatcaccggcatgcctgctgtgtgcagccctggcatggtgcctgtggccctgcccccagctgctgtgaatgcccagccccgctgcagcgaggaggacctgaaggccatccaggacatgttccccaacatggaccaggaggtgatccgctctgtgctggaggcccagaggggcaacaaggatgctgccatcaacagcctgctgcagatgggagaggagccctag

SEQ ID NO: 22194 - DNA, 768 bp, Artificial Sequence
  Description of Artificial Sequence: Synthetic coding sequence
atggccagcagcaccagcctgcctgcccctggcagccggcccaagaagcccctgggcaagatggctgactggttccggcagaccctgctgaagaagcccaagaagaggcccaacagccctgagagcaccagcagtgatgccagccagcccaccagccaggacagccccctgccccccagcctgagctctgtgaccagccccagcctgccccccacccacgccagtgacagcggcagcagccgctggagcaaggactatgatgtgtgtgtgtgccacagcgaggaggacctggtggccgcccaggacctggtgtcctacctggagggcagcacagccagcctgcgctgcttcctgcagctgagagatgccaccccaggaggagccatcgtgtctgagctgtgccaggccctgagcagcagccactgccgggtgctgctgatcaccccaggcttcctgcaggacccctggtgcaagtaccagatgctgcaggccctgacagaggcccctggagctgagggctgcaccatccccctgctgagcggcctgagcagagctgcctacccacctgagctgcgcttcatgtactacgtggatggccggggcccagatggcggcttccggcaggtgaaggaggccgtgatgaggagcaaccaggtgctgaagcacctgctgtaccacggcaccccagaaattggagtgaagctggagacagagaacccctgccgggccagtgacagccacaagtgtgacaagcgctaccgggagtag

SEQ ID NO: 22195 - DNA, 708 bp, Artificial Sequence
  Description of Artificial Sequence: Synthetic coding sequence
atggccagcagcaccagcctgcctgcccctggcagccggcccaagaagcccctgggcaagatggctgactggttccggcagaccctgctgaagaagcccaagaagaggcccaacagccctgagagcaccagcagtgatgccagccagcccaccagccaggacagccccctgccccccagcctgagctctgtgaccagccccagcctgccccccacccacgccagtgacagcggcagcagccgctggagcaaggactatgatgtgtgtgtgtgccacagcgaggaggacctggtggccgcccaggacctggtgtcctacctggagggcagcacagccagcctgcgctgcttcctgcagctgagagatgccaccccaggaggagccatcgtgtctgagctgtgccaggccctgagcagcagccactgccgggtgctgctgatcaccccaggcttcctgcaggacccctggtgcaagtaccagatgctgcaggccctgacagaggcccctggagctgagggctgcaccatccccctgctgagcggcctgagcagagctgcctacccacctgagctgcgcttcatgtactacgtggatggccggggcccagatggcggcttccggcaggtgaaggaggccgtgatgcgctgcaagctgctgcaggagggggagggggagcgggacagcgccaccgtgtctgacctgctgtag

SEQ ID NO: 22196 - DNA, 666 bp, Artificial Sequence
  Description of Artificial Sequence: Synthetic coding sequence
atggccagcagcaccagcctgcctgcccctggcagccggcccaagaagcccctgggcaagatggctgactggttccggcagaccctgctgaagaagcccaagaagaggcccaacagccctgagagcaccagcagtgatgccagccagcccaccagccaggacagccccctgccccccagcctgagctctgtgaccagccccagcctgccccccacccacgccagtgacagcggcagcagccgctggagcaaggactatgatgtgtgtgtgtgccacagcgaggaggacctggtggccgcccaggacctggtgtcctacctggagggcagcacagccagcctgcgctgcttcctgcagctgagagatgccaccccaggaggagccatcgtgtctgagctgtgccaggccctgagcagcagccactgccgggtgctgctgatcaccccaggcttcctgcaggacccctggtgcaagtaccagatgctgcaggccctgacagaggcccctggagctgagggctgcaccatccccctgctgagcggcctgagcagagctgcctacccacctgagctgcgcttcatgtactacgtggatggccggggcccagatggcggcttccggcaggtgaaggaggccgtgatgagatacctgcagaccctgtcctag

SEQ ID NO: 22197 - DNA, 666 bp, Artificial Sequence; identical to SEQ ID NO: 22196
  Description of Artificial Sequence: Synthetic coding sequence

SEQ ID NO: 22198 - DNA, 666 bp, Artificial Sequence; identical to SEQ ID NO: 22196
  Description of Artificial Sequence: Synthetic coding sequence

SEQ ID NO: 22199 - DNA, 2520 bp, Artificial Sequence
  Description of Artificial Sequence: Synthetic coding sequence
atgatgtctgccagccggctggccggcaccctcatcccagccatggccttcctgagctgtgtgcggcctgagagctgggagccctgtgtggaggtggtgcccaacatcacctaccagtgcatggagctgaacttctacaagatcccagacaacctgcccttcagcaccaagaacctggacctgtccttcaaccccctgcggcacctgggcagctacagcttcttctccttccctgagctgcaggtgctggacctgagccgctgtgagatccagaccattgaagatggagcctaccagagcctgagccacctgagcaccctcatcctgaccggcaaccccatccagagcctggccctgggcgccttcagcggcctgagcagcctgcagaagctggtggccgtggagaccaacctggccagcctggagaacttccccatcggccacctgaagaccctgaaggagctgaatgtggcccacaacctgatccagagcttcaagctgcctgagtacttcagcaacctgaccaacctggagcacctggacctgagcagcaacaagatccagagcatctactgcacagacctgcgggtgctgcaccagatgcccctgctgaacctgagcctggacctgagcctgaaccccatgaacttcatccagcccggggccttcaaggagatccggctgcacaagctgaccctgaggaacaactttgacagcctgaatgtgatgaagacctgcatccagggcctggccggcctggaggtgcaccggctggtgctgggggagttcagaaatgaaggcaacctggagaagtttgacaagagcgccctggagggcctgtgcaacctgaccatcgaggagttccggctggcctacctggactactacctggatgacatcatcgacctcttcaactgcctgaccaacgtgagcagcttcagcctggtgtctgtgaccatcgagcgggtgaaggacttctcctacaactttggctggcagcacctggagctggtgaactgcaagtttggccagttccccaccctgaagctgaagagcctgaagaggctgaccttcaccagcaacaagggcggcaatgccttcagcgaggtggacctgcccagcctggagttcctggacctgagcagaaatggcctgtccttcaagggctgctgcagccagagcgactttggcaccaccagcctgaagtacctggacctgtccttcaatggagtcatcaccatgagcagcaacttcctgggcctggagcagctggagcacctggacttccagcacagcaacctgaagcagatgtctgagttctctgtgttcctgagcctgaggaacctgatctacctggacatcagccacacccacaccagggtggccttcaacggcatcttcaacggcctgagcagcctggaggtgctgaagatggccggcaacagcttccaggagaacttcctgcctgacatcttcacagagctgaggaacctgaccttcctggacctgagccagtgccagctggagcagctgagccccacagccttcaacagcctgagcagcctgcaggtgctgaacatgagccacaacaacttcttcagcctggacaccttcccctacaagtgcctgaacagcctgcaggtgctggactacagcctgaaccacatcatgaccagcaagaagcaggagctgcagcacttccccagcagcctggccttcctgaacctgacccagaatgactttgcctgcacctgtgagcaccagagcttcctgcagtggatcaaggaccagaggcagctgctggtggaggtggagaggatggagtgtgccacccccagcgacaagcagggcatgcctgtgctgagcctgaacatcacctgccagatgaacaagaccatcatcggcgtgtctgtgctgtctgtgctggtggtgtctgtggtggccgtgctggtgtacaagttctacttccacctgatgctgctggccggctgcatcaagtatggaagaggagagaacatctatgatgcctttgtgatctacagcagccaggatgaggactgggtgagaaatgagctggtgaagaacctggaggagggcgtgccccccttccagctgtgcctgcactacagagacttcatccctggggtggccatcgccgccaacatcatccacgagggcttccacaagagcaggaaggtgattgtggtggtgtcccagcacttcatccagagccgctggtgcatctttgaatatgaaattgcccagacctggcagttcctgagcagccgggccggcatcatcttcatcgtgctgcagaaggtggagaagaccctgctgcggcagcaggtggagctgtaccgcctgctgagcaggaacacctacctggagtgggaggacagcgtgctgggccgccacatcttctggaggcggctgaggaaggccctgctggatggcaagtcctggaaccctgagggcaccgtgggcaccggctgcaactggcaggaggccaccagcatctag

SEQ ID NO: 22200 - DNA, 2400 bp, Artificial Sequence
  Description of Artificial Sequence: Synthetic coding sequence
atggagctgaacttctacaagatcccagacaacctgcccttcagcaccaagaacctggacctgtccttcaaccccctgcggcacctgggcagctacagcttcttctccttccctgagctgcaggtgctggacctgagccgctgtgagatccagaccattgaagatggagcctaccagagcctgagccacctgagcaccctcatcctgaccggcaaccccatccagagcctggccctgggcgccttcagcggcctgagcagcctgcagaagctggtggccgtggagaccaacctggccagcctggagaacttccccatcggccacctgaagaccctgaaggagctgaatgtggcccacaacctgatccagagcttcaagctgcctgagtacttcagcaacctgaccaacctggagcacctggacctgagcagcaacaagatccagagcatctactgcacagacctgcgggtgctgcaccagatgcccctgctgaacctgagcctggacctgagcctgaaccccatgaacttcatccagcccggggccttcaaggagatccggctgcacaagctgaccctgaggaacaactttgacagcctgaatgtgatgaagacctgcatccagggcctggccggcctggaggtgcaccggctggtgctgggggagttcagaaatgaaggcaacctggagaagtttgacaagagcgccctggagggcctgtgcaacctgaccatcgaggagttccggctggcctacctggactactacctggatgacatcatcgacctcttcaactgcctgaccaacgtgagcagcttcagcctggtgtctgtgaccatcgagcgggtgaaggacttctcctacaactttggctggcagcacctggagctggtgaactgcaagtttggccagttccccaccctgaagctgaagagcctgaagaggctgaccttcaccagcaacaagggcggcaatgccttcagcgaggtggacctgcccagcctggagttcctggacctgagcagaaatggcctgtccttcaagggctgctgcagccagagcgactttggcaccaccagcctgaagtacctggacctgtccttcaatggagtcatcaccatgagcagcaacttcctgggcctggagcagctggagcacctggacttccagcacagcaacctgaagcagatgtctgagttctctgtgttcctgagcctgaggaacctgatctacctggacatcagccacacccacaccagggtggccttcaacggcatcttcaacggcctgagcagcctggaggtgctgaagatggccggcaacagcttccaggagaacttcctgcctgacatcttcacagagctgaggaacctgaccttcctggacctgagccagtgccagctggagcagctgagccccacagccttcaacagcctgagcagcctgcaggtgctgaacatgagccacaacaacttcttcagcctggacaccttcccctacaagtgcctgaacagcctgcaggtgctggactacagcctgaaccacatcatgaccagcaagaagcaggagctgcagcacttccccagcagcctggccttcctgaacctgacccagaatgactttgcctgcacctgtgagcaccagagcttcctgcagtggatcaaggaccagaggcagctgctggtggaggtggagaggatggagtgtgccacccccagcgacaagcagggcatgcctgtgctgagcctgaacatcacctgccagatgaacaagaccatcatcggcgtgtctgtgctgtctgtgctggtggtgtctgtggtggccgtgctggtgtacaagttctacttccacctgatgctgctggccggctgcatcaagtatggaagaggagagaacatctatgatgcctttgtgatctacagcagccaggatgaggactgggtgagaaatgagctggtgaagaacctggaggagggcgtgccccccttccagctgtgcctgcactacagagacttcatccctggggtggccatcgccgccaacatcatccacgagggcttccacaagagcaggaaggtgattgtggtggtgtcccagcacttcatccagagccgctggtgcatctttgaatatgaaattgcccagacctggcagttcctgagcagccgggccggcatcatcttcatcgtgctgcagaaggtggagaagaccctgctgcggcagcaggtggagctgtaccgcctgctgagcaggaacacctacctggagtgggaggacagcgtgctgggccgccacatcttctggaggcggctgaggaaggccctgctggatggcaagtcctggaaccctgagggcaccgtgggcaccggctgcaactggcaggaggccaccagcatctag

SEQ ID NO: 22201 - DNA, 2577 bp, Artificial Sequence
  Description of Artificial Sequence: Synthetic coding sequence
atgggagaccacctggacctgctgctgggcgtggtgctgatggccggccctgtgtttggcatccccagctgcagctttgatggccgcatcgccttctaccgcttctgcaacctgacccaggtgccccaggtgctgaacaccacagagcggctgctgctgtccttcaactacatcagaacagtgacagccagcagcttccccttcctggagcagctgcagctgctggagctgggcagccagtacacccccctgaccatcgacaaggaggccttcaggaacctgcccaacctgcgcatcctggacctgggcagcagcaagatctacttcctgcacccagatgccttccagggcctcttccacctgtttgagctgcggctgtacttctgtggcctgagtgatgctgtgctgaaggatggctacttcaggaacctgaaggccctgacccggctggacctgagcaagaaccagatccgcagcctgtacctgcaccccagctttgggaagctgaacagcctgaagagcattgacttcagcagcaaccagatcttcctggtgtgtgagcacgagctggagcccctgcagggcaagaccctgtccttcttcagcctggccgccaacagcctgtacagccgggtgtctgtggactggggcaagtgcatgaaccccttcaggaacatggtgctggagatcctggatgtgtctggaaatggctggacagtggacatcactggaaacttcagcaatgccatcagcaagagccaggccttcagcctcatcctggcccaccacatcatgggcgccggcttcggcttccacaacatcaaggaccctgaccagaacacctttgctggcctggcccggagctctgtgcgccacctggacctgagccacggctttgtgttcagcctgaacagccgggtgtttgagaccctgaaggacctgaaggtgctgaacctggcctacaacaagatcaacaagattgctgatgaggccttctacggcctggacaacctgcaggtgctgaacctgagctacaacctgctgggggagctgtacagcagcaacttctacggcctgcccaaggtggcctacatcgacctgcagaagaaccacatcgccatcatccaggaccagaccttcaagttcctggagaagctgcagaccctggacctgcgggacaatgccctgaccaccatccacttcatccccagcatcccagacatcttcctgagcggcaacaagctggtgaccctgcccaagatcaacctgacagccaacctgatccacctgtctgagaaccggctggagaacctggacatcctgtacttcctgctgcgggtgccccacctgcagatcctgatcctgaaccagaaccgcttcagcagctgcagcggggaccagacccccagcgagaaccccagcctggagcagctgttcctgggggagaacatgctgcagctggcctgggagacagagctgtgctgggatgtgtttgagggcctgagccacctgcaggtgctgtacctgaaccacaactacctgaacagcctgcccccaggagtcttcagccacctgacagccctgcggggcctgagcctgaacagcaaccggctgactgtgctgagccacaatgacctgcctgccaacctggagatcctggacatcagcaggaaccagctgctggcccccaacccagatgtgtttgtgtccctgtctgtgctggacatcacccacaacaagttcatctgtgaatgtgagctgagcaccttcatcaactggctgaaccacaccaacgtgaccatcgccggccccccagctgacatctactgtgtgtacccagacagcttctctggagtgtccctcttcagcctgagcacagagggctgtgatgaggaggaggtgctgaagagcctgaagttcagcctcttcatcgtgtgcaccgtgaccctgaccctcttcctgatgaccatcctgactgtgaccaagttccggggcttctgcttcatctgctacaagacagcccagaggctggtgttcaaggaccacccccagggcacagagccagacatgtacaagtatgatgcctacctgtgcttcagcagcaaggacttcacctgggtgcagaatgccctgctgaagcacctggacacccagtacagcgaccagaaccgcttcaacctgtgctttgaggagcgggactttgtgcctggagagaacagaattgccaacatccaggatgccatctggaacagcaggaagatcgtgtgcctggtgagccgccacttcctgagagatggctggtgcctggaggccttctcctatgcccagggccgctgcctgagtgacctgaacagcgccctgatcatggtggtggtgggcagcctgagccagtaccagctgatgaagcaccagagcatccggggctttgtgcagaagcagcagtacctgcgctggccagaggacttccaggatgtgggctggttcctgcacaagctgagccagcagatcctgaagaaggagaaggagaagaagaaggacaacaacatccccctgcagacagtggccaccatctcctag

SEQ ID NO: 22202 - DNA, 2577 bp, Artificial Sequence; identical to SEQ ID NO: 22201
  Description of Artificial Sequence: Synthetic coding sequence

SEQ ID NO: 22203 - DNA, 66 bp, Artificial Sequence
  Description of Artificial Sequence: Synthetic coding sequence
atgggagaccacctggacctgctgctgggcgtggtgctgatggccggccctgtgtttggcatctag

SEQ ID NO: 22204 - DNA, 2577 bp, Artificial Sequence; identical to SEQ ID NO: 22201
  Description of Artificial Sequence: Synthetic coding sequence

SEQ ID NO: 22205 - DNA, 4836 bp, Artificial Sequence
  Description of Artificial Sequence: Synthetic coding sequence
caggtgagccccagccaccctgtgaatgaaaacatgcaggtgaacaagatcaagaagaatgaagatgccaagaagaggctgtctgtggagcgcatctaccagaagaagacccagctggagcacatcctgctgcggccagacacctacatcggctctgtggagctggtgacccagcagatgtgggtgtatgatgaagatgtgggcatcaactaccgggaggtgacctttgtgcccggcctgtacaagatctttgatgagatcctggtgaatgctgctgacaacaagcagagggaccccaagatgagctgcatccgggtgaccatcgaccctgagaacaacctgatcagcatctggaacaacgggaagggcatccctgtggtggagcacaaggtggagaagatgtatgtgcctgccctgatcttcggccagctgctgaccagcagcaactatgatgatgatgagaagaaggtgactggaggaagaaatggctacggggccaagctgtgcaacatcttcagcaccaagttcaccgtggagacagccagccgggagtacaagaagatgttcaagcagacctggatggacaacatgggccgggccggggagatggagctgaagcccttcaatggagaggactacacctgcatcaccttccagcctgacctgagcaagttcaagatgcagagcctggacaaggacatcgtggccctgatggtgcggcgggcctatgacattgctggcagcaccaaggatgtgaaggtgttcctgaatggaaacaagctgcctgtgaagggcttccgctcctatgtggacatgtacctgaaggacaagctggatgaaacaggcaacagcctgaaggtgattcatgagcaggtgaaccaccgctgggaggtgtgcctgaccatgtctgagaagggcttccagcagatcagctttgtgaacagcatcgccaccagcaagggcggccgccacgtggactatgtggccgaccagatcgtgaccaagctggtggatgtggtgaagaagaagaacaagggcggcgtggccgtgaaggcccaccagaggctggagtgcagcggcaccatcagcgcccactgcaacctgcggctgctgggcttcagtgacagcctggccagcgccagccgggtggccgagatcacagacatgcaccaccacatccagctgatctttgtgttcctgattgagatgggcttctaccacgtgggccaggccggcctggagctgctggccagcctggacccccccagcagcgccagctgtgtgagccactgcacccagctgtttgtgagcaacttcatctacctgttcctgatcttcctgcggcgctccttcacctttgtgacccaggccggcgtgcagtgcaccatcagccccaccagcagctctgtgctggcccagttctttgagagcttcctgtttgtggccatcggctgcggcatcgtggagagcatcctgaactgggtgaagttcaaggcccaggtgcagctgaacaagaagtgcagcgctgtgaagcacaaccgcatcaagggcatccccaagctggatgatgccaatgatgctgggggcaggaacagcacagagtgcaccctcatcctgacagaaggagacagcgccaagaccctggccgtgtctggcctgggcgtggtgggccgggacaagtatggagtcttccccctgcggggcaagatcctgaatgtgcgggaggccagccacaagcagatcatggagaatgctgagatcaacaacatcatcaagatcgtgggcctgcagtacaagaagaactatgaagatgaggacagcctgaagaccctgcgctatggcaagatcatgatcatgacagaccaggaccaggacggcagccacatcaagggcctgctgatcaacttcatccaccacaactggcccagcctgctgcggcaccgcttcctggaggagttcatcacccccatcgtgaaggtgtccaagaacaagcaggagatggccttctacagcctgcctgagtttgaggagtggaagagcagcacccccaaccacaagaagtggaaggtgaagtactacaagggcctgggcaccagcaccagcaaggaggccaaggagtactttgctgacatgaagaggcaccgcatccagttcaagtacagcggcccagaagatgatgctgccatcagcctggccttcagcaagaagcagattgatgacaggaaggagtggctgaccaacttcatggaggaccggcggcagaggaagctgctgggcctgcctgaggactacctgtatggccagaccaccacctacctgacctacaatgacttcatcaacaaggagctgatcctcttcagcaacagcgacaatgaaagaagcatccccagcatggtggatggcctgaagccaggccagaggaaggtgctcttcacctgcttcaagagaaatgacaagcgggaggtgaaggtggcccagctggccggctctgtggccgagatgagcagctaccaccacggggagatgagcctgatgatgaccatcatcaacctggcccagaactttgtgggcagcaacaacctgaacctgctgcagcccatcggccagtttggcacccggctgcatggaggcaaggacagcgccagcccccgctacatcttcaccatgctgagcagcctggcccggctgctcttcccccccaaggatgaccacaccctgaagttcctgtatgatgacaaccagagggtggagcctgagtggtacatccccatcatccccatggtgctgatcaatggagctgagggcatcggcaccggctggagctgcaagatccccaactttgatgtgcgggagatcgtgaacaacatccggcggctgatggatggagaggagcccctgcccatgctgcccagctacaagaacttcaagggcaccatcgaggagctggcccccaaccagtatgtgatcagcggggaggtggccatcctgaacagcaccaccatcgagatcagcgagctgcctgtgaggacctggacccagacctacaaggagcaggtgctggagcccatgctgaatggaacagagaagaccccacccctcatcacagactaccgggagtaccacacagacaccaccgtgaagtttgtggtgaagatgacagaggagaagctggccgaggccgagcgggtgggcctgcacaaggtgttcaagctgcagaccagcctgacctgcaacagcatggtgctgtttgaccacgtgggctgcctgaagaagtatgacacagtgctggacatcctgcgggacttctttgagctgcggctgaagtactacggcctgaggaaggagtggctgctgggcatgctgggcgctgagagcgccaagctgaacaaccaggcccgcttcatcctggagaagattgatggcaagatcatcatcgagaacaagcccaagaaggagctgatcaaggtgctgatccagaggggctatgacagcgaccctgtgaaggcctggaaggaggcccagcagaaggtgcctgatgaggaggagaatgaggagagtgacaatgagaaggagacagagaagagtgacagcgtgacagattctggccccaccttcaactacctgctggacatgcccctgtggtacctgaccaaggagaagaaggatgagctgtgccgcctgagaaatgagaaggagcaggagctggacaccctgaagaggaagagccccagcgacctgtggaaggaggacctggccaccttcatcgaggagctggaggccgtggaggccaaggagaagcaggatgagcaggtgggcctgcccgggaagggcggcaaggccaagggcaagaagacccagatggccgaggtgctgcccagcccccggggccagagggtcatcccccgcatcaccatcgagatgaaggccgaggccgagaagaagaacaagaagaagatcaagaatgaaaatacagagggcagcccccaggaggatggagtggagctggagggcctgaagcagaggctggagaagaagcagaagcgggagcccggcaccaagaccaagaagcagaccaccctggccttcaagcccatcaagaagggcaagaagaggaacccctggagcgacagcgagagtgacaggagcagtgatgagagcaactttgatgtgcccccccgggagacagagccccggcgggccgccaccaagaccaagttcaccatggacctggacagtgatgaggacttcagtgactttgatgagaagacagatgatgaggactttgtgcccagtgatgccagcccccccaagaccaagaccagccccaagctgagcaacaaggagctgaagccccagaagtctgtggtgtctgacctggaggctgatgatgtgaagggctctgtgcccctgagcagcagccccccagccacccacttcccagatgaaacagagatcaccaaccctgtgcccaagaagaatgtgacagtgaagaagacagctgccaagagccagagcagcaccagcaccaccggggccaagaagagagctgcccccaagggcaccaagagggaccctgccctgaacagcggcgtgtcccagaagccagaccctgccaagaccaagaacagaaggaagaggaagcccagcaccagtgatgacagcgacagcaactttgagaagatcgtgtccaaggctgtgaccagcaagaagagcaagggggagagtgatgacttccacatggactttgacagcgctgtggccccccgggccaagtctgtgcgggccaagaagcccatcaagtacctggaggagagtgatgaagatgacctcttctag

SEQ ID NO: 22206 - DNA, 4665 bp, Artificial Sequence
  Description of Artificial Sequence: Synthetic coding sequence
caggtgagccccagccaccctgtgaatgaaaacatgcaggtgaacaagatcaagaagaatgaagatgccaagaagaggctgtctgtggagcgcatctaccagaagaagacccagctggagcacatcctgctgcggccagacacctacatcggctctgtggagctggtgacccagcagatgtgggtgtatgatgaagatgtgggcatcaactaccgggaggtgacctttgtgcccggcctgtacaagatctttgatgagatcctggtgaatgctgctgacaacaagcagagggaccccaagatgagctgcatccgggtgaccatcgaccctgagaacaacctgatcagcatctggaacaacgggaagggcatccctgtggtggagcacaaggtggagaagatgtatgtgcctgccctgatcttcggccagctgctgaccagcagcaactatgatgatgatgagaagaaggtgactggaggaagaaatggctacggggccaagctgtgcaacatcttcagcaccaagttcaccgtggagacagccagccgggagtacaagaagatgttcaagcagacctggatggacaacatgggccgggccggggagatggagctgaagcccttcaatggagaggactacacctgcatcaccttccagcctgacctgagcaagttcaagatgcagagcctggacaaggacatcgtggccctgatggtgcggcgggcctatgacattgctggcagcaccaaggatgtgaaggtgttcctgaatggaaacaagctgcctgtgaagggcttccgctcctatgtggacatgtacctgaaggacaagctggatgaaacaggcaacagcctgaaggtgattcatgagcaggtgaaccaccgctgggaggtgtgcctgaccatgtctgagaagggcttccagcagatcagctttgtgaacagcatcgccaccagcaagggcggccgccacgtggactatgtggccgaccagatcgtgaccaagctggtggatgtggtgaagaagaagaacaagggcggcgtggccgtgaaggcccaccaggtgaagaaccacatgtggatctttgtgaatgccctgattgagaaccccacctttgacagccagaccaaggagaacatgaccctgcagcccaagagctttggcagcacctgccagctgtctgagaagttcatcaaggccgcccacctgtacagccgcttcctgattgaccccttcttccccaacatgatccccaacatgaacctcttccaggccatcggctgcggcatcgtggagagcatcctgaactgggtgaagttcaaggcccaggtgcagctgaacaagaagtgcagcgctgtgaagcacaaccgcatcaagggcatccccaagctggatgatgccaatgatgctgggggcaggaacagcacagaatgtaccctcatcctgacagaaggagacagcgccaagaccctggccgtgtctggcctgggcgtggtgggccgggacaagtatggagtcttccccctgcggggcaagatcctgaatgtgcgggaggccagccacaagcagatcatggagaatgctgagatcaacaacatcatcaagatcgtgggcctgcagtacaagaagaactatgaagatgaggacagcctgaagaccctgcgctatggcaagatcatgatcatgacagaccaggaccaggacggcagccacatcaagggcctgctgatcaacttcatccaccacaactggcccagcctgctgcggcaccgcttcctggaggagttcatcacccccatcgtgaaggtgtccaagaacaagcaggagatggccttctacagcctgcctgagtttgaggagtggaagagcagcacccccaaccacaagaagtggaaggtgaagtactacaagggcctgggcaccagcaccagcaaggaggccaaggagtactttgctgacatgaagaggcaccgcatccagttcaagtacagcggcccagaagatgatgctgccatcagcctggccttcagcaagaagcagattgatgacaggaaggagtggctgaccaacttcatggaggaccggcggcagaggaagctgctgggcctgcctgaggactacctgtatggccagaccaccacctacctgacctacaatgacttcatcaacaaggagctgatcctcttcagcaacagcgacaatgaaagaagcatccccagcatggtggatggcctgaagccaggccagaggaaggtgctcttcacctgcttcaagagaaatgacaagcgggaggtgaaggtggcccagctggccggctctgtggccgagatgagcagctaccaccacggggagatgagcctgatgatgaccatcatcaacctggcccagaactttgtgggcagcaacaacctgaacctgctgcagcccatcggccagtttggcacccggctgcacggcggcaaggacagcgccagcccccgctacatcttcaccatgctgagcagcctggcccggctgctcttcccccccaaggatgaccacaccctgaagttcctgtatgatgacaaccagagggtggagcctgagtggtacatccccatcatccccatggtgctgatcaacggggctgagggcattggaacaggctggagctgcaagatccccaactttgatgtgcgggagatcgtgaacaacatccggcggctgatggatggagaggagcccctgcccatgctgcccagctacaagaacttcaagggcaccatcgaggagctggcccccaaccagtatgtgatctctggagaggtggccatcctgaacagcaccaccatcgagatcagcgagctgcctgtgaggacctggacccagacctacaaggagcaggtgctggagcccatgctgaatggaacagagaagaccccacccctcatcacagactaccgggagtaccacacagacaccaccgtgaagtttgtggtgaagatgacagaggagaagctggccgaggccgagcgggtgggcctgcacaaggtgttcaagctgcagaccagcctgacctgcaacagcatggtgctgtttgaccacgtgggctgcctgaagaagtatgacacagtgctggacatcctgcgggacttctttgagctgcggctgaagtactacggcctgaggaaggagtggctgctgggcatgctgggcgctgagagcgccaagctgaacaaccaggcccgcttcatcctggagaagattgatggcaagatcatcatcgagaacaagcccaagaaggagctgatcaaggtgctgatccagaggggctatgacagcgaccctgtgaaggcctggaaggaggcccagcagaaggtgcctgatgaggaggagaatgaggagagtgacaatgagaaggagacagagaagagtgacagcgtgacagacagcggccccaccttcaactacctgctggacatgcccctgtggtacctgaccaaggagaagaaggatgagctgtgccgcctgagaaatgagaaggagcaggagctggacaccctgaagaggaagagccccagcgacctgtggaaggaggacctggccaccttcatcgaggagctggaggccgtggaggccaaggagaagcaggatgagcaggtgggcctgcctggaaaaggaggcaaggccaagggcaagaagacccagatggccgaggtgctgcccagcccccggggccagagggtcatcccccgcatcaccatcgagatgaaggccgaggccgagaagaagaacaagaagaagatcaagaatgaaaatacagagggcagcccccaggaggatggagtggagctggagggcctgaagcagaggctggagaagaagcagaagcgggagcccggcaccaagaccaagaagcagaccaccctggccttcaagcccatcaagaagggcaagaagaggaacccctggagcgacagcgagagtgacaggagcagtgatgagagcaactttgatgtgcccccccgggagacagagcccaggagagctgccaccaagaccaagttcaccatggacctggacagtgatgaggacttcagtgactttgatgagaagacagatgatgaagattttgtgcccagtgatgccagcccccccaagaccaagaccagccccaagctgagcaacaaggagctgaagccccagaagtctgtggtgtctgacctggaggctgatgatgtgaagggctctgtgcccctgagcagcagccccccagccacccacttcccagatgaaacagagatcaccaaccctgtgcccaagaagaatgtgacagtgaagaagacagctgccaagagccagagcagcaccagcaccactggagccaagaagagagctgcccccaagggcaccaagagggaccctgccctgaacagcggcgtgtcccagaagccagaccctgccaagaccaagaacagaaggaagaggaagcccagcaccagtgatgacagcgacagcaactttgagaagatcgtgtccaaggctgtgaccagcaagaagagcaaaggagagagtgatgacttccacatggactttgattctgctgtggccccccgggccaagtctgtgcgggccaagaagcccatcaagtacctggaggagagtgatgaagatgacctcttctag

SEQ ID NO: 22207 - DNA, 4707 bp, Artificial Sequence
  Description of Artificial Sequence: Synthetic coding sequence
atggaggtgagccccctgcagcctgtgaatgaaaacatgcaggtgaacaagatcaagaagaatgaagatgccaagaagaggctgtctgtggagcgcatctaccagaagaagacccagctggagcacatcctgctgcggccagacacctacatcggctctgtggagctggtgacccagcagatgtgggtgtatgatgaagatgtgggcatcaactaccgggaggtgacctttgtgcccggcctgtacaagatctttgatgagatcctggtgaatgctgctgacaacaagcagagggaccccaagatgagctgcatccgggtgaccattgatcctgagaacaacctgatcagcatctggaacaacgggaagggcatccctgtggtggagcacaaggtggagaagatgtatgtgcctgccctgatcttcggccagctgctgaccagcagcaactatgatgatgatgagaagaaggtgactggaggaagaaatggctatggagccaagctgtgcaacatcttcagcaccaagttcaccgtggagacagccagccgggagtacaagaagatgttcaagcaggccatcacctggatggacaacatgggccgggccggggagatggagctgaagcccttcaacggggaggactacacctgcatcaccttccagcctgacctgagcaagttcaagatgcagagcctggacaaggacatcgtggccctgatggtgagaagagcctatgacattgctggcagcaccaaggatgtgaaggtgttcctgaatggaaacaagctgcctgtgaagggcttccgctcctatgtggacatgtacctgaaggacaagctggatgagaccggcaacagcctgaaggtgatccacgagcaggtgaaccaccgctgggaggtgtgcctgaccatgtctgagaagggcttccagcagatcagctttgtgaacagcatcgccaccagcaaggtgatcctcttcctgaactacatgatctacctgtacatctacgtgttcctgctcttcctgatctacaaggtggacctgaacatcggcctggcctacttcaccggcggcagacatgtggactatgtggccgaccagatcgtgaccaagctggtggatgtggtgaagaagaagaacaagggcggcgtggccgtgaaggcccaccaggtgaagaaccacatgtggatctttgtgaatgccctgattgagaaccccacctttgacagccagaccaaggagaacatgaccctgcagcccaagagctttggcagcacctgccagctgtctgagaagttcatcaaggccgccatcggctgcggcatcgtggagagcatcctgaactgggtgaagttcaaggcccaggtgcagctgaacaagaagtgcagcgctgtgaagcacaaccgcatcaagggcatccccaagctggatgatgccaatgatgctgggggcaggaacagcacagagtgcaccctcatcctgacagaaggagacagcgccaagaccctggccgtgtctggcctgggcgtggtgggccgggacaagtatggagtcttccccctgcggggcaagatcctgaatgtgcgggaggccagccacaagcagatcatggagaatgctgagatcaacaacatcatcaagatcgtgggcctgcagtacaagaagaactatgaagatgaggacagcctgaagaccctgcgctatggcaagatcatgatcatgacagaccaggaccaggacggcagccacatcaagggcctgctgatcaacttcatccaccacaactggcccagcctgctgcggcaccgcttcctggaggagttcatcacccccatcgtgaaggtgtccaagaacaagcaggagatggccttctacagcctgcctgagtttgaggagtggaagagcagcacccccaaccacaagaagtggaaggtgaagtactacaagggcctgggcaccagcaccagcaaggaggccaaggagtactttgctgacatgaagaggcaccgcatccagttcaagtacagcggcccagaagatgatgctgccatcagcctggccttcagcaagaagcagattgatgacaggaaggagtggctgaccaacttcatggaggaccggcggcagaggaagctgctgggcctgcctgaggactacctgtatggccagaccaccacctacctgacctacaatgacttcatcaacaaggagctgatcctcttcagcaacagcgacaatgaaagaagcatccccagcatggtggatggcctgaagccaggccagaggaaggtgctcttcacctgcttcaagagaaatgacaagcgggaggtgaaggtggcccagctggccggctctgtggccgagatgagcagctaccaccacggggagatgagcctgatgatgaccatcatcaacctggcccagaactttgtgggcagcaacaacctgaacctgctgcagcccatcggccagtttggcacccggctgcatggaggcaaggacagcgccagcccccgctacatcttcaccatgctgagcagcctggcccggctgctcttcccccccaaggatgaccacaccctgaagttcctgtatgatgacaaccagagggtggagcctgagtggtacatccccatcatccccatggtgctgatcaatggagctgagggcatcggcaccggctggagctgcaagatccccaactttgatgtgcgggagatcgtgaacaacatccggcggctgatggatggagaggagcccctgcccatgctgcccagctacaagaacttcaagggcaccatcgaggagctggcccccaaccagtatgtgatcagcggggaggtggccatcctgaacagcaccaccatcgagatcagcgagctgcctgtgaggacctggacccagacctacaaggagcaggtgctggagcccatgctgaatggaacagagaagaccccacccctcatcacagactaccgggagtaccacacagacaccaccgtgaagtttgtggtgaagatgacagaggagaagctggccgaggccgagcgggtgggcctgcacaaggtgttcaagctgcagaccagcctgacctgcaacagcatggtgctgtttgaccacgtgggctgcctgaagaagtatgacacagtgctggacatcctgcgggacttctttgagctgcggctgaagtactacggcctgaggaaggagtggctgctgggcatgctgggcgctgagagcgccaagctgaacaaccaggcccgcttcatcctggagaagattgatggcaagatcatcatcgagaacaagcccaagaaggagctgatcaaggtgctgatccagaggggctatgacagcgaccctgtgaaggcctggaaggaggcccagcagaaggtgcctgatgaggaggagaatgaggagagtgacaatgagaaggagacagagaagagtgacagcgtgacagattctggccccaccttcaactacctgctggacatgcccctgtggtacctgaccaaggagaagaaggatgagctgtgccgcctgagaaatgagaaggagcaggagctggacaccctgaagaggaagagccccagcgacctgtggaaggaggacctggccaccttcatcgaggagctggaggccgtggaggccaaggagaagcaggatgagcaggtgggcctgcccgggaagggcggcaaggccaagggcaagaagacccagatggccgaggtgctgcccagcccccggggccagagggtcatcccccgcatcaccatcgagatgaaggccgaggccgagaagaagaacaagaagaagatcaagaatgaaaatacagagggcagcccccaggaggatggagtggagctggagggcctgaagcagaggctggagaagaagcagaagcgggagcccggcaccaagaccaagaagcagaccaccctggccttcaagcccatcaagaagggcaagaagaggaacccctggagcgacagcgagagtgacaggagcagtgatgagagcaactttgatgtgcccccccgggagacagagccccggcgggccgccaccaagaccaagttcaccatggacctggacagtgatgaggacttcagtgactttgatgagaagacagatgatgaggactttgtgcccagtgatgccagcccccccaagaccaagaccagccccaagcagaactgcaacaaggagctgaagccccagaagtctgtggtgtctgacctggaggctgatgatgtgaagggctctgtgcccctgagcagcagccccccagccacccacttcccagatgaaacagagatcaccaaccctgtgcccaagaagaatgtgacagtgaagaagacagctgccaagagccagagcagcaccagcaccactggagccaagaagagagctgcccccaagggcaccaagagggaccctgccctgaacagcggcgtgtcccagaagccagaccctgccaagaccaagaacagaaggaagaggaagcccagcaccagtgatgacagcgacagcaactttgagaagatcgtgtccaaggctgtgaccagcaagaagagcaaaggagagagtgatgacttccacatggactttgattctgctgtggccccccgggccaagtctgtgcgggccaagaagcccatcaagtacctggaggagagtgatgaagatgacctcttctag

SEQ ID NO: 22208 - DNA, 4596 bp, Artificial Sequence
  Description of Artificial Sequence: Synthetic coding sequence
atggaggtgagccccctgcagcctgtgaatgaaaacatgcaggtgaacaagatcaagaagaatgaagatgccaagaagaggctgtctgtggagcgcatctaccagaagaagacccagctggagcacatcctgctgcggccagacacctacatcggctctgtggagctggtgacccagcagatgtgggtgtatgatgaagatgtgggcatcaactaccgggaggtgacctttgtgcccggcctgtacaagatctttgatgagatcctggtgaatgctgctgacaacaagcagagggaccccaagatgagctgcatccgggtgaccattgatcctgagaacaacctgatcagcatctggaacaacgggaagggcatccctgtggtggagcacaaggtggagaagatgtatgtgcctgccctgatcttcggccagctgctgaccagcagcaactatgatgatgatgagaagaaggtgactggaggaagaaatggctatggagccaagctgtgcaacatcttcagcaccaagttcaccgtggagacagccagccgggagtacaagaagatgttcaagcagacctggatggacaacatgggccgggccggggagatggagctgaagcccttcaacggggaggactacacctgcatcaccttccagcctgacctgagcaagttcaagatgcagagcctggacaaggacatcgtggccctgatggtgagaagagcctatgacattgctggcagcaccaaggatgtgaaggtgttcctgaatggaaacaagctgcctgtgaagggcttccgctcctatgtggacatgtacctgaaggacaagctggatgagaccggcaacagcctgaaggtgatccacgagcaggtgaaccaccgctgggaggtgtgcctgaccatgtctgagaagggcttccagcagatcagctttgtgaacagcatcgccaccagcaaaggaggaagacatgtggactatgtggccgaccagatcgtgaccaagctggtggatgtggtgaagaagaagaacaagggcggcgtggccgtgaaggcccaccaggtgaagaaccacatgtggatctttgtgaatgccctgattgagaaccccacctttgacagccagaccaaggagaacatgaccctgcagcccaagagctttggcagcacctgccagctgtctgagaagttcatcaaggccgccatcggctgcggcatcgtggagagcatcctgaactgggtgaagttcaaggcccaggtgcagctgaacaagaagtgcagcgctgtgaagcacaaccgcatcaagggcatccccaagctggatgatgccaatgatgctgggggcaggaacagcacagagtgcaccctcatcctgacagaaggagacagcgccaagaccctggccgtgtctggcctgggcgtggtgggccgggacaagtatggagtcttccccctgcggggcaagatcctgaatgtgcgggaggccagccacaagcagatcatggagaatgctgagatcaacaacatcatcaagatcgtgggcctgcagtacaagaagaactatgaagatgaggacagcctgaagaccctgcgctatggcaagatcatgatcatgacagaccaggaccaggacggcagccacatcaagggcctgctgatcaacttcatccaccacaactggcccagcctgctgcggcaccgcttcctggaggagttcatcacccccatcgtgaaggtgtccaagaacaagcaggagatggccttctacagcctgcctgagtttgaggagtggaagagcagcacccccaaccacaagaagtggaaggtgaagtactacaagggcctgggcaccagcaccagcaaggaggccaaggagtactttgctgacatgaagaggcaccgcatccagttcaagtacagcggcccagaagatgatgctgccatcagcctggccttcagcaagaagcagattgatgacaggaaggagtggctgaccaacttcatggaggaccggcggcagaggaagctgctgggcctgcctgaggactacctgtatggccagaccaccacctacctgacctacaatgacttcatcaacaaggagctgatcctcttcagcaacagcgacaatgaaagaagcatccccagcatggtggatggcctgaagccaggccagaggaaggtgctcttcacctgcttcaagagaaatgacaagcgggaggtgaaggtggcccagctggccggctctgtggccgagatgagcagctaccaccacggggagatgagcctgatgatgaccatcatcaacctggcccagaactttgtgggcagcaacaacctgaacctgctgcagcccatcggccagtttggcacccggctgcatggaggcaaggacagcgccagcccccgctacatcttcaccatgctgagcagcctggcccggctgctcttcccccccaaggatgaccacaccctgaagttcctgtatgatgacaaccagagggtggagcctgagtggtacatccccatcatccccatggtgctgatcaatggagctgagggcatcggcaccggctggagctgcaagatccccaactttgatgtgcgggagatcgtgaacaacatccggcggctgatggatggagaggagcccctgcccatgctgcccagctacaagaacttcaagggcaccatcgaggagctggcccccaaccagtatgtgatcagcggggaggtggccatcctgaacagcaccaccatcgagatcagcgagctgcctgtgaggacctggacccagacctacaaggagcaggtgctggagcccatgctgaatggaacagagaagaccccacccctcatcacagactaccgggagtaccacacagacaccaccgtgaagtttgtggtgaagatgacagaggagaagctggccgaggccgagcgggtgggcctgcacaaggtgttcaagctgcagaccagcctgacctgcaacagcatggtgctgtttgaccacgtgggctgcctgaagaagtatgacacagtgctggacatcctgcgggacttctttgagctgcggctgaagtactacggcctgaggaaggagtggctgctgggcatgctgggcgctgagagcgccaagctgaacaaccaggcccgcttcatcctggagaagattgatggcaagatcatcatcgagaacaagcccaagaaggagctgatcaaggtgctgatccagaggggctatgacagcgaccctgtgaaggcctggaaggaggcccagcagaaggtgcctgatgaggaggagaatgaggagagtgacaatgagaaggagacagagaagagtgacagcgtgacagattctggccccaccttcaactacctgctggacatgcccctgtggtacctgaccaaggagaagaaggatgagctgtgccgcctgagaaatgagaaggagcaggagctggacaccctgaagaggaagagccccagcgacctgtggaaggaggacctggccaccttcatcgaggagctggaggccgtggaggccaaggagaagcaggatgagcaggtgggcctgcccgggaagggcggcaaggccaagggcaagaagacccagatggccgaggtgctgcccagcccccggggccagagggtcatcccccgcatcaccatcgagatgaaggccgaggccgagaagaagaacaagaagaagatcaagaatgaaaatacagagggcagcccccaggaggatggagtggagctggagggcctgaagcagaggctggagaagaagcagaagcgggagcccggcaccaagaccaagaagcagaccaccctggccttcaagcccatcaagaagggcaagaagaggaacccctggagcgacagcgagagtgacaggagcagtgatgagagcaactttgatgtgcccccccgggagacagagccccggcgggccgccaccaagaccaagttcaccatggacctggacagtgatgaggacttcagtgactttgatgagaagacagatgatgaggactttgtgcccagtgatgccagcccccccaagaccaagaccagccccaagctgagcaacaaggagctgaagccccagaagtctgtggtgtctgacctggaggctgatgatgtgaagggctctgtgcccctgagcagcagccccccagccacccacttcccagatgaaacagagatcaccaaccctgtgcccaagaagaatgtgacagtgaagaagacagctgccaagagccagagcagcaccagcaccaccggggccaagaagagagctgcccccaagggcaccaagagggaccctgccctgaacagcggcgtgtcccagaagccagaccctgccaagaccaagaacagaaggaagaggaagcccagcaccagtgatgacagcgacagcaactttgagaagatcgtgtccaaggctgtgaccagcaagaagagcaagggggagagtgatgacttccacatggactttgacagcgctgtggccccccgggccaagtctgtgcgggccaagaagcccatcaagtacctggaggagagtgatgaagatgacctcttctag

SEQ ID NO: 22209 - DNA, 4881 bp, Artificial Sequence
  Description of Artificial Sequence: Synthetic coding sequence
atggccaagagcggcggctgtggggccggggccggcgtgggcggcggcaatggagccctgacctgggtgaccctgtttgaccagaacaatgctgccaagaaggaggagagcgagacagccaacaagaatgacagcagcaagaagctgtctgtggagcgggtgtaccagaagaagacccagctggagcacatcctgctgcggccagacacctacatcggctctgtggagcccctgacccagttcatgtgggtgtatgatgaagatgtgggcatgaactgccgggaggtgacctttgtgcccggcctgtacaagatctttgatgagatcctggtgaatgctgctgacaacaagcagagggacaagaacatgacctgcatcaaggtgtccattgatcctgagagcaacatcatcagcatctggaacaacgggaagggcatccctgtggtggagcacaaggtggagaaggtgtatgtgcctgccctgatcttcggccagctgctgaccagcagcaactatgatgatgatgagaagaaggtgactggaggaagaaatggctacggggccaagctgtgcaacatcttcagcaccaagttcaccgtggagacagcctgcaaggagtacaagcacagcttcaagcagacctggatgaacaacatgatgaagaccagcgaggccaagatcaagcactttgatggagaggactacacctgcatcaccttccagcctgacctgagcaagttcaagatggagaagctggacaaggacatcgtggccctgatgacccggcgggcctatgacctggccggcagctgccggggcgtgaaggtgatgtttaatggcaagaagctgcctgtgaatggcttccgctcctatgtggacctgtatgtgaaggacaagctggatgaaacaggagtggccctgaaggtgattcatgagctggccaatgaacgctgggatgtgtgcctgaccctgtctgagaagggcttccagcagatcagctttgtgaacagcatcgccaccaccaagggcggccgccacgtggactatgtggtggaccaggtggtgggcaagctgattgaggtggtgaagaagaagaacaaggccggcgtgtctgtgaagcccttccaggtgaagaaccacatctgggtgttcatcaactgcctgattgagaaccccacctttgacagccagaccaaggagaacatgaccctgcagcccaagagctttggcagcaagtgccagctgtctgagaagttcttcaaggccgccagcaactgtggcatcgtggagagcatcctgaactgggtgaagttcaaggcccagacccagctgaacaagaagtgcagctctgtgaagtacagcaagatcaagggcatccccaagctggatgatgccaatgatgctgggggcaagcacagcctggagtgcaccctcatcctgacagaaggagacagcgccaagagcctggccgtgtctggcctgggcgtgattggccgggacagatatggagtcttccccctgcggggcaagatcctgaatgtgcgggaggccagccacaagcagatcatggagaatgctgagatcaacaacatcatcaagatcgtgggcctgcagtacaagaagagctatgatgatgctgagagcctgaagaccctgcgctatggcaagatcatgatcatgacagaccaggaccaggacggcagccacatcaagggcctgctgatcaacttcatccaccacaactggcccagcctgctgaagcacggcttcctggaggagttcatcacccccatcgtgaaggccagcaagaacaagcaggagctgtccttctacagcatccctgagtttgatgagtggaagaagcacatcgagaaccagaaggcctggaagatcaagtactacaagggcctgggcaccagcacagccaaggaggccaaggagtactttgctgacatggagcggcaccgcatcctcttccgctatgccggcccagaagatgatgctgccatcaccctggccttcagcaagaagaagattgatgacaggaaggagtggctgaccaacttcatggaggaccggcggcagaggcggctgcacggcctgcctgagcagttcctgtatggaacagccaccaagcacctgacctacaatgacttcatcaacaaggagctgatcctcttcagcaacagcgacaatgaaagaagcatccccagcctggtggatggcttcaagccaggccagaggaaggtgctcttcacctgcttcaagagaaatgacaagcgggaggtgaaggtggcccagctggccggctctgtggccgagatgtctgcctaccaccacggggagcaggccctgatgatgaccatcgtgaacctggcccagaactttgtgggcagcaacaacatcaacctgctgcagcccatcggccagtttggcacccggctgcacggcggcaaggatgctgccagcccccgctacatcttcaccatgctgagcaccctggcccggctgctcttccctgctgtggatgacaacctgctgaagttcctgtatgatgacaaccagagggtggagcctgagtggtacatccccatcatccccatggtgctgatcaacggggctgagggcattggaacaggctgggcctgcaagctgcccaactatgatgcccgggagatcgtgaacaacgtgcggaggatgctggatggcctggacccccaccccatgctgcccaactacaagaacttcaagggcaccatccaggagctgggccagaaccagtatgctgtgtctggagagatctttgtggtggacaggaacacagtggagatcacagagctgcctgtgaggacctggacccaggtgtacaaggagcaggtgctggagcccatgctgaatggaacagacaagaccccagccctgatcagtgactacaaggagtaccacacagacaccaccgtgaagtttgtggtgaagatgacagaggagaagctggcccaggccgaggccgccggcctgcacaaggtgttcaagctgcagaccaccctgacctgcaacagcatggtgctgtttgaccacatgggctgcctgaagaagtatgaaacagtgcaggacatcctgaaggagttctttgacctgcggctgagctactacggcctgaggaaggagtggctggtgggcatgctgggcgctgagagcaccaagctgaacaaccaggcccgcttcatcctggagaagatccagggcaagatcaccattgaaaatagaagcaagaaggacctgatccagatgctggtgcagaggggctatgaaagtgaccctgtgaaggcctggaaggaggcccaggagaaggctgctgaagaagatgagacccagaaccagcatgatgacagcagcagtgacagcggcaccccatctggccctgacttcaactacatcctgaacatgagcctgtggagcctgaccaaggagaaggtggaggagctgatcaagcagagagatgccaagggccgggaggtgaatgacctgaagaggaagagccccagcgacctgtggaaggaggacctggccgcctttgtggaggagctggacaaggtggagagccaggagagagaagatgtgctggccggcatgtctgggaaggccatcaagggcaaggtgggcaagcccaaggtgaagaagctgcagctggaggagaccatgcccagcccctacggccgccgcatcatccctgagatcacagccatgaaggcagatgccagcaagaagctgctgaagaagaagaagggggacctggacacagctgctgtgaaggtggagtttgatgaggagttcagcggggcccctgtggagggcgctggggaggaggccctgacccccagcgtgcccatcaacaagggccccaagcccaagcgggagaagaaggagcccggcaccagggtgaggaagacccccaccagcagcggcaagcccagcgccaagaaggtgaagaagaggaacccctggagcgatgatgagagcaagtctgagagtgacctggaggagacagagcctgtggtgatcccccgggacagcctgctgcggcgggctgctgctgagcggcccaagtacacctttgacttcagcgaggaggaggatgatgatgctgatgatgatgatgatgacaacaatgacctggaggagctgaaggtgaaggccagccccatcaccaatgatggagaagatgaatttgtgcccagtgatggcctggacaaggatgagtacaccttcagccctgggaagagcaaggccaccccagagaagagcctgcatgacaagaagagccaggactttggaaacctcttctccttccccagctacagccagaagtcagaagatgattctgccaagtttgacagcaatgaagaagattctgcctctgtgttcagccccagctttggcctgaagcagacagacaaggtgcccagcaagacagtggccgccaagaagggcaagcccagcagtgacacagtgcccaagcccaagagggcccccaagcagaagaaggtggtggaggccgtgaacagcgacagcgacagcgagtttggcatccccaagaagaccaccacccccaagggcaagggccgcggggccaagaagaggaaggccagcggctctgaaaatgaaggagactacaaccctggcaggaagaccagcaagaccaccagcaagaagcccaagaagaccagctttgaccaggacagtgatgtggacatcttccccagcgacttccccacagagccccccagcctgcccaggacaggccgggccaggaaggaggtgaagtactttgctgagagtgatgaggaggaggatgatgtggactttgccatgttcaactag

SEQ ID NO: 22210 - DNA, 3453 bp, Artificial Sequence
  Description of Artificial Sequence: Synthetic coding sequence
atggccaagagcggcggctgtggggccggggccggcgtgggcggcggcaatggagccctgacctgggtgaacaatgctgccaagaaggaggagagcgagacagccaacaagaatgacagcagcaagaagctgtctgtggagcgggtgtaccagaagaagacccagctggagcacatcctgctgcggccagacacctacatcggctctgtggagcccctgacccagttcatgtgggtgtatgatgaagatgtgggcatgaactgccgggaggtgacctttgtgcccggcctgtacaagatctttgatgagatcctggtgaatgctgctgacaacaagcagagggacaagaacatgacctgcatcaaggtgtccattgatcctgagagcaacatcatcagcatctggaacaacgggaagggcatccctgtggtggagcacaaggtggagaaggtgtatgtgcctgccctgatcttcggccagctgctgaccagcagcaactatgatgatgatgagaagaaggtgactggaggaagaaatggctatggagccaagctgtgcaacatcttcagcaccaagttcaccgtggagacagcctgcaaggagtacaagcacagcttcaagcagacctggatgaacaacatgatgaagaccagcgaggccaagatcaagcactttgatggagaggactacacctgcatcaccttccagcctgacctgagcaagttcaagatggagaagctggacaaggacatcgtggccctgatgacccggcgggcctatgacctggccggcagctgccggggcgtgaaggtgatgttcaacgggaagaagctgcctgtgaatggcttccgctcctatgtggacctgtatgtgaaggacaagctggatgagaccggggtggccctgaaggtgatccacgagctggccaatgaacgctgggatgtgtgcctgaccctgtctgagaagggcttccagcagatcagctttgtgaacagcatcgccaccaccaagggcggcagacatgtggactatgtggtggaccaggtggtgggcaagctgattgaggtggtgaagaagaagaacaaggccggcgtgtctgtgaagcccttccaggtgaagaaccacatctgggtgttcatcaactgcctgattgagaaccccacctttgacagccagaccaaggagaacatgaccctgcagcccaagagctttggcagcaagtgccagctgtctgagaagttcttcaaggccgccagcaactgtggcatcgtggagagcatcctgaactgggtgaagttcaaggcccagacccagctgaacaagaagtgcagctctgtgaagtacagcaagatcaagggcatccccaagctggatgatgccaatgatgctgggggcaagcacagcctggagtgcaccctcatcctgacagaaggagacagcgccaagagcctggccgtgtctggcctgggcgtcatcggccgggacagatatggagtcttccccctgcggggcaagatcctgaatgtgcgggaggccagccacaagcagatcatggagaatgctgagatcaacaacatcatcaagatcgtgggcctgcagtacaagaagagctatgatgatgctgagagcctgaagaccctgcgctatggcaagatcatgatcatgacagaccaggaccaggacggcagccacatcaagggcctgctgatcaacttcatccaccacaactggcccagcctgctgaagcacggcttcctggaggagttcatcacccccatcgtgaaggccagcaagaacaagcaggagctgtccttctacagcatccctgagtttgatgagtggaagaagcacatcgagaaccagaaggcctggaagatcaagtactacaagggcctgggcaccagcacagccaaggaggccaaggagtactttgctgacatggagcggcaccgcatcctcttccgctatgccggcccagaagatgatgctgccatcaccctggccttcagcaagaagaagattgatgacaggaaggagtggctgaccaacttcatggaggaccggcggcagaggcggctgcacggcctgcctgagcagttcctgtatggaacagccaccaagcacctgacctacaatgacttcatcaacaaggagctgatcctcttcagcaacagcgacaatgaaagaagcatccccagcctggtggatggcttcaagccaggccagaggaaggtgctcttcacctgcttcaagagaaatgacaagcgggaggtgaaggtggcccagctggccggctctgtggccgagatgtctgcctaccaccacggggagcaggccctgatgatgaccatcgtgaacctggcccagaactttgtgggcagcaacaacatcaacctgctgcagcccatcggccagtttggcacccggctgcatggaggcaaggatgctgccagcccccgctacatcttcaccatgctgagcaccctggcccggctgctcttccctgctgtggatgacaacctgctgaagttcctgtatgatgacaaccagagggtggagcctgagtggtacatccccatcatccccatggtgctgatcaatggagctgagggcatcggcaccggctgggcctgcaagctgcccaactatgatgcccgggagatcgtgaacaacgtgcggaggatgctggatggcctggacccccaccccatgctgcccaactacaagaacttcaagggcaccatccaggagctgggccagaaccagtatgctgtgtctggagagatctttgtggtggacaggaacacagtggagatcacagagctgcctgtgaggacctggacccaggtgtacaaggagcaggtgctggagcccatgctgaatggaacagacaagaccccagccctgatcagtgactacaaggagtaccacacagacaccaccgtgaagtttgtggtgaagatgacagaggagaagctggcccaggccgaggccgccggcctgcacaaggtgttcaagctgcagaccaccctgacctgcaacagcatggtgctgtttgaccacatgggctgcctgaagaagtatgagaccgtgcaggacatcctgaaggagttctttgacctgcggctgagctactacggcctgaggaaggagtggctggtgggcatgctgggcgctgagagcaccaagctgaacaaccaggcccgcttcatcctggagaagatccagggcaagatcaccatcgagaacagaagcaagaaggacctgatccagatgctggtgcagaggggctatgaaagtgaccctgtgaaggcctggaaggaggcccaggagaaggctgctgaggaggatgagacccagaaccagcatgatgacagcagcagtgacagcggcacccccagcggccctgacttcaactacatcctgaacatgagcctgtggagcctgacctag

SEQ ID NO: 22211 - DNA, 4866 bp, Artificial Sequence
  Description of Artificial Sequence: Synthetic coding sequence
atggccaagagcggcggctgtggggccggggccggcgtgggcggcggcaatggagccctgacctgggtgaacaatgctgccaagaaggaggagagcgagacagccaacaagaatgacagcagcaagaagctgtctgtggagcgggtgtaccagaagaagacccagctggagcacatcctgctgcggccagacacctacatcggctctgtggagcccctgacccagttcatgtgggtgtatgatgaagatgtgggcatgaactgccgggaggtgacctttgtgcccggcctgtacaagatctttgatgagatcctggtgaatgctgctgacaacaagcagagggacaagaacatgacctgcatcaaggtgtccattgatcctgagagcaacatcatcagcatctggaacaacgggaagggcatccctgtggtggagcacaaggtggagaaggtgtatgtgcctgccctgatcttcggccagctgctgaccagcagcaactatgatgatgatgagaagaaggtgactggaggaagaaatggctatggagccaagctgtgcaacatcttcagcaccaagttcaccgtggagacagcctgcaaggagtacaagcacagcttcaagcagacctggatgaacaacatgatgaagaccagcgaggccaagatcaagcactttgatggagaggactacacctgcatcaccttccagcctgacctgagcaagttcaagatggagaagctggacaaggacatcgtggccctgatgacccggcgggcctatgacctggccggcagctgccggggcgtgaaggtgatgttcaacgggaagaagctgcctgtgaatggcttccgctcctatgtggacctgtatgtgaaggacaagctggatgagaccggggtggccctgaaggtgatccacgagctggccaatgaacgctgggatgtgtgcctgaccctgtctgagaagggcttccagcagatcagctttgtgaacagcatcgccaccaccaagggcggcagacatgtggactatgtggtggaccaggtggtgggcaagctgattgaggtggtgaagaagaagaacaaggccggcgtgtctgtgaagcccttccaggtgaagaaccacatctgggtgttcatcaactgcctgattgagaaccccacctttgacagccagaccaaggagaacatgaccctgcagcccaagagctttggcagcaagtgccagctgtctgagaagttcttcaaggccgccagcaactgtggcatcgtggagagcatcctgaactgggtgaagttcaaggcccagacccagctgaacaagaagtgcagctctgtgaagtacagcaagatcaagggcatccccaagctggatgatgccaatgatgctgggggcaagcacagcctggagtgcaccctcatcctgacagaaggagacagcgccaagagcctggccgtgtctggcctgggcgtcatcggccgggacagatatggagtcttccccctgcggggcaagatcctgaatgtgcgggaggccagccacaagcagatcatggagaatgctgagatcaacaacatcatcaagatcgtgggcctgcagtacaagaagagctatgatgatgctgagagcctgaagaccctgcgctatggcaagatcatgatcatgacagaccaggaccaggacggcagccacatcaagggcctgctgatcaacttcatccaccacaactggcccagcctgctgaagcacggcttcctggaggagttcatcacccccatcgtgaaggccagcaagaacaagcaggagctgtccttctacagcatccctgagtttgatgagtggaagaagcacatcgagaaccagaaggcctggaagatcaagtactacaagggcctgggcaccagcacagccaaggaggccaaggagtactttgctgacatggagcggcaccgcatcctcttccgctatgccggcccagaagatgatgctgccatcaccctggccttcagcaagaagaagattgatgacaggaaggagtggctgaccaacttcatggaggaccggcggcagaggcggctgcacggcctgcctgagcagttcctgtatggaacagccaccaagcacctgacctacaatgacttcatcaacaaggagctgatcctcttcagcaacagcgacaatgaaagaagcatccccagcctggtggatggcttcaagccaggccagaggaaggtgctcttcacctgcttcaagagaaatgacaagcgggaggtgaaggtggcccagctggccggctctgtggccgagatgtctgcctaccaccacggggagcaggccctgatgatgaccatcgtgaacctggcccagaactttgtgggcagcaacaacatcaacctgctgcagcccatcggccagtttggcacccggctgcatggaggcaaggatgctgccagcccccgctacatcttcaccatgctgagcaccctggcccggctgctcttccctgctgtggatgacaacctgctgaagttcctgtatgatgacaaccagagggtggagcctgagtggtacatccccatcatccccatggtgctgatcaatggagctgagggcatcggcaccggctgggcctgcaagctgcccaactatgatgcccgggagatcgtgaacaacgtgcggaggatgctggatggcctggacccccaccccatgctgcccaactacaagaacttcaagggcaccatccaggagctgggccagaaccagtatgctgtgtctggagagatctttgtggtggacaggaacacagtggagatcacagagctgcctgtgaggacctggacccaggtgtacaaggagcaggtgctggagcccatgctgaatggaacagacaagaccccagccctgatcagtgactacaaggagtaccacacagacaccaccgtgaagtttgtggtgaagatgacagaggagaagctggcccaggccgaggccgccggcctgcacaaggtgttcaagctgcagaccaccctgacctgcaacagcatggtgctgtttgaccacatgggctgcctgaagaagtatgagaccgtgcaggacatcctgaaggagttctttgacctgcggctgagctactacggcctgaggaaggagtggctggtgggcatgctgggcgctgagagcaccaagctgaacaaccaggcccgcttcatcctggagaagatccagggcaagatcaccatcgagaacagaagcaagaaggacctgatccagatgctggtgcagaggggctatgaaagtgaccctgtgaaggcctggaaggaggcccaggagaaggctgctgaggaggatgagacccagaaccagcatgatgacagcagcagtgacagcggcacccccagcggccctgacttcaactacatcctgaacatgagcctgtggagcctgaccaaggagaaggtggaggagctgatcaagcagagagatgccaagggccgggaggtgaatgacctgaagaggaagagccccagcgacctgtggaaggaggacctggccgcctttgtggaggagctggacaaggtggagagccaggagcgggaggatgtgctggccggcatgtctgggaaggccatcaagggcaaggtgggcaagcccaaggtgaagaagctgcagctggaggagaccatgcccagcccctatggaagacgcatcatccctgagatcacagccatgaaggcagatgccagcaagaagctgctgaagaagaagaagggggacctggacacagctgctgtgaaggtggagtttgatgaggagttcagcggggcccctgtggagggcgctggggaggaggccctgaccccatctgtgcccatcaacaagggccccaagcccaagcgggagaagaaggagcccggcaccagggtgaggaagacccccaccagcagcggcaagcccagcgccaagaaggtgaagaagaggaacccctggagcgatgatgagagcaagtctgagagtgacctggaggagacagagcctgtggtgatcccccgggacagcctgctgcggcgggctgctgctgagcggcccaagtacacctttgacttcagcgaggaggaggatgatgatgctgatgatgatgatgatgacaacaatgacctggaggagctgaaggtgaaggccagccccatcaccaatgatggagaagatgaatttgtgcccagtgatggcctggacaaggatgagtacaccttcagccctgggaagagcaaggccaccccagagaagagcctgcatgacaagaagagccaggactttggaaacctcttctccttccccagctacagccagaagtcagaagatgacagcgccaagtttgacagcaatgaggaggacagcgccagcgtcttcagccccagctttggcctgaagcagacagacaaggtgcccagcaagacagtggccgccaagaagggcaagcccagcagtgacacagtgcccaagcccaagagggcccccaagcagaagaaggtggtggaggccgtgaacagcgacagcgacagcgagtttggcatccccaagaagaccaccacccccaagggcaagggccgcggggccaagaagaggaaggccagcggctctgaaaatgaaggagactacaaccctggcaggaagaccagcaagaccaccagcaagaagcccaagaagaccagctttgaccaggacagtgatgtggacatcttccccagcgacttccccacagagccccccagcctgcccaggacaggccgggccaggaaggaggtgaagtactttgctgagagtgatgaggaggaggatgatgtggactttgccatgttcaactag

SEQ ID NO: 22212 - DNA, 174 bp, Artificial Sequence
  Description of Artificial Sequence: Synthetic coding sequence
accctgtttgaccagaacaatgctgccaagaaggaggagagcgagacagccaacaagaatgacagcagcaagaagctgtctgtggagcgggtgtaccagaagaagacccagctggagcacatcctgctgcggccagacacctacatcggctctgtggagcccctgacccagtag

SEQ ID NO: 22213 - DNA, 1437 bp, Artificial Sequence
  Description of Artificial Sequence: Synthetic coding sequence
atgagcctgtggagcctgaccaaggagaaggtggaggagctgatcaagcagagagatgccaagggccgggaggtgaatgacctgaagaggaagagccccagcgacctgtggaaggaggacctggccgcctttgtggaggagctggacaaggtggagagccaggagagagaagatgtgctggccggcatgtctgggaaggccatcaagggcaaggtgggcaagcccaaggtgaagaagctgcagctggaggagaccatgcccagcccctacggccgccgcatcatccctgagatcacagccatgaaggcagatgccagcaagaagctgctgaagaagaagaagggggacctggacacagctgctgtgaaggtggagtttgatgaggagttcagcggggcccctgtggagggcgctggggaggaggccctgacccccagcgtgcccatcaacaagggccccaagcccaagcgggagaagaaggagcccggcaccagggtgaggaagacccccaccagcagcggcaagcccagcgccaagaaggtgaagaagaggaacccctggagcgatgatgagagcaagtctgagagtgacctggaggagacagagcctgtggtgatcccccgggacagcctgctgcggcgggctgctgctgagcggcccaagtacacctttgacttcagcgaggaggaggatgatgatgctgatgatgatgatgatgacaacaatgacctggaggagctgaaggtgaaggccagccccatcaccaatgatggagaagatgaatttgtgcccagtgatggcctggacaaggatgagtacaccttcagccctgggaagagcaaggccaccccagagaagagcctgcatgacaagaagagccaggactttggaaacctcttctccttccccagctacagccagaagtcagaagatgattctgccaagtttgacagcaatgaagaagattctgcctctgtgttcagccccagctttggcctgaagcagacagacaaggtgcccagcaagacagtggccgccaagaagggcaagcccagcagtgacacagtgcccaagcccaagagggcccccaagcagaagaaggtggtggaggccgtgaacagcgacagcgacagcgagtttggcatccccaagaagaccaccacccccaagggcaagggccgcggggccaagaagaggaaggccagcggctctgaaaatgaaggagactacaaccctggcaggaagaccagcaagaccaccagcaagaagcccaagaagaccagctttgaccaggacagtgatgtggacatcttccccagcgacttccccacagagccccccagcctgcccaggacaggccgggccaggaaggaggtgaagtactttgctgagagtgatgaggaggaggatgatgtggactttgccatgttcaactag

SEQ ID NO: 22214 - DNA, 1437 bp, Artificial Sequence; identical to SEQ ID NO: 22213
  Description of Artificial Sequence: Synthetic coding sequence

SEQ ID NO: 22215 - DNA, 3006 bp, Artificial Sequence
  Description of Artificial Sequence: Synthetic coding sequence
atgatcttccctgtggcccgctatgccctgcgctggctgcggcggccagaagatcgggccttcagccgggccgccatggagatggccctgcggggcgtgaggaaggtgctgtgtgtggccgagaagaatgatgctgccaagggcattgctgacctgctgagcaatggaaggatgagaagaagagagggcctgagcaagttcaacaagatctatgaatttgactaccacctgtatggccagaatgtgaccatggtgatgacctctgtgtctggccacctgctggcccatgacttccagatgcagttcaggaagtggcagagctgcaaccccctggtgctgtttgaggccgagattgagaagtactgcccagagaactttgtggacatcaagaagaccctggagcgggagacccggcagtgccaggccctggtgatctggacagactgtgaccgggagggggagaacatcggctttgagatcatccacgtgtgcaaggctgtgaagcccaacctgcaggtgctgcgggcccgcttcagcgagatcacccctcatgctgtgaggacagcctgtgagaacctgacagagccagaccagagggtgtctgatgctgtggatgtgcggcaggagctggacctgcgcatcggggccgccttcacccgcttccagaccctgcggctgcagaggatcttccctgaggtgctggccgagcagctgatctcctatggcagctgccagttccccaccctgggctttgtggtggagcgcttcaaggccatccaggcctttgtgcctgagatcttccaccgcatcaaggtgacccatgaccacaaggatggcatcgtggagttcaactggaagaggcacaggctcttcaaccacacagcctgcctggtgctgtaccagctgtgtgtggaggaccccatggccaccgtggtggaggtgcgcagcaagcccaagagcaagtggaggccccaggccctggacacagtggagctggagaagctggccagcaggaagctgcgcatcaatgccaaggagaccatgagaattgctgagaagctgtacacccagggctacatctcctaccccaggacagagaccaacatcttcccccgggacctgaacctgactgtgctggtggagcagcagaccccagacccccgctggggcgcctttgcccagagcatcctggagcggggcggccccaccccaagaaatggaaacaagagtgaccaggcccacccccccatccaccccaccaagtacaccaacaacctgcagggagatgagcagaggctgtatgagttcatcgtgcgccacttcctggcctgctgcagccaggatgcccagggccaggagaccaccgtggagattgacatcgcccaggagagatttgtggcccacggcctgatgatcctggccaggaactacctggatgtgtacccctatgaccactggagcgacaagatcctgcctgtgtatgagcagggcagccacttccagcccagcacagtggagatggtggatggagagaccagcccccccaagctgctgacagaagctgacctgattgccctgatggagaagcacggcatcggcacagatgccacccatgctgagcacatcgagaccatcaaggccaggatgtatgtgggcctgaccccagacaagcgcttcctgcccggccacctgggcatgggcctggtggagggctatgacagcatgggctatgagatgagcaagccagacctgcgggcagagctggaggccgacctgaagctgatctgtgatggcaagaaggacaagtttgtggtgctgcggcagcaggtgcagaagtacaagcaggtgttcatcgaggccgtggccaaggccaagaagctggatgaggccctggcccagtactttggaaatggaacagagctggcccagcaggaggacatctacccagccatgcctgagcccatcagaaaatgtccccagtgcaacaaggacatggtgctgaagaccaagaagaatggaggcttctacctgagctgcatgggcttccctgagtgccgctctgctgtgtggctgcctgacagcgtgctggaggccagccgggacagctctgtgtgccctgtgtgccagccccaccctgtgtaccgcctgaagctgaagttcaagaggggcagcctgccccccaccatgcccctggagtttgtgtgctgcattggaggctgtgatgacaccctgcgggagatcctggacctgcgcttcagcggcggccccccccgggccagccagcccagcggccgcctgcaggccaaccagagcctgaacaggatggacaacagccagcacccccagcctgctgacagccggcagacaggcagcagcaaggccctggcccagaccctgcccccacccacagctgctggggagagcaacagcgtgacctgcaactgtggccaggaggccgtgctgctgactgtgaggaaggagggccccaacagaggccggcagttcttcaagtgcaatggaggcagctgcaacttcttcctgtgggccgacagccccaaccctggggccggcggccccccagccctggcctaccggcccctgggcgccagcctgggctgccccccaggccctggcatccacctgggcggcttcggcaaccctggagatggcagcggcagcggcaccagctgcctgtgcagccagcccagcgtgaccaggacagtgcagaaggatggccccaacaagggccggcagttccacacctgtgccaagccccgggagcagcagtgtggcttcttccagtgggtggatgagaacacagcccctggcaccagcggggcccccagctggacaggagaccggggccgcaccctggagagcgaggcccggagcaagaggccccgggccagcagcagtgacatgggcagcacagccaagaagcccaggaagtgcagcctgtgccaccagcccggccacacccggcccttctgcccccagaacagatag

SEQ ID NO: 22216 - DNA, 1170 bp, Artificial Sequence
  Description of Artificial Sequence: Synthetic coding sequence
tgaagccgggccgccatggagatggccctgcggggcgtgaggaaggtgctgtgtgtggccgagaagaatgatgctgccaagggcattgctgacctgctgagcaatggaaggatgagaagaagagagggcctgagcaagttcaacaagatctatgaatttgactaccacctgtatggccagaatgtgaccatggtgatgacctctgtgtctggccacctgctggcccatgacttccagatgcagttcaggaagtggcagagctgcaaccccctggtgctgtttgaggccgagattgagaagtactgcccagagaactttgtggacatcaagaagaccctggagcgggagacccggcagtgccaggccctggtgatctggacagactgtgaccgggagggggagaacatcggctttgagatcatccacgtgtgcaaggctgtgaagcccaacctgcaggtgctgcgggcccgcttcagcgagatcacccctcatgctgtgaggacagcctgtgagaacctgacagagccagaccagagggtgtctgatgctgtggatgtgcggcaggagctggacctgcgcatcggggccgccttcacccgcttccagaccctgcggctgcagaggatcttccctgaggtgctggccgagcagctgatctcctatggcagctgccagttccccaccctgggctttgtggtggagcgcttcaaggccatccaggcctttgtgcctgagatcttccaccgcatcaaggtgacccatgaccacaaggatggcatcgtggagttcaactggaagaggcacaggctcttcaaccacacagcctgcctggtgctgtaccagctgtgtgtggaggaccccatggccaccgtggtggaggtgcgcagcaagcccaagagcaagtggaggccccaggccctggacacagtggagctggagaagctggccagcaggaagctgcgcatcaatgccaaggagaccatgagaattgctgagaagctgtacacccagggctacatctcctaccccaggacagagaccaacatcttcccccgggacctgaacctgactgtgctggtggagcagcagaccccagacccccgctggggcgcctttgcccagagcatcctggagcggggcggccccaccccaagaaatggaaacaagtag

SEQ ID NO: 22217 - DNA, 1596 bp, Artificial Sequence
  Description of Artificial Sequence: Synthetic coding sequence
atgatcctggccaggaactacctggatgtgtacccctatgaccactggagcgacaagatcctgcctgtgtatgagcagggcagccacttccagcccagcacagtggagatggtggatggagagaccagcccccccaagctgctgacagaagctgacctgattgccctgatggagaagcacggcatcggcacagatgccacccatgctgagcacatcgagaccatcaaggccaggatgtatgtgggcctgaccccagacaagcgcttcctgcccggccacctgggcatgggcctggtggagggctatgacagcatgggctatgagatgagcaagccagacctgcgggcagagctggaggccgacctgaagctgatctgtgatggcaagaaggacaagtttgtggtgctgcggcagcaggtgcagaagtacaagcaggtgttcatcgaggccgtggccaaggccaagaagctggatgaggccctggcccagtactttggaaatggaacagagctggcccagcaggaggacatctacccagccatgcctgagcccatcagaaaatgtccccagtgcaacaaggacatggtgctgaagaccaagaagaatggaggcttctacctgagctgcatgggcttccctgagtgccgctctgctgtgtggctgcctgacagcgtgctggaggccagccgggacagctctgtgtgccctgtgtgccagccccaccctgtgtaccgcctgaagctgaagttcaagaggggcagcctgccccccaccatgcccctggagtttgtgtgctgcattggaggctgtgatgacaccctgcgggagatcctggacctgcgcttcagcggcggccccccccgggccagccagcccagcggccgcctgcaggccaaccagagcctgaacaggatggacaacagccagcacccccagcctgctgacagccggcagacaggcagcagcaaggccctggcccagaccctgcccccacccacagctgctggggagagcaacagcgtgacctgcaactgtggccaggaggccgtgctgctgactgtgaggaaggagggccccaacagaggccggcagttcttcaagtgcaatggaggcagctgcaacttcttcctgtgggccgacagccccaaccctggggccggcggccccccagccctggcctaccggcccctgggcgccagcctgggctgccccccaggccctggcatccacctgggcggcttcggcaaccctggagatggcagcggcagcggcaccagctgcctgtgcagccagcccagcgtgaccaggacagtgcagaaggatggccccaacaagggccggcagttccacacctgtgccaagccccgggagcagcagtgtggcttcttccagtgggtggatgagaacacagcccctggcaccagcggggcccccagctggacaggagaccggggccgcaccctggagagcgaggcccggagcaagaggccccgggccagcagcagtgacatgggcagcacagccaagaagcccaggaagtgcagcctgtgccaccagcccggccacacccggcccttctgcccccagaacagatag

SEQ ID NO: 22218 - DNA, 2721 bp, Artificial Sequence
  Description of Artificial Sequence: Synthetic coding sequence
atgaacctgatcatcatctgcatggcccggcagagctgcaaccccctggtgctgtttgaagctgagattgagaagtactgcccagaaaattttgtggacatcaagaagaccctggagcgggagacccggcagtgccaggccctggtgatctggacagactgtgaccgggagggagaaaatattggatttgagatcatccacgtgtgcaaggctgtgaagcccaacctgcaggtgctgcgggcccgcttcagcgagatcacccctcatgctgtgaggacagcctgtgagaacctgacagagccagaccagagggtgtctgatgctgtggatgtgcggcaggagctggacctgagaattggagctgccttcacccgcttccagaccctgcggctgcagaggatcttccctgaggtgctggccgagcagctgatctcctatggcagctgccagttccccaccctgggctttgtggtggagcgcttcaaggccatccaggcctttgtgcctgagatcttccaccgcatcaaggtgacccatgaccacaaggatggcatcgtggagttcaactggaagaggcacaggctcttcaaccacacagcctgcctggtgctgtaccagctgtgtgtggaggaccccatggccaccgtggtggaggtgcgcagcaagcccaagagcaagtggaggccccaggccctggacacagtggagctggagaagctggccagcaggaagctgcgcatcaatgccaaggagaccatgagaattgctgagaagctgtacacccagggctacatctcctaccccaggacagagaccaacatcttcccccgggacctgaacctgactgtgctggtggagcagcagaccccagacccccgctggggcgcctttgcccagagcatcctggagcggggcggccccaccccaagaaatggaaacaagagtgaccaggcccacccccccatccaccccaccaagtacaccaacaacctgcagggagatgagcagaggctgtatgagttcatcgtgcgccacttcctggcctgctgcagccaggatgcccagggccaggagaccaccgtggagattgatattgcccaggagagatttgtggcccacggcctgatgatcctggccaggaactacctggatgtgtacccctatgaccactggagcgacaagatcctgcctgtgtatgagcagggcagccacttccagcccagcacagtggagatggtggatggagagaccagcccccccaagctgctgacagaggccgacctgattgccctgatggagaagcatggaattggaacagatgccacccacgccgagcacatcgagaccatcaaggccaggatgtatgtgggcctgaccccagacaagcgcttcctgcccggccacctgggcatgggcctggtggagggctatgacagcatgggctatgagatgagcaagccagacctgcgggcagagctggaggccgacctgaagctgatctgtgatggcaagaaggacaagtttgtggtgctgcggcagcaggtgcagaagtacaagcaggtgttcattgaagctgtggccaaggccaagaagctggatgaggccctggcccagtactttggaaatggaacagagctggcccagcaggaggacatctacccagccatgcctgagcccatcaggaagtgcccccagtgcaacaaggacatggtgctgaagaccaagaagaatggaggcttctacctgagctgcatgggcttcccagaatgtagatctgctgtgtggctgcctgattctgtgctggaggccagccgggacagctctgtgtgccctgtgtgccagccccaccctgtgtaccgcctgaagctgaagttcaagaggggcagcctgccccccaccatgcccctggagtttgtgtgctgcatcggcggctgtgatgacaccctgcgggagatcctggacctgcgcttcagcggcggccccccccgggccagccagcccagcggccgcctgcaggccaaccagagcctgaacaggatggacaacagccagcacccccagcctgctgacagccggcagacaggcagcagcaaggccctggcccagaccctgcccccacccacagctgctggggagagcaacagcgtgacctgcaactgtggccaggaggccgtgctgctgactgtgaggaaggagggccccaacagaggccggcagttcttcaagtgcaatggaggcagctgcaacttcttcctgtgggccgacagccccaaccctggagctgggggccccccagccctggcctaccggcccctgggcgccagcctgggctgccccccaggccctggcatccacctgggcggctttggaaatcctggagatggcagcggcagcggcaccagctgcctgtgcagccagcccagcgtgaccaggacagtgcagaaggatggccccaacaagggccggcagttccacacctgtgccaagccccgggagcagcagtgtggcttcttccagtgggtggatgaaaatacagcccctggcaccagcggggcccccagctggacaggagaccggggccgcaccctggagagcgaggcccggagcaagaggccccgggccagcagcagtgacatgggcagcacagccaagaagcccaggaagtgcagcctgtgccaccagcccggccacacccggcccttctgcccccagaacagatag

SEQ ID NO: 22219 - DNA, 2589 bp, Artificial Sequence
  Description of Artificial Sequence: Synthetic coding sequence
atgaagacagtgctgatggtggccgagaagcccagcctggcccagagcatcgccaagatcctgagccggggcagcctgagcagccacaagggcctgaatggagcctgcagcgtgcatgagtacacaggcacctttgctggccagcctgtgcgcttcaagatgacctctgtgtgtggccacgtgatgaccctggacttcctgggcaagtacaacaagtgggacaaggtggaccctgctgagctgttcagccaggcccccacagagaagaaggaggccaaccccaagctgaacatggtgaagttcctgcaggtggagggccggggctgtgactacatcgtgctgtggctggactgtgacaaggagggggagaacatctgctttgaggtgctggatgctgtgctgcctgtgatgaacaaggcccatggaggagagaagacagtgttccgggcccgcttcagcagcatcacagacacagacatctgcaatgccatggcctgcctgggggagccagaccacaatgaggccctgtctgtggatgcccggcaggagctggacctgcgcatcggctgtgccttcacccgcttccagaccaagtacttccagggcaagtacggggacctggacagcagcctcatcagctttggcccctgccagacccccaccctgggcttctgtgtggagagacatgacaagatccagagcttcaagccagagacctactgggtgctgcaggccaaggtgaacacagacaaggacaggagcctgctgctggactgggacagagtgcgggtgtttgaccgggagatcgcccagatgttcctgaacatgaccaagctggagaaggaggcccaggtggaggccaccagcaggaaggagaaggccaagcagaggcccctggccctgaacacagtggagatgctgcgggtggccagcagcagcctgggcatgggcccccagcacgccatgcagacagctgagcggctgtacacccagggctacatctcctaccccaggacagagaccacccactacccagagaactttgacctgaagggcagcctgcggcagcaggccaaccacccctactgggccgacacagtgaagaggctgctggccgagggcatcaaccggcccaggaagggccatgatgctggggaccacccccccatcacccccatgaagagcgccacagaagctgagctgggcggagatgcctggaggctgtatgagtacatcaccaggcacttcatcgccaccgtgtcccatgactgcaagtacctgcagagcaccatctccttcagaattggccctgagctgttcacctgcagcggcaagacagtgctgagccctggcttcacagaggtgatgccctggcagagcgtgcccctggaggagagcctgcccacctgccagagaggagatgccttccctgtgggggaggtgaagatgctggagaagcagaccaaccccccagactacctgacagaagctgagctgatcaccctgatggagaagcacggcatcggcacagatgccagcatccctgtgcacatcaacaacatctgccagaggaactacgtgacagtggagagcggccgccgcctgaagcccaccaacctgggcatcgtgctggtgcacggctactacaagattgatgctgagctggtgctgcccaccatccgctctgctgtggagaagcagctgaacctgattgcccagggcaaggctgactaccggcaggtgctgggccacaccctggatgtgttcaagaggaagttccactactttgtggacagcattgctggcatggatgagctgatggaggtgtccttcagccccctggccgccaccgggaagcccctgagccgctgtgggaagtgccaccgcttcatgaagtacatccaggccaagcccagccggctgcactgcagccactgtgatgagacctacaccctgccccagaatggcaccatcaagctgtacaaggagctgcgctgccccctggatgactttgagctggtgctgtggagcagcggcagccggggcaagagctaccccctgtgcccctactgctacaaccacccccccttccgggacatgaagaagggcatgggctgcaatgaatgtacccaccccagctgccagcacagcctgtccatgctgggcatcggccagtgtgtggagtgtgagagcggcgtgctggtgctggaccccaccagcggccccaagtggaaggtggcctgcaacaagtgcaatgtggtggcccactgctttgaaaatgcccaccgggtgcgggtgtctgctgacacctgcagcgtgtgtgaggccgccctgctggatgtggacttcaacaaggccaagagccccctgcctggagatgagacccagcacatgggctgtgtgttctgtgaccctgtgttccaggagctggtggagctgaagcacgccgccagctgccaccccatgcacagaggaggccctggaagacggcagggccggggccggggccgggcccggcggcccccaggcaagcccaacccccggcggcccaaggacaagatgtctgccctggccgcctactttgtgtag

SEQ ID NO: 22220 - DNA, 2589 bp, Artificial Sequence; identical to SEQ ID NO: 22219
  Description of Artificial Sequence: Synthetic coding sequence

SEQ ID NO: 22221 - DNA, 849 bp, Artificial Sequence
  Description of Artificial Sequence: Synthetic coding sequence
atgttcctgaacatgaccaagctggagaaggaggcccaggtggaggccaccagcaggaaggagaaggccaagcagaggcccctggccctgaacacagtggagatgctgcgggtggccagcagcagcctgggcatgggcccccagcacgccatgcagacagctgagcggctgtacacccagggctacatctcctaccccaggacagagaccacccactacccagaaaattttgacctgaagggcagcctgcggcagcaggccaaccacccctactgggccgacacagtgaagaggctgctggccgagggcatcaaccggcccaggaaaggacatgatgctggggaccacccccccatcacccccatgaagagcgccacagaggccgagctgggcggagatgcctggaggctgtatgagtacatcaccaggcacttcatcgccaccgtgtcccatgactgcaagtacctgcagagcaccatctccttccgcatcggccctgagctgttcacctgcagcggcaagacagtgctgagccctggcttcacagaggtgatgccctggcagagcgtgcccctggaggagagcctgcccacctgccagagaggagatgccttccctgtgggggaggtgaagatgctggagaagcagaccaaccccccagactacctgacagaggccgagctgatcaccctgatggagaagcatggaattggaggctgtgcctgccccggccccagggctggctctgtgagcagcacccaggccagcagcctgctgaccaagctgccccggcagccctgtgtgcccagccctgcccccctgcacggcctggtgtctggcaactggtag

SEQ ID NO: 22222 - DNA, 741 bp, Artificial Sequence
  Description of Artificial Sequence: Synthetic coding sequence
atgaagacagtgctgatggtggccgagaagcccagcctggcccagagcatcgccaagatcctgagccggggcagcctgagcagccacaagggcctgaatggagcctgcagcgtgcatgagtacacaggcacctttgctggccagcctgtgcgcttcaagatgacctctgtgtgtggccacgtgatgaccctggacttcctgggcaagtacaacaagtgggacaaggtggaccctgctgagctgttcagccaggcccccacagagaagaaggaggccaaccccaagctgaacatggtgaagttcctgcaggtggagggccggggctgtgactacatcgtgctgtggctggactgtgacaaggagggggagaacatctgctttgaggtgctggatgctgtgctgcctgtgatgaacaaggcccatggaggagagaagacagtgttccgggcccgcttcagcagcatcacagacacagacatctgcaatgccatggcctgcctgggggagccagaccacaatgaggccctgtctgtggatgcccggcaggagctggacctgcgcatcggctgtgccttcacccgcttccagaccaagtacttccagggcaagtacggggacctggacagcagcctcatcagctttggcccctgccagacccccaccctgggcttctgtgtggagagacatgacaagatccagagcttcaagccagagacctactgggtgctgcaggccaagtag

SEQ ID NO: 22223 - DNA, 366 bp, Artificial Sequence
  Description of Artificial Sequence: Synthetic coding sequence
atgaagacagtgctgatggtggccgagaagcccagcctggcccagagcatcgccaagatcctgagccggggcagcctgagcagccacaagggcctgaatggagcctgcagcgtgcatgagtacacaggcacctttgctggccagcctgtgcgcttcaagatgacctctgtgtgtggccacgtgatgaccctggacttcctgggcaagtacaacaagtgggacaaggtggaccctgctgagctgttcagccaggcccccacagagaagaaggaggccaaccccaagctgaacatggtgaagttcctgcaggtggagggccggggctgtgactacatcgtgctgtggctggactgtgacaaggagtag

SEQ ID NO: 22224 - DNA, 66 bp, Artificial Sequence
  Description of Artificial Sequence: Synthetic coding sequence
atgaagacagtgctgatggtggccgagaagcccagcctggcccagagcatcgccaagatcctgtag

SEQ ID NO: 22225 - DNA, 129 bp, Artificial Sequence
  Description of Artificial Sequence: Synthetic coding sequence
atgaagacagtgctgatggtggccgagaagcccagcctggcccagagcatcgccaagatcctgagccggggcagcctgagcagccacaagggcctgaatggagcctgcagcgtgcatgagtacacctag

SEQ ID NO: 22226 - DNA, 369 bp, Artificial Sequence
  Description of Artificial Sequence: Synthetic coding sequence
atgaagacagtgctgatggtggccgagaagcccagcctggcccagagcatcgccaagatcctgagccggggcagcctgagcagccacaagggcctgaatggagcctgcagcgtgcatgagtacacaggcacctttgctggccagcctgtgcgcttcaagatgacctctgtgtgtggccacgtgatgaccctggacttcctgggcaagtacaacaagtgggacaaggtggaccctgctgagctgttcagccaggcccccacagagaagaaggaggccaaccccaagctgaacatggtgaagttcctgcaggtggagggccggggctgtgactacatcgtgctgtggctggactgtgacaaggagggctag

SEQ ID NO: 22227 - DNA, 144 bp, Artificial Sequence
  Description of Artificial Sequence: Synthetic coding sequence
atgaagacagtgctgatggtggccgagaagcccagcctggcccagagcatcgccaagatcctgagccggggcagcctgagcagccacaagggcctgaatggagcctgcagcgtgcatgagtacacaggcacctttgctggatag

SEQ ID NO: 22228 - DNA, 399 bp, Artificial Sequence
  Description of Artificial Sequence: Synthetic coding sequence
atgaagacagtgctgatggtggccgagaagcccagcctggcccagagcatcgccaagatcctgagccggggcagcctgagcagccacaagggcctgaatggagcctgcagcgtgcatgagtacacaggcacctttgctggccagcctgtgcgcttcaagatgacctctgtgtgtggccacgtgatgaccctggacttcctgggcaagtacaacaagtgggacaaggtggaccctgctgagctgttcagccaggcccccacagagaagaaggaggccaaccccaagctgccccaggcctctgtgtgcacccaggccgcccctggggtgcggccccacccctgccccccagctgctgcccgggtggccgacagagtggtgccctgtggccctgtgacctag

SEQ ID NO: 22229 - DNA, 183 bp, Artificial Sequence
  Description of Artificial Sequence: Synthetic coding sequence
atgaagacagtgctgatggtggccgagaagcccagcctggcccagagcatcgccaagatcctgagccggggcagcctgagcagccacaagggcctgaatggagcctgcagcgtgcatgagtacacaggcacctttgctggccagcctgtgcgcttcaagatgacctctgtgtgtggccactag

SEQ ID NO: 22230 - DNA, 186 bp, Artificial Sequence
  Description of Artificial Sequence: Synthetic coding sequence
atgaagacagtgctgatggtggccgagaagcccagcctggcccagagcatcgccaagatcctgagccggggcagcctgagcagccacaagggcctgaatggagcctgcagcgtgcatgagtacacaggcacctttgctggccagcctgtgcgcttcaagatgacctctgtgtgtggccacgtgtag

SEQ ID NO: 22231 - DNA, 1578 bp, Artificial Sequence
  Description of Artificial Sequence: Synthetic coding sequence
tgactggacagcagcctcatcagctttggcccctgccagacccccaccctgggcttctgtgtggagagacatgacaagatccagagcttcaagccagagacctactgggtgctgcaggccaaggtgaacacagacaaggacaggagcctgctgctggactgggacagagtgcgggtgtttgaccgggagatcgcccagatgttcctgaacatgaccaagctggagaaggaggcccaggtggaggccaccagcaggaaggagaaggccaagcagaggcccctggccctgaacacagtggagatgctgcgggtggccagcagcagcctgggcatgggcccccagcacgccatgcagacagctgagcggctgtacacccagggctacatctcctaccccaggacagagaccacccactacccagaaaattttgacctgaagggcagcctgcggcagcaggccaaccacccctactgggccgacacagtgaagaggctgctggccgagggcatcaaccggcccaggaaaggacatgatgctggggaccacccccccatcacccccatgaagagcgccacagaggccgagctgggcggagatgcctggaggctgtatgagtacatcaccaggcacttcatcgccaccgtgtcccatgactgcaagtacctgcagagcaccatctccttccgcatcggccctgagctgttcacctgcagcggcaagacagtgctgagccctggcttcacagaggtgatgccctggcagagcgtgcccctggaggagagcctgcccacctgccagagaggagatgccttccctgtgggggaggtgaagatgctggagaagcagaccaaccccccagactacctgacagaggccgagctgatcaccctgatggagaagcatggaattggaacagatgccagcatccctgtgcacatcaacaacatctgccagagaaattatgtgacagtggagagcggccggcggctgaagcccaccaacctgggcatcgtgctggtgcacggctactacaagattgatgctgagctggtgctgcccaccatccgctctgctgtggagaagcagctgaacctgattgcccagggcaaggctgactaccggcaggtgctgggccacaccctggatgtgttcaagaggaagttccactactttgtggacagcattgctggcatggatgagctgatggaggtgtccttcagccccctggccgccaccgggaagcccctgagccgctgtgggaagtgccaccgcttcatgaagtacatccaggccaagcccagccggctgcactgcagccactgtgatgagacctacaccctgccccagaatggcaccatcaagctgtacaaggagctgcgctgccccctggatgactttgagctggtgctgtggagcagcggcagccggggcaagagctaccccctgtgcccctactgctacaaccacccccccttccgggacatgaagaagggagaatgtagccacagcctgctgagcacaggcagctgcagcctcttctctgtgcccaccccagccctgcaccaggccggcctgtag

SEQ ID NO: 22232 - DNA, 951 bp, Artificial Sequence
  Description of Artificial Sequence: Synthetic coding sequence
atgtctgctgaggtggagaccagcgagggcgtggatgagagcgagaagaagaacagcggggccctggagaaggagaaccagatgaggatggctgacctgtctgagctgctgaaggagggcaccaaggaggcccatgacagagctgagaacacccagtttgtgaaggacttcctgaagggcaacatcaagaaggagctgttcaagctggccaccacagccctgtacttcacctacagcgccctggaggaggagatggagaggaacaaggaccacccagcctttgcccccctgtacttccccatggagctgcacaggaaggaggccctgaccaaggacatggagtacttctttggagagaactgggaggagcaggtgcagtgccccaaggccgcccagaagtatgtggagcgcatccactacatcggccagaatgaacctgagctgctggtggcccacgcctacacccgctacatgggagacctgagcggcggccaggtgctgaagaaggtggcccagagggccctgaagctgcccagcactggagagggcacccagttctacctgtttgaaaatgtggacaatgcccagcagttcaagcagctgtaccgggccaggatgaatgccctggacctgaacatgaagaccaaggagagaattgtggaggaggccaacaaggcctttgagtacaacatgcagatcttcaatgagctggaccaggccggcagcaccctggcccgggagaccctggaggatggcttccctgtgcatgatggaaaaggagacatgaggaagtgccccttctatgctgctgagcaggacaagggggccctggagggcagcagctgccccttcagaacagccatggctgtgctgaggaagcccagcctgcagttcatcctggccgccggcgtggccctggccgccggcctgctggcctggtactacatgtag

SEQ ID NO: 22233 - DNA, 1716 bp, Artificial Sequence
  Description of Artificial Sequence: Synthetic coding sequence
atgaagtgccagcccaggtctggggcccggcgcatcgaggagcggctgcactacctgatcaccacctacctgaagtttggaaacaacaacaactacatgaacatggccgaggccaacaatgccttctttgctgccagcgagaccttccacacccccagcctgggagatgaggagtttgagatcccccccatcaccccacctcctgagagtgaccctgccctgggcatgccagatgtgctgctgcccttccaggccctgagtgaccccctgcccagccagggcagcgagttcaccccccagttccccccccagagcctggacctgcccagcatcaccatcagcaggaacctggtggagcaggatggagtgctgcacagcagcggcctgcacatggaccagagccacacccaggtgtcccagtaccggcaggaccccagcctcatcatgaggagcatcgtgcacatgacagatgctgcccggtctggagtgatgcccccagcccagctgaccaccatcaaccagagccagctgagcgcccagctgggcctgaacctgggcggggcctccatgccccacaccagccccagccccccagccagcaagagcgccacccccagccccagcagcagcatcaatgaggaggatgctgatgaggccaacagagccatcggggagaagagagctgccccagacagcggcaagaagcccaagacccccaagaagaagaagaagaaggaccccaatgagccccagaagcctgtgtctgcctatgccctcttcttccgggacacccaggccgccatcaagggccagaaccccaatgccacctttggagaggtgtccaagatcgtggcctccatgtgggacagcctgggggaggagcagaagcaggtgtacaagaggaagacagaagctgccaagaaggagtacctgaaggccctggccgcctaccgggccagcctggtgtccaaggctgctgctgagagcgctgaggcccagaccatccgctctgtgcagcagaccctggccagcaccaacctgaccagcagcctgctgctgaacacccccctgagccagcacggcaccgtgtctgccagcccccagaccctgcagcagagcctgcccaggagcatcgcccccaagcccctgaccatgaggctgcccatgaaccagatcgtgacctctgtgaccatcgccgccaacatgcccagcaacatcggggcccccctcatcagctccatgggcaccaccatggtgggcagcgcccccagcacccaggtgagccccagcgtgcagacccagcagcaccagatgcagctgcagcagcagcagcagcagcagcagcagcagatgcagcagatgcagcagcagcagctgcagcagcaccagatgcaccagcagatccagcagcagatgcagcagcagcacttccagcaccacatgcagcagcacctgcagcagcagcagcagcacctgcagcagcagatcaaccagcagcagctgcagcagcagctgcagcagaggctgcagctgcagcagctgcagcacatgcagcaccagagccagcccagcccccggcagcacagccctgtggccagccagatcaccagccccatcccagccatcggcagcccccagcctgccagccagcagcaccagagccagatccagagccagacccagacccaggtgctgagccaggtgtccatcttctag

SEQ ID NO: 22234 - DNA, 5817 bp, Artificial Sequence
  Description of Artificial Sequence: Synthetic coding sequence
atgcagagcttccgggagcagagcagctaccacggcaaccagcagagctacccccaggaggtgcacggcagcagccggctggaggagttcagcccccggcaggcccagatgttccagaactttggaggcaccggcggcagcagcggcagcagcggcagcggcagcggcggcggcagaagaggagctgctgctgctgctgctgccatggccagcgagaccagcggccaccagggctaccagggcttcaggaaggaggccggggacttctactacatggccggcaacaaggaccctgtgaccaccggcaccccccagcccccccagaggcggcccagcggccctgtgcagagctatggccccccccagggcagcagctttggaaaccagtatggcagcgagggccacgtgggccagttccaggcccagcacagcggcctgggcggcgtgagccactaccagcaggactacacaggccccttcagccctggcagcgcccagtaccagcagcaggccagcagccagcagcagcagcagcaggtgcagcagctgcggcagcagctgtaccagagccaccagcccctgccccaggccaccggccagcctgccagcagcagcagccacctgcagcccatgcagaggcccagcaccctgcccagcagcgctgctggctaccagctgcgggtgggccagtttggccagcactaccagagcagcgccagcagcagcagcagcagcagcttccccagcccccagcgcttcagccagagcggccagagctatgatggcagctacaacgtgaatgccggcagccagtatgagggccacaacgtgggcagcaatgcccaggcctacggcacccagagcaactacagctaccagccccagagcatgaagaactttgagcaggccaagatcccccagggcacccagcagggccagcagcagcagcagccccagcagcagcagcaccccagccagcacgtgatgcagtacaccaatgctgccaccaagctgcccctgcagagccaggtgggccagtacaaccagcctgaggtgcctgtgcgcagccccatgcagttccaccagaacttcagccccatcagcaaccccagccctgctgcctctgtggtgcagagccccagctgcagcagcacccccagccccctgatgcagacaggagagaacctgcagtgtggccagggctctgtgcccatgggcagcaggaaccgcatcctgcagctgatgccccagctgagccccacccccagcatgatgcccagccccaacagccacgccgccggcttcaagggcttcggcctggagggcgtgcctgagaagaggctgacagatcctggcctgagcagcctgagcgccctgagcacccaggtggccaacctgcccaacacagtgcagcacatgctgctgagtgatgccctgaccccccagaagaagaccagcaagaggcccagcagcagcaagaaggctgacagctgcaccaacagcgagggcagcagccagcctgaggagcagctgaagagccccatggccgagagcctggatggcggctgcagcagcagcagcgaggaccagggcgagcgggtgcggcagctgagcggccagagcaccagcagtgacaccacctacaagggcggggccagcgagaaggccggcagcagccctgcccagggcgcccagaatgagcccccccggctgaatgccagccctgctgcccgggaggaggccaccagccctggggccaaggacatgcccctgagcagtgatggcaaccccaaggtgaatgagaagacagtgggcgtgattgtgtcccgggaggccatgacaggccgggtggagaagccaggcggccaggacaagggcagccaggaggatgatcctgctgccacccagaggcctcccagcaatggaggagccaaggagaccagccacgccagcctgccccagcctgagcccccaggcggcggcggcagcaagggcaacaagaatggagacaacaacagcaaccacaacggggagggcaatggccagagcggccacagcgctgctggccctggcttcaccagcaggacagagcccagcaagagccctggcagcctgcgctacagctacaaggacagctttggatctgctgtgcccagaaatgtgtctggcttcccccagtaccccaccggccaggagaagggggacttcaccggccatggagagaggaaaggaagaaatgagaagttccccagcctgctgcaggaggtgctgcagggctaccaccaccacccagaccggcgctacagccgcagcacccaggagcaccagggcatggccggcagcctggagggcaccacccggcccaacgtgctggtgtcccagaccaatgagctggccagccggggcctgctgaacaagagcatcggcagcctgctggagaacccccactggggcccctgggagaggaagagcagcagcacagcccctgagatgaagcagatcaacctgacagactaccccatccccaggaagtttgaaattgagccccagagcagcgcccacgagcccggcggcagcctgtctgaaagaagaagtgtcatctgtgacatcagccccctgcggcagatcgtgcgggaccccggggcccacagcctgggccacatgtctgctgacacccgcatcggcagaaatgaccggctgaaccccaccctgagccagagcgtcatcctgcccggcggcctggtgtccatggagaccaagctgaagagccagagcggccagatcaaggaggaggactttgagcagagcaagagccaggccagcttcaacaacaagaagagcggggaccactgccaccccccatccatcaagcatgagagctacagaggaaatgccagccctggagctgccacccatgacagcctgagtgactatggcccccaggacagccggcccacccccatgagaagagtgcccggccgggtgggcggccgggagggcatgaggggccgcagccccagccagtaccatgactttgctgagaagctgaagatgagccctggccgcagccggggccctggaggagacccccaccacatgaacccccacatgaccttcagcgagcgggccaacagaagcagcctgcacacccccttcagccccaacagcgagaccctggccagcgcctaccacgccaacacccgggcccacgcctacggggaccccaatgccggcctgaacagccagctgcactacaagaggcagatgtaccagcagcagcctgaggagtacaaggactggagcagcggcagcgcccagggcgtgattgctgctgcccagcaccggcaggagggccccaggaagagcccccggcagcagcagttcctggacagagtgcgcagccccctgaagaatgacaaggatggcatgatgtatggcccccctgtgggcacctaccatgaccccagcgcccaggaggccggccgctgcctgatgagcagtgatggcctgcccaacaagggcatggagctgaagcacggcagccagaagctgcaggagagctgctgggacctgagccggcagaccagccctgccaagagcagcggccccccaggcatgagcagccagaagagatatggcccccctcatgaaacagatggccacggcctggccgaggccacccagagcagcaagccaggctctgtgatgctgcggctgcccggccaggaggaccacagcagccagaaccccctcatcatgagaagaagagtgcgctccttcatcagccccatccccagcaagaggcagagccaggatgtgaagaacagcagcacagaagataaaggccgcctgctgcacagcagcaaggagggcgctgacaaggccttcaacagctatgcccacctgagccacagccaggacatcaagagcatccccaagagggacagcagcaaggacctgcccagcccagacagcaggaactgcccagctgtgaccctgaccagccctgccaagaccaagatcctgccccccaggaagggccggggcctgaagctggaggccatcgtgcagaagatcaccagccccaacatcagaagaagtgccagcagcaacagcgctgaggccggcggggacacagtgaccctggatgacatcctgagcctgaagagcggccccccagagggcggctctgtggccgtgcaggatgctgacatcgagaagaggaaaggagaggtggccagtgacctggtgtccccagccaaccaggagctgcacgtggagaagcccctgcccaggagcagcgaggagtggaggggctctgtggatgacaaggtgaagacagagacccatgctgagaccgtgacagctgggaaggagcccccaggggccatgaccagcaccaccagccagaagccaggcagcaaccagggccgcccagatggcagcctgggcggcacagcccccctcatcttcccagacagcaagaatgtgccccctgtgggcatcctggcccctgaggccaaccccaaggccgaggagaaggaaaatgacacagtgaccatcagccccaagcaggagggcttcccccccaagggctacttccccagcggcaagaagaagggccggcccatcggctctgtgaacaagcagaagaagcagcagcagcccccacctcctccaccccagcccccccagatccctgagggcagcgcagatggagagcccaagcccaagaagcagaggcagaggcgggagaggaggaagccaggggcccagcccaggaagaggaagaccaagcaggccgtgcccatcgtggagccccaggagcctgagatcaagctgaagtatgccacccagcccctggacaagacagatgccaagaacaagagcttctacccctacatccacgtggtgaacaagtgtgagctgggcgctgtgtgcaccatcatcaatgctgaggaggaggagcagaccaagctggtgcggggcaggaagggccagaggagcctgaccccaccacccagcagcacagagagcaaggccctgcctgccagcagcttcatgctgcagggccctgtggtgacagagagctctgtgatgggccacctggtgtgctgcctgtgtgggaagtgggccagctacagaaacatgggagacctgtttggccccttctacccccaggactatgctgccaccctgcccaagaaccccccacccaagagggccacagagatgcagagcaaggtgaaggtgcgccacaagagcgccagcaatggcagcaagacagacacagaggaggaggaggagcagcagcagcagcagaaggagcagaggagcctggccgcccacccccgcttcaagaggaggcacagaagtgaggactgtggcggcggccccaggagcctgagccggggcctgccctgcaagaaggccgccacagagggcagcagcgagaagacagtgctggacagcaagcccagcgtgcccaccaccagcgagggcggccctgagctggagctgcagatccctgagctgcccctggacagcaatgagttctgggtgcatgagggctgcatcctgtgggccaacggcatctacctggtgtgtggccgcctgtatggcctgcaggaggccctggagatcgcccgggagatgaagtgcagccactgccaggaggccggggccaccctgggctgctacaacaagggctgcagcttccgctaccactacccctgtgccattgatgctgactgcctgctgcacgaggagaacttctctgtgcgctgccccaagcacaaggtgcggctgtggaggtag

SEQ ID NO: 22235 - DNA, 5883 bp, Artificial Sequence
  Description of Artificial Sequence: Synthetic coding sequence
atgcagagcttccgggagcagagcagctaccacggcaaccagcagagctacccccaggaggtgcacggcagcagccggctggaggagttcagcccccggcaggcccagatgttccagaactttggaggcaccggcggcagcagcggcagcagcggcagcggcagcggcggcggcagaagaggagctgctgctgctgctgctgccatggccagcgagaccagcggccaccagggctaccagggcttcaggaaggaggccggggacttctactacatggccggcaacaaggaccctgtgaccaccggcaccccccagcccccccagaggcggcccagcggccctgtgcagagctatggccccccccagggcagcagctttggaaaccagtatggcagcgagggccacgtgggccagttccaggcccagcacagcggcctgggcggcgtgagccactaccagcaggactacacaggccccttcagccctggcagcgcccagtaccagcagcaggccagcagccagcagcagcagcagcaggtgcagcagctgcggcagcagctgtaccagagccaccagcccctgccccaggccaccggccagcctgccagcagcagcagccacctgcagcccatgcagaggcccagcaccctgcccagcagcgctgctggctaccagctgcgggtgggccagtttggccagcactaccagagcagcgccagcagcagcagcagcagcagcttccccagcccccagcgcttcagccagagcggccagagctatgatggcagctacaacgtgaatgccggcagccagtatgagggccacaacgtgggcagcaatgcccaggcctacggcacccagagcaactacagctaccagccccagagcatgaagaactttgagcaggccaagatcccccagggcacccagcagggccagcagcagcagcagccccagcagcagcagcaccccagccagcacgtgatgcagtacaccaatgctgccaccaagctgcccctgcagagccaggtgggccagtacaaccagcctgaggtgcctgtgcgcagccccatgcagttccaccagaacttcagccccatcagcaaccccagccctgctgcctctgtggtgcagagccccagctgcagcagcacccccagccccctgatgcagacaggagagaacctgcagtgtggccagggctctgtgcccatgggcagcaggaaccgcatcctgcagctgatgccccagctgagccccacccccagcatgatgcccagccccaacagccacgccgccggcttcaagggcttcggcctggagggcgtgcctgagaagaggctgacagatcctggcctgagcagcctgagcgccctgagcacccaggtggccaacctgcccaacacagtgcagcacatgctgctgagtgatgccctgaccccccagaagaagaccagcaagaggcccagcagcagcaagaaggctgacagctgcaccaacagcgagggcagcagccagcctgaggagcagctgaagagccccatggccgagagcctggatggcggctgcagcagcagcagcgaggaccagggcgagcgggtgcggcagctgagcggccagagcaccagcagtgacaccacctacaagggcggggccagcgagaaggccggcagcagccctgcccagggcgcccagaatgagcccccccggctgaatgccagccctgctgcccgggaggaggccaccagccctggggccaaggacatgcccctgagcagtgatggcaaccccaaggtgaatgagaagacagtgggcgtgattgtgtcccgggaggccatgacaggccgggtggagaagccaggcggccaggacaagggcagccaggaggatgatcctgctgccacccagaggcctcccagcaatggaggagccaaggagaccagccacgccagcctgccccagcctgagcccccaggcggcggcggcagcaagggcaacaagaatggagacaacaacagcaaccacaacggggagggcaatggccagagcggccacagcgctgctggccctggcttcaccagcaggacagagcccagcaagagccctggcagcctgcgctacagctacaaggacagctttggatctgctgtgcccagaaatgtgtctggcttcccccagtaccccaccggccaggagaagggggacttcaccggccatggagagaggaaaggaagaaatgagaagttccccagcctgctgcaggaggtgctgcagggctaccaccaccacccagaccggcgctacagccgcagcacccaggagcaccagggcatggccggcagcctggagggcaccacccggcccaacgtgctggtgtcccagaccaatgagctggccagccggggcctgctgaacaagagcatcggcagcctgctggagaacccccactggggcccctgggagaggaagagcagcagcacagcccctgagatgaagcagatcaacctgacagactaccccatccccaggaagtttgaaattgagccccagagcagcgcccacgagcccggcggcagcctgtctgaaagaagaagtgtcatctgtgacatcagccccctgcggcagatcgtgcgggaccccggggcccacagcctgggccacatgtctgctgacacccgcatcggcagaaatgaccggctgaaccccaccctgagccagagcgtcatcctgcccggcggcctggtgtccatggagaccaagctgaagagccagagcggccagatcaaggaggaggactttgagcagagcaagagccaggccagcttcaacaacaagaagagcggggaccactgccaccccccatccatcaagcatgagagctacagaggaaatgccagccctggagctgccacccatgacagcctgagtgactatggcccccaggacagccggcccacccccatgagaagagtgcccggccgggtgggcggccgggagggcatgaggggccgcagccccagccagtaccatgactttgctgagaagctgaagatgagccctggccgcagccggggccctggaggagacccccaccacatgaacccccacatgaccttcagcgagcgggccaacagaagcagcctgcacacccccttcagccccaacagcgagaccctggccagcgcctaccacgccaacacccgggcccacgcctacggggaccccaatgccggcctgaacagccagctgcactacaagaggcagatgtaccagcagcagcctgaggagtacaaggactggagcagcggcagcgcccagggcgtgattgctgctgcccagcaccggcaggagggccccaggaagagcccccggcagcagcagttcctggacagagtgcgcagccccctgaagaatgacaaggatggcatgatgtatggcccccctgtgggcacctaccatgaccccagcgcccaggaggccggccgctgcctgatgagcagtgatggcctgcccaacaagggcatggagctgaagcacggcagccagaagctgcaggagagctgctgggacctgagccggcagaccagccctgccaagagcagcggccccccaggcatgagcagccagaagagatatggcccccctcatgaaacagatggccacggcctggccgaggccacccagagcagcaagccaggctctgtgatgctgcggctgcccggccaggaggaccacagcagccagaaccccctcatcatgagaagaagagtgcgctccttcatcagccccatccccagcaagaggcagagccaggatgtgaagaacagcagcacagaagataaaggccgcctgctgcacagcagcaaggagggcgctgacaaggccttcaacagctatgcccacctgagccacagccaggacatcaagagcatccccaagagggacagcagcaaggacctgcccagcccagacagcaggaactgcccagctgtgaccctgaccagccctgccaagaccaagatcctgccccccaggaagggccggggcctgaagctggaggccatcgtgcagaagatcaccagccccaacatcagaagaagtgccagcagcaacagcgctgaggccggcggggacacagtgaccctggatgacatcctgagcctgaagagcggccccccagagggcggctctgtggccgtgcaggatgctgacatcgagaagaggaaaggagaggtggccagtgacctggtgtccccagccaaccaggagctgcacgtggagaagcccctgcccaggagcagcgaggagtggaggggctctgtggatgacaaggtgaagacagagacccatgctgagaccgtgacagctgggaaggagcccccaggggccatgaccagcaccaccagccagaagccaggcagcaaccagggccgcccagatggcagcctgggcggcacagcccccctcatcttcccagacagcaagaatgtgccccctgtgggcatcctggcccctgaggccaaccccaaggccgaggagaaggaaaatgacacagtgaccatcagccccaagcaggagggcttcccccccaagggctacttccccagcggcaagaagaagggccggcccatcggctctgtgaacaagcagaagaagcagcagcagcccccacctcctccaccccagcccccccagatccctgagggcagcgcagatggagagcccaagcccaagaagcagaggcagaggcgggagaggaggaagccaggggcccagcccaggaagaggaagaccaagcaggccgtgcccatcgtggagccccaggagcctgagatcaagctgaagtatgccacccagcccctggacaagacagatgccaagaacaagagcttctacccctacatccacgtggtgaacaagtgtgagctgggcgctgtgtgcaccatcatcaatgctgaggaggaggagcagaccaagctggtgcggggcaggaagggccagaggagcctgaccccaccacccagcagcacagagagcaaggccctgcctgccagcagcttcatgctgcagggccctgtggtgacagagagctctgtgatgggccacctggtgtgctgcctgtgtgggaagtgggccagctacagaaacatgggagacctgtttggccccttctacccccaggactatgctgccaccctgcccaagaaccccccacccaagagggccacagagatgcagagcaaggtgaaggtgcgccacaagagcgccagcaatggcagcaagacagacacagaggaggaggaggagcagcagcagcagcagaaggagcagaggagcctggccgcccacccccgcttcaagaggaggcacagaagtgaggactgtggcggcggccccaggagcctgagccggggcctgccctgcaagaaggccgccacagagggcagcagcgagaagacagtgctggacagcaagcccagcgtgcccaccaccagcgagggcggccctgagctggagctgcagatccctgagctgcccctggacagcaatgagttctgggtgcatgagggctgcatcctgtgggccaacggcatctacctggtgtgtggccgcctgtatggcctgcaggaggccctggagatcgcccgggagatgaagtgcagccactgccaggaggccggggccaccctgggctgctacaacaagggctgcagcttccgctaccactacccctgtgccattgatgctgactgcctgctgcacgaggagaacttctctgtgcgctgccccaagcacaagccacccctgccctgccccctgccccccctgcagaacaagacagccaagggcagcctgagcacagagcagagcgagcggggctag

SEQ ID NO: 22236 - DNA, 540 bp, Artificial Sequence
  Description of Artificial Sequence: Synthetic coding sequence
atgagcacaggcagcctgagtgatgtggaggacctgcaggaggtggagatgctggagtgtgatggcctgaagatggacagcaacaaggagtttgtgaccagcaatgaaagcacagaggagagcagcaactgtgaaaatggcagcccccagaagggccggggcggcctgggcaagaggaggaaggcccccaccaagaagagccccctgagcggcgtgtcccaggagggcaagcaggtgcagagaaatgctgccaatgcccgggagcgggccaggatgagggtgctgagcaaggccttcagccggctgaagaccaccctgccctgggtgcccccagacaccaagctgagcaagctggacaccctgcggctggccagcagctacatcgcccacctgcggcagatcctggccaatgacaagtatgaaaatggctacatccaccctgtgaacctgacctggcccttcatggtggccggcaagccagagagtgacctgaaggaggtggtgacagccagccggctgtgtggcaccacagccagctag

SEQ ID NO: 22237 - DNA, 540 bp, Artificial Sequence; identical to SEQ ID NO: 22236
  Description of Artificial Sequence: Synthetic coding sequence

SEQ ID NO: 22238 - DNA, 1965 bp, Artificial Sequence
  Description of Artificial Sequence: Synthetic coding sequence
atgaaccagccccagaggatggcccctgtgggcacagacaaggagctgagtgacctgctggacttctccatgatgttccccctgcctgtgaccaacgggaagggccgcccagccagcctggccggggcccagtttggaggcagcggcctggaggaccggcccagcagcggctcctggggcagcggggaccagagcagcagcagctttgaccccagcaggaccttcagcgagggcacccacttcacagagagccacagcagcctgagcagcagcaccttcctgggccctggcctgggcggcaagagcggggagcggggggcctatgccagctttggaagagatgctggggtgggcggcctgacccaggccggcttcctgtctggagagctggccctgaacagccctggccccctgagccccagcggcatgaagggcaccagccagtactaccccagctacagcggcagcagcagaagaagagctgctgatggcagcctggacacccagcccaagaaggtgaggaaggtgcccccaggcctgcccagctctgtgtacccacccagcagtggagaagattatggaagagatgccacagcctaccccagcgccaagacccccagcagcacctacccagcccccttctacgtggctgatggcagcctgcaccccagcgctgagctgtggagccccccaggccaggccggcttcggccccatgctgggcggcggcagcagccccctgcccctgcccccaggcagcggccctgtgggcagcagcggcagcagcagcacctttggaggcctgcaccagcacgagaggatgggctaccagctgcatggagctgaggtgaatggaggcctgcccagcgccagcagcttcagcagcgcccctggggccacctatggaggagtgagcagccacaccccacctgtgtctggagctgacagcctgctgggcagccggggcaccacagctggcagcagtggagatgccctgggcaaggccctggccagcatctacagcccagaccacagcagcaacaacttcagcagcagccccagcacccctgtgggcagcccccagggcctggccggcaccagccagtggccccgggccggggcccctggggccctgagccccagctatgatggcggcctgcacggcctgcagagcaagattgaggaccacctggatgaggccatccacgtgctgcggagccatgctgtgggcacagctggggacatgcacaccctgctgcccggccacggggccctggccagcggcttcaccggccccatgagcctgggcggcagacatgctggcctggtgggcggcagccacccagaagatggcctggccggcagcaccagcctgatgcacaaccacgccgccctgcccagccagcccggcaccctgcctgacctgagccggcccccagacagctacagcggcctgggccgggccggggccacagctgctgccagcgagatcaagcgggaggagaaggaggatgaggagaacaccagcgctgctgaccacagcgaggaggagaagaaggagctgaaggccccccgggcccggaccagcccagatgaagatgaagatgacctgctgcccccagagcagaaggccgagcgggagaaggagcggcgggtggccaacaatgcccgggagcggctgcgggtgcgggacatcaatgaggccttcaaggagctgggccgcatgtgccagctgcacctgaacagcgagaagccccagaccaagctgctgatcctgcaccaggccgtgtctgtcatcctgaacctggagcagcaggtgcgggagaggaacctgaaccccaaggccgcctgcctgaagaggcgggaggaggagaaggtgtctggagtggtgggggacccccagatggtgctgagcgccccccaccctggcctgtctgaggcccacaacccagctggccacatgtag

SEQ ID NO: 22239 - DNA, 1956 bp, Artificial Sequence
  Description of Artificial Sequence: Synthetic coding sequence
atgaaccagccccagaggatggcccctgtgggcacagacaaggagctgagtgacctgctggacttctccatgatgttccccctgcctgtgaccaacgggaagggccgcccagccagcctggccggggcccagtttggaggcagcggcctggaggaccggcccagcagcggctcctggggcagcggggaccagagcagcagcagctttgaccccagcaggaccttcagcgagggcacccacttcacagagagccacagcagcctgagcagcagcaccttcctgggccctggcctgggcggcaagagcggggagcggggggcctatgccagctttggaagagatgctggggtgggcggcctgacccaggccggcttcctgtctggagagctggccctgaacagccctggccccctgagccccagcggcatgaagggcaccagccagtactaccccagctacagcggcagcagcagaagaagagctgctgatggcagcctggacacccagcccaagaaggtgaggaaggtgcccccaggcctgcccagctctgtgtacccacccagcagtggagaagattatggaagagatgccacagcctaccccagcgccaagacccccagcagcacctacccagcccccttctacgtggctgatggcagcctgcaccccagcgctgagctgtggagccccccaggccaggccggcttcggccccatgctgggcggcggcagcagccccctgcccctgcccccaggcagcggccctgtgggcagcagcggcagcagcagcacctttggaggcctgcaccagcacgagaggatgggctaccagctgcatggagctgaggtgaatggaggcctgcccagcgccagcagcttcagcagcgcccctggggccacctatggaggagtgagcagccacaccccacctgtgtctggagctgacagcctgctgggcagccggggcaccacagctggcagcagtggagatgccctgggcaaggccctggccagcatctacagcccagaccacagcagcaacaacttcagcagcagccccagcacccctgtgggcagcccccagggcctggccggcaccagccagtggccccgggccggggcccctggggccctgagccccagctatgatggcggcctgcacggcctgcagagcaagattgaggaccacctggatgaggccatccacgtgctgcggagccatgctgtgggcacagctggggacatgcacaccctgctgcccggccacggggccctggccagcggcttcaccggccccatgagcctgggcggcagacatgctggcctggtgggcggcagccacccagaagatggcctggccggcagcaccagcctgatgcacaaccacgccgccctgcccagccagcccggcaccctgcctgacctgagccggcccccagacagctacagcggcctgggccgggccggggccacagctgctgccagcgagatcaagcgggaggagaaggaggatgaggagaacaccagcgctgctgaccacagcgaggaggagaagaaggagctgaaggccccccgggcccggaccagcagcacagatgaggtgctgagcctggaggagaaggacctgcgggaccgggagaggaggatggccaacaatgcccgggagcgggtgcgggtgcgggacatcaatgaggccttccgggagctgggccgcatgtgccagatgcacctgaagagtgacaaggcccagaccaagctgctgatcctgcagcaggccgtgcaggtgatcctgggcctggagcagcaggtgcgggagaggaacctgaaccccaaggccgcctgcctgaagagaagagaggaggagaaggtgtctggagtggtgggggacccccagatggtgctgagcgccccccaccctggcctgtctgaggcccacaacccagctggccacatgtag

SEQ ID NO: 22240 - DNA, 1977 bp, Artificial Sequence
  Description of Artificial Sequence: Synthetic coding sequence
atgaaccagccccagaggatggcccctgtgggcacagacaaggagctgagtgacctgctggacttctccatgatgttccccctgcctgtgaccaacgggaagggccgcccagccagcctggccggggcccagtttggaggcagcggcaagtctggagagcggggggcctatgccagctttggaagagatgctggggtgggcggcctgacccaggccggcttcctgagcggggagctggccctgaacagccctggccccctgagccccagcggcatgaagggcaccagccagtactaccccagctacagcggcagcagcagaagaagagctgctgatggcagcctggacacccagcccaagaaggtgaggaaggtgcccccaggcctgcccagctctgtgtacccacccagcagcggggaggactatggaagagatgccacagcctaccccagcgccaagacccccagcagcacctacccagcccccttctacgtggctgatggcagcctgcaccccagcgctgagctgtggagccccccaggccaggccggcttcggccccatgctgggcggcggcagcagccccctgcccctgcccccaggcagcggccctgtgggcagcagcggcagcagcagcaccttcggcggcctgcaccagcacgagaggatgggctaccagctgcacggggctgaggtgaatggaggcctgcccagcgccagcagcttcagcagcgcccctggggccacctacggcggcgtgagcagccacaccccacctgtgtctggagctgacagcctgctgggcagccggggcaccacagctggcagcagtggagatgccctgggcaaggccctggccagcatctacagcccagaccacagcagcaacaacttcagcagcagccccagcacccctgtgggcagcccccagggcctggccggcaccagccagtggcccagggctggggcccctggggccctgagccccagctatgatggcggcctgcacggcctgcagagcaagattgaggaccacctggatgaggccatccacgtgctgcggagccatgctgtgggcacagctggggacatgcacaccctgctgcccggccatggagccctggccagcggcttcaccggccccatgagcctgggcggcagacatgctggcctggtgggcggcagccacccagaagatggcctggccggcagcaccagcctgatgcacaaccacgccgccctgcccagccagcccggcaccctgcctgacctgagccggcccccagacagctacagcggcctgggccgggccggggccacagctgctgccagcgagatcaagcgggaggagaaggaggatgaggagaacaccagcgctgctgaccacagcgaggaggagaagaaggagctgaaggccccccgggcccggacccgctgccagcccacccccaggcacagcccccccagcccccaccaggatgcccacgtgcaccggccccacgcccacaggacccacacaggccggcccagcgctggccccaccctcttcccccagccccactgcctgcccctggcccccagccggcggcccccccacagcccagatgaagatgaagatgacctgctgcccccagagcagaaggccgagcgggagaaggagcggcgggtggccaacaatgcccgggagcggctgcgggtgcgggacatcaatgaggccttcaaggagctgggccgcatgtgccagctgcacctgaacagcgagaagccccagaccaagctgctgatcctgcaccaggccgtgtctgtcatcctgaacctggagcagcaggtgcgggagaggaacctgaaccccaaggccgcctgcctgaagaggcgggaggaggagaaggtgtctggagtggtgggggacccccagatggtgctgagcgccccccaccctggcctgtctgaggcccacaacccagctggccacatgtag

SEQ ID NO: 22241 - DNA, 1956 bp, Artificial Sequence; identical to SEQ ID NO: 22239
  Description of Artificial Sequence: Synthetic coding sequence

SEQ ID NO: 22242 - DNA, 474 bp, Artificial Sequence
  Description of Artificial Sequence: Synthetic coding sequence
atgggctaccagctgcacggggctgaggtgaatggaggcctgcccagcgccagcagcttcagcagcgcccctggggccacctacggcggcgtgagcagccacaccccacctgtgtctggagctgacagcctgctgggcagccggggcaccacagctggcagcagtggagatgccctgggcaaggccctggccagcatctacagcccagaccacagcagcaacaacttcagcagcagccccagcacccctgtgggcagcccccagggcctggccggcaccagccagtggcccagggctggggcccctggggccctgagccccagctatgatggcggcctgcacggcctggtgggcggcagccacccagaagatggcctggccggcagcaccagcctgatgcacaaccacgccgccctgcccagccagcccggcaccctgcctgacctgagccggcccccagacagctacagctag

SEQ ID NO: 22243 - DNA, 2016 bp, Artificial Sequence
  Description of Artificial Sequence: Synthetic coding sequence
atgcaccaccagcagaggatggccgccctgggcacagacaaggagctgagtgacctgctggacttcagcgccatgttcagcccccctgtgagcagcggcaagaatggccccaccagcctggccagcggccacttcaccggcagcaatgtggaggacaggagcagcagcggctcctggggcaatggaggccaccccagccccagcagaaattatggagatggcaccccctatgaccacatgaccagccgggacctgggcagccatgacaacctgagccccccatttgtgaacagccgcatccagagcaagacagagcggggcagctacagcagctatggccgggagagcaacctgcagggctgccaccagcagagcctgctgggcggggacatggacatgggcaaccctggcaccctgagccccaccaagccaggcagccagtactaccagtacagcagcaacaacccccggcggcggcccctgcacagcagcgccatggaggtgcagaccaagaaggtgaggaaggtgcccccaggcctgcccagctctgtgtatgcccccagcgccagcacagctgactacaacagagacagccctggctaccccagcagcaagccagccaccagcaccttccccagcagcttcttcatgcaggacggccaccacagcagtgacccctggagcagcagcagcggcatgaaccagcccggctacgccggcatgctgggcaacagcagccacatcccccagagcagcagctactgcagcctgcacccccatgagcggctgagctaccccagccacagcagcgctgacatcaacagcagcctgccccccatgagcaccttccacaggagcggcaccaaccactacagcaccagcagctgcaccccaccagccaatggaacagacagcatcatggccaacagaggcagcggggctgctggcagcagccagacaggagatgccctgggcaaggccctggccagcatctacagcccagaccacaccaacaacagcttcagcagcaaccccagcacccctgtgggcagcccccccagcctgtctgctggaacagctgtgtggagcagaaatggaggccaggccagcagcagccccaactatgagggccccctgcacagcctgcagagcagaattgaagatcggctggagcggctggatgatgccatccacgtgctgagaaatcatgctgtgggccccagcacagccatgcctgggggccatggagacatgcacggcatcatcggccccagccacaatggagccatgggcggcctgggcagcggctatggaacaggcctgctgagcgccaacagacacagcctgatggtgggcacccaccgggaggatggagtggccctgcggggcagccacagcctgctgcccaaccaggtgcctgtgccccagctgcctgtgcagagcgccaccagcccagacctgaaccccccccaggacccctaccggggcatgcctcctggcctgcagggccagagcgtgagcagcggcagcagcgagatcaagagtgatgatgaaggagatgagaacctgcaggacaccaagagcagcgaggacaagaagctggatgatgacaagaaggacatcaagagcatcaccaggagccgcagcagcaacaatgatgatgaggacctgaccccagagcagaaggccgagcgggagaaggagaggaggatggccaacaatgcccgggagcggctgcgggtgcgggacatcaatgaggccttcaaggagctgggccgcatggtgcagctgcacctgaagagtgacaagccccagaccaagctgctgatcctgcaccaggccgtggccgtcatcctgagcctggagcagcaggtgcgggagaggaacctgaaccccaaggccgcctgcctgaagagaagagaggaggagaaggtgtcctctgagcccccacccctgagcctggccggcccccaccctggcatgggagatgccagcaaccacatgggccagatgtag

SEQ ID NO: 22244 - DNA, 2004 bp, Artificial Sequence
  Description of Artificial Sequence: Synthetic coding sequence
atgcaccaccagcagaggatggccgccctgggcacagacaaggagctgagtgacctgctggacttcagcgccatgttcagcccccctgtgagcagcggcaagaatggccccaccagcctggccagcggccacttcaccggcagcaatgtggaggacaggagcagcagcggctcctggggcaatggaggccaccccagccccagcagaaattatggagatggcaccccctatgaccacatgaccagccgggacctgggcagccatgacaacctgagccccccatttgtgaacagccgcatccagagcaagacagagcggggcagctacagcagctatggccgggagagcaacctgcagggctgccaccagcagagcctgctgggcggggacatggacatgggcaaccctggcaccctgagccccaccaagccaggcagccagtactaccagtacagcagcaacaacccccggcggcggcccctgcacagcagcgccatggaggtgcagaccaagaaggtgaggaaggtgcccccaggcctgcccagctctgtgtatgcccccagcgccagcacagctgactacaacagagacagccctggctaccccagcagcaagccagccaccagcaccttccccagcagcttcttcatgcaggacggccaccacagcagtgacccctggagcagcagcagcggcatgaaccagcccggctacgccggcatgctgggcaacagcagccacatcccccagagcagcagctactgcagcctgcacccccatgagcggctgagctaccccagccacagcagcgctgacatcaacagcagcctgccccccatgagcaccttccacaggagcggcaccaaccactacagcaccagcagctgcaccccaccagccaatggaacagacagcatcatggccaacagaggcagcggggctgctggcagcagccagacaggagatgccctgggcaaggccctggccagcatctacagcccagaccacaccaacaacagcttcagcagcaaccccagcacccctgtgggcagcccccccagcctgtctgctggaacagctgtgtggagcagaaatggaggccaggccagcagcagccccaactatgagggccccctgcacagcctgcagagcagaattgaagatcggctggagcggctggatgatgccatccacgtgctgagaaatcatgctgtgggccccagcacagccatgcctgggggccatggagacatgcacggcatcatcggccccagccacaatggagccatgggcggcctgggcagcggctatggaacaggcctgctgagcgccaacagacacagcctgatggtgggcacccaccgggaggatggagtggccctgcggggcagccacagcctgctgcccaaccaggtgcctgtgccccagctgcctgtgcagagcgccaccagcccagacctgaaccccccccaggacccctaccggggcatgcctcctggcctgcagggccagagcgtgagcagcggcagcagcgagatcaagagtgatgatgaaggagatgagaacctgcaggacaccaagagcagcgaggacaagaagctggatgatgacaagaaggacatcaagagcatcaccagcaacaatgatgatgaggacctgaccccagagcagaaggccgagcgggagaaggagaggaggatggccaacaatgcccgggagcggctgcgggtgcgggacatcaatgaggccttcaaggagctgggccgcatggtgcagctgcacctgaagagtgacaagccccagaccaagctgctgatcctgcaccaggccgtggccgtcatcctgagcctggagcagcaggtgcgggagaggaacctgaaccccaaggccgcctgcctgaagagaagagaggaggagaaggtgtcctctgagcccccacccctgagcctggccggcccccaccctggcatgggagatgccagcaaccacatgggccagatgtag

SEQ ID NO: 22245 - DNA, 2322 bp, Artificial Sequence
  Description of Artificial Sequence: Synthetic coding sequence
atgttcagcaagaggctggagaagatcgcccaggtgcccctgctcttccccttcatcttcatcatcctgaccaactacagcaagatggagggcgctgtggagagccagcccagcttcttcaagaccagccaggacatcgtgacctgcacctgggtggagaactgctacagcagcttcagcagaagacccctggagcagatgttctgcaagcaccagagcaagaacatcatctcctggacaggcatggtggcccacacctgcaaccccagcaccctgggcggccagggcctgtgtgactttgccaagatgcaccaccagcagaggatggccgccctgggcacagacaaggagctgagtgacctgctggacttcagcgccatgttcagcccccctgtgagcagcggcaagaatggccccaccagcctggccagcggccacttcaccggcagcaatgtggaggacaggagcagcagcggctcctggggcaatggaggccaccccagccccagcagaaattatggagatggcaccccctatgaccacatgaccagccgggacctgggcagccatgacaacctgagccccccatttgtgaacagccgcatccagagcaagacagagcggggcagctacagcagctatggccgggagagcaacctgcagggctgccaccagcagagcctgctgggcggggacatggacatgggcaaccctggcaccctgagccccaccaagccaggcagccagtactaccagtacagcagcaacaacccccggcggcggcccctgcacagcagcgccatggaggtgcagaccaagaaggtgaggaaggtgcccccaggcctgcccagctctgtgtatgcccccagcgccagcacagctgactacaacagagacagccctggctaccccagcagcaagccagccaccagcaccttccccagcagcttcttcatgcaggacggccaccacagcagtgacccctggagcagcagcagcggcatgaaccagcccggctacgccggcatgctgggcaacagcagccacatcccccagagcagcagctactgcagcctgcacccccatgagcggctgagctaccccagccacagcagcgctgacatcaacagcagcctgccccccatgagcaccttccacaggagcggcaccaaccactacagcaccagcagctgcaccccaccagccaatggaacagacagcatcatggccaacagaggcagcggggctgctggcagcagccagacaggagatgccctgggcaaggccctggccagcatctacagcccagaccacaccaacaacagcttcagcagcaaccccagcacccctgtgggcagcccccccagcctgtctgctggaacagctgtgtggagcagaaatggaggccaggccagcagcagccccaactatgagggccccctgcacagcctgcagagcagaattgaagatcggctggagcggctggatgatgccatccacgtgctgagaaatcatgctgtgggccccagcacagccatgcctgggggccatggagacatgcacggcatcatcggccccagccacaatggagccatgggcggcctgggcagcggctatggaacaggcctgctgagcgccaacagacacagcctgatggtgggcacccaccgggaggatggagtggccctgcggggcagccacagcctgctgcccaaccaggtgcctgtgccccagctgcctgtgcagagcgccaccagcccagacctgaaccccccccaggacccctaccggggcatgcctcctggcctgcagggccagagcgtgagcagcggcagcagcgagatcaagagtgatgatgaaggagatgagaacctgcaggacaccaagagcagcgaggacaagaagctggatgatgacaagaaggacatcaagagcatcaccaggagccgcagcagcaacaatgatgatgaggacctgaccccagagcagaaggccgagcgggagaaggagaggaggatggccaacaatgcccgggagcggctgcgggtgcgggacatcaatgaggccttcaaggagctgggccgcatggtgcagctgcacctgaagagtgacaagccccagaccaagctgctgatcctgcaccaggccgtggccgtcatcctgagcctggagcagcaggtgcgggagaggaacctgaaccccaaggccgcctgcctgaagagaagagaggaggagaaggtgtcctctgagcccccacccctgagcctggccggcccccaccctggcatgggagatgccagcaaccacatgggccagatgtag

SEQ ID NO: 22246 - DNA, 1536 bp, Artificial Sequence
  Description of Artificial Sequence: Synthetic coding sequence
atgtactgtgcctacaccatccctggcatgggcggcaacagcctgatgtactactacaacgggaaggctgtgtatgcccccagcgccagcacagctgactacaacagagacagccctggctaccccagcagcaagccagccaccagcaccttccccagcagcttcttcatgcaggacggccaccacagcagtgacccctggagcagcagcagcggcatgaaccagcccggctacgccggcatgctgggcaacagcagccacatcccccagagcagcagctactgcagcctgcacccccatgagcggctgagctaccccagccacagcagcgctgacatcaacagcagcctgccccccatgagcaccttccacaggagcggcaccaaccactacagcaccagcagctgcaccccaccagccaatggaacagacagcatcatggccaacagaggcagcggggctgctggcagcagccagacaggagatgccctgggcaaggccctggccagcatctacagcccagaccacaccaacaacagcttcagcagcaaccccagcacccctgtgggcagcccccccagcctgtctgctggaacagctgtgtggagcagaaatggaggccaggccagcagcagccccaactatgagggccccctgcacagcctgcagagcagaattgaagatcggctggagcggctggatgatgccatccacgtgctgagaaatcatgctgtgggccccagcacagccatgcctgggggccatggagacatgcacggcatcatcggccccagccacaatggagccatgggcggcctgggcagcggctatggaacaggcctgctgagcgccaacagacacagcctgatggtgggcacccaccgggaggatggagtggccctgcggggcagccacagcctgctgcccaaccaggtgcctgtgccccagctgcctgtgcagagcgccaccagcccagacctgaaccccccccaggacccctaccggggcatgcctcctggcctgcagggccagagcgtgagcagcggcagcagcgagatcaagagtgatgatgaaggagatgagaacctgcaggacaccaagagcagcgaggacaagaagctggatgatgacaagaaggacatcaagagcatcaccaggagccgcagcagcaacaatgatgatgaggacctgaccccagagcagaaggccgagcgggagaaggagaggaggatggccaacaatgcccgggagcggctgcgggtgcgggacatcaatgaggccttcaaggagctgggccgcatggtgcagctgcacctgaagagtgacaagccccagaccaagctgctgatcctgcaccaggccgtggccgtcatcctgagcctggagcagcaggtgcgggagaggaacctgaaccccaaggccgcctgcctgaagagaagagaggaggagaaggtgtcctctgagcccccacccctgagcctggccggcccccaccctggcatgggagatgccagcaaccacatgggccagatgtag

SEQ ID NO: 22247 - DNA, 1944 bp, Artificial Sequence
  Description of Artificial Sequence: Synthetic coding sequence
atgttcagcccccctgtgagcagcggcaagaatggccccaccagcctggccagcggccacttcaccggcagcaatgtggaggacaggagcagcagcggctcctggggcaatggaggccaccccagccccagcagaaattatggagatggcaccccctatgaccacatgaccagccgggacctgggcagccatgacaacctgagccccccatttgtgaacagccgcatccagagcaagacagagcggggcagctacagcagctatggccgggagagcaacctgcagggctgccaccagcagagcctgctgggcggggacatggacatgggcaaccctggcaccctgagccccaccaagccaggcagccagtactaccagtacagcagcaacaacccccggcggcggcccctgcacagcagcgccatggaggtgcagaccaagaaggtgaggaaggtgcccccaggcctgcccagctctgtgtatgcccccagcgccagcacagctgactacaacagagacagccctggctaccccagcagcaagccagccaccagcaccttccccagcagcttcttcatgcaggacggccaccacagcagtgacccctggagcagcagcagcggcatgaaccagcccggctacgccggcatgctgggcaacagcagccacatcccccagagcagcagctactgcagcctgcacccccatgagcggctgagctaccccagccacagcagcgctgacatcaacagcagcctgccccccatgagcaccttccacaggagcggcaccaaccactacagcaccagcagctgcaccccaccagccaatggaacagacagcatcatggccaacagaggcagcggggctgctggcagcagccagacaggagatgccctgggcaaggccctggccagcatctacagcccagaccacaccaacaacagcttcagcagcaaccccagcacccctgtgggcagcccccccagcctgtctgctggaacagctgtgtggagcagaaatggaggccaggccagcagcagccccaactatgagggccccctgcacagcctgcagagcagaattgaagatcggctggagcggctggatgatgccatccacgtgctgagaaatcatgctgtgggccccagcacagccatgcctgggggccatggagacatgcacggcatcatcggccccagccacaatggagccatgggcggcctgggcagcggctatggaacaggcctgctgagcgccaacagacacagcctgatggtgggcacccaccgggaggatggagtggccctgcggggcagccacagcctgctgcccaaccaggtgcctgtgccccagctgcctgtgcagagcgccaccagcccagacctgaaccccccccaggacccctaccggggcatgcctcctggcctgcagggccagagcgtgagcagcggcagcagcgagatcaagagtgatgatgaaggagatgagaacctgcaggacaccaagagcagcgaggacaagaagctggatgatgacaagaaggacatcaagagcatcaccaggagccgcagcagcaacaatgatgatgaggacctgaccccagagcagaaggccgagcgggagaaggagaggaggatggccaacaatgcccgggagcggctgcgggtgcgggacatcaatgaggccttcaaggagctgggccgcatggtgcagctgcacctgaagagtgacaagccccagaccaagctgctgatcctgcaccaggccgtggccgtcatcctgagcctggagcagcaggtgcgggagaggaacctgaaccccaaggccgcctgcctgaagagaagagaggaggagaaggtgtcctctgagcccccacccctgagcctggccggcccccaccctggcatgggagatgccagcaaccacatgggccagatgtag

SEQ ID NO: 22248 - DNA, 1614 bp, Artificial Sequence
  Description of Artificial Sequence: Synthetic coding sequence
atggacatgggcaaccctggcaccctgagccccaccaagccaggcagccagtactaccagtacagcagcaacaacccccggcggcggcccctgcacagcagcgccatggaggtgcagaccaagaaggtgaggaaggtgcccccaggcctgcccagctctgtgtatgcccccagcgccagcacagctgactacaacagagacagccctggctaccccagcagcaagccagccaccagcaccttccccagcagcttcttcatgcaggacggccaccacagcagtgacccctggagcagcagcagcggcatgaaccagcccggctacgccggcatgctgggcaacagcagccacatcccccagagcagcagctactgcagcctgcacccccatgagcggctgagctaccccagccacagcagcgctgacatcaacagcagcctgccccccatgagcaccttccacaggagcggcaccaaccactacagcaccagcagctgcaccccaccagccaatggaacagacagcatcatggccaacagaggcagcggggctgctggcagcagccagacaggagatgccctgggcaaggccctggccagcatctacagcccagaccacaccaacaacagcttcagcagcaaccccagcacccctgtgggcagcccccccagcctgtctgctggaacagctgtgtggagcagaaatggaggccaggccagcagcagccccaactatgagggccccctgcacagcctgcagagcagaattgaagatcggctggagcggctggatgatgccatccacgtgctgagaaatcatgctgtgggccccagcacagccatgcctgggggccatggagacatgcacggcatcatcggccccagccacaatggagccatgggcggcctgggcagcggctatggaacaggcctgctgagcgccaacagacacagcctgatggtgggcacccaccgggaggatggagtggccctgcggggcagccacagcctgctgcccaaccaggtgcctgtgccccagctgcctgtgcagagcgccaccagcccagacctgaaccccccccaggacccctaccggggcatgcctcctggcctgcagggccagagcgtgagcagcggcagcagcgagatcaagagtgatgatgaaggagatgagaacctgcaggacaccaagagcagcgaggacaagaagctggatgatgacaagaaggacatcaagagcatcaccagcaacaatgatgatgaggacctgaccccagagcagaaggccgagcgggagaaggagaggaggatggccaacaatgcccgggagcggctgcgggtgcgggacatcaatgaggccttcaaggagctgggccgcatggtgcagctgcacctgaagagtgacaagccccagaccaagctgctgatcctgcaccaggccgtggccgtcatcctgagcctggagcagcaggtgcgggagaggaacctgaaccccaaggccgcctgcctgaagagaagagaggaggagaaggtgtcctctgagcccccacccctgagcctggccggcccccaccctggcatgggagatgccagcaaccacatgggccagatgtag

SEQ ID NO: 22249 - DNA, 1932 bp, Artificial Sequence
  Description of Artificial Sequence: Synthetic coding sequence
atgttcagcccccctgtgagcagcggcaagaatggccccaccagcctggccagcggccacttcaccggcagcaatgtggaggacaggagcagcagcggctcctggggcaatggaggccaccccagccccagcagaaattatggagatggcaccccctatgaccacatgaccagccgggacctgggcagccatgacaacctgagccccccatttgtgaacagccgcatccagagcaagacagagcggggcagctacagcagctatggccgggagagcaacctgcagggctgccaccagcagagcctgctgggcggggacatggacatgggcaaccctggcaccctgagccccaccaagccaggcagccagtactaccagtacagcagcaacaacccccggcggcggcccctgcacagcagcgccatggaggtgcagaccaagaaggtgaggaaggtgcccccaggcctgcccagctctgtgtatgcccccagcgccagcacagctgactacaacagagacagccctggctaccccagcagcaagccagccaccagcaccttccccagcagcttcttcatgcaggacggccaccacagcagtgacccctggagcagcagcagcggcatgaaccagcccggctacgccggcatgctgggcaacagcagccacatcccccagagcagcagctactgcagcctgcacccccatgagcggctgagctaccccagccacagcagcgctgacatcaacagcagcctgccccccatgagcaccttccacaggagcggcaccaaccactacagcaccagcagctgcaccccaccagccaatggaacagacagcatcatggccaacagaggcagcggggctgctggcagcagccagacaggagatgccctgggcaaggccctggccagcatctacagcccagaccacaccaacaacagcttcagcagcaaccccagcacccctgtgggcagcccccccagcctgtctgctggaacagctgtgtggagcagaaatggaggccaggccagcagcagccccaactatgagggccccctgcacagcctgcagagcagaattgaagatcggctggagcggctggatgatgccatccacgtgctgagaaatcatgctgtgggccccagcacagccatgcctgggggccatggagacatgcacggcatcatcggccccagccacaatggagccatgggcggcctgggcagcggctatggaacaggcctgctgagcgccaacagacacagcctgatggtgggcacccaccgggaggatggagtggccctgcggggcagccacagcctgctgcccaaccaggtgcctgtgccccagctgcctgtgcagagcgccaccagcccagacctgaaccccccccaggacccctaccggggcatgcctcctggcctgcagggccagagcgtgagcagcggcagcagcgagatcaagagtgatgatgaaggagatgagaacctgcaggacaccaagagcagcgaggacaagaagctggatgatgacaagaaggacatcaagagcatcaccagcaacaatgatgatgaggacctgaccccagagcagaaggccgagcgggagaaggagaggaggatggccaacaatgcccgggagcggctgcgggtgcgggacatcaatgaggccttcaaggagctgggccgcatggtgcagctgcacctgaagagtgacaagccccagaccaagctgctgatcctgcaccaggccgtggccgtcatcctgagcctggagcagcaggtgcgggagaggaacctgaaccccaaggccgcctgcctgaagagaagagaggaggagaaggtgtcctctgagcccccacccctgagcctggccggcccccaccctggcatgggagatgccagcaaccacatgggccagatgtag

SEQ ID NO: 22250 - DNA, 1878 bp, Artificial Sequence
  Description of Artificial Sequence: Synthetic coding sequence
atggaggaggacagcagagatgtggaggacaggagcagcagcggctcctggggcaatggaggccaccccagccccagcagaaattatggagatggcaccccctatgaccacatgaccagccgggacctgggcagccatgacaacctgagccccccatttgtgaacagccgcatccagagcaagacagagcggggcagctacagcagctatggccgggagagcaacctgcagggctgccaccagcagagcctgctgggcggggacatggacatgggcaaccctggcaccctgagccccaccaagccaggcagccagtactaccagtacagcagcaacaacccccggcggcggcccctgcacagcagcgccatggaggtgcagaccaagaaggtgaggaaggtgcccccaggcctgcccagctctgtgtatgcccccagcgccagcacagctgactacaacagagacagccctggctaccccagcagcaagccagccaccagcaccttccccagcagcttcttcatgcaggacggccaccacagcagtgacccctggagcagcagcagcggcatgaaccagcccggctacgccggcatgctgggcaacagcagccacatcccccagagcagcagctactgcagcctgcacccccatgagcggctgagctaccccagccacagcagcgctgacatcaacagcagcctgccccccatgagcaccttccacaggagcggcaccaaccactacagcaccagcagctgcaccccaccagccaatggaacagacagcatcatggccaacagaggcagcggggctgctggcagcagccagacaggagatgccctgggcaaggccctggccagcatctacagcccagaccacaccaacaacagcttcagcagcaaccccagcacccctgtgggcagcccccccagcctgtctgctggaacagctgtgtggagcagaaatggaggccaggccagcagcagccccaactatgagggccccctgcacagcctgcagagcagaattgaagatcggctggagcggctggatgatgccatccacgtgctgagaaatcatgctgtgggccccagcacagccatgcctgggggccatggagacatgcacggcatcatcggccccagccacaatggagccatgggcggcctgggcagcggctatggaacaggcctgctgagcgccaacagacacagcctgatggtgggcacccaccgggaggatggagtggccctgcggggcagccacagcctgctgcccaaccaggtgcctgtgccccagctgcctgtgcagagcgccaccagcccagacctgaaccccccccaggacccctaccggggcatgcctcctggcctgcagggccagagcgtgagcagcggcagcagcgagatcaagagtgatgatgaaggagatgagaacctgcaggacaccaagagcagcgaggacaagaagctggatgatgacaagaaggacatcaagagcatcaccagcaacaatgatgatgaggacctgaccccagagcagaaggccgagcgggagaaggagaggaggatggccaacaatgcccgggagcggctgcgggtgcgggacatcaatgaggccttcaaggagctgggccgcatggtgcagctgcacctgaagagtgacaagccccagaccaagctgctgatcctgcaccaggccgtggccgtcatcctgagcctggagcagcaggtgcgggagaggaacctgaaccccaaggccgcctgcctgaagagaagagaggaggagaaggtgtcctctgagcccccacccctgagcctggccggcccccaccctggcatgggagatgccagcaaccacatgggccagatgtag

SEQ ID NO: 22251 - DNA, 1803 bp, Artificial Sequence
  Description of Artificial Sequence: Synthetic coding sequence
atgaaggacatcttcttccagttcatcatcgcccgggtgaggaagtgctacagcctgagctgcctgcacaccctgcctgtggtgcccaccctgaggaagacagagcggggcagctacagcagctatggccgggagagcaacctgcagggctgccaccagagcctgctgggcggggacatggacatgggcaaccctggcaccctgagccccaccaagccaggcagccagtactaccagtacagcagcaacaaccccaggagaagacccctgcacagcagcgccatggaggtgcagaccaagaaggtgaggaaggtgcccccaggcctgcccagctctgtgtatgcccccagcgccagcacagctgactacaacagagacagccctggctaccccagcagcaagccagccaccagcaccttccccagcagcttcttcatgcaggacggccaccacagcagtgacccctggagcagcagcagcggcatgaaccagcccggctacgccggcatgctgggcaacagcagccacatcccccagagcagcagctactgcagcctgcacccccatgagcggctgagctaccccagccacagcagcgctgacatcaacagcagcctgccccccatgagcaccttccacaggagcggcaccaaccactacagcaccagcagctgcaccccaccagccaacggcacagacagcatcatggccaacagaggcagcggggccgccggcagcagccagacaggagatgccctgggcaaggccctggccagcatctacagcccagaccacaccaacaacagcttcagcagcaaccccagcacccctgtgggcagcccccccagcctgtctgctggaacagctgtgtggagcagaaatggaggccaggccagcagcagccccaactatgagggccccctgcacagcctgcagagcagaattgaggaccggctggagcggctggatgatgccatccacgtgctgaggaaccacgctgtgggccccagcacagccatgcctgggggccacggggacatgcacggcatcatcggccccagccacaacggggccatgggcggcctgggcagcggctacggcaccggcctgctgagcgccaacagacacagcctgatggtgggcacccacagagaagatggagtggccctgcggggcagccacagcctgctgcccaaccaggtgcctgtgccccagctgcctgtgcagagcgccaccagcccagacctgaaccccccccaggacccctaccggggcatgcctcctggcctgcagggccagagcgtgagcagcggcagcagcgagatcaagagtgatgatgaaggagatgagaacctgcaggacaccaagagcagcgaggacaagaagctggatgatgacaagaaggacatcaagagcatcaccaggagccgcagcagcaacaatgatgatgaggacctgaccccagagcagaaggccgagcgggagaaggagaggaggatggccaacaatgcccgggagcggctgcgggtgcgggacatcaatgaggccttcaaggagctgggccgcatggtgcagctgcacctgaagagtgacaagccccagaccaagctgctgatcctgcaccaggccgtggccgtcatcctgagcctggagcagcaggtgcgggagaggaacctgaaccccaaggccgcctgcctgaagaggcgggaggaggagaaggtgagcagcgagcccccacccctgagcctggccggcccccaccctggcatgggagatgccagcaaccacatgggccagatgtag

SEQ ID NO: 22252 - DNA, 1233 bp, Artificial Sequence
  Description of Artificial Sequence: Synthetic coding sequence
atggccaaggatgctggcctcatcgaggccaatggagagctgaaggtgttcatcgaccagaacctgagccctgggaagggcgtggtgtccctggtggccgtgcaccccagcacagtgaaccccctgggcaagcagctgctgcccaagaccttcggccagagcaatgtgaacatcgcccagcaggtggtgattggcaccccccagaggcctgctgccagcaacaccctggtggtgggcagcccccacacccccagcacccactttgccagccagaaccagcccagcgacagcagcccctggagcgctgggaagaggaacaggaagggggagaagaatggcaagggcctgcggcacttctccatgaaggtgtgtgagaaggtgcagaggaagggcaccaccagctacaatgaggtggctgatgagctggtggccgagttctctgctgctgacaaccacatcctgcccaatgaaagtgcctatgaccagaagaacatcagaagaagagtgtatgatgccctgaatgtgctgatggccatgaacatcatcagcaaggagaagaaggagatcaagtggattggcctgcccaccaacagcgcccaggagtgccagaacctggaggtggagcggcagaggcggctggagcgcatcaagcagaagcagagccagctgcaggagctgatcctgcagcagatcgccttcaagaacctggtgcagaggaacagacatgctgagcagcaggccagccggcccccaccacccaacagcgtcatccacctgcccttcatcatcgtgaacaccagcaagaagacagtcatcgactgcagcatcagcaatgacaagtttgagtacctgttcaactttgacaacacctttgagatccatgatgacatcgaggtgctgaagaggatgggcatggcctgtggcctggagagcggcagctgcagcgctgaggacctgaagatggcccggagcctggtgcccaaggccctggagccctacgtgacagagatggcccagggcaccgtgggcggcgtcttcatcaccacagctggcagcaccagcaatggcacccgcttcagcgccagtgacctgaccaacggggctgatggcatgctggccaccagcagcaatggcagccagtacagcggcagccgggtggagacccctgtgtcctatgtgggagaagatgatgaagaagatgatgacttcaatgaaaatgatgaagatgactag

SEQ ID NO: 22253 - DNA, 711 bp, Artificial Sequence
  Description of Artificial Sequence: Synthetic coding sequence
atggccaaggatgctggcctcatcgaggccaatggagagctgaaggtgttcatcgaccagaacctgagccctgggaagggcgtggtgtccctggtggccgtgcaccccagcacagtgaaccccctgggcaagcagctgctgcccaagaccttcggccagagcaatgtgaacatcgcccagcaggtggtgattggcaccccccagaggcctgctgccagcaacaccctggtggtgggcagcccccacacccccagcacccactttgccagccagaaccagcccagcgacagcagcccctggagcgctgggaagaggaacaggaagggggagaagaatggcaagggcctgcggcacttctccatgaaggtgtgtgagaaggtgcagaggaagggcaccaccagctacaatgaggtggctgatgagctggtggccgagttctctgctgctgacaaccacatcctgcccaatgaaagtgcctatgaccagaagaacatcagaagaagagtgtatgatgccctgaatgtgctgatggccatgaacatcatcagcaaggagaagaaggagatcaagtggattggcctgcccaccaacagcgcccaggagtgccagaacctggaggtggagcggcagaggcggctggagcgcatcaagcagaagcagagccagctgcaggagctgatcctgcagcagatcgccttcaagaacctgtag

SEQ ID NO: 22254 - DNA, 480 bp, Artificial Sequence
  Description of Artificial Sequence: Synthetic coding sequence
atggccaaggatgctggcctcatcgaggccaatggagagctgaaggtgttcatcgaccagaacctgagccctgggaagggcgtggtgtccctggtggccgtgcaccccagcacagtgaaccccctgggcaagcagctgctgcccaagaccttcggccagagcaatgtgaacatcgcccagcaggtggtgattggcaccccccagaggcctgctgccagcaacaccctggtggtgggcagcccccacacccccagcacccactttgccagccagaaccagcccagcgacagcagcccctggagcgctgggaagaggaacaggaagggggagaagaatggcaagggcctgcggcacttctccatgaaggtgtgtgagaaggtgcagaggaagggcaccaccagctacaatgaggtggctgatgagctggtggccgagttctctgctgctgacaaccacatcctgcccaatgaatctgtgtag

SEQ ID NO: 22255 - DNA, 936 bp, Artificial Sequence
  Description of Artificial Sequence: Synthetic coding sequence
atgagcaccctgcccagcaagtggaagaggaacagaaaaggagagaagaatggcaagggcctgcggcacttctccatgaaggtgtgtgagaaggtgcagaggaagggcaccaccagctacaatgaggtggctgatgagctggtggccgagttctctgctgctgacaaccacatcctgcccaatgaaagtgcctatgaccagaagaacatcagaagaagagtgtatgatgccctgaatgtgctgatggccatgaacatcatcagcaaggagaagaaggagatcaagtggattggcctgcccaccaacagcgcccaggagtgccagaacctggaggtggagcggcagaggcggctggagcgcatcaagcagaagcagagccagctgcaggagctgatcctgcagcagatcgccttcaagaacctggtgcagaggaacagacatgctgagcagcaggccagcaggcctcctccacccaacagcgtcatccacctgcccttcatcatcgtgaacaccagcaagaagacagtgattgactgcagcatcagcaatgacaagtttgagtacctgttcaactttgacaacacctttgagatccatgatgacatcgaggtgctgaagaggatgggcatggcctgtggcctggagagcggcagctgcagcgctgaggacctgaagatggcccggagcctggtgcccaaggccctggagccctacgtgacagagatggcccagggcaccgtgggcggcgtcttcatcaccacagctggcagcaccagcaatggcaccagtgacctgaccaatggagcagatggcatgctggccaccagcagcaatggcagccagtacagcggcagccgggtggagacccctgtgtcctatgtgggggaggatgatgaggaggatgatgacttcaatgaaaatgatgaagatgactag

SEQ ID NO: 22256 - DNA, 1146 bp, Artificial Sequence
  Description of Artificial Sequence: Synthetic coding sequence
atgagcaccctgcccagcaagtggaagaggaacagaaaaggagagaagaatggcaagggcctgcggcacttctccatgaaggtgtgtgagaaggtgcagaggaagggcaccaccagctacaatgaggtggctgatgagctggtggccgagttctctgctgctgacaaccacatcctgcccaatgaaagtgcctatgaccagaagaacatcagaagaagagtgtatgatgccctgaatgtgctgatggccatgaacatcatcagcaaggagaagaaggagatcaagtggattggcctgcccaccaacagcgcccaggagtgccagaacctggaggtggagcggcagaggcggctggagcgcatcaagcagaagcagagccagctgcaggagctgatcctgcagcagatcgccttcaagaacctggtgcagaggaacagacatgctgagcagcaggccagcaggcctcctccacccaacagcgtcatccacctgcccttcatcatcgtgaacaccagcaagaagacagtgattgactgcagcatcagcaatgacaagtttgagtacctgttcaactttgacaacacctttgagatccatgatgacatcgaggtgctgaagaggatgggcatggcctgtggcctggagagcggcagctgcagcgctgaggacctgaagatggcccggagcctggtgcccaaggccctggagccctacgtgacagagaagacaggcctgtgtgactgcacagctggctgcccagccccctggaggtctgtggagaacacaggccaggccaaggacatcaggaagctgctgcagcccagcgtgctgtggaactgtgccagcttctgctggctgcctgtgcggctggtgctcttcctgttccatgaccacagcctcatcttcttccccttcagcgagatggcccagggcaccgtgggcggcgtcttcatcaccacagctggcagcaccagcaatggcacccgcttcagcgccagtgacctgaccaatggagcagatggcatgctggccaccagcagcaatggcagccagtacagcggcagccgggtggagacccctgtgtcctatgtgggggaggatgatgaggaggatgatgacttcaatgaaaatgatgaagatgactag

SEQ ID NO: 22257 - DNA, 1161 bp, Artificial Sequence
  Description of Artificial Sequence: Synthetic coding sequence
atgatcatcagcaccccccagaggctgaccagcagcggctctgtgctgattggcagcccctacaccccagccccagccatggtgacccagacccacatcgccgaggccaccggctgggtgcctggggacaggaagagggccaggaagttcatcgacagcgacttcagcgagagcaagaggagcaagaagggggacaagaatggcaagggcctgcggcacttctccatgaaggtgtgtgagaaggtgcagaggaagggcaccaccagctacaatgaggtggctgatgagctggtgtctgagttcaccaacagcaacaaccacctggccgctgacagccaggcctatgaccagaagaacatcagaagaagagtgtatgatgccctgaatgtgctgatggccatgaacatcatcagcaaggagaagaaggagatcaagtggattggcctgcccaccaacagcgcccaggagtgccagaacctggagattgagaagcagaggcgcatcgagcgcatcaagcagaagagggcccagctgcaggagctgctgctgcagcagatcgccttcaagaacctggtgcagaggaaccggcagaatgagcagcagaaccagggccccccagccctgaacagcaccatccagctgcccttcatcatcatcaacaccagcaggaagacagtgattgactgcagcatcagcagtgacaagtttgagtacctgttcaactttgacaacacctttgagatccatgatgacatcgaggtgctgaagaggatgggcatgagctttggcctggagagcggcaagtgcagcctggaggacctgaagctggccaagagcctggtgcccaaggccctggagggctacatcacagacatcagcacaggccccagctggctgaaccagggcctgctgctgaacagcacccagagcgtgagcaacctggacctgaccaccggggccaccctgccccagagctctgtgaaccagggcctgtgcctggatgctgaggtggccctggccaccggccagttcctggcccccaacagccaccagagcagcagcgctgccagccactgcagcgagagcagaggagagaccccctgcagcttcaatgatgaagatgaggaggatgatgaggaggacagcagcagccctgagtag

SEQ ID NO: 22258 - DNA, 1113 bp, Artificial Sequence
  Description of Artificial Sequence: Synthetic coding sequence
atgatcatcagcaccccccagaggctgaccagcagcggctctgtgctgattggcagcccctacaccccagccccagccatggtgacccagacccacatcgccgaggccaccggctgggtgcctgggaagaggagcaagaagggggacaagaatggcaagggcctgcggcacttctccatgaaggtgtgtgagaaggtgcagaggaagggcaccaccagctacaatgaggtggctgatgagctggtgtctgagttcaccaacagcaacaaccacctggccgctgacagccaggcctatgaccagaagaacatcagaagaagagtgtatgatgccctgaatgtgctgatggccatgaacatcatcagcaaggagaagaaggagatcaagtggattggcctgcccaccaacagcgcccaggagtgccagaacctggagattgagaagcagaggcgcatcgagcgcatcaagcagaagagggcccagctgcaggagctgctgctgcagcagatcgccttcaagaacctggtgcagaggaaccggcagaatgagcagcagaaccagggccccccagccctgaacagcaccatccagctgcccttcatcatcatcaacaccagcaggaagacagtgattgactgcagcatcagcagtgacaagtttgagtacctgttcaactttgacaacacctttgagatccatgatgacatcgaggtgctgaagaggatgggcatgagctttggcctggagagcggcaagtgcagcctggaggacctgaagctggccaagagcctggtgcccaaggccctggagggctacatcacagacatcagcacaggccccagctggctgaaccagggcctgctgctgaacagcacccagagcgtgagcaacctggacctgaccaccggggccaccctgccccagagctctgtgaaccagggcctgtgcctggatgctgaggtggccctggccaccggccagttcctggcccccaacagccaccagagcagcagcgctgccagccactgcagcgagagcagaggagagaccccctgcagcttcaatgatgaagatgaggaggatgatgaggaggacagcagcagccctgagtag

SEQ ID NO: 22259 - DNA, 1257 bp, Artificial Sequence
  Description of Artificial Sequence: Synthetic coding sequence
atgcagcctgagggcatcatctttgaagctgagaacaagcccagccctggaacagagagcgctggcaccttcatcctggacctgagcgccaccagcaggaccatcatcagcaccccccagaggctgaccagcagcggctctgtgctgattggcagcccctacaccccagccccagccatggtgacccagacccacatcgccgaggccaccggctgggtgcctggggacaggaagagggccaggaagttcatcgacagcgacttcagcgagagcaagaggagcaagaagggggacaagaatggcaagggcctgcggcacttctccatgaaggtgtgtgagaaggtgcagaggaagggcaccaccagctacaatgaggtggctgatgagctggtgtctgagttcaccaacagcaacaaccacctggccgctgacagcgcctatgaccagaagaacatcagaagaagagtgtatgatgccctgaatgtgctgatggccatgaacatcatcagcaaggagaagaaggagatcaagtggattggcctgcccaccaacagcgcccaggagtgccagaacctggagattgagaagcagaggcgcatcgagcgcatcaagcagaagagggcccagctgcaggagctgctgctgcagcagatcgccttcaagaacctggtgcagaggaaccggcagaatgagcagcagaaccagggccccccagccctgaacagcaccatccagctgcccttcatcatcatcaacaccagcaggaagacagtgattgactgcagcatcagcagtgacaagtttgagtacctgttcaactttgacaacacctttgagatccatgatgacatcgaggtgctgaagaggatgggcatgagctttggcctggagagcggcaagtgcagcctggaggacctgaagctggccaagagcctggtgcccaaggccctggagggctacatcacagacatcagcacaggccccagctggctgaaccagggcctgctgctgaacagcacccagagcgtgagcaacctggacctgaccaccggggccaccctgccccagagctctgtgaaccagggcctgtgcctggatgctgaggtggccctggccaccggccagttcctggcccccaacagccaccagagcagcagcgctgccagccactgcagcgagagcagaggagagaccccctgcagcttcaatgatgaagatgaggaggatgatgaggaggacagcagcagccctgagtag

SEQ ID NO: 22260 - DNA, 1161 bp, Artificial Sequence; identical to SEQ ID NO: 22257
  Description of Artificial Sequence: Synthetic coding sequence

SEQ ID NO: 22261 - DNA, 261 bp, Artificial Sequence
  Description of Artificial Sequence: Synthetic coding sequence
atgacagccaagaatgtgggcctgaccagcaccaatgctgaggtgcggggcttcatcgaccagaacctgagccccaccaagggcaacatcagctttgtggccttccctgtgagcaacaccaacagccccaccaagatcctgcccaagaccctgggccccatcaacgtgaatgtgggcccccagatgatcatcagcaccccccagaggctgaccagcagcggctctgtgctgattggcagcccctacaccccagccccctag

SEQ ID NO: 22262 - DNA, 141 bp, Artificial Sequence
  Description of Artificial Sequence: Synthetic coding sequence
atgatcatcagcaccccccagaggctgaccagcagcggctctgtgctgattggcagcccctacaccccagccccagccatggtgacccagacccacatcgccgaggccaccggctgggtgcctggggacaggaagaggtag

SEQ ID NO: 22263 - DNA, 1158 bp, Artificial Sequence
  Description of Artificial Sequence: Synthetic coding sequence
atgatcatcagcaccccccagaggctgaccagcagcggctctgtgctgattggcagcccctacaccccagccccagccatggtgacccagacccacatcgccgaggccaccggctgggtgcctggggacaggaagagggccaggaagttcatcgacagcgacttcagcgagagcaagaggagcaagaagggggacaagaatggcaagggcctgcggcacttctccatgaaggtgtgtgagaaggtgcagaggaagggcaccaccagctacaatgaggtggctgatgagctggtgtctgagttcaccaacagcaacaaccacctggccgctgacagcgcctatgaccagaagaacatcagaagaagagtgtatgatgccctgaatgtgctgatggccatgaacatcatcagcaaggagaagaaggagatcaagtggattggcctgcccaccaacagcgcccaggagtgccagaacctggagattgagaagcagaggagaattgagcgcatcaagcagaagagggcccagctgcaggagctgctgctgcagcagatcgccttcaagaacctggtgcagaggaaccggcagaatgagcagcagaaccagggccccccagccctgaacagcaccatccagctgcccttcatcatcatcaacaccagcaggaagacagtcatcgactgcagcatcagcagtgacaagtttgagtacctgttcaactttgacaacacctttgagatccatgatgacatcgaggtgctgaagaggatgggcatgagctttggcctggagagcggcaagtgcagcctggaggacctgaagctggccaagagcctggtgcccaaggccctggagggctacatcacagacatcagcacaggccccagctggctgaaccagggcctgctgctgaacagcacccagagcgtgagcaacctggacctgaccactggagccaccctgccccagagctctgtgaaccagggcctgtgcctggatgctgaggtggccctggccaccggccagttcctggcccccaacagccaccagagcagcagcgctgccagccactgcagcgagagcagaggagagaccccctgcagcttcaatgatgaagatgaagaagatgatgaggaggacagcagcagccctgagtag

SEQ ID NO: 22264 - DNA, 270 bp, Artificial Sequence
  Description of Artificial Sequence: Synthetic coding sequence
atgatcatcagcaccccccagaggctgaccagcagcggctctgtgctgattggcagcccctacaccccagccccagccatggtgacccagacccacatcgccgaggccaccggctgggtgcctggggacaggaagagggccaggaagttcatcgacagcgacttcagcgagagcaagaggagcaagaagggggacaagaatggcaagggcctgcggcacttctccatgaaggtgtgtgagaaggtgcagaggaagggcaccaccagctag

SEQ ID NO: 22265 - DNA, 1341 bp, Artificial Sequence
  Description of Artificial Sequence: Synthetic coding sequence
atgacagccaagaatgtgggcctgaccagcaccaatgctgaggtgcggggcttcatcgaccagaacctgagccccaccaagggcaacatcagctttgtggccttccctgtgagcaacaccaacagccccaccaagatcctgcccaagaccctgggccccatcaacgtgaatgtgggcccccagatgatcatcagcaccccccagaggctgaccagcagcggctctgtgctgattggcagcccctacaccccagccccagccatggtgacccagacccacatcgccgaggccaccggctgggtgcctggggacaggaagagggccaggaagttcatcgacagcgacttcagcgagagcaagaggagcaagaagggggacaagaatggcaagggcctgcggcacttctccatgaaggtgtgtgagaaggtgcagaggaagggcaccaccagctacaatgaggtggctgatgagctggtgtctgagttcaccaacagcaacaaccacctggccgctgacagcgcctatgaccagaagaacatcagaagaagagtgtatgatgccctgaatgtgctgatggccatgaacatcatcagcaaggagaagaaggagatcaagtggattggcctgcccaccaacagcgcccaggagtgccagaacctggagattgagaagcagaggcgcatcgagcgcatcaagcagaagagggcccagctgcaggagctgctgctgcagcagatcgccttcaagaacctggtgcagaggaaccggcagaatgagcagcagaaccagggccccccagccctgaacagcaccatccagctgcccttcatcatcatcaacaccagcaggaagacagtgattgactgcagcatcagcagtgacaagtttgagtacctgttcaactttgacaacacctttgagatccatgatgacatcgaggtgctgaagaggatgggcatgagctttggcctggagagcggcaagtgcagcctggaggacctgaagctggccaagagcctggtgcccaaggccctggagggctacatcacagacatcagcacaggccccagctggctgaaccagggcctgctgctgaacagcacccagagcgtgagcaacctggacctgaccaccggggccaccctgccccagagctctgtgaaccagggcctgtgcctggatgctgaggtggccctggccaccggccagttcctggcccccaacagccaccagagcagcagcgctgccagccactgcagcgagagcagaggagagaccccctgcagcttcaatgatgaagatgaggaggatgatgaggaggacagcagcagccctgagtag

SEQ ID NO: 22266 - DNA, 84 bp, Artificial Sequence
  Description of Artificial Sequence: Synthetic coding sequence
atgatcatcagcaccccccagaggctgaccagcagcggctctgtgctgattggcagcccctacaccccagccccagccatgtag

SEQ ID NO: 22267 - DNA, 1050 bp, Artificial Sequence
  Description of Artificial Sequence: Synthetic coding sequence
atgctggaccccaagtgtgacaggaagagggccaggaagttcatcgacagcgacttcagcgagagcaagaggagcaagaagggggacaagaatggcaagggcctgcggcacttctccatgaaggtgtgtgagaaggtgcagaggaagggcaccaccagctacaatgaggtggctgatgagctggtgtctgagttcaccaacagcaacaaccacctggccgctgacagcgcctatgaccagaagaacatcagaagaagagtgtatgatgccctgaatgtgctgatggccatgaacatcatcagcaaggagaagaaggagatcaagtggattggcctgcccaccaacagcgcccaggagtgccagaacctggagattgagaagcagaggagaattgagcgcatcaagcagaagagggcccagctgcaggagctgctgctgcagcagatcgccttcaagaacctggtgcagaggaaccggcagaatgagcagcagaaccagggccccccagccctgaacagcaccatccagctgcccttcatcatcatcaacaccagcaggaagacagtcatcgactgcagcatcagcagtgacaagtttgagtacctgttcaactttgacaacacctttgagatccatgatgacatcgaggtgctgaagaggatgggcatgagctttggcctggagagcggcaagtgcagcctggaggacctgaagctggccaagagcctggtgcccaaggccctggagggctacatcacagacatcagcacaggccccagctggctgaaccagggcctgctgctgaacagcacccagagcgtgagcaacctggacctgaccactggagccaccctgccccagagctctgtgaaccagggcctgtgcctggatgctgaggtggccctggccaccggccagttcctggcccccaacagccaccagagcagcagcgctgccagccactgcagcgagagcagaggagagaccccctgcagcttcaatgatgaagatgaagaagatgatgaggaggacagcagcagccctgagtag

SEQ ID NO: 22268 - DNA, 663 bp, Artificial Sequence
  Description of Artificial Sequence: Synthetic coding sequence
atgatcatcagcaccccccagaggctgaccagcagcggctctgtgctgattggcagcccctacaccccagccccagccatggtgacccagacccacatcgccgaggccaccggctgggtgcctggggacaggaagagggccaggaagttcatcgacagcgacttcagcgagagcaagaggagcaagaagggggacaagaatggcaagggcctgcggcacttctccatgaaggtgtgtgagaaggtgcagaggaagggcaccaccagctacaatgaggtggctgatgagctggtgtctgagttcaccaacagcaacaaccacctggccgctgacagcgcctatgaccagaagaacatcagaagaagagtgtatgatgccctgaatgtgctgatggccatgaacatcatcagcaaggagaagaaggagatcaagtggattggcctgcccaccaacagcgcccaggagtgccagaacctggagattgagaagcagaggagaattgagcgcatcaagcagaagagggcccagctgcaggagctgctgctgcagcagatcgccttcaagaacctggtgcagaggaaccggcagaatgagcagcagaaccagggccccccagccctgaacagcaccatccagctgcccttcatcatcatcaacacctag

SEQ ID NO: 22269 - DNA, 1161 bp, Artificial Sequence; identical to SEQ ID NO: 22257
  Description of Artificial Sequence: Synthetic coding sequence

SEQ ID NO: 22270 - DNA, 933 bp, Artificial Sequence
  Description of Artificial Sequence: Synthetic coding sequence
atgaaggtgtgtgagaaggtgcagaggaagggcaccaccagctacaatgaggtggctgatgagctggtgtctgagttcaccaacagcaacaaccacctggccgctgacagcgcctatgaccagaagaacatcagaagaagagtgtatgatgccctgaatgtgctgatggccatgaacatcatcagcaaggagaagaaggagatcaagtggattggcctgcccaccaacagcgcccaggagtgccagaacctggagattgagaagcagaggcgcatcgagcgcatcaagcagaagagggcccagctgcaggagctgctgctgcagcagatcgccttcaagaacctggtgcagaggaaccggcagaatgagcagcagaaccagggccccccagccctgaacagcaccatccagctgcccttcatcatcatcaacaccagcaggaagacagtgattgactgcagcatcagcagtgacaagtttgagtacctgttcaactttgacaacacctttgagatccatgatgacatcgaggtgctgaagaggatgggcatgagctttggcctggagagcggcaagtgcagcctggaggacctgaagctggccaagagcctggtgcccaaggccctggagggctacatcacagacatcagcacaggccccagctggctgaaccagggcctgctgctgaacagcacccagagcgtgagcaacctggacctgaccaccggggccaccctgccccagagctctgtgaaccagggcctgtgcctggatgctgaggtggccctggccaccggccagttcctggcccccaacagccaccagagcagcagcgctgccagccactgcagcgagagcagaggagagaccccctgcagcttcaatgatgaagatgaggaggatgatgaggaggacagcagcagccctgagtag

SEQ ID NO: 22271 - DNA, 1335 bp, Artificial Sequence
  Description of Artificial Sequence: Synthetic coding sequence
atgcccaggtctggggcccccaaggagaggcctgctgagcccctgaccccaccacccagctatggccaccagccccagacaggcagcggggagagcagcggggccagcggggacaaggaccacctgtacagcacagtgtgcaagcccaggagccccaagccagctgccccagctgccccacccttcagcagcagcagcggcgtgctgggcaccggcctgtgtgagctggaccggctgctgcaggagctgaatgccacccagttcaacatcacagatgagatcatgagccagttccccagcagcaaggtggccagcggggagcagaaggaggaccagagcgaggacaagaagaggcccagcctgcccagcagccccagccctggcctgcccaaggccagcgccaccagcgccaccctggagctggaccggctgatggccagcctgagtgacttccgggtgcagaaccacctgcctgccagcggccccacccagccccctgtggtgagcagcaccaatgaaggcagccccagccccccagagcccaccgggaagggcagcctggacaccatgctgggcctgctgcagagcgacctgagccggcggggcgtgcccacccaggccaagggcctgtgtggcagctgcaacaagcccatcgccggccaggtggtgacagccctgggccgggcctggcaccctgagcactttgtgtgtggcggctgcagcacagccctgggcggcagcagcttctttgagaaggatggagcccccttctgcccagagtgctactttgagcgcttcagcccccgctgtggcttctgcaaccagcccatccgccacaagatggtgacagccctgggcacccactggcaccctgagcacttctgctgcgtgtcctgtggggagccctttggagatgagggcttccacgagcgggagggccggccctactgccggcgggacttcctgcagctgtttgccccccgctgccagggctgccagggccccatcctggacaactacatcagcgccctgagcgccctgtggcacccagactgctttgtgtgcagagaatgttttgcccccttcagcggcggcagcttctttgagcacgagggccggcccctgtgtgagaaccacttccacgcccggcggggcagcctgtgtgccacctgtggcctgcctgtgacaggccgctgtgtgtctgccctgggccgccgcttccacccagaccacttcacctgcaccttctgcctgcggcccctgaccaagggcagcttccaggagcgggccggcaagccctactgccagccctgcttcctgaagctgtttggatag

SEQ ID NO: 22272 - DNA, 1335 bp, Artificial Sequence; identical to SEQ ID NO: 22271
  Description of Artificial Sequence: Synthetic coding sequence

SEQ ID NO: 22273 - DNA, 1386 bp, Artificial Sequence
  Description of Artificial Sequence: Synthetic coding sequence
atggaggacctggatgccctgctgagtgacctggagaccaccaccagccacatgcccaggtctggggcccccaaggagaggcctgctgagcccctgaccccacctccttcctatggccaccagccccagacaggcagcggggagagcagcggggccagcggggacaaggaccacctgtacagcacagtgtgcaagcccaggagccccaagccagctgccccagctgccccacccttcagcagcagcagtggagtgctgggcaccggcctgtgtgagctggaccggctgctgcaggagctgaatgccacccagttcaacatcacagatgagatcatgagccagttccccagcagcaaggtggccagcggggagcagaaggaggaccagagcgaggacaagaagaggcccagcctgcccagcagccccagccctggcctgcccaaggccagcgccaccagcgccaccctggagctggaccggctgatggccagcctgagtgacttccgggtgcagaaccacctgcctgccagcggccccacccagccccctgtggtgagcagcaccaatgaaggcagccccagccccccagagcccaccgggaagggcagcctggacaccatgctgggcctgctgcagagcgacctgagcagaagaggagtgcccacccaggccaagggcctgtgtggcagctgcaacaagcccatcgccggccaggtggtgacagccctgggccgggcctggcaccctgagcactttgtgtgtggcggctgcagcacagccctgggcggcagcagcttctttgagaaggatggagcccccttctgcccagagtgctactttgagcgcttcagcccccgctgtggcttctgcaaccagcccatccgccacaagatggtgacagccctgggcacccactggcaccctgagcacttctgctgcgtgtcctgtggggagccctttggagatgagggcttccacgagcgggagggccggccctactgcagaagagacttcctgcagctgtttgccccccgctgccagggctgccagggccccatcctggacaactacatcagcgccctgagcgccctgtggcacccagactgctttgtgtgccgggagtgctttgcccccttcagcggcggcagcttctttgaacatgagggccggcccctgtgtgagaaccacttccacgcccggcggggcagcctgtgtgccacctgtggcctgcctgtgacaggccgctgtgtgtctgccctgggccgccgcttccacccagaccacttcacctgcaccttctgcctgcggcccctgaccaagggcagcttccaggagagagctgggaagccctactgccagccctgcttcctgaagctgtttggatag

SEQ ID NO: 22274 - DNA, 783 bp, Artificial Sequence
  Description of Artificial Sequence: Synthetic coding sequence
atggtgtggccagccctgtgggagctgtaccgggagctgggcctcttccagggccctgccctgggcctgaggaaccacctgggcaggaagctgcggcggaggaagaagaagaaggccaagaggaccaccaactggaagatcatcacagaccggcccggcttccatgatgagagcgccatctaccctgtgggctactgcagcacccgcatctatgcctccatgaagtgcccagaccagaagtgcctgtacacctgccagatcaaggatggaggagtgcagccccagtttgagatcgtgcctgaagatgacccccagaatgccatcgtgagcagcagcgcagatgcctgccacgccgagctgctgcggaccatcagcaccaccatgggcaagctgatgcccaacctgctgcctgctggagctgacttcttcggcttcagccacccagccatccacaacctgatccagagctgccctggggccaggaagtgcatcaactaccagtgggtgaagtttgatgtgtgcaagccaggagatggccagctgcctgagggcctgcctgaaaatgatgctgccatgagctttgaggccttccagaggcagatctttgatgaggaccagaatgaccccctgctgcccggcagcctggacctgcctgagctgcagcctgctgcctttgtgagcagctaccagcccatgtacctgacccatgagcccctggtggacacccacctgcagcacctgaagagccccagccagggcagccccatccagagcagtgactag

SEQ ID NO: 22275 - DNA, 1236 bp, Artificial Sequence
  Description of Artificial Sequence: Synthetic coding sequence
atgagcctgctggatggcctggccagcagcccccgggcccccctgcagagcagcaaggccaggatgaagaagctgcccaagaagagccagaatgagaagtaccgcctgaagtacctgcggctgaggaaggccgccaaggccaccgtgtttgaaaatgctgccatctgtgatgaaattgcccggctggaggagaagttcctgaaggccaaggaggagcggcgctacctgctgaagaagctgctgcagctgcaggccctgacagaaggagaggtgcaggccgccgcccccagccacagcagcagcctgcccctgacctacggcgtggccagctctgtgggcaccatccagggcgccggccccatcagcggccccagcactggagctgaggagccctttgggaagaagaccaagaaggagaagaaggagaagggcaaggagaacaacaagctggaggtgctgaagaagacctgcaagaagaagaagatggccggcggggccaggaagctggtgcagcccatcgccctggaccccagcggccggcctgtgttccccatcggcctgggcggcctgactgtgtacagcctgggggagatcatcacagacaggcctggcttccatgatgaaagtgccatctaccctgtgggctactgcagcacccgcatctatgcctccatgaagtgcccagaccagaagtgcctgtacacctgccagatcaaggatggcggcgtgcagccccagtttgaaattgtgcctgaagatgacccccagaatgccatcgtgagcagcagcgcagatgcctgccacgccgagctgctgcggaccatcagcaccaccatgggcaagctgatgcccaacctgctgcctgctggagctgacttcttcggcttcagccacccagccatccacaacctgatccagagctgccctggggccaggaagtgcatcaactaccagtgggtgaagtttgatgtgtgcaagccaggagatggccagctgcctgagggcctgcctgaaaatgatgctgccatgagctttgaggccttccagaggcagatctttgatgaggaccagaatgaccccctgctgcccggcagcctggacctgcctgagctgcagcctgctgcctttgtgtcctcctaccagcccatgtacctgacccatgagcccctggtggacacccacctgcagcacctgaagagccccagccagggcagccccatccagagcagtgactag

SEQ ID NO: 22276 - DNA, 1281 bp, Artificial Sequence
  Description of Artificial Sequence: Synthetic coding sequence
atggaggccgctgtggccgccccccggccccggctgctgctgctggtgctggccgctgctgctgctgctgctgctgccctgctgcccggggccacagccctgcagtgcttctgccacctgtgcaccaaggacaacttcacctgtgtgacagatggcctgtgctttgtgtctgtgacagagaccacagacaaggtgatccacaacagcatgtgcatcgccgagattgacctgatcccccgggaccggccctttgtgtgtgcccccagcagcaagacaggctctgtgaccaccacctactgctgcaaccaggaccactgcaacaagattgagctgcccaccaccggcctgcccctgctggtgcagaggaccatcgcccggaccatcgtgctgcaggagagcatcggcaagggccgctttggagaggtgtggaggggcaagtggagaggagaggaggtggccgtgaagatcttcagcagccgggaggagaggtcctggttccgggaggccgagatctaccagacagtgatgctgcggcatgagaacatcctgggcttcatcgctgctgacaacaaggacaatggcacctggacccagctgtggctggtgtctgactaccacgagcacggcagcctgtttgactacctgaaccgctacacagtgacagtggagggcatgatcaagctggccctgagcacagccagcggcctggcccacctgcacatggagatcgtgggcacccagggcaagccagccatcgcccaccgggacctgaagagcaagaacatcctggtgaagaagaatggcacctgctgcatcgctgacctgggcctggccgtgagacatgattctgccacagacaccatcgacatcgcccccaaccaccgggtgggcaccaagcgctacatggcccctgaggtgctggatgacagcatcaacatgaagcactttgagagcttcaagagagctgacatctatgccatgggcctggtgttctgggagatcgcccggcgctgcagcatcggcggcatccacgaggactaccagctgccctactatgacctggtgcccagcgaccccagcgtggaggagatgaggaaggtggtgtgtgagcagaagctgcggcccaacatccccaaccgctggcagagctgtgaggccctgcgggtgatggccaagatcatgagggagtgctggtacgccaatggagctgcccggctgacagccctgcgcatcaagaagaccctgagccagctgagccagcaggagggcatcaagatgtag

SEQ ID NO: 22277 - DNA, 1512 bp, Artificial Sequence
  Description of Artificial Sequence: Synthetic coding sequence
atggaggccgctgtggccgccccccggccccggctgctgctgctggtgctggccgctgctgctgctgctgctgctgccctgctgcccggggccacagccctgcagtgcttctgccacctgtgcaccaaggacaacttcacctgtgtgacagatggcctgtgctttgtgtctgtgacagagaccacagacaaggtgatccacaacagcatgtgcatcgccgagattgacctgatcccccgggaccggccctttgtgtgtgcccccagcagcaagacaggctctgtgaccaccacctactgctgcaaccaggaccactgcaacaagattgagctgcccaccaccgtgaagagcagccctggcctgggccctgtggagctggccgctgtgattgctggccctgtgtgctttgtgtgcatcagcctgatgctgatggtgtacatctgccacaacagaactgtcatccaccaccgggtgcccaatgaggaggaccccagcctggaccggcccttcatcagcgagggcaccaccctgaaggacctgatctatgacatgaccaccagcggcagcggcagcggcctgcccctgctggtgcagaggaccatcgcccggaccatcgtgctgcaggagagcatcggcaagggccgctttggagaggtgtggaggggcaagtggagaggagaggaggtggccgtgaagatcttcagcagccgggaggagaggtcctggttccgggaggccgagatctaccagacagtgatgctgcggcatgagaacatcctgggcttcatcgctgctgacaacaaggacaatggcacctggacccagctgtggctggtgtctgactaccatgaacatggcagcctgtttgactacctgaaccgctacacagtgacagtggagggcatgatcaagctggccctgagcacagccagcggcctggcccacctgcacatggagatcgtgggcacccagggcaagccagccatcgcccaccgggacctgaagagcaagaacatcctggtgaagaagaatggcacctgctgcatcgctgacctgggcctggccgtgagacatgacagcgccacagacaccattgatattgcccccaaccaccgggtgggcaccaagcgctacatggcccctgaggtgctggatgacagcatcaacatgaagcactttgagagcttcaagagagctgacatctatgccatgggcctggtgttctgggagatcgcccggcgctgcagcattggaggcatccacgaggactaccagctgccctactatgacctggtgcccagcgaccccagcgtggaggagatgaggaaggtggtgtgtgagcagaagctgcggcccaacatccccaaccgctggcagagctgtgaggccctgcgggtgatggccaagatcatgagggagtgctggtacgccaacggggccgcccggctgacagccctgcgcatcaagaagaccctgagccagctgagccagcaggagggcatcaagatgtag

SEQ ID NO: 22278 - DNA, 1398 bp, Artificial Sequence
  Description of Artificial Sequence: Synthetic coding sequence
atggaggccgctgtggccgccccccggccccggctgctgctgctggtgctggccgctgctgctgctgctgctgctgccctgctgcccggggccacagccctgcagtgcttctgccacctgtgcaccaaggacaacttcacctgtgtgacagatggcctgtgctttgtgtctgtgacagagaccacagacaaggtgatccacaacagcatgtgcatcgccgagattgacctgatcccccgggaccggccctttgtgtgtgcccccagcagcaagacaggctctgtgaccaccacctactgctgcaaccaggaccactgcaacaagattgagctgcccaccaccgtgaagagcagccctggcctgggccctgtggagctggccgctgtgattgctggccctgtgtgctttgtgtgcatcagcctgatgctgatggtgtacatctgccacaacagaactgtcatccaccaccgggtgcccaatgaggaggaccccagcctggaccggcccttcatcagcgagggcaccaccctgaaggacctgatctatgacatgaccaccagcggcagcggcagcggcctgcccctgctggtgcagaggaccatcgcccggaccatcgtgctgcaggagagcatcggcaagggccgctttggagaggtgtggaggggcaagtggagaggagaggaggtggccgtgaagatcttcagcagccgggaggagaggtcctggttccgggaggccgagatctaccagacagtgatgctgcggcatgagaacatcctgggcttcatcgctgctgacaacaaggacaatggcacctggacccagctgtggctggtgtctgactaccatgaacatggcagcctgtttgactacctgaaccgctacacagtgacagtggagggcatgatcaagctggccctgagcacagccagcggcctggcccacctgcacatggagatcgtgggcacccagggcaagccagccatcgcccccaaccaccgggtgggcaccaagcgctacatggcccctgaggtgctggatgacagcatcaacatgaagcactttgagagcttcaagagagctgacatctatgccatgggcctggtgttctgggagatcgcccggcgctgcagcattggaggcatccacgaggactaccagctgccctactatgacctggtgcccagcgaccccagcgtggaggagatgaggaaggtggtgtgtgagcagaagctgcggcccaacatccccaaccgctggcagagctgtgaggccctgcgggtgatggccaagatcatgagggagtgctggtacgccaacggggccgcccggctgacagccctgcgcatcaagaagaccctgagccagctgagccagcaggagggcatcaagatgtag

SEQ ID NO: 22279 - DNA, 216 bp, Artificial Sequence
  Description of Artificial Sequence: Synthetic coding sequence
atggaggccgctgtggccgccccccggccccggctgctgctggccagcaccagcctgcagtgcttctgccacctgtgcaccaaggacaacttcacctgtgtgacagatggcctgtgctttgtgtctgtgacagagaccacagacaaggtgatccacaacagcatgtgcatcgccgagattgacctgatcccccgggaccggccctttgtgtgctag

SEQ ID NO: 22280 - DNA, 1305 bp, Artificial Sequence
  Description of Artificial Sequence: Synthetic coding sequence
atgtgcatcgccgagattgacctgatcccccgggaccggccctttgtgtgtgcccccagcagcaagacaggctctgtgaccaccacctactgctgcaaccaggaccactgcaacaagattgagctgcccaccaccgtgaagagcagccctggcctgggccctgtggagctggccgctgtgattgctggccctgtgtgctttgtgtgcatcagcctgatgctgatggtgtacatctgccacaacagaactgtcatccaccaccgggtgcccaatgaggaggaccccagcctggaccggcccttcatcagcgagggcaccaccctgaaggacctgatctatgacatgaccaccagcggcagcggcagcggcctgcccctgctggtgcagaggaccatcgcccggaccatcgtgctgcaggagagcatcggcaagggccgctttggagaggtgtggaggggcaagtggagaggagaggaggtggccgtgaagatcttcagcagccgggaggagaggtcctggttccgggaggccgagatctaccagacagtgatgctgcggcatgagaacatcctgggcttcatcgctgctgacaacaaggacaatggcacctggacccagctgtggctggtgtctgactaccacgagcacggcagcctgtttgactacctgaaccgctacacagtgacagtggagggcatgatcaagctggccctgagcacagccagcggcctggcccacctgcacatggagatcgtgggcacccagggcaagccagccatcgcccaccgggacctgaagagcaagaacatcctggtgaagaagaatggcacctgctgcatcgctgacctgggcctggccgtgagacatgattctgccacagacaccatcgacatcgcccccaaccaccgggtgggcaccaagcgctacatggcccctgaggtgctggatgacagcatcaacatgaagcactttgagagcttcaagagagctgacatctatgccatgggcctggtgttctgggagatcgcccggcgctgcagcatcggcggcatccacgaggactaccagctgccctactatgacctggtgcccagcgaccccagcgtggaggagatgaggaaggtggtgtgtgagcagaagctgcggcccaacatccccaaccgctggcagagctgtgaggccctgcgggtgatggccaagatcatgagggagtgctggtacgccaatggagctgcccggctgacagccctgcgcatcaagaagaccctgagccagctgagccagcaggagggcatcaagatgtag

SEQ ID NO: 22281 - DNA, 411 bp, Artificial Sequence
  Description of Artificial Sequence: Synthetic coding sequence
atgaaggacagcaaccgctgctgctgcggccagttcaccaaccagcacatcccccccctgcccagcgccacccccagcaagaatgaggaggagagcaagcaggtggagacccagcctgagaagtggagcgtggccaagcacacccagagctaccccacagacagctatggagtgctggagttccagggcggcggctacagcaacaaggccatggtgaggaaggccttccgccacggggccacccgcatcacagccttcatcggcggccagagccccagccccaagctgcagatccctggcctgctgcacggctgcggcagcatcttcctggacatcagcctgaagaaccaggagatctacctgtgcacctggctgctggccatgaggctgggcaactggacccccctgtag

SEQ ID NO: 22282 - DNA, 4878 bp, Artificial Sequence
  Description of Artificial Sequence: Synthetic coding sequence
atgggccagaagtcctggattgagaagaccttctgcaagcgggagtgcatcttcgtcatccccagcatgaaggacagcaaccgctgctgctgcggccagttcaccaaccagcacatcccccccctgcccagcgccacccccagcaagaatgaggaggagagcaagcaggtggagacccagcctgagaagtggagcgtggccaagcacacccagagctaccccacagacagctatggagtgctggagttccagggcggcggctacagcaacaaggccatgtacatccgggtgtcctatgacaccaagccagacagcctgctgcacctgatggtgaaggactggcagctggagctgcccaagctgctgatctctgtgcacggcggcctgcagaactttgagatgcagcccaagctgaagcaggtgtttgggaagggcctcatcaaggccgccatgaccactggagcctggatcttcaccggaggagtgtccactggagtcatcagccacgtgggagatgccctgaaggaccacagcagcaagagccggggccgggtgtgtgccatcggcatcgccccctggggcatcgtggagaacaaggaggacctggtgggcaaggatgtgaccagggtgtaccagaccatgagcaaccccctgagcaagctgtctgtgctgaacaacagccacacccacttcatcctggccgacaatggcaccctgggcaagtacggggctgaggtgaagctgcggcggctgctggagaagcacatcagcctgcagaagatcaacacccggctgggccagggcgtgcccctggtgggcctggtggtggagggcggccccaacgtggtgtccatcgtgctggagtacctgcaggaggagccccccatccctgtggtgatctgtgatggcagcggccgggccagtgacatcctgagctttgcccacaagtactgtgaggagggcggcatcatcaatgaaagcctgcgggagcagctgctggtgaccatccagaagaccttcaactacaacaaggcccagagccaccagctgtttgccatcatcatggagtgcatgaagaagaaggagctggtgacagtgttcaggatgggcagcgagggccagcaggacatcgagatggccatcctgacagccctgctgaagggcaccaacgtgtctgccccagaccagctgagcctggccctggcctggaacagagtggacatcgcccggagccagatctttgtgtttggcccccactggccacccctgggcagcctggccccacccacagacagcaaggccacagagaaggagaagaagccacccatggccaccaccaagggcggccggggcaagggcaagggcaagaagaagggcaaggtgaaggaggaggtggaggaggagacagaccccaggaagattgagctgctgaactgggtgaatgccctggagcaggccatgctggatgccctggtgctggacagagtggactttgtgaagctgctgattgaaaatggagtgaacatgcagcacttcctgaccatcccccggctggaggagctgtacaacacccggctgggcccccccaacaccctgcacctgctggtgagagatgtgaagaagagcaacctgcccccagactaccacatcagcctgattgatattggcctggtgctggagtacctgatgggcggggcctaccgctgcaactacaccaggaagaacttccgcaccctgtacaacaacctgtttggccccaagaggcccaaggccctgaagctgctgggcatggaggatgatgagcccccagccaagggcaagaagaagaagaagaagaagaaggaggaggagattgatattgatgtggatgatcctgctgtgagccgcttccagtaccccttccacgagctgatggtgtgggccgtgctgatgaagaggcagaagatggctgtgttcctgtggcagagaggagaggagagcatggccaaggccctggtggcctgcaagctgtacaaggccatggcccacgagagcagcgagagtgacctggtggatgacatcagccaggacctggacaacaacagcaaggactttggccagctggccctggagctgctggaccagagctacaagcatgatgagcagatcgccatgaagctgctgacctatgagctgaagaactggagcaacagcacctgcctgaagctggccgtggccgccaagcaccgggacttcatcgcccacacctgcagccagatgctgctgacagacatgtggatgggccgcctgaggatgaggaagaaccctggcctgaaggtgatcatgggcatcctgctgccccccaccatcctcttcctggagttccgcacctatgatgacttctcctaccagaccagcaaagaaaatgaagatggcaaggagaaggaggaggagaacacagatgccaatgctgatgctggcagcaggaaaggagatgaagaaaatgagcacaagaagcagaggagcatccccatcggcaccaagatctgtgagttctacaatgcccccatcgtgaagttctggttctacaccatctcctacctgggctacctgctgctcttcaactacgtgatcctggtgaggatggatggctggcccagcctgcaggagtggatcgtcatctcctacatcgtgtccctggccctggagaagatccgggagatcctgatgtctgagcccgggaagctgagccagaagatcaaggtgtggctgcaggagtactggaacatcacagacctggtggccatcagcaccttcatgattggagccatcctgcggctgcagaaccagccctacatgggctacggccgggtcatctactgtgtggacatcatcttctggtacatccgggtgctggacatcttcggcgtgaacaagtacctgggcccctacgtgatgatgattggcaagatgatgattgacatgctgtactttgtggtgatcatgctggtggtgctgatgagctttggagtggcccggcaggccatcctgcaccctgaggagaagcccagctggaagctggccaggaacatcttctacatgccctactggatgatctatggagaggtgtttgctgaccagattgacctgtatgccatggagatcaaccccccctgtggggagaacctgtatgatgaggagggcaagaggctgcccccctgcatccctggggcctggctgaccccagccctgatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccatgacaggcctgtgctgcccccacccatgatcatcctgagccacatctacatcatcatcatgaggctgagcggccgctgcaggaagaagcgggagggggaccaggaggagcgggaccggggcctgaagctgttcctgagtgatgaggagctgaagaggctgcacgagtttgaggagcagtgtgtgcaggagcacttccgggagaaggaggatgagcagcagagcagcagtgatgagcgcatccgggtgaccagcgagcgggtggagaacatgtccatgaggctggaggagatcaatgaaagagagaccttcatgaagaccagcctgcagacagtggacctgcggctggcccagctggaggagctgagcaacaggatggtgaatgccctggagaacctggccggcatcgacagaagtgacctgatccaggcccggagccgggccagcagtgaatgtgaggccacctacctgctgcggcagagcagcatcaacagcgcagatggctacagcctgtaccgctaccacttcaacggggaggagctgctgtttgaggacaccagcctgagcaccagccctggcactggagtgaggaagaagacctgcagcttccgcatcaaggaggagaaggatgtgaagacccacctggtgcctgagtgccagaacagcctgcacctgagcctgggcaccagcaccagcgccaccccagatggcagccacctggccgtggatgacctgaagaatgctgaggagagcaagctgggccctgacatcggcatcagcaaagaagatgatgagcggcagacagacagcaagaaggaggagaccatcagccccagcctgaacaagacagatgtgatccacggccaggacaagagtgatgtgcagaacacccagctgactgtggagaccaccaacatcgagggcaccatctcctaccccctggaggagaccaagatcacccgctacttcccagatgagaccatcaatgcctgcaagaccatgaagagccgcagctttgtgtacagccggggcaggaagctggtgggcggcgtgaaccaggatgtggagtacagcagcatcacagaccagcagctgaccacagagtggcagtgccaggtgcagaagatcaccaggagccacagcacagacatcccctacatcgtgtctgaggccgctgtgcaggccgagcacaaggagcagtttgctgacatgcaggatgagcaccacgtggccgaggccatcccccgcatcccccggctgagcctgaccatcacagacagaaatggcatggagaacctgctgtctgtgaagccagaccagaccctgggcttccccagcctgcggagcaagagcctgcacggccaccccagaaatgtgaagagcatccagggcaagctggacaggagcggccacgccagctctgtgagcagcctggtgattgtgtctggcatgacagctgaggagaagaaggtgaagaaggagaaggccagcacagaaacagagtgctag

SEQ ID NO: 22283 - DNA, 4812 bp, Artificial Sequence
  Description of Artificial Sequence: Synthetic coding sequence
atcaagaccagcaagcgctgctgctgcggccagttcaccaaccagcacatcccccccctgcccagcgccacccccagcaagaatgaggaggagagcaagcaggtggagacccagcctgagaagtggagcgtggccaagcacacccagagctaccccacagacagctatggagtgctggagttccagggcggcggctacagcaacaaggccatgtacatccgggtgtcctatgacaccaagccagacagcctgctgcacctgatggtgaaggactggcagctggagctgcccaagctgctgatctctgtgcacggcggcctgcagaactttgagatgcagcccaagctgaagcaggtgtttgggaagggcctcatcaaggccgccatgaccactggagcctggatcttcaccggaggagtgtccactggagtcatcagccacgtgggagatgccctgaaggaccacagcagcaagagccggggccgggtgtgtgccatcggcatcgccccctggggcatcgtggagaacaaggaggacctggtgggcaaggatgtgaccagggtgtaccagaccatgagcaaccccctgagcaagctgtctgtgctgaacaacagccacacccacttcatcctggccgacaatggcaccctgggcaagtacggggctgaggtgaagctgcggcggctgctggagaagcacatcagcctgcagaagatcaacacccggctgggccagggcgtgcccctggtgggcctggtggtggagggcggccccaacgtggtgtccatcgtgctggagtacctgcaggaggagccccccatccctgtggtgatctgtgatggcagcggccgggccagtgacatcctgagctttgcccacaagtactgtgaggagggcggcatcatcaatgaaagcctgcgggagcagctgctggtgaccatccagaagaccttcaactacaacaaggcccagagccaccagctgtttgccatcatcatggagtgcatgaagaagaaggagctggtgacagtgttcaggatgggcagcgagggccagcaggacatcgagatggccatcctgacagccctgctgaagggcaccaacgtgtctgccccagaccagctgagcctggccctggcctggaacagagtggacatcgcccggagccagatctttgtgtttggcccccactggccacccctgggcagcctggccccacccacagacagcaaggccacagagaaggagaagaagccacccatggccaccaccaagggcggccggggcaagggcaagggcaagaagaagggcaaggtgaaggaggaggtggaggaggagacagaccccaggaagattgagctgctgaactgggtgaatgccctggagcaggccatgctggatgccctggtgctggacagagtggactttgtgaagctgctgattgaaaatggagtgaacatgcagcacttcctgaccatcccccggctggaggagctgtacaacacccggctgggcccccccaacaccctgcacctgctggtgagagatgtgaagaagagcaacctgcccccagactaccacatcagcctgattgatattggcctggtgctggagtacctgatgggcggggcctaccgctgcaactacaccaggaagaacttccgcaccctgtacaacaacctgtttggccccaagaggcccaaggccctgaagctgctgggcatggaggatgatgagcccccagccaagggcaagaagaagaagaagaagaagaaggaggaggagattgatattgatgtggatgatcctgctgtgagccgcttccagtaccccttccacgagctgatggtgtgggccgtgctgatgaagaggcagaagatggctgtgttcctgtggcagagaggagaggagagcatggccaaggccctggtggcctgcaagctgtacaaggccatggcccacgagagcagcgagagtgacctggtggatgacatcagccaggacctggacaacaacagcaaggactttggccagctggccctggagctgctggaccagagctacaagcatgatgagcagatcgccatgaagctgctgacctatgagctgaagaactggagcaacagcacctgcctgaagctggccgtggccgccaagcaccgggacttcatcgcccacacctgcagccagatgctgctgacagacatgtggatgggccgcctgaggatgaggaagaaccctggcctgaaggtgatcatgggcatcctgctgccccccaccatcctcttcctggagttccgcacctatgatgacttctcctaccagaccagcaaagaaaatgaagatggcaaggagaaggaggaggagaacacagatgccaatgctgatgctggcagcaggaaaggagatgaagaaaatgagcacaagaagcagaggagcatccccatcggcaccaagatctgtgagttctacaatgcccccatcgtgaagttctggttctacaccatctcctacctgggctacctgctgctcttcaactacgtgatcctggtgaggatggatggctggcccagcctgcaggagtggatcgtcatctcctacatcgtgtccctggccctggagaagatccgggagatcctgatgtctgagcccgggaagctgagccagaagatcaaggtgtggctgcaggagtactggaacatcacagacctggtggccatcagcaccttcatgattggagccatcctgcggctgcagaaccagccctacatgggctacggccgggtcatctactgtgtggacatcatcttctggtacatccgggtgctggacatcttcggcgtgaacaagtacctgggcccctacgtgatgatgattggcaagatgatgattgacatgctgtactttgtggtgatcatgctggtggtgctgatgagctttggagtggcccggcaggccatcctgcaccctgaggagaagcccagctggaagctggccaggaacatcttctacatgccctactggatgatctatggagaggtgtttgctgaccagattgacctgtatgccatggagatcaaccccccctgtggggagaacctgtatgatgaggagggcaagaggctgcccccctgcatccctggggcctggctgaccccagccctgatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccatgacaggcctgtgctgcccccacccatgatcatcctgagccacatctacatcatcatcatgaggctgagcggccgctgcaggaagaagcgggagggggaccaggaggagcgggaccggggcctgaagctgttcctgagtgatgaggagctgaagaggctgcacgagtttgaggagcagtgtgtgcaggagcacttccgggagaaggaggatgagcagcagagcagcagtgatgagcgcatccgggtgaccagcgagcgggtggagaacatgtccatgaggctggaggagatcaatgaaagagagaccttcatgaagaccagcctgcagacagtggacctgcggctggcccagctggaggagctgagcaacaggatggtgaatgccctggagaacctggccggcatcgacagaagtgacctgatccaggcccggagccgggccagcagtgaatgtgaggccacctacctgctgcggcagagcagcatcaacagcgcagatggctacagcctgtaccgctaccacttcaacggggaggagctgctgtttgaggacaccagcctgagcaccagccctggcactggagtgaggaagaagacctgcagcttccgcatcaaggaggagaaggatgtgaagacccacctggtgcctgagtgccagaacagcctgcacctgagcctgggcaccagcaccagcgccaccccagatggcagccacctggccgtggatgacctgaagaatgctgaggagagcaagctgggccctgacatcggcatcagcaaagaagatgatgagcggcagacagacagcaagaaggaggagaccatcagccccagcctgaacaagacagatgtgatccacggccaggacaagagtgatgtgcagaacacccagctgactgtggagaccaccaacatcgagggcaccatctcctaccccctggaggagaccaagatcacccgctacttcccagatgagaccatcaatgcctgcaagaccatgaagagccgcagctttgtgtacagccggggcaggaagctggtgggcggcgtgaaccaggatgtggagtacagcagcatcacagaccagcagctgaccacagagtggcagtgccaggtgcagaagatcaccaggagccacagcacagacatcccctacatcgtgtctgaggccgctgtgcaggccgagcacaaggagcagtttgctgacatgcaggatgagcaccacgtggccgaggccatcccccgcatcccccggctgagcctgaccatcacagacagaaatggcatggagaacctgctgtctgtgaagccagaccagaccctgggcttccccagcctgcggagcaagagcctgcacggccaccccagaaatgtgaagagcatccagggcaagctggacaggagcggccacgccagctctgtgagcagcctggtgattgtgtctggcatgacagctgaggagaagaaggtgaagaaggagaaggccagcacagaaacagagtgctag

SEQ ID NO: 22284 - DNA, 4812 bp, Artificial Sequence
  Description of Artificial Sequence: Synthetic coding sequence
atgaaggacagcaaccgctgctgctgcggccagttcaccaaccagcacatcccccccctgcccagcgccacccccagcaagaatgaggaggagagcaagcaggtggagacccagcctgagaagtggagcgtggccaagcacacccagagctaccccacagacagctatggagtgctggagttccagggcggcggctacagcaacaaggccatgtacatccgggtgtcctatgacaccaagccagacagcctgctgcacctgatggtgaaggactggcagctggagctgcccaagctgctgatctctgtgcacggcggcctgcagaactttgagatgcagcccaagctgaagcaggtgtttgggaagggcctcatcaaggccgccatgaccactggagcctggatcttcaccggaggagtgtccactggagtcatcagccacgtgggagatgccctgaaggaccacagcagcaagagccggggccgggtgtgtgccatcggcatcgccccctggggcatcgtggagaacaaggaggacctggtgggcaaggatgtgaccagggtgtaccagaccatgagcaaccccctgagcaagctgtctgtgctgaacaacagccacacccacttcatcctggccgacaatggcaccctgggcaagtacggggctgaggtgaagctgcggcggctgctggagaagcacatcagcctgcagaagatcaacacccggctgggccagggcgtgcccctggtgggcctggtggtggagggcggccccaacgtggtgtccatcgtgctggagtacctgcaggaggagccccccatccctgtggtgatctgtgatggcagcggccgggccagtgacatcctgagctttgcccacaagtactgtgaggagggcggcatcatcaatgaaagcctgcgggagcagctgctggtgaccatccagaagaccttcaactacaacaaggcccagagccaccagctgtttgccatcatcatggagtgcatgaagaagaaggagctggtgacagtgttcaggatgggcagcgagggccagcaggacatcgagatggccatcctgacagccctgctgaagggcaccaacgtgtctgccccagaccagctgagcctggccctggcctggaacagagtggacatcgcccggagccagatctttgtgtttggcccccactggccacccctgggcagcctggccccacccacagacagcaaggccacagagaaggagaagaagccacccatggccaccaccaagggcggccggggcaagggcaagggcaagaagaagggcaaggtgaaggaggaggtggaggaggagacagaccccaggaagattgagctgctgaactgggtgaatgccctggagcaggccatgctggatgccctggtgctggacagagtggactttgtgaagctgctgattgaaaatggagtgaacatgcagcacttcctgaccatcccccggctggaggagctgtacaacacccggctgggcccccccaacaccctgcacctgctggtgagagatgtgaagaagagcaacctgcccccagactaccacatcagcctgattgatattggcctggtgctggagtacctgatgggcggggcctaccgctgcaactacaccaggaagaacttccgcaccctgtacaacaacctgtttggccccaagaggcccaaggccctgaagctgctgggcatggaggatgatgagcccccagccaagggcaagaagaagaagaagaagaagaaggaggaggagattgatattgatgtggatgatcctgctgtgagccgcttccagtaccccttccacgagctgatggtgtgggccgtgctgatgaagaggcagaagatggctgtgttcctgtggcagagaggagaggagagcatggccaaggccctggtggcctgcaagctgtacaaggccatggcccacgagagcagcgagagtgacctggtggatgacatcagccaggacctggacaacaacagcaaggactttggccagctggccctggagctgctggaccagagctacaagcatgatgagcagatcgccatgaagctgctgacctatgagctgaagaactggagcaacagcacctgcctgaagctggccgtggccgccaagcaccgggacttcatcgcccacacctgcagccagatgctgctgacagacatgtggatgggccgcctgaggatgaggaagaaccctggcctgaaggtgatcatgggcatcctgctgccccccaccatcctcttcctggagttccgcacctatgatgacttctcctaccagaccagcaaagaaaatgaagatggcaaggagaaggaggaggagaacacagatgccaatgctgatgctggcagcaggaaaggagatgaagaaaatgagcacaagaagcagaggagcatccccatcggcaccaagatctgtgagttctacaatgcccccatcgtgaagttctggttctacaccatctcctacctgggctacctgctgctcttcaactacgtgatcctggtgaggatggatggctggcccagcctgcaggagtggatcgtcatctcctacatcgtgtccctggccctggagaagatccgggagatcctgatgtctgagcccgggaagctgagccagaagatcaaggtgtggctgcaggagtactggaacatcacagacctggtggccatcagcaccttcatgattggagccatcctgcggctgcagaaccagccctacatgggctacggccgggtcatctactgtgtggacatcatcttctggtacatccgggtgctggacatcttcggcgtgaacaagtacctgggcccctacgtgatgatgattggcaagatgatgattgacatgctgtactttgtggtgatcatgctggtggtgctgatgagctttggagtggcccggcaggccatcctgcaccctgaggagaagcccagctggaagctggccaggaacatcttctacatgccctactggatgatctatggagaggtgtttgctgaccagattgacctgtatgccatggagatcaaccccccctgtggggagaacctgtatgatgaggagggcaagaggctgcccccctgcatccctggggcctggctgaccccagccctgatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccatgacaggcctgtgctgcccccacccatgatcatcctgagccacatctacatcatcatcatgaggctgagcggccgctgcaggaagaagcgggagggggaccaggaggagcgggaccggggcctgaagctgttcctgagtgatgaggagctgaagaggctgcacgagtttgaggagcagtgtgtgcaggagcacttccgggagaaggaggatgagcagcagagcagcagtgatgagcgcatccgggtgaccagcgagcgggtggagaacatgtccatgaggctggaggagatcaatgaaagagagaccttcatgaagaccagcctgcagacagtggacctgcggctggcccagctggaggagctgagcaacaggatggtgaatgccctggagaacctggccggcatcgacagaagtgacctgatccaggcccggagccgggccagcagtgaatgtgaggccacctacctgctgcggcagagcagcatcaacagcgcagatggctacagcctgtaccgctaccacttcaacggggaggagctgctgtttgaggacaccagcctgagcaccagccctggcactggagtgaggaagaagacctgcagcttccgcatcaaggaggagaaggatgtgaagacccacctggtgcctgagtgccagaacagcctgcacctgagcctgggcaccagcaccagcgccaccccagatggcagccacctggccgtggatgacctgaagaatgctgaggagagcaagctgggccctgacatcggcatcagcaaagaagatgatgagcggcagacagacagcaagaaggaggagaccatcagccccagcctgaacaagacagatgtgatccacggccaggacaagagtgatgtgcagaacacccagctgactgtggagaccaccaacatcgagggcaccatctcctaccccctggaggagaccaagatcacccgctacttcccagatgagaccatcaatgcctgcaagaccatgaagagccgcagctttgtgtacagccggggcaggaagctggtgggcggcgtgaaccaggatgtggagtacagcagcatcacagaccagcagctgaccacagagtggcagtgccaggtgcagaagatcaccaggagccacagcacagacatcccctacatcgtgtctgaggccgctgtgcaggccgagcacaaggagcagtttgctgacatgcaggatgagcaccacgtggccgaggccatcccccgcatcccccggctgagcctgaccatcacagacagaaatggcatggagaacctgctgtctgtgaagccagaccagaccctgggcttccccagcctgcggagcaagagcctgcacggccaccccagaaatgtgaagagcatccagggcaagctggacaggagcggccacgccagctctgtgagcagcctggtgattgtgtctggcatgacagctgaggagaagaaggtgaagaaggagaaggccagcacagaaacagagtgctag

SEQ ID NO: 22285 - DNA, 4929 bp, Artificial Sequence
  Description of Artificial Sequence: Synthetic coding sequence
atgagcagcttcaagaggggcagcctgaagagcagcaccagcggcagccagaagggccagaagtcctggattgagaagaccttctgcaagcgggagtgcatctttgtgatccccagcatgaaggacagcaaccgctgctgctgcggccagttcaccaaccagcacatcccccccctgcccagcgccacccccagcaagaatgaggaggagagcaagcaggtggagacccagcctgagaagtggagcgtggccaagcacacccagagctaccccacagacagctatggagtgctggagttccagggcggcggctacagcaacaaggccatgtacatccgggtgtcctatgacaccaagccagacagcctgctgcacctgatggtgaaggactggcagctggagctgcccaagctgctgatctctgtgcatggaggcctgcagaactttgagatgcagcccaagctgaagcaggtgtttgggaagggcctcatcaaggccgccatgaccaccggggcctggatcttcaccggcggcgtgtccactggagtcatcagccacgtgggagatgccctgaaggaccacagcagcaagagccggggccgggtgtgtgccatcggcatcgccccctggggcatcgtggagaacaaggaggacctggtgggcaaggatgtgaccagggtgtaccagaccatgagcaaccccctgagcaagctgtctgtgctgaacaacagccacacccacttcatcctggccgacaatggcaccctgggcaagtatggagctgaggtgaagctgcggcggctgctggagaagcacatcagcctgcagaagatcaacacccggctgggccagggcgtgcccctggtgggcctggtggtggagggcggccccaacgtggtgtccatcgtgctggagtacctgcaggaggagccccccatccctgtggtgatctgtgatggcagcggccgggccagtgacatcctgagctttgcccacaagtactgtgaggagggcggcatcatcaatgaaagcctgcgggagcagctgctggtgaccatccagaagaccttcaactacaacaaggcccagagccaccagctgtttgccatcatcatggagtgcatgaagaagaaggagctggtgaccgtcttcaggatgggcagcgagggccagcaggacatcgagatggccatcctgacagccctgctgaagggcaccaacgtgtctgccccagaccagctgagcctggccctggcctggaacagagtggacatcgcccggagccagatctttgtgtttggcccccactggccacccctgggcagcctggccccacccacagacagcaaggccacagagaaggagaagaagccacccatggccaccaccaagggcggccggggcaagggcaagggcaagaagaagggcaaggtgaaggaggaggtggaggaggagacagaccccaggaagattgagctgctgaactgggtgaatgccctggagcaggccatgctggatgccctggtgctggacagagtggactttgtgaagctgctgattgaaaatggagtgaacatgcagcacttcctgaccatcccccggctggaggagctgtacaacacccggctgggcccccccaacaccctgcacctgctggtgagagatgtgaagaagagcaacctgcccccagactaccacatcagcctgattgacatcggcctggtgctggagtacctgatgggcggggcctaccgctgcaactacaccaggaagaacttccgcaccctgtacaacaacctgtttggccccaagaggcccaaggccctgaagctgctgggcatggaggatgatgagcccccagccaagggcaagaagaagaagaagaagaagaaggaggaggagattgatattgatgtggatgatcctgctgtgagccgcttccagtaccccttccacgagctgatggtgtgggccgtgctgatgaagaggcagaagatggctgtgttcctgtggcagagaggagaggagagcatggccaaggccctggtggcctgcaagctgtacaaggccatggcccacgagagcagcgagagtgacctggtggatgacatcagccaggacctggacaacaacagcaaggactttggccagctggccctggagctgctggaccagagctacaagcatgatgagcagatcgccatgaagctgctgacctatgagctgaagaactggagcaacagcacctgcctgaagctggccgtggccgccaagcaccgggacttcatcgcccacacctgcagccagatgctgctgacagacatgtggatgggccgcctgaggatgaggaagaaccctggcctgaaggtgatcatgggcatcctgctgccccccaccatcctcttcctggagttccgcacctatgatgacttctcctaccagaccagcaaagaaaatgaagatggcaaggagaaggaggaggagaacacagatgccaatgctgatgctggcagcaggaaaggagatgaggagaatgagcacaagaagcagaggagcatccccatcggcaccaagatctgtgagttctacaatgcccccatcgtgaagttctggttctacaccatctcctacctgggctacctgctgctcttcaactacgtgatcctggtgaggatggatggctggcccagcctgcaggagtggatcgtcatctcctacatcgtgtccctggccctggagaagatccgggagatcctgatgtctgagcccgggaagctgagccagaagatcaaggtgtggctgcaggagtactggaacatcacagacctggtggccatcagcaccttcatgattggagccatcctgcggctgcagaaccagccctacatgggctacggccgggtcatctactgtgtggacatcatcttctggtacatccgggtgctggacatctttggagtgaacaagtacctgggcccctacgtgatgatgattggcaagatgatgattgacatgctgtactttgtggtgatcatgctggtggtgctgatgagctttggagtggcccggcaggccatcctgcaccctgaggagaagcccagctggaagctggccaggaacatcttctacatgccctactggatgatctacggggaggtgtttgctgaccagattgacctgtatgccatggagatcaaccccccctgtggggagaacctgtatgatgaggagggcaagaggctgcccccctgcatccctggggcctggctgaccccagccctgatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccatgacaggcctgtgctgcccccacccatgatcatcctgagccacatctacatcatcatcatgaggctgagcggccgctgcaggaagaagcgggagggggaccaggaggagcgggaccggggcctgaagctgttcctgagtgatgaggagctgaagaggctgcatgaatttgaggagcagtgtgtgcaggagcacttccgggagaaggaggatgagcagcagagcagcagtgatgagcgcatccgggtgaccagcgagcgggtggagaacatgtccatgaggctggaggagatcaatgaaagagagaccttcatgaagaccagcctgcagacagtggacctgcggctggcccagctggaggagctgagcaacaggatggtgaatgccctggagaacctggccggcatcgacagaagtgacctgatccaggcccggagccgggccagcagtgaatgtgaggccacctacctgctgcggcagagcagcatcaacagcgcagatggctacagcctgtaccgctaccacttcaatggagaggagctgctgtttgaggacaccagcctgagcaccagccctggcaccggggtgaggaagaagacctgcagcttccgcatcaaggaggagaaggatgtgaagacccacctggtgcctgagtgccagaacagcctgcacctgagcctgggcaccagcaccagcgccaccccagatggcagccacctggccgtggatgacctgaagaatgctgaggagagcaagctgggccctgacatcggcatcagcaaggaggatgatgagcggcagacagacagcaagaaggaggagaccatcagccccagcctgaacaagacagatgtgattcatggccaggacaagagtgatgtgcagaacacccagctgactgtggagaccaccaacatcgagggcaccatctcctaccccctggaggagaccaagatcacccgctacttcccagatgagaccatcaatgcctgcaagaccatgaagagccgcagctttgtgtacagccggggcaggaagctggtgggcggcgtgaaccaggatgtggagtacagcagcatcacagaccagcagctgaccacagagtggcagtgccaggtgcagaagatcaccaggagccacagcacagacatcccctacatcgtgtctgaggccgctgtgcaggccgagcacaaggagcagtttgctgacatgcaggatgagcaccacgtggccgaggccatcccccgcatcccccggctgagcctgaccatcacagacagaaatggcatggagaacctgctgtctgtgaagccagaccagaccctgggcttccccagcctgcggagcaagagcctgcacggccaccccagaaatgtgaagagcatccagggcaagctggacagaagtggccacgccagctctgtgagcagcctggtgattgtgtctggcatgacagctgaggagaagaaggtgaagaaggagaaggccagcacagaaacagaatgttag

SEQ ID NO: 22286 - DNA, 4173 bp, Artificial Sequence
  Description of Artificial Sequence: Synthetic coding sequence
atgaaggacagcaaccgctgctgctgcggccagttcaccaaccagcacatcccccccctgcccagcgccacccccagcaagaatgaggaggagagcaagcaggtggagacccagcctgagaagtggagcgtggccaagcacacccagagctaccccacagacagctatggagtgctggagttccagggcggcggctacagcaacaaggccatgtacatccgggtgtcctatgacaccaagccagacagcctgctgcacctgatggtgaaggactggcagctggagctgcccaagctgctgatctctgtgcacggcggcctgcagaactttgagatgcagcccaagctgaagcaggtgtttgggaagggcctcatcaaggccgccatgaccactggagcctggatcttcaccggaggagtgtccactggagtcatcagccacgtgggagatgccctgaaggaccacagcagcaagagccggggccgggtgtgtgccatcggcatcgccccctggggcatcgtggagaacaaggaggacctggtgggcaaggatgtgaccagggtgtaccagaccatgagcaaccccctgagcaagctgtctgtgctgaacaacagccacacccacttcatcctggccgacaatggcaccctgggcaagtacggggctgaggtgaagctgcggcggctgctggagaagcacatcagcctgcagaagatcaacacccggctgggccagggcgtgcccctggtgggcctggtggtggagggcggccccaacgtggtgtccatcgtgctggagtacctgcaggaggagccccccatccctgtggtgatctgtgatggcagcggccgggccagtgacatcctgagctttgcccacaagtactgtgaggagggcggcatcatcaatgaaagcctgcgggagcagctgctggtgaccatccagaagaccttcaactacaacaaggcccagagccaccagctgtttgccatcatcatggagtgcatgaagaagaaggagctggtgacagtgttcaggatgggcagcgagggccagcaggacatcgagatggccatcctgacagccctgctgaagggcaccaacgtgtctgccccagaccagctgagcctggccctggcctggaacagagtggacatcgcccggagccagatctttgtgtttggcccccactggccacccctgggcagcctggccccacccacagacagcaaggccacagagaaggagaagaagccacccatggccaccaccaagggcggccggggcaagggcaagggcaagaagaagggcaaggtgaaggaggaggtggaggaggagacagaccccaggaagattgagctgctgaactgggtgaatgccctggagcaggccatgctggatgccctggtgctggacagagtggactttgtgaagctgctgattgaaaatggagtgaacatgcagcacttcctgaccatcccccggctggaggagctgtacaacacccggctgggcccccccaacaccctgcacctgctggtgagagatgtgaagaagagcaacctgcccccagactaccacatcagcctgattgatattggcctggtgctggagtacctgatgggcggggcctaccgctgcaactacaccaggaagaacttccgcaccctgtacaacaacctgtttggccccaagaggcccaaggccctgaagctgctgggcatggaggatgatgagcccccagccaagggcaagaagaagaagaagaagaagaaggaggaggagattgatattgatgtggatgatcctgctgtgagccgcttccagtaccccttccacgagctgatggtgtgggccgtgctgatgaagaggcagaagatggctgtgttcctgtggcagagaggagaggagagcatggccaaggccctggtggcctgcaagctgtacaaggccatggcccacgagagcagcgagagtgacctggtggatgacatcagccaggacctggacaacaacagcaaggactttggccagctggccctggagctgctggaccagagctacaagcatgatgagcagatcgccatgaagctgctgacctatgagctgaagaactggagcaacagcacctgcctgaagctggccgtggccgccaagcaccgggacttcatcgcccacacctgcagccagatgctgctgacagacatgtggatgggccgcctgaggatgaggaagaaccctggcctgaaggtgatcatgggcatcctgctgccccccaccatcctcttcctggagttccgcacctatgatgacttctcctaccagaccagcaaagaaaatgaagatggcaaggagaaggaggaggagaacacagatgccaatgctgatgctggcagcaggaaaggagatgaagaaaatgagcacaagaagcagaggagcatccccatcggcaccaagatctgtgagttctacaatgcccccatcgtgaagttctggttctacaccatctcctacctgggctacctgctgctcttcaactacgtgatcctggtgaggatggatggctggcccagcctgcaggagtggatcgtcatctcctacatcgtgtccctggccctggagaagatccgggagatcctgatgtctgagcccgggaagctgagccagaagatcaaggtgtggctgcaggagtactggaacatcacagacctggtggccatcagcaccttcatgattggagccatcctgcggctgcagaaccagccctacatgggctacggccgggtcatctactgtgtggacatcatcttctggtacatccgggtgctggacatcttcggcgtgaacaagtacctgggcccctacgtgatgatgattggcaagatgatgattgacatgctgtactttgtggtgatcatgctggtggtgctgatgagctttggagtggcccggcaggccatcctgcaccctgaggagaagcccagctggaagctggccaggaacatcttctacatgccctactggatgatctatggagaggtgtttgctgaccagattgacctgtatgccatggagatcaaccccccctgtggggagaacctgtatgatgaggagggcaagaggctgcccccctgcatccctggggcctggctgaccccagccctgatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccatgacaggcctgtgctgcccccacccatgatcatcctgagccacatctacatcatcatcatgaggctgagcggccgctgcaggaagaagcgggagggggaccaggaggagcgggaccggggcctgaagctgttcctgagtgatgaggagctgaagaggctgcacgagtttgaggagcagtgtgtgcaggagcacttccgggagaaggaggatgagcagcagagcagcagtgatgagcgcatccgggtgaccagcgagcgggtggagaacatgtccatgaggctggaggagatcaatgaaagagagaccttcatgaagaccagcctgcagacagtggacctgcggctggcccagctggaggagctgagcaacaggatggtgaatgccctggagaacctggccggcatcgacagaagtgacctgatccaggcccggagccgggccagcagtgaatgtgaggccacctacctgctgcggcagagcagcatcaacagcgcagatggctacagcctgtaccgctaccacttcaacggggaggagctgctgtttgaggacaccagcctgagcaccagccctggcactggagtgaggaagaagacctgcagcttccgcatcaaggaggagaaggatgtgaagacccacctggtgcctgagtgccagaacagcctgcacctgagcctgggcaccagcaccagcgccaccccagatggcagccacctggccgtggatgacctgaagaatgctgaggagagcaagctgggccctgacatcggcatcagcaaagaagatgatgagcggcagacagacagcaagaaggaggagaccatcagccccagcctgaacaagacagatgtgatccacggccagtag

SEQ ID NO: 22287 - DNA, 4584 bp, Artificial Sequence
  Description of Artificial Sequence: Synthetic coding sequence
atgtacatccgggtgtcctatgacaccaagccagacagcctgctgcacctgatggtgaaggactggcagctggagctgcccaagctgctgatctctgtgcacggcggcctgcagaactttgagatgcagcccaagctgaagcaggtgtttgggaagggcctcatcaaggccgccatgaccactggagcctggatcttcaccggaggagtgtccactggagtcatcagccacgtgggagatgccctgaaggaccacagcagcaagagccggggccgggtgtgtgccatcggcatcgccccctggggcatcgtggagaacaaggaggacctggtgggcaaggatgtgaccagggtgtaccagaccatgagcaaccccctgagcaagctgtctgtgctgaacaacagccacacccacttcatcctggccgacaatggcaccctgggcaagtacggggctgaggtgaagctgcggcggctgctggagaagcacatcagcctgcagaagatcaacacccggctgggccagggcgtgcccctggtgggcctggtggtggagggcggccccaacgtggtgtccatcgtgctggagtacctgcaggaggagccccccatccctgtggtgatctgtgatggcagcggccgggccagtgacatcctgagctttgcccacaagatcatcaatgaaagcctgcgggagcagctgctggtgaccatccagaagaccttcaactacaacaaggcccagagccaccagctgtttgccatcatcatggagtgcatgaagaagaaggagctggtgacagtgttcaggatgggcagcgagggccagcaggacatcgagatggccatcctgacagccctgctgaagggcaccaacgtgtctgccccagaccagctgagcctggccctggcctggaacagagtggacatcgcccggagccagatctttgtgtttggcccccactggccacccctgggcagcctggccccacccacagacagcaaggccacagagaaggagaagaagccacccatggccaccaccaagggcggccggggcaagggcaagggcaagaagaagggcaaggtgaaggaggaggtggaggaggagacagaccccaggaagattgagctgctgaactgggtgaatgccctggagcaggccatgctggatgccctggtgctggacagagtggactttgtgaagctgctgattgaaaatggagtgaacatgcagcacttcctgaccatcccccggctggaggagctgtacaacacccggctgggcccccccaacaccctgcacctgctggtgagagatgtgaagaagagcaacctgcccccagactaccacatcagcctgattgatattggcctggtgctggagtacctgatgggcggggcctaccgctgcaactacaccaggaagaacttccgcaccctgtacaacaacctgtttggccccaagaggcccaaggccctgaagctgctgggcatggaggatgatgagcccccagccaagggcaagaagaagaagaagaagaagaaggaggaggagattgatattgatgtggatgatcctgctgtgagccgcttccagtaccccttccacgagctgatggtgtgggccgtgctgatgaagaggcagaagatggctgtgttcctgtggcagagaggagaggagagcatggccaaggccctggtggcctgcaagctgtacaaggccatggcccacgagagcagcgagagtgacctggtggatgacatcagccaggacctggacaacaacagcaaggactttggccagctggccctggagctgctggaccagagctacaagcatgatgagcagatcgccatgaagctgctgacctatgagctgaagaactggagcaacagcacctgcctgaagctggccgtggccgccaagcaccgggacttcatcgcccacacctgcagccagatgctgctgacagacatgtggatgggccgcctgaggatgaggaagaaccctggcctgaaggtgatcatgggcatcctgctgccccccaccatcctcttcctggagttccgcacctatgatgacttctcctaccagaccagcaaagaaaatgaagatggcaaggagaaggaggaggagaacacagatgccaatgctgatgctggcagcaggaaaggagatgaagaaaatgagcacaagaagcagaggagcatccccatcggcaccaagatctgtgagttctacaatgcccccatcgtgaagttctggttctacaccatctcctacctgggctacctgctgctcttcaactacgtgatcctggtgaggatggatggctggcccagcctgcaggagtggatcgtcatctcctacatcgtgtccctggccctggagaagatccgggagatcctgatgtctgagcccgggaagctgagccagaagatcaaggtgtggctgcaggagtactggaacatcacagacctggtggccatcagcaccttcatgattggagccatcctgcggctgcagaaccagccctacatgggctacggccgggtcatctactgtgtggacatcatcttctggtacatccgggtgctggacatcttcggcgtgaacaagtacctgggcccctacgtgatgatgattggcaagatgatgattgacatgctgtactttgtggtgatcatgctggtggtgctgatgagctttggagtggcccggcaggccatcctgcaccctgaggagaagcccagctggaagctggccaggaacatcttctacatgccctactggatgatctatggagaggtgtttgctgaccagattgacctgtatgccatggagatcaaccccccctgtggggagaacctgtatgatgaggagggcaagaggctgcccccctgcatccctggggcctggctgaccccagccctgatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccatgacaggcctgtgctgcccccacccatgatcatcctgagccacatctacatcatcatcatgaggctgagcggccgctgcaggaagaagcgggagggggaccaggaggagcgggaccggggcctgaagctgttcctgagtgatgaggagctgaagaggctgcacgagtttgaggagcagtgtgtgcaggagcacttccgggagaaggaggatgagcagcagagcagcagtgatgagcgcatccgggtgaccagcgagcgggtggagaacatgtccatgaggctggaggagatcaatgaaagagagaccttcatgaagaccagcctgcagacagtggacctgcggctggcccagctggaggagctgagcaacaggatggtgaatgccctggagaacctggccggcatcgacagaagtgacctgatccaggcccggagccgggccagcagtgaatgtgaggccacctacctgctgcggcagagcagcatcaacagcgcagatggctacagcctgtaccgctaccacttcaacggggaggagctgctgtttgaggacaccagcctgagcaccagccctggcactggagtgaggaagaagacctgcagcttccgcatcaaggaggagaaggatgtgaagacccacctggtgcctgagtgccagaacagcctgcacctgagcctgggcaccagcaccagcgccaccccagatggcagccacctggccgtggatgacctgaagaatgctgaggagagcaagctgggccctgacatcggcatcagcaaagaagatgatgagcggcagacagacagcaagaaggaggagaccatcagccccagcctgaacaagacagatgtgatccacggccaggacaagagtgatgtgcagaacacccagctgactgtggagaccaccaacatcgagggcaccatctcctaccccctggaggagaccaagatcacccgctacttcccagatgagaccatcaatgcctgcaagaccatgaagagccgcagctttgtgtacagccggggcaggaagctggtgggcggcgtgaaccaggatgtggagtacagcagcatcacagaccagcagctgaccacagagtggcagtgccaggtgcagaagatcaccaggagccacagcacagacatcccctacatcgtgtctgaggccgctgtgcaggccgagcacaaggagcagtttgctgacatgcaggatgagcaccacgtggccgaggccatcccccgcatcccccggctgagcctgaccatcacagacagaaatggcatggagaacctgctgtctgtgaagccagaccagaccctgggcttccccagcctgcggagcaagagcctgcacggccaccccagaaatgtgaagagcatccagggcaagctggacaggagcggccacgccagctctgtgagcagcctggtgattgtgtctggcatgacagctgaggagaagaaggtgaagaaggagaaggccagcacagaaacagagtgctag

SEQ ID NO: 22288 - DNA, 1479 bp, Artificial Sequence
  Description of Artificial Sequence: Synthetic coding sequence
atggccctgaacagcggcagccccccagccatcggcccctactatgagaaccacggctaccagcctgagaacccctacccagcccagcccaccgtggtgcccaccgtgtatgaggtgcacccagcccagtactaccccagccctgtgccccagtatgccccccgggtgctgacccaggccagcaaccctgtggtgtgcacccagcccaagagccccagcggcaccgtgtgcaccagcaagaccaagaaggccctgtgcatcaccctgaccctgggcaccttcctggtgggcgccgccctggccgccggcctgctgtggaagttcatgggcagcaagtgcagcaacagcggcattgaatgtgacagcagcggcacctgcatcaaccccagcaactggtgtgatggagtgagccactgccctggaggagaagatgaaaatagatgtgtgcggctgtatggccccaacttcatcctgcaggtgtacagcagccagaggaagtcctggcaccctgtgtgccaggatgactggaatgaaaactacggccgggccgcctgccgggacatgggctacaagaacaacttctacagcagccagggcatcgtggatgacagcggcagcaccagcttcatgaagctgaacaccagcgctggaaatgtggacatctacaagaagctgtaccacagtgatgcctgcagcagcaaggctgtggtgtccctgcgctgcatcgcctgtggggtgaacctgaacagcagccggcagagccgcatcgtgggcggggagagcgccctgcccggggcctggccctggcaggtgtccctgcacgtgcagaatgtgcacgtgtgtggcggcagcatcatcaccccagagtggatcgtgacagctgcccactgtgtggagaagcccctgaacaacccctggcactggacagcctttgctggcatcctgcggcagagcttcatgttctacggggccggctaccaggtggagaaggtgatcagccaccccaactatgacagcaagaccaagaacaatgacatcgccctgatgaagctgcagaagcccctgaccttcaatgacctggtgaagcctgtgtgcctgcccaaccctggcatgatgctgcagcctgagcagctgtgctggatcagcggctggggcgccacagaggagaagggcaagaccagcgaggtgctgaatgctgccaaggtgctgctgattgagacccagcgctgcaacagccgctacgtgtatgacaacctgatcaccccagccatgatctgtgccggcttcctgcagggcaatgtggacagctgccagggcgacagcggcggccccctggtgaccagcaagaacaacatctggtggctgattggagacacctcctggggcagcggctgtgccaaggcctacagacctggggtgtatggaaatgtgatggtgttcacagactggatctaccggcagatgagagcagatggatag

SEQ ID NO: 22289 - DNA, 1590 bp, Artificial Sequence
  Description of Artificial Sequence: Synthetic coding sequence
atgcccccagcccctcctggaggagagagcggctgtgaggagagaggagctgctggccacatcgagcacagccgctacctgagcctgctggatgctgtggacaacagcaagatggccctgaacagcggcagccccccagccatcggcccctactatgaaaatcatggctaccagcctgagaacccctacccagcccagcccaccgtggtgcccaccgtgtatgaggtgcacccagcccagtactaccccagccctgtgccccagtatgccccccgggtgctgacccaggccagcaaccctgtggtgtgcacccagcccaagagccccagcggcaccgtgtgcaccagcaagaccaagaaggccctgtgcatcaccctgaccctgggcaccttcctggtgggcgccgccctggccgccggcctgctgtggaagttcatgggcagcaagtgcagcaacagcggcattgaatgtgacagcagcggcacctgcatcaaccccagcaactggtgtgatggagtgagccactgccctggaggagaagatgagaacagatgtgtgcggctgtatggccccaacttcatcctgcaggtgtacagcagccagaggaagtcctggcaccctgtgtgccaggatgactggaatgaaaattatggccgggccgcctgccgggacatgggctacaagaacaacttctacagcagccagggcatcgtggatgattctggcagcaccagcttcatgaagctgaacaccagcgctggaaatgtggacatctacaagaagctgtaccacagtgatgcctgcagcagcaaggctgtggtgtccctgcgctgcatcgcctgtggggtgaacctgaacagcagccggcagagcagaattgtgggcggggagagcgccctgcccggggcctggccctggcaggtgtccctgcacgtgcagaatgtgcacgtgtgtggcggcagcatcatcaccccagagtggatcgtgacagctgcccactgtgtggagaagcccctgaacaacccctggcactggacagcctttgctggcatcctgcggcagagcttcatgttttatggagctggctaccaggtggagaaggtgatcagccaccccaactatgacagcaagaccaagaacaatgacatcgccctgatgaagctgcagaagcccctgaccttcaatgacctggtgaagcctgtgtgcctgcccaaccctggcatgatgctgcagcctgagcagctgtgctggatcagcggctggggcgccacagaggagaagggcaagaccagcgaggtgctgaatgctgccaaggtgctgctgattgagacccagcgctgcaacagccgctacgtgtatgacaacctgatcaccccagccatgatctgtgccggcttcctgcagggcaatgtggacagctgccagggcgacagcggcggccccctggtgaccagcaagaacaacatctggtggctgattggagacacctcctggggcagcggctgtgccaaggcctacagacctggggtgtatggaaatgtgatggtgttcacagactggatctaccggcagatgagagcagatggatag

SEQ ID NO: 22290 - DNA, 1470 bp, Artificial Sequence
  Description of Artificial Sequence: Synthetic coding sequence
atggccctgaacagcggcagccccccagccatcggcccctactatgagaaccacggctaccagcctgagaacccctacccagcccagcccaccgtggtgcccaccgtgtatgaggtgcacccagcccagtactaccccagccctgtgccccagtatgccccccgggtgctgacccaggccagcaaccctgtggtgtgcacccagcccaagagccccagcggcaccgtgtgcaccagcaagaccaagaaggccctgtgcatcaccctgaccctgggcaccttcctggtgggcgccgccctggccgccggcctgctgtggaagttcatgggcagcaagtgcagcaacagcggcattgaatgtgacagcagcggcacctgcatcaaccccagcaactggtgtgatggagtgagccactgccctggaggagaagatgaaaatagatgtgtgcggctgtatggccccaacttcatcctgcaggtgtacagcagccagaggaagtcctggcaccctgtgtgccaggatgactggaatgaaaactacggccgggccgcctgccgggacatgggctacaagaacaacttctacagcagccagggcatcgtggatgacagcggcagcaccagcttcatgaagctgaacaccagcgctggaaatgtggacatctacaagaagctgtaccacagtgatgcctgcagcagcaaggctgtggtgtccctgcgctgcatcgcctgtggggtgaacctgaacagcagccggcagagccgcatcgtgggcggggagagcgccctgcccggggcctggccctggcaggtgtccctgcacgtgcagaatgtgcacgtgtgtggcggcagcatcatcaccccagagtggatcgtgacagctgcccactgtgtggagaagcccctgaacaacccctggcactggacagcctttgctggcatcctgcggcagagcttcatgttctacggggccggctaccaggtggagaaggtgatcagccaccccaactatgacagcaagaccaagaacaatgacatcgccctgatgaagctgcagaagcccctgaccttcaatgacctggtgaagcctgtgtgcctgcccaaccctggcatgatgctgcagcctgagcagctgtgctggatcagcggctggggcgccacagaggagaagggcaagaccagcgaggtgctgaatgctgccaaggtgctgctgattgagacccagcgctgcaacagccgctacgtgtatgacaacctgatcaccccagccatgatctgtgccggcttcctgcagggcaatgtggacagctgccagggcgacagcggcggccccctggtgaccagcaagaacaacatctggtggctgattggagacacctcctggggcagcggctgtgccaaggcctacagacctggggtgtatggaaatgtgatggtgttcacagactggatctaccggcagatgaggtag

SEQ ID NO: 22291 - DNA, 240 bp, Artificial Sequence
  Description of Artificial Sequence: Synthetic coding sequence
atggccctgaacagcggcagccccccagccatcggcccctactatgagaaccacggctaccagcctgagaacccctacccagcccagcccaccgtggtgcccaccgtgtatgaggtgcacccagcccagtactaccccagccctgtgccccagtatgccccccgggtgctgacccaggccagcaaccctgtggtgtgcacccagcccaagagccccagcggcaccgtgtgcaccagctag

SEQ ID NO: 22292 - DNA, 1479 bp, Artificial Sequence; identical to SEQ ID NO: 22288
  Description of Artificial Sequence: Synthetic coding sequence

SEQ ID NO: 22293 - DNA, 717 bp, Artificial Sequence
  Description of Artificial Sequence: Synthetic coding sequence
atgtatgcccctgggggcgccggcctgcccggcggcagaagaagaagaagccctgggggcagcgccctgcccaagcagcctgagaggagcctggccagcgccctgcccggggccctgagcatcacagccctgtgcacagccctggccgagcccgcctggctgcacatccatggaggcacctgcagccggcaggagctgggcgtgtctgatgtgctgggctacgtgcacccagacctgctgaaggacttctgcatgaacccccagacagtgctgctgctgcgggtgattgctgccttctgcttcctgggcatcctgtgcagcctgagcgccttcctgctggatgtgtttggccccaagcacccagccctgaagatcaccaggagatatgcctttgcccacatcctgactgtgctgcagtgtgccaccgtcatcggcttctcctactgggccagcgagctgatcctggcccagcagcagcagcacaagaagtaccacggcagccaggtgtatgtgacctttgctgtgtccttctacctggtggccggggccggcggggccagcatcctggccacagctgccaacctgctgcggcactaccccacagaggaggaggagcaggccctggagctgctgtctgagatggaggagaatgagccctacccagcagaatatgaggtgatcaaccagttccagcccccaccagcctacaccccctag

SEQ ID NO: 22294 - DNA, 717 bp, Artificial Sequence; identical to SEQ ID NO: 22293
  Description of Artificial Sequence: Synthetic coding sequence

SEQ ID NO: 22295 - DNA, 3075 bp, Artificial Sequence
  Description of Artificial Sequence: Synthetic coding sequence
atgtgtgccaggatggccggccgcaccacagctgccccccggggcccctacggcccctggctgtgcctgctggtggccctggccctggatgtggtgcgggtggactgtggccaggcccccctggaccctgtgtacctgcctgctgccctggagctgctggatgcccctgagcacttccgggtgcagcaggtgggccactaccccccagccaacagcagcctgagcagccgctctgagaccttcctgctgctgcagccctggccccgggcccagcccctgctgcgggccagctaccccccatttgccacccagcaggtggtgcccccccgggtgacagagccccaccagaggcctgtgccctgggatgtgcgggctgtgtctgtggaggccgctgtgaccccagctgagccctatgcccgggtgctcttccacctgaagggccaggactggcccccaggcagcggcagcctgccctgtgcccggctgcacgccacccaccctgctggaacagcccaccaggcctgccgcttccagcccagcctgggcgcctgtgtggtggagctggagctgcccagccactggttcagccaggccagcaccaccagggctgagctggcctacaccctggagcctgctgctgagggccctgggggctgcggcagcggggaggagaatgaccctggagagcaggccctgcctgtgggcggcgtggagctgcggcctgctgaccccccccagtaccaggaggtgcccctggatgaagctgtgaccctgcgggtgcctgacatgcctgtgcggcccggccagctgttcagcgccaccctgctgctgcggcacaacttcaccgccagcctgctgaccctgcgcatcaaggtgaagaagggcctgcacgtgacagctgcccggcctgcccagcccaccctgtggacagccaagctggaccgcttcaagggcagccgccaccacaccaccctcatcacctgccacagagctggcctgacagagccagacagcagcagccccctggagctgtctgagttcctgtgggtggactttgtggtggagaacagcactggaggaggagtggccgtgaccaggcctgtgacctggcagctggagtacccaggccaggcccctgaggccgagaaggacaagatggtgtgggagatcctggtgtctgagcgggacatccgggccctgatccccctggccaaggccgaggagctggtgaacacagcccccctgactggagtgccccagcacgtgcctgtgcggctggtgacagtggatggcggcggggccctggtggaggtgacagaacatgtgggctgtgagagcgccaacacccaggtgctgcaggtgtctgaggcctgtgatgctgtgtttgtggccggcaaggagagcagaggagcccggggcgtgcgggtggacttctggtggaggcggctgcgggccagcctgcggctgactgtgtgggcccccctgctgcccctgcgcatcgagctgacagacaccaccctggagcaggtgcggggctggagggtgcccggccctgctgagggccctgctgagcctgctgctgaggccagtgatgaagctgagcggcgggcccggggctgccacctgcagtaccagagagctggggtgcgcttcctggccccctttgctgcccaccccctggatggcggccggcggctgacccacctgctgggccctgactggctgctggatgtgagccacctggtggcccctcatgcccgggtgctggacagccgggtggccagcctggagggcggccgggtggtggtgggccgggagcccggggtgaccagcattgaggtgcgcagccccctgagtgacagcatcctgggggagcaggccctggccgtgacagatgacaaggtgtctgtgctggagctgcgggtgcagcctgtgatgggcatcagcctgaccctgagccggggcacagcccaccctggagaggtgacagccacctgctgggcccagagcgccctgcctgcccccaagcaggaggtggccctgagcctgtggctgtccttcagtgaccacacagtggccccagctgagctgtatgaccggcgggacctgggcctgtctgtgtctgctgaggagcccggggccatcctgcctgctgaggagcagggcgcccagctgggcgtggtggtgtctggggccggggctgagggcctgcccctgcacgtggccctgcaccccccagagccctgccggcggggccgccaccgggtgcccctggccagcggcacagcctggctgggcctgcccccagccagcaccccagccccagccctgcccagcagccctgcctggagccccccagccacagaggccaccatgggcggcaagaggcaggtggccggctctgtgggcggcaacacaggagtgcggggcaagtttgaaagagctgaggaggaggccaggaaggaggagacagaggcccgggaggaggaggaggaggaggaggaggagatggtgcctgccccccagcacgtgacagagctggagctgggcatgtatgccctgctgggcgtcttctgtgtggccatcttcatcttcctggtgaatggagtggtgtttgtgctgcgctaccagaggaaggagcccccagacagcgccacagaccccaccagcccccagccccacaactgggtgtggctgggcacagaccaggaggagctgagccggcagctggaccggcagagccctggcccccccaagggggagggcagctgcccctgtgagagcggcggcggcggggaggcccccaccctggcccctggccccccaggcggcaccaccagcagcagcagcaccctggccaggaaggaggccggcggccgcaggaagagggtggagtttgtgacctttgccccagcccccccagcccagagccctgaggagcctgtgggcgccccagctgtgcagagcatcctggtggccggggaggaggacatccgctgggtgtgtgaggacatgggcctgaaggaccctgaggagctgaggaactacatggagcgcatccggggcagcagctag

SEQ ID NO: 22296 - DNA, 3072 bp, Artificial Sequence
  Description of Artificial Sequence: Synthetic coding sequence
atgtgtgccaggatggccggccgcaccacagctgccccccggggcccctacggcccctggctgtgcctgctggtggccctggccctggatgtggtgcgggtggactgtggccaggcccccctggaccctgtgtacctgcctgctgccctggagctgctggatgcccctgagcacttccgggtgcagcaggtgggccactaccccccagccaacagcagcctgagcagccgctctgagaccttcctgctgctgcagccctggccccgggcccagcccctgctgcgggccagctaccccccatttgccacccagcaggtggtgcccccccgggtgacagagccccaccagaggcctgtgccctgggatgtgcgggctgtgtctgtggaggccgctgtgaccccagctgagccctatgcccgggtgctcttccacctgaagggccaggactggcccccaggcagcggcagcctgccctgtgcccggctgcacgccacccaccctgctggaacagcccaccaggcctgccgcttccagcccagcctgggcgcctgtgtggtggagctggagctgcccagccactggttcagccaggccagcaccaccagggctgagctggcctacaccctggagcctgctgctgagggccctgggggctgcggcagcggggaggagaatgaccctggagagcaggccctgcctgtgggcggcgtggagctgcggcctgctgaccccccccagtaccaggaggtgcccctggatgaagctgtgaccctgcgggtgcctgacatgcctgtgcggcccggccagctgttcagcgccaccctgctgctgcggcacaacttcaccgccagcctgctgaccctgcgcatcaaggtgaagaagggcctgcacgtgacagctgcccggcctgcccagcccaccctgtggacagccaagctggaccgcttcaagggcagccgccaccacaccaccctcatcacctgccacagagctggcctgacagagccagacagcagccccctggagctgtctgagttcctgtgggtggactttgtggtggagaacagcactggaggcggcgtggccgtgaccaggcctgtgacctggcagctggagtacccaggccaggcccctgaggccgagaaggacaagatggtgtgggagatcctggtgtctgagcgggacatccgggccctgatccccctggccaaggccgaggagctggtgaacacagcccccctgactggagtgccccagcacgtgcctgtgcggctggtgacagtggatggcggcggggccctggtggaggtgacagagcacgtgggctgtgagagcgccaacacccaggtgctgcaggtgtctgaggcctgtgatgctgtgtttgtggccggcaaggagagcagaggagcccggggcgtgcgggtggacttctggtggaggcggctgcgggccagcctgcggctgactgtgtgggcccccctgctgcccctgagaattgagctgacagacaccaccctggagcaggtgcggggctggagggtgcccggccctgctgagggccctgctgagcctgctgctgaggccagtgatgaggccgagcggcgggcccggggctgccacctgcagtaccagagagctggggtgcgcttcctggccccctttgctgcccaccccctggatggcggccgccgcctgacccacctgctgggccctgactggctgctggatgtgagccacctggtggccccccacgcccgggtgctggacagccgggtggccagcctggagggcggccgggtggtggtgggccgggagcccggggtgaccagcattgaggtgcgcagccccctgagtgacagcatcctgggggagcaggccctggccgtgacagatgacaaggtgtctgtgctggagctgcgggtgcagcctgtgatgggcatcagcctgaccctgagccggggcacagcccaccctggagaggtgacagccacctgctgggcccagagcgccctgcctgcccccaagcaggaggtggccctgagcctgtggctgtccttcagtgaccacacagtggccccagctgagctgtatgacagaagagacctgggcctgtctgtgtctgctgaggagcccggggccatcctgcctgctgaggagcagggcgcccagctgggcgtggtggtgtctggagctggagctgagggcctgcccctgcacgtggccctgcaccccccagagccctgcagaagaggccgccaccgggtgcccctggccagcggcacagcctggctgggcctgcccccagccagcaccccagccccagccctgcccagcagccctgcctggagccccccagccacagaggccaccatgggcggcaagaggcaggtggccggctctgtgggcggcaacacaggagtgcggggcaagtttgagcgggcagaggaggaggccaggaaggaggagacagaggcccgggaggaggaggaggaggaggaggaggagatggtgcctgccccccagcacgtgacagagctggagctgggcatgtatgccctgctgggcgtcttctgtgtggccatcttcatcttcctggtgaatggagtggtgtttgtgctgcgctaccagaggaaggagcccccagattctgccacagaccccaccagcccccagccccacaactgggtgtggctgggcacagaccaggaggagctgagccggcagctggaccggcagagccctggcccccccaagggggagggcagctgcccctgtgagagcggcggcggcggggaggcccccaccctggcccctggccccccaggcggcaccaccagcagcagcagcaccctggccaggaaggaggccggcggccgcaggaagagggtggagtttgtgacctttgccccagcccccccagcccagagccctgaggagcctgtgggcgccccagctgtgcagagcatcctggtggccggggaggaggacatccgctgggtgtgtgaggacatgggcctgaaggaccctgaggagctgaggaactacatggagcgcatccggggcagcagctag

SEQ ID NO: 22297 - DNA, 1026 bp, Artificial Sequence
  Description of Artificial Sequence: Synthetic coding sequence
atgctgcctgagcagctgtacttcctgcagagccccccagaggaggagcctgagtaccacccagatgccagcgcccaggagctgaatgtgcgggagagtgatgtgcgggtgtgtgatgagagcagctgcaagtatggaggagtgtgcaaggaggatggagatggcctgaagtgtgcctgccagttccagtgccacaccaactacatccctgtgtgtggcagcaatggagacacctaccagaatgaatgcttcctgcggcgggccgcctgcaagcaccagaaggagatcaccgtgattgcccggggcccctgctacagcgacaatggcagcggcagcggggagggggaggaggagggcagcggggctgaggtgcacaggaagcacagcaaatgtggcccctgcaagtacaaggcagaatgtgatgaagatgctgaaaatgtgggctgtgtgtgcaacatcgactgcagcggctacagcttcaaccctgtgtgtgccagtgatggcagcagctacaacaacccctgctttgtgcgggaggccagctgcatcaagcaggagcagattgacatccgccacctgggccactgcacagacacagatgacaccagcctgctgggcaagaaggatgatggcctgcagtacagaccagatgtgaaggatgccagtgaccagcgggaggatgtgtacatcggcaaccacatgccctgcccagagaacctgaatggctactgcatccacggcaaatgtgagttcatctacagcacccagaaggccagctgccgctgtgagagcggctacacaggccagcactgtgagaagacagacttcagcatcctgtatgtggtgcccagccggcagaagctgacccacgtgctgattgctgccatcattggagctgtgcagatcgccatcatcgtggccatcgtgatgtgcatcaccaggaaatgtcccaagaacaacagaggaagacggcagaagcagaacctgggccacttcaccagtgacaccagcagcaggatggtgtag

SEQ ID NO: 22298 - DNA, 1143 bp, Artificial Sequence
  Description of Artificial Sequence: Synthetic coding sequence
atgggcgctgctgctgctgaggcccccctgcggctgcctgctgccccacccctggccttctgctgctacacctctgtgctgctgctgtttgccttcagcctgcccggcagccgggccagcaaccagcccccaggcggcggcggcggcagcggcggggactgccctgggggcaagggcaagagcatcaactgcagcgagctgaatgtgcgggagagtgatgtgcgggtgtgtgatgagagcagctgcaagtatggaggagtgtgcaaggaggatggagatggcctgaagtgtgcctgccagttccagtgccacaccaactacatccctgtgtgtggcagcaatggagacacctaccagaatgaatgcttcctgcggcgggccgcctgcaagcaccagaaggagatcaccgtcatcgcccggggcccctgctacagcgacaatggaagtggcagcggggagggggaggaggagggcagcggggctgaggtgcacaggaagcacagcaaatgtggcccctgcaagtacaaggccgagtgtgatgaagatgctgaaaatgtgggctgtgtgtgcaacatcgactgcagcggctacagcttcaaccctgtgtgtgccagtgatggcagcagctacaacaacccctgctttgtgcgggaggccagctgcatcaagcaggagcagattgacatccgccacctgggccactgcacagacacagatgacaccagcctgctgggcaagaaggatgatggcctgcagtacagaccagatgtgaaggatgccagtgaccagagagaagatgtgtacatcggcaaccacatgccctgcccagagaacctgaatggctactgcatccatggaaaatgtgagttcatctacagcacccagaaggccagctgccgctgtgagagcggctacacaggccagcactgtgagaagacagacttcagcatcctgtatgtggtgcccagccggcagaagctgacccacgtgctgattgctgccatcatcggggctgtgcagatcgccatcatcgtggccatcgtgatgtgcatcaccaggaagtgccccaagaacaacagaggccggcggcagaagcagaacctgggccacttcaccagtgacaccagcagcaggatggtgtag

SEQ ID NO: 22299 - DNA, 393 bp, Artificial Sequence
  Description of Artificial Sequence: Synthetic coding sequence
atgcaggagaggactggagctgccacagcccggcgggagagcctgccccaggccaacaaccctgagcagctgtgcaagcagcgctgcatcaatgaggcctcctggaccatgaagagggtgctgagctgtgtgcctgagcccaccgtggtgatggccgcccgggccctgtgcatgctgggcctggtgctggccctgctgagcagcagcagcgctgaggagtatgtgggcctgagcgccaaccagtgtgctgtgcctgccaaggacagagtggactgtggctacccccacgtgacccccaaggagtgcaacaacagaggctgctgctttgacagccgcatccctggggtgccctggtgcttcaagcccctgcaggaggctgaatgtaccttctag

SEQ ID NO: 22300 - DNA, 285 bp, Artificial Sequence
  Description of Artificial Sequence: Synthetic coding sequence
atgaagagggtgctgagctgtgtgcctgagcccaccgtggtgatggccgcccgggccctgtgcatgctgggcctggtgctggccctgctgagcagcagcagcgctgaggagtatgtgggcctgagcgccaaccagtgtgctgtgcctgccaaggacagagtggactgtggctacccccacgtgacccccaaggagtgcaacaacagaggctgctgctttgacagccgcatccctggggtgccctggtgcttcaagcccctgcaggaggctgaatgtaccttctag

SEQ ID NO: 22301 - DNA, 1497 bp, Artificial Sequence
  Description of Artificial Sequence: Synthetic coding sequence
atggccctgcccaccctgcccagctactggtgcagccagcagaggctgaaccagcagctggcccggcagcgggagcaggaggcccggctgcggcagcagtgggagcagaacagccgctacttcaggatgtctgacatctgcagcagcaagcaggccgagtggagcagcaagaccagctaccagaggtccatgcacgcctaccagcgggagaagatgaaggaggagaagagaagaagcctggaggcccggcgggagaagctgcggcagctgatgcaggaggagcaggacctgctggcccgggagctggaggagctgcggctgtccatgaacctgcaggagcggcgcatccgggagcagcacggcaagctgaagagcgccaaggaggagcagaggaagctgattgctgagcagctgctgtatgagcactggaagaagaacaaccccaagctgcgggagatggagctggacctgcaccagaagcacgtggtgaacagctgggagatgcagaaggaggagaagaagcagcaggaggccacagctgagcaggagaacaagagatatgaaaatgaatatgagcgggcccggcgggaggccctggagaggatgaaggccgaggaggagcggcggcagctggaggacaagctgcaggccgaggccctgctgcagcagatggaggagctgaagctgaaggaggtggaggccaccaagctgaagaaggagcaggagaacctgctgaagcagcgctgggagctggagcggctggaggaggagaggaagcagatggaggccttccggcagaaggccgagctgggccgcttcctgcggcaccagtacaatgcccagctgagcaggaggacccagcagatccaggaggagctggaggccgaccggcgcatcctgcaggccctgctggagaaggaggatgagagccagaggctgcacctggcccggcgggagcaggtgatggctgatgtggcctggatgaagcaggccatcgaggagcagctgcagctggagcgggcccgggaggccgagctgcagatgctgctgcgggaggaggccaaggagatgtgggagaagcgggaggccgagtgggcccgggagaggtctgcccgggaccggctgatgtctgaggtgctgaccggccggcagcagcagatccaggagaagattgagcagaacagaagagcccaggaggagagcctgaagcaccgggagcagctgatccggaacctggaggaggtgcgggagctggcccggcgggagaaggaggagagcgagaagctgaagagcgccaggaagcaggagctggaggcccaggtggccgagcggcggctgcaggcctgggaggccgaccagcaggaggaggaggaggaggaggaggccaggagagtggagcagctgagtgatgccctgctgcagcaggaggccgagaccatggccgagcagggctaccggcccaagccctacggccaccccaagatcgcctggaactag

SEQ ID NO: 22302 - DNA, 1497 bp, Artificial Sequence; identical to SEQ ID NO: 22301
  Description of Artificial Sequence: Synthetic coding sequence

SEQ ID NO: 22303 - DNA, 525 bp, Artificial Sequence
  Description of Artificial Sequence: Synthetic coding sequence
atggccctgcccaccctgcccagctactggtgcagccagcagaggctgaaccagcagctggcccggcagcgggagcaggaggcccggctgcggcagcagtgggagcagaacagccgctacttcaggatgtctgacatctgcagcagcaagcaggccgagtggagcagcaagaccagctaccagaggtccatgcacgcctaccagcgggagaagatgaaggaggagaagagaagaagcctggaggcccggcgggagaagctgcggcagctgatgcaggaggagcaggacctgctggcccgggagctggaggagctgcggctgtccatgaacctgcaggagcggcgcatccgggagcagcacggcaagctgaagagcgccaaggaggagcagaggaagctgattgctgagcagctgctgtatgagcactggaagaagaacaaccccaagctgcgggagatggagctggacctgcaccagaagcacgtggtgaacagctgggagatgcagaaggaggagaagaagtag

SEQ ID NO: 22304 - DNA, 663 bp, Artificial Sequence
  Description of Artificial Sequence: Synthetic coding sequence
atggccctgcccaccctgcccagctactggtgcagccagcagaggctgaaccagcagctggcccggcagcgggagcaggaggcccggctgcggcagcagtgggagcagaacagccgctacttcaggatgtctgacatctgcagcagcaagcaggccgagtggagcagcaagaccagctaccagaggtccatgcacgcctaccagcgggagaagatgaaggaggagaagagaagaagcctggaggcccggcgggagaagctgcggcagctgatgcaggaggagcaggacctgctggcccgggagctggaggagctgcggctgtccatgaacctgcaggagcggcgcatccgggagcagcacggcaagctgaagagcgccaaggaggagcagaggaagctgattgctgagcagctgctgtatgagcactggaagaagaacaaccccaagctgcgggagatggagctggacctgcaccagaagcacgtggtgaacagctgggagatgcagaaggaggagaagaagcagcaggaggccacagctgagcaggagaacaagagatatgaaaatgaatatgagcgggcccggcgggaggccctggagaggatgaaggccgaggaggagcggcggctgagcaggacagatggccacaagaggaacccctag

SEQ ID NO: 22305 - DNA, 1497 bp, Artificial Sequence; identical to SEQ ID NO: 22301
  Description of Artificial Sequence: Synthetic coding sequence

SEQ ID NO: 22306 - DNA, 3090 bp, Artificial Sequence
  Description of Artificial Sequence: Synthetic coding sequence
atgcagaccaatgaaggagaggtgtctgaggagagcagcagcaaggtggagcaggaggactttgtgatggagggccacggcaagaccccacctcctggagaggagagcaagcaggagaaggagcaggagcgggaggagcagctgatggaggacaagaagaggaagaaggaggacaagaagaagaaggaggccacccagaaggtgacagagcagaagaccaaggtgcctgaggtgaccaagcccagcctgagccagcccacagctgccagccccatcggcagcagccccagcccccctgtgaatggaggcaacaatgccaagagggtggccgtgcccaacggccagccccccagcgctgcccgctacatgccccgggaggtgcccccacgcttccgctgccagcaggaccacaaggtgctgctgaagaggggccagcccccaccacccagctgcatgctgctgggcggcggggccggccccccaccctgcacagcccctggggccaaccccaacaatgcccaggtgactggagccctgctgcagagcgagagcggcacagcccctgtgtggagcaagagcaccccaccagccccagacaatggcaccagcgcctggggcgagcccaatgaaagcagccctggctggggcgagatggatgacacaggagccagcaccaccggctggggcaacaccccagccaatgccccaaatgccatgaagcccaacagcaagtccatgcaggacggctggggcgagagtgatggccctgtgactggagcccggcaccccagctgggaggaggaggaggatggcggcgtgtggaacaccaccggcagccagggcagcgccagcagccacaacagcgcctcctggggccagggcggcaagaagcagatgaagtgcagcctgaagggcggcaacaatgacagctggatgaaccccctggccaagcagttcagcaacatgggcctgctgagccagacagaggacaaccccagcagcaagatggacctgtctgtgggcagcctgagtgacaagaagtttgatgtggacaagagggccatgaacctgggggacttcaatgacatcatgaggaaggacagaagtggcttccggccccccaacagcaaggacatgggcaccacagacagcggcccctactttgagaagggcggcagccacggcctgtttggaaacagcacagcccagagccggggcctgcacacccctgtgcagcccctgaacagcagccccagcctgcgggcccaggtgcccccccagttcatcagcccccaggtgtctgcctccatgctgaagcagttccccaacagcggcctgagccctggcctcttcaacgtgggcccccagctgagcccccagcagatcgccatgctgagccagctgccccagatcccccagttccagctggcctgccagctgctgctgcagcagcagcagcagcagcagctgctgcagaaccagaggaagatcagccaggccgtgcggcagcagcaggagcagcagctggccaggatggtgtctgccctgcagcagcagcagcagcagcagcagaggcagcccggcatgaagcacagccccagccaccctgtgggccccaagccccacctggacaacatggtgcccaatgccctgaatgtgggcctgcctgacctgcagaccaagggccccatccctggctacggcagcggcttcagcagcggcggcatggactatggcatggtgggcggcaaggaggccggcacagagagccgcttcaagcagtggacctccatgatggagggcctgcccagcgtggccacccaggaggccaacatgcacaagaatggagccatcgtggcccctgggaagacccggggcggcagcccctacaaccagtttgacatcatccctggggacaccctgggcggccacactggacctgctggggacagctggctgcctgccaagagcccccccaccaacaagattggcagcaagagcagcaatgcctcctggcccccagagttccagcccggggtgccctggaagggcatccagaacatcgaccctgagagtgacccctacgtgaccccaggctctgtgctgggcggcacagccaccagccccatcgtggacacagaccaccagctgctgcgggacaacaccaccggcagcaacagcagcctgaacaccagcctgcccagccctggggcctggccctacagcgccagtgacaacagcttcaccaacgtgcacagcaccagcgccaagttcccagactacaagagcacctggagcccagaccccatcggccacaaccccacccacctgagcaacaagatgtggaagaaccacatcagcagcaggaacaccacccccctgcccaggcctcctcctggcctgaccaaccccaagcccagcagcccctggagcagcacagcccccaggtctgtgcggggctggggcacccaggacagccggctggccagcgccagcacctggagcgatggcggctctgtgcggcccagctactggctggtgctgcacaacctgaccccccagattgatggcagcaccctgcggaccatctgcatgcagcacggccccctgctgaccttccacctgaacctgacccagggcacagccctgatccgctacagcaccaagcaggaggccgccaaggcccagacagccctgcacatgtgtgtgctgggcaacaccaccatcctggccgagtttgccacagatgatgaggtgagccgcttcctggcccaggcccagccccccaccccagctgccacccccagcgccccagctgctggctggcagagcctggagaccggccagaaccagagcgaccctgtgggccctgccctgaacctgtttggaggcagcacaggcctgggccagtggagcagcagcgctgggggcagcagtggagctgacctggccggggccagcctgtggggcccccccaactacagcagcagcctgtggggcgtgcccaccgtggaggacccccacaggatgggcagccctgcccccctgctgcccggggacctgctgggcggcggcagtgacagcatctag

SEQ ID NO: 22307 - DNA, 5172 bp, Artificial Sequence
  Description of Artificial Sequence: Synthetic coding sequence
atgagggagaaggagcaggagcgggaggagcagctgatggaggacaagaagaggaagaaggaggacaagaagaagaaggaggccacccagaaggtgacagagcagaagaccaaggtgcctgaggtgaccaagcccagcctgagccagcccacagctgccagccccatcggcagcagccccagcccccctgtgaatggaggcaacaatgccaagagggtggccgtgcccaacggccagccccccagcgctgcccgctacatgccccgggaggtgcccccacgcttccgctgccagcaggaccacaaggtgctgctgaagaggggccagcccccaccacccagctgcatgctgctgggcggcggggccggccccccaccctgcacagcccctggggccaaccccaacaatgcccaggtgactggagccctgctgcagagcgagagcggcacagccccagacagcaccctgggcggggccgccgccagcaactatgccaacagcacctggggcagcggggccagcagcaacaacggcaccagccccaaccccatccacatctgggacaaggtgattgtggatggcagtgacatggaggagtggccctgcatcgccagcaaggacacagagagcagcagcgagaacaccacagacaacaacagcgccagcaaccctggcagcgagaagagcaccctgcccggcagcaccaccagcaacaagggcaagggcagccagtgccagagcgccagcagtggaaatgaatgcaacctgggcgtgtggaagagtgaccccaaggccaagtctgtgcagagcagcaacagcaccacagagaacaacaacggcctgggcaactggagaaatgtgtctggccaggacagaattggccctggcagcggcttcagcaacttcaaccccaacagcaaccccagcgcctggccagccctggtgcaggagggcaccagcaggaagggggccctggagacagacaacagcaacagcagcgcccaggtgtccacagtgggccagaccagccgggagcagcagagcaagatggagaatgccggcgtgaactttgtggtgtctggccgggagcaggcccagatccacaacacagatggccccaagaatggaaacaccaacagcctgaacctgagcagccccaaccccatggagaacaagggcatgcccttcggcatgggcctgggcaacaccagccgcagcacagatgcccccagccagagcactggagacaggaagacaggctctgtgggctcctggggcgccgcccggggccccagcggcacagacacagtgtctggccagagcaacagcggcaacaacggcaacaacgggaaggagcgggaggacagctggaagggggcctctgtgcagaagagcacaggcagcaagaatgacagctgggacaacaacaacagaagcactggaggctcctggaactttggcccccaggacagcaatgacaacaagtggggcgagggcaacaagatgaccagcggcgtgtcccagggcgagtggaagcagcccactggaagtgatgagctgaagatcggggagtggagcggccccaaccagcccaacagcagcactggagcctgggacaaccagaagggccaccccctgcctgagaaccagggcaatgcccaggccccctgctggggccgcagcagcagcagcactggaagtgaggtgggcggccagagcacaggcagcaaccacaaggccggcagcagtgacagccacaacagcggccgccgcagctaccggcccacccacccagactgccaggccgtgctgcagaccctgctgagcaggacagacctggacccccgggtgctgagcaacacaggctggggccagacccagatcaagcaggacacagtgtgggacatcgaggaggtgcccaggcctgagggcaagagtgacaagggcacagagggctgggagagcgctgccacccagaccaagaacagcggcggctggggagatgcccccagccagagcaaccagatgaagagcggctggggcgagctgagcgccagcacagagtggaaggaccccaagaacacaggaggctggaatgactacaagaacaacaacagcagcaactggggcggcggccgcccagatgagaagacccccagctcctggaatgaaaaccccagcaaggaccagggctggggcggcggccggcagcccaaccagggctggagcagcggcaagaatggctggggcgaggaggtggaccagaccaagaacagcaactgggagagcagcgccagcaagcctgtgtctggctggggcgagggcggccagaatgagatcggcacctggggcaatggaggaaatgccagcctggccagcaagggcggctgggaggactgcaagaggagccctgcctggaatgaaacaggccggcagcccaacagctggaacaagcagcaccagcagcagcagcccccccagcagcccccaccaccccagcctgaggccagcggctcctggggcggccccccacctcctcctcctggaaatgtgcggcccagcaacagctcctggagcagcggcccccagcctgccacccccaaggatgaggagcccagcggctgggaggagcccagcccccagagcatcagcaggaagatggacattgatgatggcaccagcgcctggggagaccccaacagctacaactacaagaatgtgaacctgtgggacaagaacagccagggcggccctgccccccgggagcccaacctgcccacccccatgaccagcaagagcgccagtgacagcaagtccatgcaggacggctggggcgagagtgatggccctgtgactggagcccggcaccccagctgggaggaggaggaggatggcggcgtgtggaacaccaccggcagccagggcagcgccagcagccacaacagcgcctcctggggccagggcggcaagaagcagatgaagtgcagcctgaagggcggcaacaatgacagctggatgaaccccctggccaagcagttcagcaacatgggcctgctgagccagacagaggacaaccccagcagcaagatggacctgtctgtgggcagcctgagtgacaagaagtttgatgtggacaagagggccatgaacctgggggacttcaatgacatcatgaggaaggacagaagtggcttccggccccccaacagcaaggacatgggcaccacagacagcggcccctactttgagaagggcggcagccacggcctgtttggaaacagcacagcccagagccggggcctgcacacccctgtgcagcccctgaacagcagccccagcctgcgggcccaggtgcccccccagttcatcagcccccaggtgtctgcctccatgctgaagcagttccccaacagcggcctgagccctggcctcttcaacgtgggcccccagctgagcccccagcagatcgccatgctgagccagctgccccagatcccccagttccagctggcctgccagctgctgctgcagcagcagcagcagcagcagctgctgcagaaccagaggaagatcagccaggccgtgcggcagcagcaggagcagcagctggccaggatggtgtctgccctgcagcagcagcagcagcagcagcagaggcagcccggcatgaagcacagccccagccaccctgtgggccccaagccccacctggacaacatggtgcccaatgccctgaatgtgggcctgcctgacctgcagaccaagggccccatccctggctacggcagcggcttcagcagcggcggcatggactatggcatggtgggcggcaaggaggccggcacagagagccgcttcaagcagtggacctccatgatggagggcctgcccagcgtggccacccaggaggccaacatgcacaagaatggagccatcgtggcccctgggaagacccggggcggcagcccctacaaccagtttgacatcatccctggggacaccctgggcggccacactggacctgctggggacagctggctgcctgccaagagcccccccaccaacaagattggcagcaagagcagcaatgcctcctggcccccagagttccagcccggggtgccctggaagggcatccagaacatcgaccctgagagtgacccctacgtgaccccaggctctgtgctgggcggcacagccaccagccccatcgtggacacagaccaccagctgctgcgggacaacaccaccggcagcaacagcagcctgaacaccagcctgcccagccctggggcctggccctacagcgccagtgacaacagcttcaccaacgtgcacagcaccagcgccaagttcccagactacaagagcacctggagcccagaccccatcggccacaaccccacccacctgagcaacaagatgtggaagaaccacatcagcagcaggaacaccacccccctgcccaggcctcctcctggcctgaccaaccccaagcccagcagcccctggagcagcacagcccccaggtctgtgcggggctggggcacccaggacagccggctggccagcgccagcacctggagcgatggcggctctgtgcggcccagctactggctggtgctgcacaacctgaccccccagattgatggcagcaccctgcggaccatctgcatgcagcacggccccctgctgaccttccacctgaacctgacccagggcacagccctgatccgctacagcaccaagcaggaggccgccaaggcccagacagccctgcacatgtgtgtgctgggcaacaccaccatcctggccgagtttgccacagatgatgaggtgagccgcttcctggcccaggcccagccccccaccccagctgccacccccagcgccccagctgctggctggcagagcctggagaccggccagaaccagagcgaccctgtgggccctgccctgaacctgtttggaggcagcacaggcctgggccagtggagcagcagcgctgggggcagcagtggagctgacctggccggggccagcctgtggggcccccccaactacagcagcagcctgtggggcgtgcccaccgtggaggacccccacaggatgggcagccctgcccccctgctgcccggggacctgctgggcggcggcagtgacagcatctag

SEQ ID NO: 22308 - DNA, 5172 bp, Artificial Sequence
  Description of Artificial Sequence: Synthetic coding sequence
atgagggagaaggagcaggagcgggaggagcagctgatggaggacaagaagaggaagaaggaggacaagaagaagaaggaggccacccagaagcacagcaaccagaagacagccatgcctgaggtgaccaagcccagcctgagccagcccacagctgccagccccatcggcagcagccccagcccccctgtgaatggaggcaacaatgccaagagggtggccgtgcccaacggccagccccccagcgctgcccgctacatgccccgggaggtgcccccacgcttccgctgccagcaggaccacaaggtgctgctgaagaggggccagcccccaccacccagctgcatgctgctgggcggcggggccggccccccaccctgcacagcccctggggccaaccccaacaatgcccaggtgactggagccctgctgcagagcgagagcggcacagccccagacagcaccctgggcggggccgccgccagcaactatgccaacagcacctggggcagcggggccagcagcaacaacggcaccagccccaaccccatccacatctgggacaaggtgattgtggatggcagtgacatggaggagtggccctgcatcgccagcaaggacacagagagcagcagcgagaacaccacagacaacaacagcgccagcaaccctggcagcgagaagagcaccctgcccggcagcaccaccagcaacaagggcaagggcagccagtgccagagcgccagcagtggaaatgaatgcaacctgggcgtgtggaagagtgaccccaaggccaagtctgtgcagagcagcaacagcaccacagagaacaacaacggcctgggcaactggagaaatgtgtctggccaggacagaattggccctggcagcggcttcagcaacttcaaccccaacagcaaccccagcgcctggccagccctggtgcaggagggcaccagcaggaagggggccctggagacagacaacagcaacagcagcgcccaggtgtccacagtgggccagaccagccgggagcagcagagcaagatggagaatgccggcgtgaactttgtggtgtctggccgggagcaggcccagatccacaacacagatggccccaagaatggaaacaccaacagcctgaacctgagcagccccaaccccatggagaacaagggcatgcccttcggcatgggcctgggcaacaccagccgcagcacagatgcccccagccagagcactggagacaggaagacaggctctgtgggctcctggggcgccgcccggggccccagcggcacagacacagtgtctggccagagcaacagcggcaacaacggcaacaacgggaaggagcgggaggacagctggaagggggcctctgtgcagaagagcacaggcagcaagaatgacagctgggacaacaacaacagaagcactggaggctcctggaactttggcccccaggacagcaatgacaacaagtggggcgagggcaacaagatgaccagcggcgtgtcccagggcgagtggaagcagcccactggaagtgatgagctgaagatcggggagtggagcggccccaaccagcccaacagcagcactggagcctgggacaaccagaagggccaccccctgcctgagaaccagggcaatgcccaggccccctgctggggccgcagcagcagcagcactggaagtgaggtgggcggccagagcacaggcagcaaccacaaggccggcagcagtgacagccacaacagcggccgccgcagctaccggcccacccacccagactgccaggccgtgctgcagaccctgctgagcaggacagacctggacccccgggtgctgagcaacacaggctggggccagacccagatcaagcaggacacagtgtgggacatcgaggaggtgcccaggcctgagggcaagagtgacaagggcacagagggctgggagagcgctgccacccagaccaagaacagcggcggctggggagatgcccccagccagagcaaccagatgaagagcggctggggcgagctgagcgccagcacagagtggaaggaccccaagaacacaggaggctggaatgactacaagaacaacaacagcagcaactggggcggcggccgcccagatgagaagacccccagctcctggaatgaaaaccccagcaaggaccagggctggggcggcggccggcagcccaaccagggctggagcagcggcaagaatggctggggcgaggaggtggaccagaccaagaacagcaactgggagagcagcgccagcaagcctgtgtctggctggggcgagggcggccagaatgagatcggcacctggggcaatggaggaaatgccagcctggccagcaagggcggctgggaggactgcaagaggagccctgcctggaatgaaacaggccggcagcccaacagctggaacaagcagcaccagcagcagcagcccccccagcagcccccaccaccccagcctgaggccagcggctcctggggcggccccccacctcctcctcctggaaatgtgcggcccagcaacagctcctggagcagcggcccccagcctgccacccccaaggatgaggagcccagcggctgggaggagcccagcccccagagcatcagcaggaagatggacattgatgatggcaccagcgcctggggagaccccaacagctacaactacaagaatgtgaacctgtgggacaagaacagccagggcggccctgccccccgggagcccaacctgcccacccccatgaccagcaagagcgccagtgacagcaagtccatgcaggacggctggggcgagagtgatggccctgtgactggagcccggcaccccagctgggaggaggaggaggatggcggcgtgtggaacaccaccggcagccagggcagcgccagcagccacaacagcgcctcctggggccagggcggcaagaagcagatgaagtgcagcctgaagggcggcaacaatgacagctggatgaaccccctggccaagcagttcagcaacatgggcctgctgagccagacagaggacaaccccagcagcaagatggacctgtctgtgggcagcctgagtgacaagaagtttgatgtggacaagagggccatgaacctgggggacttcaatgacatcatgaggaaggacagaagtggcttccggccccccaacagcaaggacatgggcaccacagacagcggcccctactttgagaagggcggcagccacggcctgtttggaaacagcacagcccagagccggggcctgcacacccctgtgcagcccctgaacagcagccccagcctgcgggcccaggtgcccccccagttcatcagcccccaggtgtctgcctccatgctgaagcagttccccaacagcggcctgagccctggcctcttcaacgtgggcccccagctgagcccccagcagatcgccatgctgagccagctgccccagatcccccagttccagctggcctgccagctgctgctgcagcagcagcagcagcagcagctgctgcagaaccagaggaagatcagccaggccgtgcggcagcagcaggagcagcagctggccaggatggtgtctgccctgcagcagcagcagcagcagcagcagaggcagcccggcatgaagcacagccccagccaccctgtgggccccaagccccacctggacaacatggtgcccaatgccctgaatgtgggcctgcctgacctgcagaccaagggccccatccctggctacggcagcggcttcagcagcggcggcatggactatggcatggtgggcggcaaggaggccggcacagagagccgcttcaagcagtggacctccatgatggagggcctgcccagcgtggccacccaggaggccaacatgcacaagaatggagccatcgtggcccctgggaagacccggggcggcagcccctacaaccagtttgacatcatccctggggacaccctgggcggccacactggacctgctggggacagctggctgcctgccaagagcccccccaccaacaagattggcagcaagagcagcaatgcctcctggcccccagagttccagcccggggtgccctggaagggcatccagaacatcgaccctgagagtgacccctacgtgaccccaggctctgtgctgggcggcacagccaccagccccatcgtggacacagaccaccagctgctgcgggacaacaccaccggcagcaacagcagcctgaacaccagcctgcccagccctggggcctggccctacagcgccagtgacaacagcttcaccaacgtgcacagcaccagcgccaagttcccagactacaagagcacctggagcccagaccccatcggccacaaccccacccacctgagcaacaagatgtggaagaaccacatcagcagcaggaacaccacccccctgcccaggcctcctcctggcctgaccaaccccaagcccagcagcccctggagcagcacagcccccaggtctgtgcggggctggggcacccaggacagccggctggccagcgccagcacctggagcgatggcggctctgtgcggcccagctactggctggtgctgcacaacctgaccccccagattgatggcagcaccctgcggaccatctgcatgcagcacggccccctgctgaccttccacctgaacctgacccagggcacagccctgatccgctacagcaccaagcaggaggccgccaaggcccagacagccctgcacatgtgtgtgctgggcaacaccaccatcctggccgagtttgccacagatgatgaggtgagccgcttcctggcccaggcccagccccccaccccagctgccacccccagcgccccagctgctggctggcagagcctggagaccggccagaaccagagcgaccctgtgggccctgccctgaacctgtttggaggcagcacaggcctgggccagtggagcagcagcgctgggggcagcagtggagctgacctggccggggccagcctgtggggcccccccaactacagcagcagcctgtggggcgtgcccaccgtggaggacccccacaggatgggcagccctgcccccctgctgcccggggacctgctgggcggcggcagtgacagcatctag

SEQ ID NO: 22309 - DNA, 3090 bp, Artificial Sequence; identical to SEQ ID NO: 22306
  Description of Artificial Sequence: Synthetic coding sequence

SEQ ID NO: 22310 - DNA, 114 bp, Artificial Sequence
  Description of Artificial Sequence: Synthetic coding sequence
atgcagaccaatgaaggagaggtgtctgaggagagcagcagcaaggtggagcaggaggactttgtgatggagggccacggcaagaccccacctcctggagaggagagcaagtag

SEQ ID NO: 22311 - DNA, 5502 bp, Artificial Sequence
  Description of Artificial Sequence: Synthetic coding sequence
atgagggagaaggagcaggagcgggaggagcagctgatggaggacaagaagaggaagaaggaggacaagaagaagaaggaggccacccagaaggtgacagagcagaagaccaaggtgcctgaggtgaccaagcccagcctgagccagcccacagctgccagccccatcggcagcagccccagcccccctgtgaatggaggcaacaatgccaagagggtggccgtgcccaacggccagccccccagcgctgcccgctacatgccccgggaggtgcccccacgcttccgctgccagcaggaccacaaggtgctgctgaagaggggccagcccccaccacccagctgcatgctgctgggcggcggggccggccccccaccctgcacagcccctggggccaaccccaacaatgcccaggtgactggagccctgctgcagagcgagagcggcacagccccagacagcaccctgggcggggccgccgccagcaactatgccaacagcacctggggcagcggggccagcagcaacaacggcaccagccccaaccccatccacatctgggacaaggtgattgtggatggcagtgacatggaggagtggccctgcatcgccagcaaggacacagagagcagcagcgagaacaccacagacaacaacagcgccagcaaccctggcagcgagaagagcaccctgcccggcagcaccaccagcaacaagggcaagggcagccagtgccagagcgccagcagtggaaatgaatgcaacctgggcgtgtggaagagtgaccccaaggccaagtctgtgcagagcagcaacagcaccacagagaacaacaacggcctgggcaactggagaaatgtgtctggccaggacagaattggccctggcagcggcttcagcaacttcaaccccaacagcaaccccagcgcctggccagccctggtgcaggagggcaccagcaggaagggggccctggagacagacaacagcaacagcagcgcccaggtgtccacagtgggccagaccagccgggagcagcagagcaagatggagaatgccggcgtgaactttgtggtgtctggccgggagcaggcccagatccacaacacagatggccccaagaatggaaacaccaacagcctgaacctgagcagccccaaccccatggagaacaagggcatgcccttcggcatgggcctgggcaacaccagccgcagcacagatgcccccagccagagcactggagacaggaagacaggctctgtgggctcctggggcgccgcccggggccccagcggcacagacacagtgtctggccagagcaacagcggcaacaacggcaacaacgggaaggagcgggaggacagctggaagggggcctctgtgcagaagagcacaggcagcaagaatgacagctgggacaacaacaacagaagcactggaggctcctggaactttggcccccaggacagcaatgacaacaagtggggcgagggcaacaagatgaccagcggcgtgtcccagggcgagtggaagcagcccactggaagtgatgagctgaagatcggggagtggagcggccccaaccagcccaacagcagcactggagcctgggacaaccagaagggccaccccctgcctgagaaccagggcaatgcccaggccccctgctggggccgcagcagcagcagcactggaagtgaggtgggcggccagagcacaggcagcaaccacaaggccggcagcagtgacagccacaacagcggccgccgcagctaccggcccacccacccagactgccaggccgtgctgcagaccctgctgagcaggacagacctggacccccgggtgctgagcaacacaggctggggccagacccagatcaagcaggacacagtgtgggacatcgaggaggtgcccaggcctgagggcaagagtgacaagggcacagagggctgggagagcgctgccacccagaccaagaacagcggcggctggggagatgcccccagccagagcaaccagatgaagagcggctggggcgagctgagcgccagcacagagtggaaggaccccaagaacacaggaggctggaatgactacaagaacaacaacagcagcaactggggcggcggccgcccagatgagaagacccccagctcctggaatgaaaaccccagcaaggaccagggctggggcggcggccggcagcccaaccagggctggagcagcggcaagaatggctggggcgaggaggtggaccagaccaagaacagcaactgggagagcagcgccagcaagcctgtgtctggctggggcgagggcggccagaatgagatcggcacctggggcaatggaggaaatgccagcctggccagcaagggcggctgggaggactgcaagaggagccctgcctggaatgaaacaggccggcagcccaacagctggaacaagcagcaccagcagcagcagcccccccagcagcccccaccaccccagcctgaggccagcggctcctggggcggccccccacctcctcctcctggaaatgtgcggcccagcaacagctcctggagcagcggcccccagcctgccacccccaaggatgaggagcccagcggctgggaggagcccagcccccagagcatcagcaggaagatggacattgatgatggcaccagcgcctggggagaccccaacagctacaactacaagaatgtgaacctgtgggacaagaacagccagggcggccctgccccccgggagcccaacctgcccacccccatgaccagcaagagcgcctctgtgtggagcaagagcaccccaccagccccagacaatggcaccagcgcctggggcgagcccaatgaaagcagccctggctggggcgagatggatgacaccggggccagcaccaccggctggggcaacaccccagccaatgccccaaatgccatgaagcccaacagcaagtccatgcaggacggctggggcgagagtgatggccctgtgactggagcccggcaccccagctgggaggaggaggaggatggaggagtgtggaacaccaccggcagccagggcagcgccagcagccacaacagcgcctcctggggccagggcggcaagaagcagatgaagtgcagcctgaagggcggcaacaatgacagctggatgaaccccctggccaagcagttcagcaacatgggcctgctgagccagacagaggacaaccccagcagcaagatggacctgtctgtgggcagcctgagtgacaagaagtttgatgtggacaagagggccatgaacctgggggacttcaatgacatcatgaggaaggacaggagcggcttccggccccccaacagcaaggacatgggcaccacagattctggcccctactttgagaagctgaccctgcccttcagcaaccaggacggctgcctgggagatgaggccccctgcagccccttcagccccagccccagctacaagctgagccccagcggcagcaccctgcccaacgtgtccctgggcgccatcggcaccggcctgaacccccagaactttgctgcccggcagggcggcagccacggcctgtttggaaacagcacagcccagagccggggcctgcacacccctgtgcagcccctgaacagcagccccagcctgcgggcccaggtgcccccccagttcatcagcccccaggtgtctgcctccatgctgaagcagttccccaacagcggcctgagccctggcctcttcaacgtgggcccccagctgagcccccagcagatcgccatgctgagccagctgccccagatcccccagttccagctggcctgccagctgctgctgcagcagcagcagcagcagcagctgctgcagaaccagaggaagatcagccaggccgtgcggcagcagcaggagcagcagctggccaggatggtgtctgccctgcagcagcagcagcagcagcagcagaggcagcccggcatgaagcacagccccagccaccctgtgggccccaagccccacctggacaacatggtgcccaatgccctgaatgtgggcctgcctgacctgcagaccaagggccccatccctggctacggcagcggcttcagcagcggcggcatggactatggcatggtgggcggcaaggaggccggcacagagagccgcttcaagcagtggacctccatgatggagggcctgcccagcgtggccacccaggaggccaacatgcacaagaatggagccatcgtggcccctgggaagacccggggcggcagcccctacaaccagtttgacatcatccctggggacaccctgggcggccacactggacctgctggggacagctggctgcctgccaagagcccccccaccaacaagattggcagcaagagcagcaatgcctcctggcccccagagttccagcccggggtgccctggaagggcatccagaacatcgaccctgagagtgacccctacgtgaccccaggctctgtgctgggcggcacagccaccagccccatcgtggacacagaccaccagctgctgcgggacaacaccaccggcagcaacagcagcctgaacaccagcctgcccagccctggggcctggccctacagcgccagtgacaacagcttcaccaacgtgcacagcaccagcgccaagttcccagactacaagagcacctggagcccagaccccatcggccacaaccccacccacctgagcaacaagatgtggaagaaccacatcagcagcaggaacaccacccccctgcccaggcctcctcctggcctgaccaaccccaagcccagcagcccctggagcagcacagcccccaggtctgtgcggggctggggcacccaggacagccggctggccagcgccagcacctggagcgatggcggctctgtgcggcccagctactggctggtgctgcacaacctgaccccccagattgatggcagcaccctgcggaccatctgcatgcagcacggccccctgctgaccttccacctgaacctgacccagggcacagccctgatccgctacagcaccaagcaggaggccgccaaggcccagacagccctgcacatgtgtgtgctgggcaacaccaccatcctggccgagtttgccacagatgatgaggtgagccgcttcctggcccaggcccagccccccaccccagctgccacccccagcgccccagctgctggctggcagagcctggagaccggccagaaccagagcgaccctgtgggccctgccctgaacctgtttggaggcagcacaggcctgggccagtggagcagcagcgctgggggcagcagtggagctgacctggccggggccagcctgtggggcccccccaactacagcagcagcctgtggggcgtgcccaccgtggaggacccccacaggatgggcagccctgcccccctgctgcccggggacctgctgggcggcggcagtgacagcatctag

SEQ ID NO: 22312 - DNA, 3153 bp, Artificial Sequence
  Description of Artificial Sequence: Synthetic coding sequence
atggaggtggccgtggagaaggctgtggccgctgctgctgctgccagcgctgctgccagcggcggccccagcgctgcccccagcggggagaatgaagctgagagccggcagggcccagattctgagcggggcggggaggccgcccggctgaacctgctggacacctgtgctgtgtgccaccagaacatccagagccgggcccccaagctgctgccctgcctgcacagcttctgccagcgctgcctgcctgccccccagcgctacctgatgctgcctgcccccatgctgggcagcgctgagaccccacctcctgtgcctgcccctggcagccctgtgtctggcagcagcccctttgccacccaggtgggcgtcatccgctgccctgtgtgcagccaggagtgtgccgagcggcacatcatcgacaacttctttgtgaaggacaccacagaggtgcccagcagcacagtggagaagagcaaccaggtgtgcaccagctgtgaagataatgctgaggccaacggcttctgtgtggagtgtgtggagtggctgtgcaagacctgcatccgggcccaccagagggtgaagttcaccaaggaccacacagtgcggcagaaggaggaggtgtccccagaggccgtgggcgtgaccagccagaggcctgtgttctgccccttccacaagaaggagcagctgaagctgtactgtgagacctgtgacaagctgacctgccgggactgccagctgctggagcacaaggagcaccgctaccagttcatcgaggaggccttccagaaccagaaggtgatcatcgacaccctcatcaccaagctgatggagaagaccaagtacatcaagttcaccggcaaccagatccagaaccgcatcatcgaggtgaaccagaaccagaagcaggtggagcaggacatcaaggtggccatcttcaccctgatggtggagatcaacaagaagggcaaggccctgctgcaccagctggagagcctggccaaggaccacaggatgaagctgatgcagcagcagcaggaggtggccggcctgagcaagcagctggagcacgtgatgcacttcagcaagtgggccgtgagcagcggcagcagcacagccctgctgtacagcaagaggctcatcacctaccgcctgcggcacctgctgcgggcccgctgtgatgccagccctgtgaccaacaacaccatccagttccactgtgaccccagcttctgggcccagaacatcatcaacctgggcagcctggtgattgaggacaaggagagccagccccagatgcccaagcagaaccctgtggtggagcagaacagccagcccccatctggcctgagcagcaaccagctgagcaagttccccacccagatcagcctggcccagctgcggctgcagcacatgcagcagcaggtgatggcccagaggcagcaggtgcagaggaggcctgcccctgtgggcctgcccaaccccaggatgcagggccccatccagcagcccagcatcagccaccagcagcccccacccaggctcatcaacttccagaaccacagccccaagcccaatggacctgtgctgcccccccacccccagcagctgcgctacccacccaaccagaacatcccccggcaggccatcaagcccaaccccctgcagatggccttcctggcccagcaggccatcaagcagtggcagatcagcagcggccagggcacccccagcaccaccaacagcaccagcagcacccccagcagccccaccatcaccagcgctgctggctatgatggcaaggccttcggcagccccatgattgacctgagcagccctgtgggcggcagctacaacctgcccagcctgcctgacatcgactgcagcagcaccatcatgctggacaacatcgtgaggaaggacaccaacatcgaccacggccagccccggccccccagcaacagaacagtgcagagccccaacagctctgtgcccagccctggcctggccggccctgtgaccatgacctctgtgcacccccccatccgcagccccagcgccagctctgtgggcagccggggcagcagcggcagcagcagcaagccagctggagctgacagcacccacaaggtgcctgtggtgatgctggagcccatccgcatcaagcaggagaacagcggccccccagaaaattatgacttccctgtggtgattgtgaagcaggagagtgatgaggagagccggccccagaatgccaactaccccaggagcatcctgaccagcctgctgctgaacagcagccagagcagcaccagcgaggagaccgtgctgcggagtgatgccccagacagcactggagaccagcccggcctgcaccaggacaacagcagcaatggcaagtctgagtggctggaccccagccagaagagccccctgcacgtgggggagaccaggaaagaagatgaccccaatgaagactggtgtgctgtgtgccagaatggaggagagctgctgtgctgtgagaagtgccccaaggtgttccacctgagctgccacgtgcccaccctgaccaacttccccagcggggagtggatctgcaccttctgccgggacctgagcaagccagaggtggagtatgactgtgatgcccccagccacaacagcgagaagaagaagacagagggcctggtgaagctgacccccatcgacaagaggaaatgtgagcggctgctgctcttcctgtactgccacgagatgagcctggccttccaggaccctgtgcccctgactgtgcctgactactacaagatcatcaagaaccccatggacctgagcaccatcaagaagaggctgcaggaggactacagcatgtacagcaagccagaagattttgtggccgacttccgcctcatcttccagaactgtgccgagttcaatgaaccagacagcgaggtggccaatgccggcatcaagctggagaactactttgaggagctgctgaagaacctgtacccagagaagcgcttccccaagccagagttcagaaatgaaagtgaggacaacaagttcagtgatgacagtgatgatgactttgtgcagcccaggaagaagaggctgaagagcattgaggagcggcagctgctgaagtag

SEQ ID NO: 22313 - DNA, 1650 bp, Artificial Sequence
  Description of Artificial Sequence: Synthetic coding sequence
atggagggccccaggtctgctgcctgccgggcccggcctgccaccagccctggagctgtggacctgacagcccctcctcctccacccctgctgcgcatcctgaacagccgggccgccccagccaccaggacctttgctgacctgtgccgcagcctgctgcagcctgagagccgggtgctgtgccgcctgcagcctgtgaactgctaccccccagctgccagcaccaagctgtgccctgtgggcgtcatccgctgccctgtgtgcagccaggagtgtgccgagcggcacatcatcgacaacttctttgtgaaggacaccacagaggtgcccagcagcacagtggagaagagcaaccaggtgtgcaccagctgtgaagataatgctgaggccaacggcttctgtgtggagtgtgtggagtggctgtgcaagacctgcatccgggcccaccagagggtgaagttcaccaaggaccacacagtgcggcagaaggaggaggtgtccccagaggccgtgggcgtgaccagccagaggcctgtgttctgccccttccacaagaaggagcagctgaagctgtactgtgagacctgtgacaagctgacctgccgggactgccagctgctggagcacaaggagcaccgctaccagttcatcgaggaggccttccagaaccagaaggtgatcatcgacaccctcatcaccaagctgatggagaagaccaagtacatcaagttcaccggcaaccagatccagaaccgcatcatcgaggtgaaccagaaccagaagcaggtggagcaggacatcaaggtggccatcttcaccctgatggtggagatcaacaagaagggcaaggccctgctgcaccagctggagagcctggccaaggaccacaggatgaagctgatgcagcagcagcaggaggtggccggcctgagcaagcagctggagcacgtgatgcacttcagcaagtgggccgtgagcagcggcagcagcacagccctgctgtacagcaagaggctcatcacctaccgcctgcggcacctgctgcgggcccgctgtgatgccagccctgtgaccaacaacaccatccagttccactgtgaccccagcttctgggcccagaacatcatcaacctgggcagcctggtgattgaggacaaggagagccagccccagatgcccaagcagaaccctgtggtggagcagaacagccagcccccatctggcctgagcagcaaccagctgagcaagttccccacccagatcagcctggcccagctgcggctgcagcacatgcagcagcagcagcccccacccaggctcatcaacttccagaaccacagccccaagcccaatggacctgtgctgcccccccacccccagcagctgcgctacccacccaaccagaacatcccccggcaggccatcaagcccaaccccctgcagatggccttcctggcccagcaggccatcaagcagtggcagatcagcagcggccagggcacccccagcaccacccagaacatcaacacagctgcctgcaccgtgtttgatgtgcgggtgctgcaccacatcccctactgggccctgaacatcagcagcagcgagcgggacagcttcctgtggttcagctctgtgtacaacctggagtag

SEQ ID NO: 22314 - DNA, 3051 bp, Artificial Sequence
  Description of Artificial Sequence: Synthetic coding sequence
atggaggtggccgtggagaaggctgtggccgctgctgctgctgccagcgctgctgccagcggcggccccagcgctgcccccagcggggagaatgaagctgagagccggcagggcccagattctgagcggggcggggaggccgcccggctgaacctgctggacacctgtgctgtgtgccaccagaacatccagagccgggcccccaagctgctgccctgcctgcacagcttctgccagcgctgcctgcctgccccccagcgctacctgatgctgcctgcccccatgctgggcagcgctgagaccccacctcctgtgcctgcccctggcagccctgtgtctggcagcagcccctttgccacccaggtgggcgtcatccgctgccctgtgtgcagccaggagtgtgccgagcggcacatcatcgacaacttctttgtgaaggacaccacagaggtgcccagcagcacagtggagaagagcaaccaggtgtgcaccagctgtgaagataatgctgaggccaacggcttctgtgtggagtgtgtggagtggctgtgcaagacctgcatccgggcccaccagagggtgaagttcaccaaggaccacacagtgcggcagaaggaggaggtgtccccagaggccgtgggcgtgaccagccagaggcctgtgttctgccccttccacaagaaggagcagctgaagctgtactgtgagacctgtgacaagctgacctgccgggactgccagctgctggagcacaaggagcaccgctaccagttcatcgaggaggccttccagaaccagaaggtgatcatcgacaccctcatcaccaagctgatggagaagaccaagtacatcaagttcaccggcaaccagatccagaaccgcatcatcgaggtgaaccagaaccagaagcaggtggagcaggacatcaaggtggccatcttcaccctgatggtggagatcaacaagaagggcaaggccctgctgcaccagctggagagcctggccaaggaccacaggatgaagctgatgcagcagcagcaggaggtggccggcctgagcaagcagctggagcacgtgatgcacttcagcaagtgggccgtgagcagcggcagcagcacagccctgctgtacagcaagaggctcatcacctaccgcctgcggcacctgctgcgggcccgctgtgatgccagccctgtgaccaacaacaccatccagttccactgtgaccccagcttctgggcccagaacatcatcaacctgggcagcctggtgattgaggacaaggagagccagccccagatgcccaagcagaaccctgtggtggagcagaacagccagcccccatctggcctgagcagcaaccagctgagcaagttccccacccagatcagcctggcccagctgcggctgcagcacatgcagcagcagcagcccccacccaggctcatcaacttccagaaccacagccccaagcccaatggacctgtgctgcccccccacccccagcagctgcgctacccacccaaccagaacatcccccggcaggccatcaagcccaaccccctgcagatggccttcctggcccagcaggccatcaagcagtggcagatcagcagcggccagggcacccccagcaccaccaacagcaccagcagcacccccagcagccccaccatcaccagcgctgctggctatgatggcaaggccttcggcagccccatgattgacctgagcagccctgtgggcggcagctacaacctgcccagcctgcctgacatcgactgcagcagcaccatcatgctggacaacatcgtgaggaaggacaccaacatcgaccacggccagccccggccccccagcaacagaacagtgcagagccccaacagctctgtgcccagccctggcctggccggccctgtgaccatgacctctgtgcacccccccatccgcagccccagcgccagctctgtgggcagccggggcagcagcggcagcagcagcaagccagctggagctgacagcacccacaaggtgcctgtggtgatgctggagcccatccgcatcaagcaggagaacagcggccccccagaaaattatgacttccctgtggtgattgtgaagcaggagagtgatgaggagagccggccccagaatgccaactaccccaggagcatcctgaccagcctgctgctgaacagcagccagagcagcaccagcgaggagaccgtgctgcggagtgatgccccagacagcactggagaccagcccggcctgcaccaggacaacagcagcaatggcaagtctgagtggctggaccccagccagaagagccccctgcacgtgggggagaccaggaaagaagatgaccccaatgaagactggtgtgctgtgtgccagaatggaggagagctgctgtgctgtgagaagtgccccaaggtgttccacctgagctgccacgtgcccaccctgaccaacttccccagcggggagtggatctgcaccttctgccgggacctgagcaagccagaggtggagtatgactgtgatgcccccagccacaacagcgagaagaagaagacagagggcctggtgaagctgacccccatcgacaagaggaaatgtgagcggctgctgctcttcctgtactgccacgagatgagcctggccttccaggaccctgtgcccctgactgtgcctgactactacaagatcatcaagaaccccatggacctgagcaccatcaagaagaggctgcaggaggactacagcatgtacagcaagccagaagattttgtggccgacttccgcctcatcttccagaactgtgccgagttcaatgaaccagacagcgaggtggccaatgccggcatcaagctggagaactactttgaggagctgctgaagaacctgtacccagagaagcgcttccccaagccagagttcagaaatgaaagtgaggacaacaagttcagtgatgacagtgatgatgactttgtgcagcccaggaagaagaggctgaagagcattgaggagcggcagctgctgaagtag

SEQ ID NO: 22315 - DNA, 2886 bp, Artificial Sequence
  Description of Artificial Sequence: Synthetic coding sequence
atgctgcctgcccccatgctgggcagcgctgagaccccacctcctgtgcctgcccctggcagccctgtgtctggcagcagcccctttgccacccaggtgggcgtcatccgctgccctgtgtgcagccaggagtgtgccgagcggcacatcatcgacaacttctttgtgaaggacaccacagaggtgcccagcagcacagtggagaagagcaaccaggtgtgcaccagctgtgaggacaatgctgaggccaacggcttctgtgtggagtgtgtggagtggctgtgcaagacctgcatccgggcccaccagagggtgaagttcaccaaggaccacacagtgcggcagaaggaggaggtgtccccagaggccgtgggcgtgaccagccagaggcctgtgttctgccccttccacaagaaggagcagctgaagctgtactgtgagacctgtgacaagctgacctgccgggactgccagctgctggagcacaaggagcaccgctaccagttcatcgaggaggccttccagaaccagaaggtgatcatcgacaccctcatcaccaagctgatggagaagaccaagtacatcaagttcaccggcaaccagatccagaaccgcatcatcgaggtgaaccagaaccagaagcaggtggagcaggacatcaaggtggccatcttcaccctgatggtggagatcaacaagaagggcaaggccctgctgcaccagctggagagcctggccaaggaccacaggatgaagctgatgcagcagcagcaggaggtggccggcctgagcaagcagctggagcacgtgatgcacttcagcaagtgggccgtgagcagcggcagcagcacagccctgctgtacagcaagaggctcatcacctaccgcctgcggcacctgctgcgggcccgctgtgatgccagccctgtgaccaacaacaccatccagttccactgtgaccccagcttctgggcccagaacatcatcaacctgggcagcctggtgattgaggacaaggagagccagccccagatgcccaagcagaaccctgtggtggagcagaacagccagccccccagcggcctgagcagcaaccagctgagcaagttccccacccagatcagcctggcccagctgcggctgcagcacatgcagcagcaggtgatggcccagaggcagcaggtgcagaggaggcctgcccctgtgggcctgcccaaccccaggatgcagggccccatccagcagcccagcatcagccaccagcagcccccacccaggctcatcaacttccagaaccacagccccaagcccaacggccctgtgctgcccccccacccccagcagctgcgctacccacccaaccagaacatcccccggcaggccatcaagcccaaccccctgcagatggccttcctggcccagcaggccatcaagcagtggcagatcagcagcggccagggcacccccagcaccaccaacagcaccagcagcacccccagcagccccaccatcaccagcgctgctggctatgatggcaaggccttcggcagccccatgattgacctgagcagccctgtgggcggcagctacaacctgcccagcctgcctgacatcgactgcagcagcaccatcatgctggacaacatcgtgaggaaggacaccaacatcgaccacggccagcccaggcctcccagcaacagaacagtgcagagccccaacagctctgtgcccagccctggcctggccggccctgtgaccatgacctctgtgcacccccccatccgcagccccagcgccagctctgtgggcagccggggcagcagcggcagcagcagcaagccagctggagctgacagcacccacaaggtgcctgtggtgatgctggagcccatccgcatcaagcaggagaacagcggccccccagagaactatgacttccctgtggtgattgtgaagcaggagagtgatgaggagagccggccccagaatgccaactaccccaggagcatcctgaccagcctgctgctgaacagcagccagagcagcaccagcgaggagaccgtgctgcggagtgatgccccagacagcactggagaccagcccggcctgcaccaggacaacagcagcaatggcaagtctgagtggctggaccccagccagaagagccccctgcacgtgggggagaccaggaaggaggatgaccccaatgaagactggtgtgctgtgtgccagaatggaggagagctgctgtgctgtgagaagtgccccaaggtgttccacctgagctgccacgtgcccaccctgaccaacttccccagcggggagtggatctgcaccttctgccgggacctgagcaagccagaggtggagtatgactgtgatgcccccagccacaacagcgagaagaagaagacagagggcctggtgaagctgacccccatcgacaagaggaaatgtgagcggctgctgctcttcctgtactgccacgagatgagcctggccttccaggaccctgtgcccctgactgtgcctgactactacaagatcatcaagaaccccatggacctgagcaccatcaagaagaggctgcaggaggactacagcatgtacagcaagccagaggactttgtggccgacttccgcctcatcttccagaactgtgccgagttcaatgaaccagattctgaggtggccaatgccggcatcaagctggagaactactttgaggagctgctgaagaacctgtacccagagaagcgcttccccaagccagagttcagaaatgaaagtgaggacaacaagttcagtgatgacagtgatgatgactttgtgcagcccaggaagaagaggctgaagagcattgaggagcggcagctgctgaagtag

SEQ ID NO: 22316 - DNA, 1692 bp, Artificial Sequence
  Description of Artificial Sequence: Synthetic coding sequence
atgggcctgcaggcctgcctgctgggcctgtttgccctgatcctgagcggcaagtgcagctacagccctgagccagaccagaggaggaccctgcccccaggctgggtgtccctgggccgggctgaccctgaggaggagctgagcctgacctttgccctgcggcagcagaatgtggagcggctgtctgagctggtgcaggccgtgtctgaccccagcagcccccagtatggcaagtacctgaccctggagaatgtggccgacctggtgcggcccagccccctgaccctgcacacagtgcagaagtggctgctggccgccggggcccagaagtgccacagcgtcatcacccaggacttcctgacctgctggctgagcatccggcaggccgagctgctgctgcccggggctgagttccaccactacgtgggcggccccacagagacccacgtggtgcgcagcccccacccctaccagctgccccaggccctggccccccacgtggactttgtgggcggcctgcaccgcttcccccccaccagcagcctgcggcagaggcctgagccccaggtgactggaacagtgggcctgcacctgggcgtgaccccatctgtcatcaggaagcgctacaacctgaccagccaggatgtgggcagcggcaccagcaacaacagccaggcctgtgcccagttcctggagcagtacttccatgacagcgacctggcccagttcatgaggctgtttggaggcaactttgcccaccaggcctctgtggcccgggtggtgggccagcagggccggggccgggccggcatcgaggccagcctggatgtgcagtacctgatgtctgctggggccaacatcagcacctgggtgtacagcagccctggaagacatgagggccaggagcccttcctgcagtggctgatgctgctgagcaatgaaagtgccctgccccacgtgcacacagtgtcctatggagatgatgaggacagcctgagcagcgcctacatccagagggtgaacacagagctgatgaaggccgccgcccggggcctgaccctgctgtttgccagcggggacagcggggccggctgctggagcgtgtctggccgccaccagttccggcccaccttccctgccagcagcccctacgtgaccaccgtgggcggcaccagcttccaggagcccttcctgatcaccaatgaaattgtggactacatcagcggcggcggcttcagcaatgtgttcccccggcccagctaccaggaggaggccgtgaccaagttcctgagcagcagcccccacctgccccccagcagctacttcaatgccagcggccgggcctacccagatgtggccgccctgagtgatggctactgggtggtgagcaacagagtgcccatcccctgggtgtctggcaccagcgccagcacccctgtgtttggaggcatcctgagcctcatcaatgagcaccgcatcctgagcggccggccccccctgggcttcctgaacccccggctgtaccagcagcacggggccggcctgtttgatgtgacccggggctgccacgagagctgcctggatgaggaggtggagggccagggcttctgcagcggccctggctgggaccctgtgacaggctggggcacccccaacttccctgccctgctgaagaccctgctgaacccctag

SEQ ID NO: 22317 - DNA, 1041 bp, Artificial Sequence
  Description of Artificial Sequence: Synthetic coding sequence
atgggcctgcaggcctgcctgctgggcctgtttgccctgatcctgagcggcaagtgcagctacagccctgagccagaccagaggaggaccctgcccccaggctgggtgtccctgggccgggctgaccctgaggaggagctgagcctgacctttgccctgcggcagcagaatgtggagcggctgtctgagctggtgcaggccgtgtctgaccccagcagcccccagtatggcaagtacctgaccctggagaatgtggccgacctggtgcggcccagccccctgaccctgcacacagtgcagaagtggctgctggccgccggggcccagaagtgccacagcgtcatcacccaggacttcctgacctgctggctgagcatccggcaggccgagctgctgctgcccggggctgagttccaccactacgtgggcggccccacagagacccacgtggtgcgcagcccccacccctaccagctgccccacatcctggaggtgccctacgtgaccaccgtgggcggcaccagcttccaggagcccttcctgatcaccaatgagatcgtggactacatcagcggcggcggcttcagcaatgtgttcccccggcccagctaccaggaggaggccgtgaccaagttcctgagcagcagcccccacctgccccccagcagctacttcaatgccagcggccgggcctacccagatgtggccgccctgagtgatggctactgggtggtgagcaacagagtgcccatcccctgggtgtctggcaccagcgccagcacccctgtgtttggaggcatcctgagcctcatcaatgagcaccgcatcctgagcggccggccccccctgggcttcctgaacccccggctgtaccagcagcacggggccggcctgtttgatgtgacccggggctgccacgagagctgcctggatgaggaggtggagggccagggcttctgcagcggccctggctgggaccctgtgacaggctggggcacccccaacttccctgccctgctgaagaccctgctgaacccctag

SEQ ID NO: 22318 - DNA, 3495 bp, Artificial Sequence
  Description of Artificial Sequence: Synthetic coding sequence
atggcccagcaggccaacgtgggggagctgctggccatgctggacagccccatgctgggcgtgagagatgatgtgacagctgtgttcaaggagaacctgaacagcgaccggggccccatgctggtgaacaccctggtggactactacctggagaccagcagccagcctgccctgcacatcctgaccaccctgcaggagccccatgacaagcacctgctggaccgcatcaatgaatatgtgggcaaggccgccacccggctgagcatcctgagcctgctgggccacgtgatccggctgcagcccagctggaagcacaagctgagccaggcccccctgctgcccagcctgctgaagtgcctgaagatggacacagatgtggtggtgctgaccactggagtgctggtgctgatcaccatgctgcccatgatcccccagagcggcaagcagcacctgctggacttctttgacatcttcggccgcctgagctcctggtgcctgaagaagccaggccacgtggccgaggtgtacctggtgcacctgcacgcctctgtgtatgccctcttccaccggctgtatggcatgtacccctgcaactttgtgtccttcctgcggagccactacagcatgaaggagaacctggagacctttgaggaggtggtgaagcccatgatggagcacgtgcgcatccaccctgagctggtgacaggcagcaaggaccacgagctggacccccggcgctggaagaggctggagacccatgatgtggtgattgaatgtgccaagatcagcctggaccccacagaggccagctatgaagatggctacagcgtgagccaccagatcagcgcccgcttcccccacaggtctgcagatgtgaccaccagcccctatgctgacacccagaacagctatggctgtgccaccagcaccccctacagcaccagccggctgatgctgctgaacatgcctggccagctgccccagaccctgagcagccccagcaccaggctcatcacagagcccccccaggccaccctgtggagccccagcatggtgtgtggcatgaccaccccacccaccagccctggaaatgtgcccccagacctgagccacccctacagcaaggtgtttggcaccacagctgggggcaagggcacccccctgggcaccccagccaccagccccccaccagcccccctgtgccacagtgatgattatgtgcacatcagcctgccccaggccaccgtgaccccacccaggaaggaggagaggatggattctgcccggccctgcctgcaccggcagcaccacctgctgaatgaccggggcagcgaggagcccccaggcagcaaaggatctgtgaccctgagtgacctgcccggcttcctgggggacctggccagcgaggaggacagcattgagaaggacaaggaggaggccgccatcagccgggagctgtctgagatcaccacagctgaggccgagcctgtggtgccccggggcggctttgacagccccttctacagagacagcctgcccggcagccagaggaagacccacagcgctgccagcagcagccagggcgcctctgtgaaccctgagcccctgcacagcagcctggacaagctgggccctgacacccccaagcaggccttcacccccatcgacctgccctgtggcagcgcagatgagagccctgctggggaccgggagtgccagaccagcctggagaccagcatcttcacccccagcccctgcaagatccccccacccaccagggtgggcttcggcagcggccagcccccaccctatgaccacctgtttgaggtggccctgcccaagacagcccaccactttgtgatcaggaagacagaggagctgctgaagaaggccaagggcaacacagaagaagatggagtgcccagcaccagccccatggaggtgctggacaggctcatccagcagggcgcagatgcccacagcaaggagctgaacaagctgcccctgcccagcaagtctgtggactggacccactttggaggcagccccccatctgatgagatccgcaccctgcgggaccagctgctgctgctgcacaaccagctgctgtatgagcgcttcaagaggcagcagcacgccctgaggaacagaaggctgctgaggaaggtgatcaaggctgctgccctggaggagcacaatgctgccatgaaggaccagctgaagctgcaggagaaggacatccagatgtggaaggtgtccctgcagaaggagcaggcccgctacaaccagctgcaggagcagagggacaccatggtgaccaagctgcacagccagatccggcagctgcagcacgaccgggaggagttctacaaccagagccaggagctgcagaccaagctggaggactgcaggaacatgattgctgagctgcgcatcgagctgaagaaggccaacaacaaggtgtgccacacagagctgctgctgagccaggtgtcccagaagctgagcaacagcgagagcgtgcagcagcagatggagttcctgaaccggcagctgctggtgctgggggaggtgaatgagctgtacctggagcagctgcagaacaagcacagcgacaccaccaaggaggtggagatgatgaaggccgcctacaggaaggagctggagaagaacagaagccacgtgctgcagcagacccagaggctggacaccagccagaagaggatcctggagctggagagccacctggccaagaaggaccacctgctgctggagcagaagaagtacctggaggatgtgaagctgcaggcccggggccagctgcaggccgctgagagccgctatgaggcccagaagaggatcacccaggtgtttgagctggagatcctggacctgtatggccgcctggagaaggatggcctgctgaagaagctggaggaggagaaggccgaggccgctgaggccgctgaggagcggctggactgctgcaatgatggctgcagcgacagcatggtgggccacaatgaggaggccagcggccacaatggagagaccaagaccccccggcccagcagcgcccggggcagcagcggcagccggggcggcggcggcagcagcagcagcagcagcgagctgagcaccccagagaagccaccccaccagagagctggccccttcagcagccgctgggagaccaccatgggagaggccagcgccagcatccccaccaccgtgggcagcctgcccagcagcaagagcttcctgggcatgaaggcccgggagctgttcaggaacaagtctgagagccagtgtgatgaagatggcatgaccagcagcctgtctgagagcctgaagacagagctgggcaaggacctgggcgtggaggccaagatccccctgaacctggatggcccccaccccagcccccccaccccagattctgtgggccagctgcacatcatggactacaatgagacccaccacgagcacagctag

SEQ ID NO: 22319 - DNA, 1101 bp, Artificial Sequence
  Description of Artificial Sequence: Synthetic coding sequence
atggcccagcaggccaacgtgggggagctgctggccatgctggacagccccatgctgggcgtgagagatgatgtgacagctgtgttcaaggagaacctgaacagcgaccggggccccatgctggtgaacaccctggtggactactacctggagaccagcagccagcctgccctgcacatcctgaccaccctgcaggagccccatgacaagcacctgctggaccgcatcaatgaatatgtgggcaaggccgccacccggctgagcatcctgagcctgctgggccacgtgatccggctgcagcccagctggaagcacaagctgagccaggcccccctgctgcccagcctgctgaagtgcctgaagatggacacagatgtggtggtgctgaccactggagtgctggtgctgatcaccatgctgcccatgatcccccagagcggcaagcagcacctgctggacttctttgacatcttcggccgcctgagctcctggtgcctgaagaagccaggccacgtggccgaggtgtacctggtgcacctgcacgcctctgtgtatgccctcttccaccggctgtatggcatgtacccctgcaactttgtgtccttcctgcggagccactacagcatgaaggagaacctggagacctttgaggaggtggtgaagcccatgatggagcacgtgcgcatccaccctgagctggtgacaggcagcaaggaccacgagctggacccccggcgctggaagaggctggagacccatgatgtggtgattgaatgtgccaagatcagcctggaccccacagaggccagctatgaagatggctacagcgtgagccaccagatcagcgcccgcttcccccacaggtctgcagatgtgaccaccagcccctatgctgacacccagaacagctatggctgtgccaccagcaccccctacagcaccagccggctgatgctgctgaacatgcctggccagctgccccagaccctgagcagccccagcaccaggctcatcacagagcccccccaggtgtggtgccagctggtgtgcctgctgagccccctgctgtctggagaggccgaccccctgggccagatctag

SEQ ID NO: 22320 - DNA, 954 bp, Artificial Sequence
  Description of Artificial Sequence: Synthetic coding sequence
atggacacagatgtggtggtgctgaccaccggggtgctggtgctgatcaccatgctgcccatgatcccccagagcggcaagcagcacctgctggacttctttgacatcttcggccgcctgagctcctggtgcctgaagaagccaggccacgtggccgaggtgtacctggtgcacctgcacgcctctgtgtatgccctcttccaccggctgtatggcatgtacccctgcaactttgtgtccttcctgcggagccactacagcatgaaggagaacctggagacctttgaggaggtggtgaagcccatgatggagcacgtgcgcatccaccctgagctggtgacaggcagcaaggaccacgagctggacccccggcgctggaagaggctggagacccatgatgtggtgattgaatgtgccaagatcagcctggaccccacagaggccagctatgaagatggctacagcgtgagccaccagatcagcgcccgcttcccccacaggtctgcagatgtgaccaccagcccctatgctgacacccagaacagctatggctgtgccaccagcaccccctacagcaccagccggctgatgctgctgaacatgcctggccagctgccccagaccctgagcagccccagcaccaggctcatcacagagcccccccaggccaccctgtggagccccagcatggtgtgtggcatgaccaccccacccaccagccctggaaatgtgcccccagacctgagccacccctacagcaaggtgtttggcaccacagctgggggcaagggcacccccctgggcaccccagccaccagccccccaccagcccccagcgtcatccgcatgaccacctgcaccttccacagcccccggccccagagccaccccccaggcaggaagcgggagtggatcctgcaggaccacgtgtacacagacaacaccatcttctag

SEQ ID NO: 22321 - DNA, 3495 bp, Artificial Sequence; identical to SEQ ID NO: 22318
  Description of Artificial Sequence: Synthetic coding sequence

SEQ ID NO: 22322 - DNA, 849 bp, Artificial Sequence
  Description of Artificial Sequence: Synthetic coding sequence
atggacacagatgtggtggtgctgaccaccggggtgctggtgctgatcaccatgctgcccatgatcccccagagcggcaagcagcacctgctggacttctttgacatcttcggccgcctgagctcctggtgcctgaagaagccaggccacgtggccgaggtgtacctggtgcacctgcacgcctctgtgtatgccctcttccaccggctgtatggcatgtacccctgcaactttgtgtccttcctgcggagccactacagcatgaaggagaacctggagacctttgaggaggtggtgaagcccatgatggagcacgtgcgcatccaccctgagctggtgacaggcagcaaggaccacgagctggacccccggcgctggaagaggctggagacccatgatgtggtgattgaatgtgccaagatcagcctggaccccacagaggccagctatgaagatggctacagcgtgagccaccagatcagcgcccgcttcccccacaggtctgcagatgtgaccaccagcccctatgctgacacccagaacagctatggctgtgccaccagcaccccctacagcaccagccggctgatgctgctgaacatgcctggccacctggccaccaccgtgcggcccaggcctcctggccctgctgcccctggagctgtggtggaggccgaggtggtggaggccgctgctgctgctgctgccagcttcctgccccagaggaacccccacacccggggccaggcccacagcgctgtgggcggccgccgcctgtgggagaagaggctgcctgccagcccccccctgtgggcccacttccctgtgcagaaggcctcctgggtgtag

SEQ ID NO: 22323 - DNA, 3342 bp, Artificial Sequence
  Description of Artificial Sequence: Synthetic coding sequence
atggcccagcaggccaacgtgggggagctgctggccatgctggacagccccatgctgggcgtgagagatgatgtgacagctgtgttcaaggagaacctgaacagcgaccggggccccatgctggtgaacaccctggtggactactacctggagaccagcagccagcctgccctgcacatcctgaccaccctgcaggagccccatgacaagatggacacagatgtggtggtgctgaccaccggggtgctggtgctgatcaccatgctgcccatgatcccccagagcggcaagcagcacctgctggacttctttgacatcttcggccgcctgagctcctggtgcctgaagaagccaggccacgtggccgaggtgtacctggtgcacctgcacgcctctgtgtatgccctcttccaccggctgtatggcatgtacccctgcaactttgtgtccttcctgcggagccactacagcatgaaggagaacctggagacctttgaggaggtggtgaagcccatgatggagcacgtgcgcatccaccctgagctggtgacaggcagcaaggaccacgagctggacccccggcgctggaagaggctggagacccatgatgtggtgattgaatgtgccaagatcagcctggaccccacagaggccagctatgaagatggctacagcgtgagccaccagatcagcgcccgcttcccccacaggtctgcagatgtgaccaccagcccctatgctgacacccagaacagctatggctgtgccaccagcaccccctacagcaccagccggctgatgctgctgaacatgcctggccagctgccccagaccctgagcagccccagcaccaggctcatcacagagcccccccaggccaccctgtggagccccagcatggtgtgtggcatgaccaccccacccaccagccctggaaatgtgcccccagacctgagccacccctacagcaaggtgtttggcaccacagctgggggcaagggcacccccctgggcaccccagccaccagccccccaccagcccccctgtgccacagtgatgattatgtgcacatcagcctgccccaggccaccgtgaccccacccaggaaggaggagaggatggacagcgcccggccctgcctgcaccggcagcaccacctgctgaatgaccggggcagcgaggagcccccaggcagcaagggctctgtgaccctgagtgacctgcccggcttcctgggggacctggcctctgaagaagattccattgagaaggacaaggaggaggccgccatcagccgggagctgtctgagatcaccacagctgaggccgagcctgtggtgccccggggcggctttgacagccccttctacagagacagcctgcccggcagccagaggaagacccacagcgctgccagcagcagccagggcgcctctgtgaaccctgagcccctgcacagcagcctggacaagctgggccctgacacccccaagcaggccttcacccccatcgacctgccctgtggcagcgcagatgagagccctgctggggaccgggagtgccagaccagcctggagaccagcatcttcacccccagcccctgcaagatccccccacccaccagggtgggctttggaagtggccagcccccaccctatgaccacctgtttgaggtggccctgcccaagacagcccaccacttcgtcatcaggaagacagaggagctgctgaagaaggccaagggcaacacagaggaggatggagtgcccagcaccagccccatggaggtgctggacaggctcatccagcagggcgcagatgcccacagcaaggagctgaacaagctgcccctgcccagcaagtctgtggactggacccactttggaggcagccccccatctgatgagatccgcaccctgcgggaccagctgctgctgctgcacaaccagctgctgtatgagcgcttcaagaggcagcagcacgccctgaggaacagaaggctgctgaggaaggtgatcaaggccgccgccctggaggagcacaatgctgccatgaaggaccagctgaagctgcaggagaaggacatccagatgtggaaggtgtccctgcagaaggagcaggcccgctacaaccagctgcaggagcagagggacaccatggtgaccaagctgcacagccagatccggcagctgcagcacgaccgggaggagttctacaaccagagccaggagctgcagaccaagctggaggactgcaggaacatgattgctgagctgagaattgagctgaagaaggccaacaacaaggtgtgccacacagagctgctgctgagccaggtgtcccagaagctgagcaacagcgagagcgtgcagcagcagatggagttcctgaaccggcagctgctggtgctgggggaggtgaatgagctgtacctggagcagctgcagaacaagcacagcgacaccaccaaggaggtggagatgatgaaggccgcctacaggaaggagctggagaagaacagaagccacgtgctgcagcagacccagaggctggacaccagccagaagaggatcctggagctggagagccacctggccaagaaggaccacctgctgctggagcagaagaagtacctggaggatgtgaagctgcaggcccggggccagctgcaggccgctgagagccgctatgaggcccagaagaggatcacccaggtgtttgagctggagatcctggacctgtatggccgcctggagaaggatggcctgctgaagaagctggaggaggagaaggccgaggccgctgaggccgctgaggagcggctggactgctgcaatgatggctgcagcgacagcatggtgggccacaatgaggaggccagcggccacaacggggagaccaagaccccccggcccagcagcgcccggggcagcagcggcagcagaggaggcggcggcagcagcagcagcagcagcgagctgagcaccccagagaagccaccccaccagagagctggccccttcagcagccgctgggagaccaccatgggagaggccagcgccagcatccccaccaccgtgggcagcctgcccagcagcaagagcttcctgggcatgaaggcccgggagctgttcaggaacaagtctgagagccagtgtgatgaagatggcatgaccagcagcctgtctgagagcctgaagacagagctgggcaaggacctgggcgtggaggccaagatccccctgaacctggatggcccccaccccagcccccccaccccagacagcgtgggccagctgcacatcatggactacaatgagacccaccacgagcacagctag

SEQ ID NO: 22324 - DNA, 2397 bp, Artificial Sequence
  Description of Artificial Sequence: Synthetic coding sequence
atggccctgcacagcccccagtacatctttggagacttctccccagatgagttcaaccagttctttgtgacccccaggagctctgtggagctgcccccctacagcggcaccgtgctgtgtggcacccaggccgtggacaagctgcctgatggccaggagtaccagagaattgaatttggagtggatgaggtgattgagcccagcgacaccctgcccaggacccccagctacagcatcagcagcaccctgaacccccaggcccctgagttcatcctgggctgcacagccagcaagatcaccccagatggcatcaccaaggaggccagctatggcagcattgactgccagtacccaggcagcgccctggccctggatggcagcagcaatgtggaggccgaggtgctggagaatgatggagtgtctgggggcctgggccagcgggagaggaagaagaagaagaagaggcctcctggctactacagctacctgaaggatggaggagatgacagcatcagcacagaggccctggtgaatggccacgccaacagcgctgtgcccaacagcgtgtctgcagaagatgctgagttcatgggagacatgcctccttctgtgacccccaggacctgcaacagcccccagaacagcacagacagcgtgtctgacatcgtgcctgacagccccttccctggggccctgggcagtgacaccaggacagctggccagcctgagggcggccctggagctgactttggccagagctgcttccctgctgaggccggccgggacaccctgagcaggacagctggggcccagccctgtgtgggcacagacaccacagagaacctgggcgtggccaacggccagatcctggagagcagtggagagggcacagccaccaacggggtggagctgcacaccacagagagcattgacctggaccccaccaagccagagagcgccagccccccagcagatggcactggaagtgccagcggcaccctgcctgtgtcccagcccaagtcctgggccagcctcttccatgacagcaagcccagcagcagcagccctgtggcctacgtggagaccaagtacagccccccagccatcagccccctggtgtctgagaagcaggtggaggtgaaggagggcctggtgcctgtgtctgaagatcctgtggccatcaagattgctgagctgctggagaatgtgaccctcatccacaagcctgtgtccctgcagccccggggcctcatcaacaagggcaactggtgctacatcaatgccaccctgcaggccctggtggcctgcccccccatgtaccacctgatgaagttcatccccctgtacagcaaggtgcagaggccctgcaccagcacccccatgattgacagctttgtgcggctgatgaatgagttcaccaacatgcctgtgccccccaagccccggcaggccctgggggacaagatcgtgcgggacatccggcctggagctgcctttgagcccacctacatctaccgcctgctgactgtgaacaagagcagcctgtctgagaagggccggcaggaggatgctgaggagtacctgggcttcatcctgaatggcctgcacgaggagatgctgaacctgaagaagctgctgagccccagcaatgagaagctgaccatcagcaatggccccaagaaccacagcgtgaatgaggaggagcaggaggagcagggcgagggctctgaagatgagtgggagcaggtgggccccaggaacaagacctctgtgacccggcaggccgactttgtgcagacccccatcaccggcatctttggaggccacatccgctctgtggtgtaccagcagagcagcaaggagagcgccaccctgcagcccttcttcaccctgcagctggacatccagagcgacaagatcagaacagtgcaggatgccctggagagcctggtggcccgggagagcgtgcagggctacaccaccaagaccaagcaggaggtggagatcagcagaagagtgaccctggagaagctgccccctgtgctggtgctgcacctgaagagatttgtgtatgagaagacaggaggctgccagaagctgatcaagaacatcgagtaccctgtggacctggagatcagcaaggagctgctgagccctggggtgaagaacaagaacttcaagtgccacaggacctaccgcctgtttgctgtggtgtaccaccacggcaacagcgccaccggcggccactacaccacagatgtgttccagatcggcctgaatggctggctgagaattgatgaccagacagtgaaggtgatcaaccagtaccaggtggtgaagcccacagctgagaggacagcctacctgctgtactacagaagagtggacctgctgtag

SEQ ID NO: 22325 - DNA, 5355 bp, Artificial Sequence
  Description of Artificial Sequence: Synthetic coding sequence
atggccaagcccaccagcaaggacagcggcctgaaggagaagttcaagatcctgctgggcctgggcaccccccggcccaaccccaggtctgctgagggcaagcagacagagttcatcatcacagctgagatcctgcgggagctgtccatggagtgtggcctgaacaaccgcatccgcatgattggccagatctgtgaggtggccaagaccaagaagtttgaggagcacgctgtggaggccctgtggaaggctgtggccgacctgctgcagcctgagcggcccctggaggcccggcatgctgtgctggccctgctgaaggccatcgtgcagggccagggcgagcggctgggcgtgctgcgggccctcttcttcaaggtgatcaaggactaccccagcaatgaagacctgcacgagcggctggaggtgttcaaggccctgacagacaatggccgccacatcacctacctggaggaggagctggccgactttgtgctgcagtggatggatgtgggcctgagcagcgagttcctgctggtgctggtgaacctggtgaagttcaacagctgctacctggatgagtacatcgccaggatggtgcagatgatctgcctgctgtgtgtgaggacagccagctctgtggacatcgaggtgtccctgcaggtgctggatgctgtggtgtgctacaactgcctgcctgctgagagcctgcccctcttcatcgtgaccctgtgcaggaccatcaacgtgaaggagctgtgtgagccctgctggaagctgatgaggaacctgctgggcacccacctgggccacagcgccatctacaacatgtgccacctgatggaggaccgggcctacatggaggatgcccccctgctgcggggagctgtgttctttgtgggcatggccctgtggggcgcccaccggctgtacagcctgaggaacagccccacctctgtgctgcccagcttctaccaggccatggcctgccccaatgaggtggtgtcctatgagatcgtgctgagcatcaccaggctcatcaagaagtacaggaaggagctgcaggtggtggcctgggacatcctgctgaacatcatcgagcggctgctgcagcagctgcagaccctggacagccctgagctgcggaccatcgtgcatgacctgctgaccaccgtggaggagctgtgtgaccagaatgagttccacggcagccaggagcgctactttgagctggtggagcgctgtgccgaccagaggcctgagagcagcctgctgaacctgatctcctaccgggcccagagcatccacccagccaaggatggctggatccagaacctgcaggccctgatggagcgcttcttccgctctgagagcagaggagctgtgcgcatcaaggtgctggatgtgctgagctttgtgctgctgatcaaccggcagttctatgaggaggagctgatcaacagcgtggtgatcagccagctgagccacatccctgaggacaaggaccaccaggtgaggaagctggccacccagctgctggtggacctggccgagggctgccacacccaccacttcaacagcctgctggacatcatcgagaaggtgatggcccggagcctgagccccccacctgagctggaggagagagatgtggccgcctacagcgccagcctggaggatgtgaagacagctgtgctgggcctgctggtgatcctgcagaccaagctgtacaccctgcctgccagccacgccaccagggtgtatgagatgctggtgagccacatccagctgcactacaagcacagctacaccctgcccatcgccagcagcatccggctgcaggcctttgacttcctgctgctgctgcgggctgacagcctgcaccggctgggcctgcccaacaaggatggagtggtgcgcttcagcccctactgtgtgtgtgactacatggagcctgagcggggcagcgagaagaagaccagcggccccctgagccccccaactggacctcctggccctgccccagctggccctgctgtgcggctgggctctgtgccctacagcctgctcttccgggtgctgctgcagtgcctgaagcaggagagtgactggaaggtgctgaagctggtgctgggccgcctgcctgagagcctgcgctacaaggtgctgatcttcaccagcccctgcagcgtggaccagctgtgcagcgccctgtgcagcatgctgagcggccccaagaccctggagcggctgcggggggcccctgagggcttcagcaggacagacctgcacctggccgtggtgcctgtgctgacagccctgatctcctaccacaactacctggacaagaccaagcagcgggagatggtgtactgcctggagcagggcctcatccaccgctgtgccagccagtgtgtggtggccctgagcatctgcagcgtggagatgccagacatcatcatcaaggccctgcctgtgctggtggtgaagctgacccacatcagcgccacagcctccatggctgtgcccctgctggagttcctgagcaccctggcccggctgccccacctgtacagaaactttgctgctgagcagtatgcctctgtgtttgccatcagcctgccctacaccaaccccagcaagttcaaccagtacatcgtgtgcctggcccaccacgtgattgccatgtggttcatccgctgccgcctgcccttcaggaaggactttgtgcccttcatcaccaagggcctgcggagcaatgtgctgctgagctttgatgacaccccagagaaggacagcttccgggcccggagcaccagcctgaatgaaagacccaagagcctgagaattgcccggccccccaagcagggcctgaacaacagcccccctgtgaaggagttcaaggagagcagcgctgctgaggccttccgctgccgcagcatctctgtgtctgaacatgtggtgcgcagccgcatccagaccagcctgaccagcgccagcctgggcagcgcagatgaaaattctgtggcccaggctgatgacagcctgaagaacctgcacctggagctgacagagacctgcctggacatgatggcccgctacgtgttcagcaacttcaccgctgtgcccaagaggagccctgtgggggagttcctgctggccggcggccgcaccaagacctggctggtgggcaacaagctggtgacagtgaccacctctgtgggcaccggcaccaggagcctgctgggcctggacagcggggagctgcagagcggccctgagagcagcagcagccctggggtgcacgtgcggcagaccaaggaggccccagccaagctggagagccaggccggccagcaggtgtccagaggagcccgggacagagtgcgctccatgtctgggggccacggcctgcgggtgggcgccctggatgtgcctgccagccagttcctgggcagcgccaccagccctggccccaggacagccccagctgccaagccagagaaggccagcgctggcaccagggtgcctgtgcaggagaagaccaacctggccgcctacgtgcccctgctgacccagggctgggccgagatcctggtgcggcggcccactggaaacacctcctggctgatgagcctggagaaccccctgagccccttcagcagtgacatcaacaacatgcccctgcaggagctgagcaatgccctgatggctgctgagcgcttcaaggagcaccgggacacagccctgtacaagagcctgtctgtgcctgctgccagcacagccaagcccccacccctgcccaggagcaacacagattctgctgtggtgatggaggagggcagccctggagaggtgcctgtgctggtggagcccccaggcctggaggatgtggaggccgccctgggcatggacagaagaacagatgcctacagccgcagcagctctgtgagcagccaggaggagaagagcctgcacgccgaggagctggtgggccggggcatccccatcgagcgggtggtgagcagcgagggcggccggcccagcgtggacctgtccttccagcccagccagcccctgagcaagagcagcagcagccctgagctgcagaccctgcaggacatcctgggggaccccggggacaaggcagatgtgggccgcctgagccctgaggtgaaggcccggagccagagcggcaccctggatggagagagcgctgcctggagcgccagcggggaggacagccggggccagcctgagggccccctgcccagcagcagccccaggagccccagcggcctgcggccccggggctacaccatcagtgacagcgcccccagcagaagaggcaagagggtggagagagatgccctgaagagccgggccacagccagcaatgctgagaaggtgcccggcatcaaccccagctttgtgttcctgcagctgtaccacagccccttctttggagatgagagcaacaagcccatcctgctgcccaatgaaagccagagctttgagaggtctgtgcagctgctggaccagatccccagctatgacacccacaagattgctgtgctgtatgtgggggagggccagagcaacagcgagctggccatcctgagcaatgaacatggcagctaccgctacacagagttcctgaccggcctgggccgcctgattgagctgaaggactgccagcctgacaaggtgtacctgggcggcctggatgtgtgtggagaagatggccagttcacctactgctggcatgatgacatcatgcaggccgtgttccacatcgccaccctgatgcccaccaaggatgtggacaagcaccgctgtgacaagaagaggcacctgggcaatgactttgtgtccatcgtgtacaatgacagcggggaggacttcaagctgggcaccatcaagggccagttcaactttgtgcacgtgattgtgacccccctggactatgagtgcaacctggtgtccctgcagtgcaggaaggacatggagggcctggtggacacctctgtggccaagatcgtgtctgacaggaacctgccctttgtggcccggcagatggccctgcacgccaacatggccagccaggtgcaccacagccgcagcaaccccacagacatctaccccagcaagtggatcgcccggctgcggcacatcaagaggctgcggcagaggatctgtgaggaggccgcctacagcaaccccagcctgcccctggtgcacccccccagccacagcaaggccccagcccagaccccagctgagcccaccccaggctatgaggtgggccagaggaagaggctcatcagctctgtggaggacttcacagaatttgtgtag

SEQ ID NO: 22326 - DNA, 5295 bp, Artificial Sequence
  Description of Artificial Sequence: Synthetic coding sequence
atggccaagcccaccagcaaggacagcggcctgaaggagaagttcaagatcctgctgggcctgggcaccccccggcccaaccccaggtctgctgagggcaagcagacagagttcatcatcacagctgagatcctgcgggagctgtccatggagtgtggcctgaacaaccgcatccgcatgattggccagatctgtgaggtggccaagaccaagaagtttgaggagcacgctgtggaggccctgtggaaggctgtggccgacctgctgcagcctgagcggcccctggaggcccggcatgctgtgctggccctgctgaaggccatcgtgcagggccagggcgagcggctgggcgtgctgcgggccctcttcttcaaggtgatcaaggactaccccagcaatgaagacctgcacgagcggctggaggtgttcaaggccctgacagacaatggccgccacatcacctacctggaggaggagctggccgactttgtgctgcagtggatggatgtgggcctgagcagcgagttcctgctggtgctggtgaacctggtgaagttcaacagctgctacctggatgagtacatcgccaggatggtgcagatgatctgcctgctgtgtgtgaggacagccagctctgtggacatcgaggtgtccctgcaggtgctggatgctgtggtgtgctacaactgcctgcctgctgagagcctgcccctcttcatcgtgaccctgtgcaggaccatcaacgtgaaggagctgtgtgagccctgctggaagctgatgaggaacctgctgggcacccacctgggccacagcgccatctacaacatgtgccacctgatggaggaccgggcctacatggaggatgcccccctgctgcggggagctgtgttctttgtgggcatggccctgtggggcgcccaccggctgtacagcctgaggaacagccccacctctgtgctgcccagcttctaccaggccatggcctgccccaatgaggtggtgtcctatgagatcgtgctgagcatcaccaggctcatcaagaagtacaggaaggagctgcaggtggtggcctgggacatcctgctgaacatcatcgagcggctgctgcagcagctgcagaccctggacagccctgagctgcggaccatcgtgcatgacctgctgaccaccgtggaggagctgtgtgaccagaatgagttccacggcagccaggagcgctactttgagctggtggagcgctgtgccgaccagaggcctgagagcagcctgctgaacctgatctcctaccgggcccagagcatccacccagccaaggatggctggatccagaacctgcaggccctgatggagcgcttcttccgctctgagagcagaggagctgtgcgcatcaaggtgctggatgtgctgagctttgtgctgctgatcaaccggcagttctatgaggaggagctgatcaacagcgtggtgatcagccagctgagccacatccctgaggacaaggaccaccaggtgaggaagctggccacccagctgctggtggacctggccgagggctgccacacccaccacttcaacagcctgctggacatcatcgagaaggtgatggcccggagcctgagccccccacctgagctggaggagagagatgtggccgcctacagcgccagcctggaggatgtgaagacagctgtgctgggcctgctggtgatcctgcagaccaagctgtacaccctgcctgccagccacgccaccagggtgtatgagatgctggtgagccacatccagctgcactacaagcacagctacaccctgcccatcgccagcagcatccggctgcaggcctttgacttcctgctgctgctgcgggctgacagcctgcaccggctgggcctgcccaacaaggatggagtggtgcgcttcagcccctactgtgtgtgtgactacatggagcctgagcggggcagcgagaagaagaccagcggccccctgagccccccaactggacctcctggccctgccccagctggccctgctgtgcggctgggctctgtgccctacagcctgctcttccgggtgctgctgcagtgcctgaagcaggagagtgactggaaggtgctgaagctggtgctgggccgcctgcctgagagcctgcgctacaaggtgctgatcttcaccagcccctgcagcgtggaccagctgtgcagcgccctgtgcagcatgctgagcggccccaagaccctggagcggctgcggggggcccctgagggcttcagcaggacagacctgcacctggccgtggtgcctgtgctgacagccctgatctcctaccacaactacctggacaagaccaagcagcgggagatggtgtactgcctggagcagggcctcatccaccgctgtgccagccagtgtgtggtggccctgagcatctgcagcgtggagatgccagacatcatcatcaaggccctgcctgtgctggtggtgaagctgacccacatcagcgccacagcctccatggctgtgcccctgctggagttcctgagcaccctggcccggctgccccacctgtacagaaactttgctgctgagcagtatgcctctgtgtttgccatcagcctgccctacaccaaccccagcaagttcaaccagtacatcgtgtgcctggcccaccacgtgattgccatgtggttcatccgctgccgcctgcccttcaggaaggactttgtgcccttcatcaccaagggcctgcggagcaatgtgctgctgagctttgatgacaccccagagaaggacagcttccgggcccggagcaccagcctgaatgaaagacccaagagccgcatccagaccagcctgaccagcgccagcctgggcagcgcagatgagaacagcgtggcccaggctgatgacagcctgaagaacctgcacctggagctgacagagacctgcctggacatgatggcccgctacgtgttcagcaacttcaccgctgtgcccaagaggagccctgtgggggagttcctgctggccggcggccgcaccaagacctggctggtgggcaacaagctggtgacagtgaccacctctgtgggcaccggcaccaggagcctgctgggcctggacagcggggagctgcagagcggccctgagagcagcagcagccctggggtgcacgtgcggcagaccaaggaggccccagccaagctggagagccaggccggccagcaggtgtccagaggagcccgggacagagtgcgctccatgtctgggggccacggcctgcgggtgggcgccctggatgtgcctgccagccagttcctgggcagcgccaccagccctggccccaggacagccccagctgccaagccagagaaggccagcgctggcaccagggtgcctgtgcaggagaagaccaacctggccgcctacgtgcccctgctgacccagggctgggccgagatcctggtgagaagacccaccggcaacacctcctggctgatgagcctggagaaccccctgagccccttcagcagtgacatcaacaacatgcccctgcaggagctgagcaatgccctgatggctgctgagcgcttcaaggagcaccgggacacagccctgtacaagagcctgtctgtgcctgctgccagcacagccaagcccccacccctgcccaggagcaacacagtggccagcttcagcagcctgtaccagagcagctgccagggccagctgcacaggtctgtgtcctgggccgacagcgctgtggtgatggaggagggcagccctggagaggtgcctgtgctggtggagcccccaggcctggaggatgtggaggccgccctgggcatggacagaagaacagatgcctacagccgcagcagctctgtgagcagccaggaggagaagagcctgcacgccgaggagctggtgggccggggcatccccatcgagcgggtggtgagcagcgagggcggccggcccagcgtggacctgtccttccagcccagccagcccctgagcaagagcagcagcagccctgagctgcagaccctgcaggacatcctgggggaccccggggacaaggcagatgtgggccgcctgagccctgaggtgaaggcccggagccagagcggcaccctggatggagagagcgctgcctggagcgccagcggggaggacagccggggccagcctgagggccccctgcccagcagcagccccaggagccccagcggcctgcggccccggggctacaccatcagtgacagcgcccccagcagaagaggcaagagggtggagagagatgccctgaagagccgggccacagccagcaatgctgagaaggtgcccggcatcaaccccagctttgtgttcctgcagctgtaccacagccccttctttggagatgagagcaacaagcccatcctgctgcccaatgaaagccagagctttgagaggtctgtgcagctgctggaccagatccccagctatgacacccacaagattgctgtgctgtatgtgggggagggccagagcaacagcgagctggccatcctgagcaatgaacatggcagctaccgctacacagagttcctgaccggcctgggccgcctgattgagctgaaggactgccagcctgacaaggtgtacctgggcggcctggatgtgtgtggagaagatggccagttcacctactgctggcatgatgacatcatgcaggccgtgttccacatcgccaccctgatgcccaccaaggatgtggacaagcaccgctgtgacaagaagaggcacctgggcaatgactttgtgtccatcgtgtacaatgacagcggggaggacttcaagctgggcaccatcaagggccagttcaactttgtgcacgtgattgtgacccccctggactatgagtgcaacctggtgtccctgcagtgcaggaaggacatggagggcctggtggacacctctgtggccaagatcgtgtctgacaggaacctgccctttgtggcccggcagatggccctgcacgccaacatggccagccaggtgcaccacagccgcagcaaccccacagacatctaccccagcaagtggatcgcccggctgcggcacatcaagaggctgcggcagaggatctgtgaggaggccgcctacagcaaccccagcctgcccctggtgcacccccccagccacagcaaggccccagcccagaccccagctgagcccaccccaggctatgaggtgggccagaggaagaggctcatcagctctgtggaggacttcacagaatttgtgtag

SEQ ID NO: 22327 - DNA, 5079 bp, Artificial Sequence
  Description of Artificial Sequence: Synthetic coding sequence
atggagtgtggcctgaacaaccgcatccgcatgattggccagatctgtgaggtggccaagaccaagaagtttgaggagcacgctgtggaggccctgtggaaggctgtggccgacctgctgcagcctgagcggcccctggaggcccggcatgctgtgctggccctgctgaaggccatcgtgcagggccagggcgagcggctgggcgtgctgcgggccctcttcttcaaggtgatcaaggactaccccagcaatgaagacctgcacgagcggctggaggtgttcaaggccctgacagacaatggccgccacatcacctacctggaggaggagctggccgactttgtgctgcagtggatggatgtgggcctgagcagcgagttcctgctggtgctggtgaacctggtgaagttcaacagctgctacctggatgagtacatcgccaggatggtgcagatgatctgcctgctgtgtgtgaggacagccagctctgtggacatcgaggtgtccctgcaggtgctggatgctgtggtgtgctacaactgcctgcctgctgagagcctgcccctcttcatcgtgaccctgtgcaggaccatcaacgtgaaggagctgtgtgagccctgctggaagctgatgaggaacctgctgggcacccacctgggccacagcgccatctacaacatgtgccacctgatggaggaccgggcctacatggaggatgcccccctgctgcggggagctgtgttctttgtgggcatggccctgtggggcgcccaccggctgtacagcctgaggaacagccccacctctgtgctgcccagcttctaccaggccatggcctgccccaatgaggtggtgtcctatgaaattgtgctgagcatcaccaggctcatcaagaagtacaggaaggagctgcaggtggtggcctgggacatcctgctgaacatcatcgagcggctgctgcagcagctgcagaccctggacagccctgagctgcggaccatcgtgcatgacctgctgaccaccgtggaggagctgtgtgaccagaatgagttccacggcagccaggagcgctactttgagctggtggagcgctgtgccgaccagaggcctgagagcagcctgctgaacctgatctcctaccgggcccagagcatccacccagccaaggatggctggatccagaacctgcaggccctgatggagcgcttcttccgctctgagagcagaggagctgtgcgcatcaaggtgctggatgtgctgagctttgtgctgctgatcaaccggcagttctatgaggaggagctgatcaacagcgtggtgatcagccagctgagccacatccctgaggacaaggaccaccaggtgaggaagctggccacccagctgctggtggacctggccgagggctgccacacccaccacttcaacagcctgctggacatcatcgagaaggtgatggcccggagcctgagccccccacctgagctggaggagagagatgtggccgcctacagcgccagcctggaggatgtgaagacagctgtgctgggcctgctggtgatcctgcagaccaagctgtacaccctgcctgccagccacgccaccagggtgtatgagatgctggtgagccacatccagctgcactacaagcacagctacaccctgcccatcgccagcagcatccggctgcaggcctttgacttcctgctgctgctgcgggctgacagcctgcaccggctgggcctgcccaacaaggatggagtggtgcgcttcagcccctactgtgtgtgtgactacatggagcctgagcggggcagcgagaagaagaccagcggccccctgagcccccccaccggccccccaggccctgccccagctggccctgctgtgcggctgggctctgtgccctacagcctgctcttccgggtgctgctgcagtgcctgaagcaggagagtgactggaaggtgctgaagctggtgctgggccgcctgcctgagagcctgcgctacaaggtgctgatcttcaccagcccctgcagcgtggaccagctgtgcagcgccctgtgcagcatgctgagcggccccaagaccctggagcggctgcggggggcccctgagggcttcagcaggacagacctgcacctggccgtggtgcctgtgctgacagccctgatctcctaccacaactacctggacaagaccaagcagcgggagatggtgtactgcctggagcagggcctcatccaccgctgtgccagccagtgtgtggtggccctgagcatctgcagcgtggagatgccagacatcatcatcaaggccctgcctgtgctggtggtgaagctgacccacatcagcgccacagcctccatggctgtgcccctgctggagttcctgagcaccctggcccggctgccccacctgtacagaaactttgctgctgagcagtatgcctctgtgtttgccatcagcctgccctacaccaaccccagcaagttcaaccagtacatcgtgtgcctggcccaccacgtgattgccatgtggttcatccgctgccgcctgcccttcaggaaggactttgtgcccttcatcaccaagggcctgcggagcaatgtgctgctgagctttgatgacaccccagagaaggacagcttccgggcccggagcaccagcctgaatgaaagacccaagagccgcatccagaccagcctgaccagcgccagcctgggcagcgcagatgaaaattctgtggcccaggctgatgacagcctgaagaacctgcacctggagctgacagagacctgcctggacatgatggcccgctacgtgttcagcaacttcaccgctgtgcccaagaggagccctgtgggggagttcctgctggccggcggccgcaccaagacctggctggtgggcaacaagctggtgacagtgaccacctctgtgggcaccggcaccaggagcctgctgggcctggacagcggggagctgcagagcggccctgagagcagcagcagccctggggtgcacgtgcggcagaccaaggaggccccagccaagctggagagccaggccggccagcaggtgtccagaggagcccgggacagagtgcgctccatgtctgggggccacggcctgcgggtgggcgccctggatgtgcctgccagccagttcctgggcagcgccaccagccctggccccaggacagccccagctgccaagccagagaaggccagcgctggcaccagggtgcctgtgcaggagaagaccaacctggccgcctacgtgcccctgctgacccagggctgggccgagatcctggtgcggcggcccactggaaacacctcctggctgatgagcctggagaaccccctgagccccttcagcagtgacatcaacaacatgcccctgcaggagctgagcaatgccctgatggctgctgagcgcttcaaggagcaccgggacacagccctgtacaagagcctgtctgtgcctgctgccagcacagccaagcccccacccctgcccaggagcaacacagattctgctgtggtgatggaggagggcagccctggagaggtgcctgtgctggtggagcccccaggcctggaggatgtggaggccgccctgggcatggacagaagaacagatgcctacagccgcagcagctctgtgagcagccaggaggagaagagcctgcacgccgaggagctggtgggccggggcatccccatcgagcgggtggtgagcagcgagggcggccggcccagcgtggacctgtccttccagcccagccagcccctgagcaagagcagcagcagccctgagctgcagaccctgcaggacatcctgggggaccccggggacaaggcagatgtgggccgcctgagccctgaggtgaaggcccggagccagagcggcaccctggatggagagagcgctgcctggagcgccagcggggaggacagccggggccagcctgagggccccctgcccagcagcagccccaggagccccagcggcctgcggccccggggctacaccatcagtgacagcgcccccagcagaagaggcaagagggtggagagagatgccctgaagagccgggccacagccagcaatgctgagaaggtgcccggcatcaaccccagctttgtgttcctgcagctgtaccacagccccttctttggagatgagagcaacaagcccatcctgctgcccaatgaaagccagagctttgagaggtctgtgcagctgctggaccagatccccagctatgacacccacaagattgctgtgctgtatgtgggggagggccagagcaacagcgagctggccatcctgagcaatgaacatggcagctaccgctacacagagttcctgaccggcctgggccgcctgattgagctgaaggactgccagcctgacaaggtgtacctgggcggcctggatgtgtgtggagaagatggccagttcacctactgctggcatgatgacatcatgcaggccgtgttccacatcgccaccctgatgcccaccaaggatgtggacaagcaccgctgtgacaagaagaggcacctgggcaatgactttgtgtccatcgtgtacaatgacagcggggaggacttcaagctgggcaccatcaagggccagttcaactttgtgcacgtgattgtgacccccctggactatgagtgcaacctggtgtccctgcagtgcaggaaggacatggagggcctggtggacacctctgtggccaagatcgtgtctgacaggaacctgccctttgtggcccggcagatggccctgcacgccaacatggccagccaggtgcaccacagccgcagcaaccccacagacatctaccccagcaagtggatcgcccggctgcggcacatcaagaggctgcggcagaggatctgtgaggaggccgcctacagcaaccccagcctgcccctggtgcacccccccagccacagcaaggccccagcccagaccccagctgagcccaccccaggctatgaggtgggccagaggaagaggctcatcagctctgtggaggacttcacagaatttgtgtag

SEQ ID NO: 22328 - DNA, 5226 bp, Artificial Sequence
  Description of Artificial Sequence: Synthetic coding sequence
atggccaagcccaccagcaaggacagcggcctgaaggagaagttcaagatcctgctgggcctgggcaccccccggcccaaccccaggtctgctgagggcaagcagacagagttcatcatcacagctgagatcctgcgggagctgtccatggagtgtggcctgaacaaccgcatccgcatgattggccagatctgtgaggtggccaagaccaagaagtttgaggagcacgctgtggaggccctgtggaaggctgtggccgacctgctgcagcctgagcggcccctggaggcccggcatgctgtgctggccctgctgaaggccatcgtgcagggccagggcgagcggctgggcgtgctgcgggccctcttcttcaaggtgatcaaggactaccccagcaatgaagacctgcacgagcggctggaggtgttcaaggccctgacagacaatggccgccacatcacctacctggaggaggagctggccgactttgtgctgcagtggatggatgtgggcctgagcagcgagttcctgctggtgctggtgaacctggtgaagttcaacagctgctacctggatgagtacatcgccaggatggtgcagatgatctgcctgctgtgtgtgaggacagccagctctgtggacatcgaggtgtccctgcaggtgctggatgctgtggtgtgctacaactgcctgcctgctgagagcctgcccctcttcatcgtgaccctgtgcaggaccatcaacgtgaaggagctgtgtgagccctgctggaagctgatgaggaacctgctgggcacccacctgggccacagcgccatctacaacatgtgccacctgatggaggaccgggcctacatggaggatgcccccctgctgcggggagctgtgttctttgtgggcatggccctgtggggcgcccaccggctgtacagcctgaggaacagccccacctctgtgctgcccagcttctaccaggccatggcctgccccaatgaggtggtgtcctatgagatcgtgctgagcatcaccaggctcatcaagaagtacaggaaggagctgcaggtggtggcctgggacatcctgctgaacatcatcgagcggctgctgcagcagctgcagaccctggacagccctgagctgcggaccatcgtgcatgacctgctgaccaccgtggaggagctgtgtgaccagaatgagttccacggcagccaggagcgctactttgagctggtggagcgctgtgccgaccagaggcctgagagcagcctgctgaacctgatctcctaccgggcccagagcatccacccagccaaggatggctggatccagaacctgcaggccctgatggagcgcttcttccgctctgagagcagaggagctgtgcgcatcaaggtgctggatgtgctgagctttgtgctgctgatcaaccggcagttctatgaggaggagctgatcaacagcgtggtgatcagccagctgagccacatccctgaggacaaggaccaccaggtgaggaagctggccacccagctgctggtggacctggccgagggctgccacacccaccacttcaacagcctgctggacatcatcgagaaggtgatggcccggagcctgagccccccacctgagctggaggagagagatgtggccgcctacagcgccagcctggaggatgtgaagacagctgtgctgggcctgctggtgatcctgcagaccaagctgtacaccctgcctgccagccacgccaccagggtgtatgagatgctggtgagccacatccagctgcactacaagcacagctacaccctgcccatcgccagcagcatccggctgcaggcctttgacttcctgctgctgctgcgggctgacagcctgcaccggctgggcctgcccaacaaggatggagtggtgcgcttcagcccctactgtgtgtgtgactacatggagcctgagcggggcagcgagaagaagaccagcggccccctgagccccccaactggacctcctggccctgccccagctggccctgctgtgcggctgggctctgtgccctacagcctgctcttccgggtgctgctgcagtgcctgaagcaggagagtgactggaaggtgctgaagctggtgctgggccgcctgcctgagagcctgcgctacaaggtgctgatcttcaccagcccctgcagcgtggaccagctgtgcagcgccctgtgcagcatgctgagcggccccaagaccctggagcggctgcggggggcccctgagggcttcagcaggacagacctgcacctggccgtggtgcctgtgctgacagccctgatctcctaccacaactacctggacaagaccaagcagcgggagatggtgtactgcctggagcagggcctcatccaccgctgtgccagccagtgtgtggtggccctgagcatctgcagcgtggagatgccagacatcatcatcaaggccctgcctgtgctggtggtgaagctgacccacatcagcgccacagcctccatggctgtgcccctgctggagttcctgagcaccctggcccggctgccccacctgtacagaaactttgctgctgagcagtatgcctctgtgtttgccatcagcctgccctacaccaaccccagcaagttcaaccagtacatcgtgtgcctggcccaccacgtgattgccatgtggttcatccgctgccgcctgcccttcaggaaggactttgtgcccttcatcaccaagggcctgcggagcaatgtgctgctgagctttgatgacaccccagagaaggacagcttccgggcccggagcaccagcctgaatgaaagacccaagagccgcatccagaccagcctgaccagcgccagcctgggcagcgcagatgagaacagcgtggcccaggctgatgacagcctgaagaacctgcacctggagctgacagagacctgcctggacatgatggcccgctacgtgttcagcaacttcaccgctgtgcccaagaggagccctgtgggggagttcctgctggccggcggccgcaccaagacctggctggtgggcaacaagctggtgacagtgaccacctctgtgggcaccggcaccaggagcctgctgggcctggacagcggggagctgcagagcggccctgagagcagcagcagccctggggtgcacgtgcggcagaccaaggaggccccagccaagctggagagccaggccggccagcaggtgtccagaggagcccgggacagagtgcgctccatgtctgggggccacggcctgcgggtgggcgccctggatgtgcctgccagccagttcctgggcagcgccaccagccctggccccaggacagccccagctgccaagccagagaaggccagcgctggcaccagggtgcctgtgcaggagaagaccaacctggccgcctacgtgcccctgctgacccagggctgggccgagatcctggtgagaagacccaccggcaacacctcctggctgatgagcctggagaaccccctgagccccttcagcagtgacatcaacaacatgcccctgcaggagctgagcaatgccctgatggctgctgagcgcttcaaggagcaccgggacacagccctgtacaagagcctgtctgtgcctgctgccagcacagccaagcccccacccctgcccaggagcaacacagacagcgctgtggtgatggaggagggcagccctggagaggtgcctgtgctggtggagcccccaggcctggaggatgtggaggccgccctgggcatggacagaagaacagatgcctacagccgcagcagctctgtgagcagccaggaggagaagagcctgcatgctgaggagctggtgggccggggcatccccatcgagcgggtggtgtcctctgagggcggccggcccagcgtggacctgtccttccagcccagccagcccctgagcaagagcagcagcagccctgagctgcagaccctgcaggacatcctgggggaccccggggacaaggcagatgtgggccgcctgagccctgaggtgaaggcccggagccagagcggcaccctggatggagagagcgctgcctggagcgccagcggggaggacagccggggccagcctgagggccccctgcccagcagcagccccaggagccccagcggcctgcggccccggggctacaccatcagtgacagcgcccccagccggcggggcaagagggtggagagagatgccctgaagagccgggccacagccagcaatgctgagaaggtgcccggcatcaaccccagctttgtgttcctgcagctgtaccacagccccttctttggagatgagagcaacaagcccatcctgctgcccaatgaaagccagagctttgagaggtctgtgcagctgctggaccagatccccagctatgacacccacaagattgctgtgctgtatgtgggggagggccagagcaacagcgagctggccatcctgagcaatgagcacggcagctaccgctacacagagttcctgaccggcctgggccgcctcatcgagctgaaggactgccagcctgacaaggtgtacctgggcggcctggatgtgtgtggggaggatggccagttcacctactgctggcatgatgacatcatgcaggccgtgttccacatcgccaccctgatgcccaccaaggatgtggacaagcaccgctgtgacaagaagaggcacctgggcaatgactttgtgtccatcgtgtacaatgattctggagaggacttcaagctgggcaccatcaagggccagttcaactttgtgcacgtgattgtgacccccctggactatgagtgcaacctggtgtccctgcagtgcaggaaggacatggagggcctggtggacacctctgtggccaagatcgtgtctgacaggaacctgccctttgtggcccggcagatggccctgcacgccaacatggccagccaggtgcaccacagccgcagcaaccccacagacatctaccccagcaagtggatcgcccggctgcggcacatcaagaggctgcggcagaggatctgtgaggaggccgcctacagcaaccccagcctgcccctggtgcacccccccagccacagcaaggccccagcccagaccccagctgagcccaccccaggctatgaggtgggccagaggaagaggctcatcagctctgtggaggacttcacagaatttgtgtag

SEQ ID NO: 22329 - DNA, 5115 bp, Artificial Sequence
  Description of Artificial Sequence: Synthetic coding sequence
atggccaagcccaccagcaaggacagcggcctgaaggagaagttcaagatcctgctgggcctgggcaccccccggcccaaccccaggtctgctgagggcaagcagacagagttcatcatcacagctgagatcctgcgggagctgtccatggagtgtggcctgaacaaccgcatccgcatgattggccagatctgtgaggtggccaagaccaagaagtttgaggagggggagcggctgggcgtgctgcgggccctcttcttcaaggtgatcaaggactaccccagcaatgaagacctgcacgagcggctggaggtgttcaaggccctgacagacaatggccgccacatcacctacctggaggaggagctggccgactttgtgctgcagtggatggatgtgggcctgagcagcgagttcctgctggtgctggtgaacctggtgaagttcaacagctgctacctggatgagtacatcgccaggatggtgcagatgatctgcctgctgtgtgtgaggacagccagctctgtggacatcgaggtgtccctgcaggtgctggatgctgtggtgtgctacaactgcctgcctgctgagagcctgcccctcttcatcgtgaccctgtgcaggaccatcaacgtgaaggagctgtgtgagccctgctggaagctgatgaggaacctgctgggcacccacctgggccacagcgccatctacaacatgtgccacctgatggaggaccgggcctacatggaggatgcccccctgctgcggggagctgtgttctttgtgggcatggccctgtggggcgcccaccggctgtacagcctgaggaacagccccacctctgtgctgcccagcttctaccaggccatggcctgccccaatgaggtggtgtcctatgaaattgtgctgagcatcaccaggctcatcaagaagtacaggaaggagctgcaggtggtggcctgggacatcctgctgaacatcatcgagcggctgctgcagcagctgcagaccctggacagccctgagctgcggaccatcgtgcatgacctgctgaccaccgtggaggagctgtgtgaccagaatgagttccacggcagccaggagcgctactttgagctggtggagcgctgtgccgaccagaggcctgagagcagcctgctgaacctgatctcctaccgggcccagagcatccacccagccaaggatggctggatccagaacctgcaggccctgatggagcgcttcttccgctctgagagcagaggagctgtgcgcatcaaggtgctggatgtgctgagctttgtgctgctgatcaaccggcagttctatgaggaggagctgatcaacagcgtggtgatcagccagctgagccacatccctgaggacaaggaccaccaggtgaggaagctggccacccagctgctggtggacctggccgagggctgccacacccaccacttcaacagcctgctggacatcatcgagaaggtgatggcccggagcctgagccccccacctgagctggaggagagagatgtggccgcctacagcgccagcctggaggatgtgaagacagctgtgctgggcctgctggtgatcctgcagaccaagctgtacaccctgcctgccagccacgccaccagggtgtatgagatgctggtgagccacatccagctgcactacaagcacagctacaccctgcccatcgccagcagcatccggctgcaggcctttgacttcctgctgctgctgcgggctgacagcctgcaccggctgggcctgcccaacaaggatggagtggtgcgcttcagcccctactgtgtgtgtgactacatggagcctgagcggggcagcgagaagaagaccagcggccccctgagcccccccaccggccccccaggccctgccccagctggccctgctgtgcggctgggctctgtgccctacagcctgctcttccgggtgctgctgcagtgcctgaagcaggagagtgactggaaggtgctgaagctggtgctgggccgcctgcctgagagcctgcgctacaaggtgctgatcttcaccagcccctgcagcgtggaccagctgtgcagcgccctgtgcagcatgctgagcggccccaagaccctggagcggctgcggggggcccctgagggcttcagcaggacagacctgcacctggccgtggtgcctgtgctgacagccctgatctcctaccacaactacctggacaagaccaagcagcgggagatggtgtactgcctggagcagggcctcatccaccgctgtgccagccagtgtgtggtggccctgagcatctgcagcgtggagatgccagacatcatcatcaaggccctgcctgtgctggtggtgaagctgacccacatcagcgccacagcctccatggctgtgcccctgctggagttcctgagcaccctggcccggctgccccacctgtacagaaactttgctgctgagcagtatgcctctgtgtttgccatcagcctgccctacaccaaccccagcaagttcaaccagtacatcgtgtgcctggcccaccacgtgattgccatgtggttcatccgctgccgcctgcccttcaggaaggactttgtgcccttcatcaccaagggcctgcggagcaatgtgctgctgagctttgatgacaccccagagaaggacagcttccgggcccggagcaccagcctgaatgaaagacccaagagccgcatccagaccagcctgaccagcgccagcctgggcagcgcagatgaaaattctgtggcccaggctgatgacagcctgaagaacctgcacctggagctgacagagacctgcctggacatgatggcccgctacgtgttcagcaacttcaccgctgtgcccaagaggagccctgtgggggagttcctgctggccggcggccgcaccaagacctggctggtgggcaacaagctggtgacagtgaccacctctgtgggcaccggcaccaggagcctgctgggcctggacagcggggagctgcagagcggccctgagagcagcagcagccctggggtgcacgtgcggcagaccaaggaggccccagccaagctggagagccaggccggccagcaggtgtccagaggagcccgggacagagtgcgctccatgtctgggggccacggcctgcgggtgggcgccctggatgtgcctgccagccagttcctgggcagcgccaccagccctggccccaggacagccccagctgccaagccagagaaggccagcgctggcaccagggtgcctgtgcaggagaagaccaacctggccgcctacgtgcccctgctgacccagggctgggccgagatcctggtgcggcggcccactggaaacacctcctggctgatgagcctggagaaccccctgagccccttcagcagtgacatcaacaacatgcccctgcaggagctgagcaatgccctgatggctgctgagcgcttcaaggagcaccgggacacagccctgtacaagagcctgtctgtgcctgctgccagcacagccaagcccccacccctgcccaggagcaacacagattctgctgtggtgatggaggagggcagccctggagaggtgcctgtgctggtggagcccccaggcctggaggatgtggaggccgccctgggcatggacagaagaacagatgcctacagccgcagcagctctgtgagcagccaggaggagaagagcctgcacgccgaggagctggtgggccggggcatccccatcgagcgggtggtgagcagcgagggcggccggcccagcgtggacctgtccttccagcccagccagcccctgagcaagagcagcagcagccctgagctgcagaccctgcaggacatcctgggggaccccggggacaaggcagatgtgggccgcctgagccctgaggtgaaggcccggagccagagcggcaccctggatggagagagcgctgcctggagcgccagcggggaggacagccggggccagcctgagggccccctgcccagcagcagccccaggagccccagcggcctgcggccccggggctacaccatcagtgacagcgcccccagcagaagaggcaagagggtggagagagatgccctgaagagccgggccacagccagcaatgctgagaaggtgcccggcatcaaccccagctttgtgttcctgcagctgtaccacagccccttctttggagatgagagcaacaagcccatcctgctgcccaatgaaagccagagctttgagaggtctgtgcagctgctggaccagatccccagctatgacacccacaagattgctgtgctgtatgtgggggagggccagagcaacagcgagctggccatcctgagcaatgaacatggcagctaccgctacacagagttcctgaccggcctgggccgcctgattgagctgaaggactgccagcctgacaaggtgtacctgggcggcctggatgtgtgtggagaagatggccagttcacctactgctggcatgatgacatcatgcaggccgtgttccacatcgccaccctgatgcccaccaaggatgtggacaagcaccgctgtgacaagaagaggcacctgggcaatgactttgtgtccatcgtgtacaatgacagcggggaggacttcaagctgggcaccatcaagggccagttcaactttgtgcacgtgattgtgacccccctggactatgagtgcaacctggtgtccctgcagtgcaggaaggacatggagggcctggtggacacctctgtggccaagatcgtgtctgacaggaacctgccctttgtggcccggcagatggccctgcacgccaacatggccagccaggtgcaccacagccgcagcaaccccacagacatctaccccagcaagtggatcgcccggctgcggcacatcaagaggctgcggcagaggatctgtgaggaggccgcctacagcaaccccagcctgcccctggtgcacccccccagccacagcaaggccccagcccagaccccagctgagcccaccccaggctatgaggtgggccagaggaagaggctcatcagctctgtggaggacttcacagaatttgtgtag

SEQ ID NO: 22330 - DNA, 516 bp, Artificial Sequence
  Description of Artificial Sequence: Synthetic coding sequence
ttcccccgggacctgagcctcatcagccccctggcccaggccgtgcgcagcagcagcaggacccccagcgacaagcctgtggcccacgtggtggccaacccccaggccgagggccagctgcagtggctgaacagaagagccaatgccctgctggccaatggagtggagctgcgggacaaccagctggtggtgcccagcgagggcctgtacctgatctacagccaggtgctcttcaagggccagggctgccccagcacccacgtgctgctgacccacaccatcagcagaattgctgtgtcctaccagaccaaggtgaacctgctgagcgccatcaagagcccctgccagcgggagaccccagagggcgctgaggccaagccctggtatgagcccatctacctgggcggcgtcttccagctggagaagggggaccggctgtctgctgagatcaacagaccagactacctggactttgctgagagcggccaggtgtacttcggcatcatcgccctgtag

SEQ ID NO: 22331 - DNA, 306 bp, Artificial Sequence
  Description of Artificial Sequence: Synthetic coding sequence
atggccatgatggaggtgcagggcggccccagcctgggccagacctgtgtgctgattgtcatcttcaccgtgctgctgcagagcctgtgtgtggccgtgacctacgtgtacttcaccaatgagctgaagcagatgcaggacaagtacagcaagagcggcatcgcctgcttcctgaaggaggatgacagctactgggaccccaatgatgaggagagcatgaacagcccctgctggcaggtgaagtggcagctgcggcagctggtgaggaagacccccaggatgaagaggctgtgggccgccaagtag

SEQ ID NO: 22332 - DNA, 846 bp, Artificial Sequence
  Description of Artificial Sequence: Synthetic coding sequence
atggccatgatggaggtgcagggcggccccagcctgggccagacctgtgtgctgattgtcatcttcaccgtgctgctgcagagcctgtgtgtggccgtgacctacgtgtacttcaccaatgagctgaagcagatgcaggacaagtacagcaagagcggcatcgcctgcttcctgaaggaggatgacagctactgggaccccaatgatgaggagagcatgaacagcccctgctggcaggtgaagtggcagctgcggcagctggtgaggaagatgatcctgcggaccagcgaggagaccatcagcacagtgcaggagaagcagcagaacatcagccccctggtgcgggagcggggcccccagagggtggccgcccacatcaccggcacccggggccgcagcaacaccctgagcagccccaacagcaagaatgagaaggccctgggcaggaagatcaacagctgggagagcagccgcagcggccacagcttcctgagcaacctgcacctgagaaatggagagctggtgattcatgagaagggcttctactacatctacagccagacctacttccgcttccaggaggagatcaaggagaacaccaagaatgacaagcagatggtgcagtacatctacaagtacaccagctacccagaccccatcctgctgatgaagagcgccaggaacagctgctggagcaaggatgctgaatatggcctgtacagcatctaccagggcggcatctttgagctgaaggaaaatgaccgcatctttgtgtctgtgaccaatgagcacctgattgacatggaccacgaggccagcttctttggagccttcctggtgggctag

SEQ ID NO: 22333 - DNA, 858 bp, Artificial Sequence
  Description of Artificial Sequence: Synthetic coding sequence
atggatgacagcacagagcgggagcagagccggctgaccagctgcctgaagaagcgggaggagatgaagctgaaggaatgtgtgtccatcctgcccaggaaggagagccccagcgtgcgcagcagcaaggatggcaagctgctggccgccaccctgctgctggccctgctgagctgctgcctgactgtggtgtccttctaccaggtggccgccctgcagggcgacctggccagcctgcgggcagagctgcagggccaccacgccgagaagctgcctgctggagctggggcccccaaggccggcctggaggaggccccagctgtgacagctggcctgaagatctttgagcccccagcccctggagagggcaacagcagccagaacagcaggaacaagagagctgtgcagggccctgaggagaccgtgacccaggactgcctgcagctgattgctgacagcgagacccccaccatccagaagggcagctacacctttgtgccctggctgctgtccttcaagaggggcagcgccctggaggagaaggagaacaagatcctggtgaaggagaccggctacttcttcatctacggccaggtgctgtacacagacaagacctacgccatgggccacctgatccagaggaagaaggtgcacgtgtttggagatgagctgagcctggtgaccctcttccgctgcatccagaacatgcctgagaccctgcccaacaacagctgctacagcgctggcatcgccaagctggaggagggagatgagctgcagctggccatcccccgggagaatgcccagatcagcctggatggagatgtgaccttctttggagccctgaagctgctgtag

SEQ ID NO: 22334 - DNA, 801 bp, Artificial Sequence
  Description of Artificial Sequence: Synthetic coding sequence
atggatgacagcacagagcgggagcagagccggctgaccagctgcctgaagaagcgggaggagatgaagctgaaggaatgtgtgtccatcctgcccaggaaggagagccccagcgtgcgcagcagcaaggatggcaagctgctggccgccaccctgctgctggccctgctgagctgctgcctgactgtggtgtccttctaccaggtggccgccctgcagggcgacctggccagcctgcgggcagagctgcagggccaccacgccgagaagctgcctgctggagctggggcccccaaggccggcctggaggaggccccagctgtgacagctggcctgaagatctttgagcccccagcccctggagagggcaacagcagccagaacagcaggaacaagagagctgtgcagggccctgaggagaccggcagctacacctttgtgccctggctgctgtccttcaagaggggcagcgccctggaggagaaggagaacaagatcctggtgaaggagaccggctacttcttcatctacggccaggtgctgtacacagacaagacctacgccatgggccacctgatccagaggaagaaggtgcacgtgtttggagatgagctgagcctggtgaccctcttccgctgcatccagaacatgcctgagaccctgcccaacaacagctgctacagcgctggcatcgccaagctggaggagggagatgagctgcagctggccatccccagagaaaatgcccagatcagcctggatggagatgtgaccttcttcggggccctgaagctgctgtag

SEQ ID NO: 22335 - DNA, 495 bp, Artificial Sequence
  Description of Artificial Sequence: Synthetic coding sequence
atggatgacagcacagagcgggagcagagccggctgaccagctgcctgaagaagcgggaggagatgaagctgaaggaatgtgtgtccatcctgcccaggaaggagagccccagcgtgcgcagcagcaaggatggcaagctgctggccgccaccctgctgctggccctgctgagctgctgcctgactgtggtgtccttctaccaggtggccgccctgcagggcgacctggccagcctgcgggcagagctgcagggccaccacgccgagaagctgcctgctggagctggggcccccaaggccggcctggaggaggccccagctgtgacagctggcctgaagatctttgagcccccagcccctggagagggcaacagcagccagaacagcaggaacaagagagctgtgcagggccctgaggagaccgtgacccaggactgcctgcagctgattgctgacagcgagacccccaccatccagaagggcttcatctactag

SEQ ID NO: 22336 - DNA, 2700 bp, Artificial Sequence
  Description of Artificial Sequence: Synthetic coding sequence
atgcccaccctgggctggctgcctgaaaatagagacatcagcgaggaccagagcagcgctgagcagacccaggccctggccagccaggccagccagttcctggccaaggtggagagctttgagcggctcatccaggccggccgcctgatgccccaggaccaggtgaagggcttccagaggctgaaggccgcccacgccgccctggaggaggagtacctgaaggcctgccgggagcagcacccagcccagcccctggccggcagcaagggcaccccaggccgctttgacccccggcgggagctggaggccgagatctaccgcctgggcagctgcctggaggagctgaaggagcacatcgaccagacccagcaggagcctgagcccccaggcagtgacagcgccctggacagcaccccagccctgccctgcctgcaccagcccacccacctgcctgcccccagcggccaggcccccatgcctgccatcaagaccagctgcccagagcccgccaccaccacagctgctgccagcacaggcccctgccccctgcacgtgaatgtggaggtgagcagcggcaacagcgaggtggaggaccggccccaggaccccctggcccggctgcggcacaaggagctgcagatggagcaggtgtaccacggcctgatggagcgctacctgtctgtgaagagcctgcctgaggccatgaggatggaggaggaggaggagggggaggaggaggaggaggaggagggcggcggggacagcctggaggtggatggagtggccgccaccccaggcaaggccgaggccaccagggtgctgccccggcagtgccctgtgcaggccgagaagagccacggggcccccctggaggaggccacagagaagatggtgtccatgaagcccccaggcttccaggccagcctggccagagatggccacatgagcggcctgggcaaggccgaggccgcccctcctggccctggggtgcccccccaccccccaggcaccaagtctgctgccagccaccagagctccatgaccagcctggagggcagcggcatcagcgagcggctgccccagaagcccctgcacagaggaggcggcccccacctggaggagacctggatggccagccctgagacagacagcggctttgtgggcagcgagaccagccgggtgagccccctgacccagaccccagagcaccggctgagccacatcagcacagctggcaccctggcccagccctttgctgcctctgtgcccagagatggagccagctaccccaaggcccggggcagcctcatcccccggcgggccacagagcccagcacccccaggagccaggcccagcgctacctgagcagccccagcggccccctgcggcagagggcccccaacttcagcctggagaggaccctggccgctgagatggctgtgcccggcagcgagtttgagggccacaagaggatcagcgagcagcccctgcccaacaagaccatcagccccccaccagccccagccccagctgctgcccccctgccctgtggccccacagagaccatccccagcttcctgctgaccagggctggccgggaccaggccatctgtgagctgcaggaggaggtgtcccggctgcggctgcggctggaggacagcctgcaccagcccctgcagggcagccccaccaggcctgccagcgcctttgacaggcctgcccggacccggggccggcctgctgacagccctgccacctggggcagccactacggcagcaagagcacagagcggctgcccggggagcccagaggagaggagcagatcgtgcccccaggccggcagagggcccggagcagctctgtgccccgggaggtgctgcggctgagcctgagcagcgagagcgagctgcccagcctgcccctcttcagcgagaagagcaagaccaccaaggacagcccccaggccgccagagatggcaagaggggcgtgggcagcgctggctggccagacagagtgaccttccggggccagtacacaggccacgagtaccacgtgctgagccccaaggctgtgcccaagggaaatggcaccgtgtcctgcccccactgccggcccatccgcacccaggatgctgggggcgctgtgactggagaccccctgggccccccacctgctgacaccctgcagtgccccctgtgtggccaggtgggcagccccccagaggctgatggccctggcagcgccaccagcggggctgagaaggccaccaccaggaggaaggccagcagcacccccagccccaagcagaggagcaagcaggccggcagcagccccaggcctcctcctggcctgtggtacctggccacagcccccccagccccagcccccccagcctttgcctacatcagctctgtgcccatcatgccctaccccccagctgctgtgtactatgccccagctggccccaccagcgcccagcctgctgccaagtggcccccaacagccagccccccaccagcccggcggcaccgccacagcatccagctggacctgggggacctggaggagctgaacaaggccctgagcagagctgtgcaggccgctgagagcgtgcgcagcaccacccggcagatgaggagcagcctgtctgctgacctgcggcaggcccacagcctgcggggcagctgcctcttctag

SEQ ID NO: 22337 - DNA, 1569 bp, Artificial Sequence
  Description of Artificial Sequence: Synthetic coding sequence
atggccctgctgccccgggccctgtctgctggggccggccccagctggaggagagctgcccgggccttccggggcttcctgctgctgctgcctgagcctgctgccctgacccgggccctgagccgggccatggcctgccggcaggagccccagccccagggccccccacctgctgctggagctgtggccagctatgactacctggtgattggaggcggcagcggcggcctggccagcgccaggagagctgctgagctgggcgcccgggctgctgtggtggagagccacaagctgggcggcacctgtgtgaatgtgggctgtgtgcccaagaaggtgatgtggaacacagctgtgcacagcgagttcatgcatgaccatgctgactatggcttccccagctgtgagggcaagttcaactggagggtcatcaaggagaagagagatgcctacgtgtcccggctgaatgccatctaccagaacaacctgaccaagagccacatcgagatcatccggggccacgccgccttcaccagtgaccccaagcccaccatcgaggtgtctgggaagaagtacacagccccccacatcctgattgccaccggcggcatgcccagcacccctcatgagagccagatccctggggccagcctgggcatcaccagtgatggcttcttccagctggaggagctgcccggccgcagcgtcatcgtgggcgccggctacatcgctgtggagatggccggcatcctgagcgccctgggcagcaagaccagcctgatgatcagacatgacaaggtgctgcggagctttgacagcatgatcagcaccaactgcacagaggagctggagaatgccggcgtggaggtgctgaagttcagccaggtgaaggaggtgaagaagaccctgagcggcctggaggtgtccatggtgacagctgtgcccggccgcctgcctgtgatgaccatgatcccagatgtggactgcctgctgtgggccatcggccgggtgcccaacaccaaggacctgagcctgaacaagctgggcatccagacagatgacaagggccacatcatcgtggatgagttccagaacaccaacgtgaagggcatctatgctgtgggagatgtgtgtgggaaggccctgctgacccctgtggccatcgctgctggcaggaagctggcccaccggctgtttgagtacaaggaggacagcaagctggactacaacaacatccccaccgtggtgttcagccacccccccatcggcaccgtgggcctgacagaagatgaggccatccacaagtatggaattgaaaatgtgaagacctacagcaccagcttcacccccatgtaccacgctgtgaccaagaggaagaccaagtgtgtgatgaagatggtgtgtgccaacaaggaggagaaggtggtgggcatccacatgcagggcctgggctgtgatgagatgctgcagggctttgctgtggccgtgaagatgggcgccaccaaggctgactttgacaacacagtggccatccaccccaccagcagcgaggagctggtgaccctgaggtag

SEQ ID NO: 22338 - DNA, 1323 bp, Artificial Sequence
  Description of Artificial Sequence: Synthetic coding sequence
atggagcagaggggccagaatgccccagctgccagcggggccaggaagagacatggccctggcccccgggaggcccggggggcccggcccggcccccgggtgcccaagaccctggtgctggtggtggccgctgtgctgctgctggtgtctgctgagagcgccctgatcacccagcaggacctggccccccagcagagagctgccccccagcagaagaggagcagccccagcgagggcctgtgccccccaggccaccacatcagtgaagatggccgggactgcatcagctgcaagtatggccaggactacagcacccactggaatgacctgctcttctgcctgcgctgcacccgctgtgacagcggggaggtggagctgagcccctgcaccaccaccaggaacacagtgtgccagtgtgaggagggcaccttccgggaggaggacagccctgagatgtgcaggaaatgtagaacaggctgcccccggggcatggtgaaggtgggggactgcaccccctggagcgacattgaatgtgtgcacaaggagagcggcaccaagcacagcggggaggtgcctgctgtggaggagaccgtgaccagcagccctggcaccccagccagcccctgcagcctgagcggcatcatcatcggcgtgacagtggccgctgtggtgctgattgtggccgtgtttgtgtgcaagagcctgctgtggaagaaggtgctgccctacctgaagggcatctgcagcggcggcggcggggaccctgagcgggtggacaggagcagccagaggcctggagctgaggacaacgtgctgaatgaaattgtgtccatcctgcagcccacccaggtgcctgagcaggagatggaggtgcaggagcctgctgagcccaccggggtgaacatgctgagccctggagagagcgagcacctgctggagcctgctgaggccgagaggagccagaggcggcggctgctggtgcctgccaatgaaggagaccccacagagaccctgcggcagtgctttgatgactttgctgacctggtgccctttgacagctgggagcccctgatgaggaagctgggcctgatggacaatgagatcaaggtggccaaggccgaggccgccggccaccgggacaccctgtacaccatgctgatcaagtgggtgaacaagacaggaagagatgcctctgtgcacaccctgctggatgccctggagaccctgggggagcggctggccaagcagaagattgaggaccacctgctgagcagcggcaagttcatgtacctggagggcaatgctgacagcgccatgtcctag

SEQ ID NO: 22339 - DNA, 1236 bp, Artificial Sequence
  Description of Artificial Sequence: Synthetic coding sequence
atggagcagaggggccagaatgccccagctgccagcggggccaggaagagacatggccctggcccccgggaggcccggggggcccggcccggcccccgggtgcccaagaccctggtgctggtggtggccgctgtgctgctgctggtgtctgctgagagcgccctgatcacccagcaggacctggccccccagcagagagctgccccccagcagaagaggagcagccccagcgagggcctgtgccccccaggccaccacatcagtgaagatggccgggactgcatcagctgcaagtatggccaggactacagcacccactggaatgacctgctcttctgcctgcgctgcacccgctgtgacagcggggaggtggagctgagcccctgcaccaccaccaggaacacagtgtgccagtgtgaggagggcaccttccgggaggaggacagccctgagatgtgcaggaaatgtagaacaggctgcccccggggcatggtgaaggtgggggactgcaccccctggagcgacattgaatgtgtgcacaaggagagcggcatcatcattggagtgacagtggccgctgtggtgctgattgtggccgtgtttgtgtgcaagagcctgctgtggaagaaggtgctgccctacctgaagggcatctgcagcggcggcggcggggaccctgagcgggtggacaggagcagccagaggcctggagcagaagataatgtgctgaatgagatcgtgtccatcctgcagcccacccaggtgcctgagcaggagatggaggtgcaggagcctgctgagcccactggagtgaacatgctgagccctggagagagcgagcacctgctggagcctgctgaggccgagaggagccagaggcggcggctgctggtgcctgccaatgaaggagaccccacagagaccctgcggcagtgctttgatgactttgctgacctggtgccctttgacagctgggagcccctgatgaggaagctgggcctgatggacaatgagatcaaggtggccaaggccgaggccgccggccaccgggacaccctgtacaccatgctgatcaagtgggtgaacaagacaggaagagatgcctctgtgcacaccctgctggatgccctggagaccctgggggagcggctggccaagcagaagattgaggaccacctgctgagcagcggcaagttcatgtacctggagggcaatgctgacagcgccatgtcctag

SEQ ID NO: 22340 - DNA, 783 bp, Artificial Sequence
  Description of Artificial Sequence: Synthetic coding sequence
atgtgcaggaagtgcaggacaggctgcccccggggcatggtgaaggtgggggactgcaccccctggagcgacattgaatgtgtgcacaaggagagcggcatcatcatcggcgtgacagtggccgctgtggtgctgattgtggccgtgtttgtgtgcaagagcctgctgtggaagaaggtgctgccctacctgaagggcatctgcagcggcggcggcggggaccctgagcgggtggacaggagcagccagaggcctggagctgaggacaacgtgctgaatgaaattgtgtccatcctgcagcccacccaggtgcctgagcaggagatggaggtgcaggagcctgctgagcccaccggggtgaacatgctgagccctggagagagcgagcacctgctggagcctgctgaggccgagaggagccagaggcggcggctgctggtgcctgccaatgaaggagaccccacagagaccctgcggcagtgctttgatgactttgctgacctggtgccctttgacagctgggagcccctgatgaggaagctgggcctgatggacaatgagatcaaggtggccaaggccgaggccgccggccaccgggacaccctgtacaccatgctgatcaagtgggtgaacaagacaggaagagatgcctctgtgcacaccctgctggatgccctggagaccctgggggagcggctggccaagcagaagattgaggaccacctgctgagcagcggcaagttcatgtacctggagggcaatgctgacagcgccatgtcctag

SEQ ID NO: 22341 - DNA, 1161 bp, Artificial Sequence
  Description of Artificial Sequence: Synthetic coding sequence
atgggcctgtggggccagagcgtgcccacagccagcagcgcccgggccggccgctacccaggggccaggacagccagcggcacccggccctggctgctggaccccaagatcctgaagtttgtggtgttcatcgtggccgtgctgctgcctgtgcgggtggacagcgccaccatcccccggcaggatgaggtgccccagcagacagtggccccccagcagcagaggaggagcctgaaggaggaggagtgcccagctggcagccacaggtctgagtacacaggagcctgcaacccctgcacagagggcgtggactacaccatcgccagcaacaacctgcccagctgcctgctgtgcaccgtgtgcaagagcggccagaccaacaagagcagctgcaccaccacccgggacacagtgtgccagtgtgagaagggcagcttccaggacaagaacagccctgagatgtgcaggacctgcaggacaggctgcccccggggcatggtgaaggtgagcaactgcacccccaggagtgacatcaagtgcaagaatgaatctgctgccagcagcacaggcaagaccccagctgctgaggagaccgtgaccaccatcctgggcatgctggccagcccctaccactacctgatcatcatcgtggtgctggtgatcatcctggccgtggtggtggtgggcttcagctgcaggaagaagttcatctcctacctgaagggcatctgcagcggcggcggcggcggccctgagcgggtgcaccgggtgctcttcagaagaagaagctgccccagccgggtgcctggagctgaggacaatgccagaaatgagaccctgagcaaccgctacctgcagcccacccaggtgtctgagcaggagatccagggccaggagctggccgagctgactggagtgacagtggagctgcctgaggagccccagaggctgctggagcaggccgaggccgagggctgccagaggcggcggctgctggtgcctgtgaatgatgctgacagcgctgacatcagcaccctgctggatgccagcgccaccctggaggagggccacgccaaggagaccatccaggaccagctggtgggcagcgagaagctgttctatgaggaggatgaagctggcagcgccaccagctgcctgtag

SEQ ID NO: 22342 - DNA, 1368 bp, Artificial Sequence
  Description of Artificial Sequence: Synthetic coding sequence
atgggcctgagcacagtgcctgacctgctgctgcccctggtgctgctggagctgctggtgggcatctaccccagcggggtcatcggcctggtgccccacctgggggaccgggagaagagggacagcgtgtgcccccagggcaagtacatccacccccagaacaacagcatctgctgcaccaagtgccacaagggcacctacctgtacaatgactgccccggccctggccaggacacagactgcagagaatgtgagagcggcagcttcaccgccagcgagaaccacctgcggcactgcctgagctgcagcaagtgcaggaaggagatgggccaggtggagatcagcagctgcaccgtggaccgggacacagtgtgtggctgcaggaagaaccagtaccgccactactggagcgagaacctcttccagtgcttcaactgcagcctgtgcctgaatggaacagtgcacctgagctgccaggagaagcagaacacagtgtgcacctgccacgccggcttcttcctgcgggagaatgaatgtgtgtcctgcagcaactgcaagaagagcctggagtgcaccaagctgtgcctgccccagattgaaaatgtgaagggcacagaggacagcggcaccaccgtgctgctgcccctggtgatcttcttcggcctgtgcctgctgagcctgctcttcatcggcctgatgtaccgctaccagcgctggaagagcaagctgtacagcatcgtgtgtgggaagagcaccccagagaaggagggggagctggagggcaccaccaccaagcccctggcccccaaccccagcttcagccccaccccaggcttcacccccaccctgggcttcagccctgtgcccagcagcaccttcaccagcagcagcacctacacccctggggactgccccaactttgctgccccccggcgggaggtggccccaccctaccagggcgctgaccccatcctggccacagccctggccagtgaccccatccccaaccccctgcagaagtgggaggacagcgcccacaagccccagagcctggacacagatgatcctgccaccctgtatgctgtggtggagaatgtgccccccctgcgctggaaggagtttgtgcggcggctgggcctgagtgaccatgaaattgaccggctggagctgcagaatggccgctgcctgcgggaggcccagtacagcatgctggccacctggaggaggaggaccccaagaagagaggccaccctggagctgctgggccgggtgctgcgggacatggacctgctgggctgcctggaggacatcgaggaggccctgtgtggccctgctgccctgcccccagcccccagcctgctgaggtag

SEQ ID NO: 22343 - DNA, 657 bp, Artificial Sequence
  Description of Artificial Sequence: Synthetic coding sequence
atgggcctgagcacagtgcctgacctgctgctgcccctggtgctgctggagctgctggtgggcatctaccccagcggggtcatcggcctggtgccccacctgggggaccgggagaagagggacagcgtgtgcccccagggcaagtacatccacccccagaacaacagcatctgctgcaccaagtgccacaagggcacctacctgtacaatgactgccccggccctggccaggacacagactgcagagaatgtgagagcggcagcttcaccgccagcgagaaccacctgcggcactgcctgagctgcagcaagtgcaggaaggagatgggccaggtggagatcagcagctgcaccgtggaccgggacacagtgtgtggctgcaggaagaaccagtaccgccactactggagcgagaacctcttccagtgcttcaactgcagcctgtgcctgaatggaacagtgcacctgagctgccaggagaagcagaacacagtgtgcacctgccacgccggcttcttcctgcgggagaatgaatgtgtgtcctgcagcaaggtgctgctgtgccggcccggctggaatgctgtggcccggagccggctgacagccaccagcgccagccagatccaggccatcctgctgctgcagccccccaagtag

SEQ ID NO: 22344 - DNA, 1386 bp, Artificial Sequence
  Description of Artificial Sequence: Synthetic coding sequence
atggcccctgtggccgtgtgggccgccctggccgtgggcctggagctgtgggccgccgcccacgccctgcctgcccaggtggccttcaccccctatgcccctgagcccggcagcacctgccgcctgcgggagtactatgaccagacagcccagatgtgctgcagcaagtgcagccctggccagcacgccaaggtgttctgcaccaagaccagtgacacagtgtgtgacagctgtgaggacagcacctacacccagctgtggaactgggtgcctgagtgcctgagctgtggcagccgctgcagcagtgaccaggtggagacccaggcctgcacccgggagcagaaccgcatctgcacctgccggcccggctggtactgtgccctgagcaagcaggagggctgccgcctgtgtgcccccctgaggaagtgcaggcctggctttggagtggcccggcccggcacagagaccagtgatgtggtgtgcaagccctgtgcccctggcaccttcagcaacaccaccagcagcacagacatctgccggccccaccagatctgcaatgtggtggccatccctggaaatgcctccatggatgctgtgtgcaccagcaccagccccaccaggtccatggcccctggagctgtgcacctgccccagcctgtgtccaccaggagccagcacacccagcccaccccagagcccagcacagcccccagcaccagcttcctgctgcccatgggccccagccccccagctgagggcagcactggagactttgccctgcctgtgggcctgattgtgggcgtgacagccctgggcctgctgatcatcggcgtggtgaactgtgtgatcatgacccaggtgaagaagaagcccctgtgcctgcagcgggaggccaaggtgccccacctgcctgctgacaaggcccggggcacccagggccctgagcagcagcacctgctgatcacagcccccagcagcagcagcagcagcctggagagcagcgccagcgccctggaccggcgggcccccaccaggaaccagccccaggcccctggggtggaggccagcggggccggggaggcccgggccagcacaggcagcagtgacagcagccctgggggccacggcacccaggtgaatgtgacctgcatcgtgaatgtgtgcagcagcagtgaccacagcagccagtgcagcagccaggccagcagcaccatgggagacacagacagcagccccagcgagagccccaaggatgagcaggtgcccttcagcaaggaggagtgtgccttccgcagccagctggagaccccagagaccctgctgggcagcacagaggagaagcccctgcccctgggcgtgcctgatgctggcatgaagcccagctag

SEQ ID NO: 22345 - DNA, 807 bp, Artificial Sequence
  Description of Artificial Sequence: Synthetic coding sequence
atggcccctgtggccgtgtgggccgccctggccgtgggcctggagctgtgggccgccgcccacgccctgcctgcccaggtggccttcaccccctatgcccctgagcccggcagcacctgccgcctgcgggagtactatgaccagacagcccagatgtgctgcagcaagtgcagccctggccagcacgccaaggtgttctgcaccaagaccagtgacacagtgtgtgacagctgtgaggacagcacctacacccagctgtggaactgggtgcctgagtgcctgagctgtggcagccgctgcagcagtgaccaggtggagacccaggcctgcacccgggagcagaaccgcatctgcacctgccggcccggctggtactgtgccctgagcaagcaggagggctgccgcctgtgtgcccccctgaggaagtgcaggcctggctttggagtggcccggcccggcacagagaccagtgatgtggtgtgcaagccctgtgcccctggcaccttcagcaacaccaccagcagcacagacatctgccggccccaccagatctgcaatgtggtggccatccctggaaatgcctccatggatgctgtgtgcaccagcaccagccccaccaggtccatggcccctggagctgtgcacctgccccagcctgtgtccaccaggagccagcacacccagcccaccccagagcccagcacagcccccagcaccagcttcctgctgcccatgggccccagccccccagctgagggcagcactggagactttgccctgcctgtggtgtccctgagcagcagctag

SEQ ID NO: 22346 - DNA, 468 bp, Artificial Sequence
  Description of Artificial Sequence: Synthetic coding sequence
atggcccctgtggccgtgtgggccgccctggccgtgggcctggagctgtgggccgccgcccacgccctgcctgcccaggtggccttcaccccctatgcccctgagcccggcagcacctgccgcctgcgggagtactatgaccagacagcccagatgtgctgcagcaagtgcagccctggccagcacgccaaggtgttctgcaccaagaccagtgacacagtgtgtgacagctgtgaggacagcacctacacccagctgtggaactgggtgcctgagtgcctgagctgtggcagccgctgcagcagtgaccaggtggagacccaggcctgcacccgggagcagaaccgcatctgcacctgccggcccggctggtactgtgccctgagcaagcaggagggctgccgcctgtgtgcccccctgaggaagtgcaggcctggctttggagtggcccggccagacctgtcctag

SEQ ID NO: 22347 - DNA, 114 bp, Artificial Sequence
  Description of Artificial Sequence: Synthetic coding sequence
atggcccctgtggccgtgtgggccgccctggccgtgggcctggagctgtgggccgccgcccacgccctgcctgcccaggtggaccccggccccctcttcccccaccctggatag

SEQ ID NO: 22348 - DNA, 1968 bp, Artificial Sequence
  Description of Artificial Sequence: Synthetic coding sequence
atgggcaccagccccagcagcagcacagccctggccagctgcagcagaattgcccggcgggccacagccaccatgattgctggcagcctgctgctgctgggcttcctgagcaccaccacagcccagcctgagcagaaggccagcaacctgattggcacctaccgccacgtggaccgggccaccggccaggtgctgacctgtgacaagtgcccagctggcacctacgtgtctgagcactgcaccaacaccagcctgcgggtgtgcagcagctgccctgtgggcaccttcaccaggcatgaaaatggaattgaaaaatgtcatgactgcagccagccctgcccctggcccatgattgagaagctgccctgtgccgccctgacagaccgggagtgcacctgccccccaggcatgttccagagcaatgccacctgtgccccccacacagtgtgccctgtgggctggggcgtgaggaagaagggcacagaaacagaagatgtgcgctgcaagcagtgtgcccggggcaccttcagtgatgtgcccagctctgtgatgaagtgcaaggcctacacagactgcctgagccagaacctggtggtgatcaagccaggcaccaaggagacagacaacgtgtgtggcaccctgcccagcttcagcagcagcaccagccccagccctggaacagccatcttccccaggcctgagcacatggagacccatgaggtgcccagcagcacctacgtgcccaagggcatgaacagcacagagagcaacagcagcgcctctgtgcggcccaaggtgctgagcagcatccaggagggcaccgtgcctgacaacaccagcagcgcccggggcaaggaggatgtgaacaagaccctgcccaacctgcaggtggtgaaccaccagcagggcccccaccaccgccacatcctgaagctgctgcccagcatggaggccactggaggagagaagagcagcacccccatcaagggccccaagaggggccacccccggcagaacctgcacaagcactttgacatcaatgagcacctgccctggatgattgtgctcttcctgctgctggtgctggtggtgattgtggtgtgcagcatcaggaagagcagcaggaccctgaagaagggcccccggcaggaccccagcgccatcgtggagaaggccggcctgaagaagtccatgacccccacccagaaccgggagaagtggatctactactgcaatggccacggcatcgacatcctgaagctggtggccgcccaggtgggcagccagtggaaggacatctaccagttcctgtgcaatgccagcgagcgggaggtggccgccttcagcaatggctacacagctgaccacgagcgggcctatgctgccctgcagcactggaccatccggggccctgaggccagcctggcccagctgatcagcgccctgcggcagcacagaagaaatgatgtggtggagaagatccggggcctgatggaggacaccacccagctggagacagacaagctggccctgcccatgagccccagccccctgagccccagccccatccccagccccaatgccaagctggagaacagcgccctgctgactgtggagcccagcccccaggacaagaacaagggcttctttgtggatgagagcgagcccctgctgcgctgtgacagcaccagcagcggcagcagcgccctgagcagaaatggcagcttcatcaccaaggagaagaaggacacagtgctgcggcaggtgcggctggacccctgtgacctgcagcccatctttgatgacatgctgcacttcctgaaccctgaggagctgcgggtgattgaggagatcccccaggccgaggacaagctggaccggctgtttgagatcatcggcgtgaagagccaggaggccagccagaccctgctggacagcgtgtacagccacctgcctgacctgctgtag

SEQ ID NO: 22349 - DNA, 1035 bp, Artificial Sequence
  Description of Artificial Sequence: Synthetic coding sequence
agctgctgccggccctggaggcccctgggcgcccggagccctgcccggcccagccggcccaagaggggccacccccggcagaacctgcacaagcactttgacatcaatgagcacctgccctggatgattgtgctcttcctgctgctggtgctggtggtgattgtggtgtgcagcatcaggaagagcagcaggaccctgaagaagggcccccggcaggaccccagcgccatcgtggagaaggccggcctgaagaagtccatgacccccacccagaaccgggagaagtggatctactactgcaatggacatggaattgacatcctgaagctggtggccgcccaggtgggcagccagtggaaggacatctaccagttcctgtgcaatgccagcgagcgggaggtggccgccttcagcaatggctacacagctgaccacgagcgggcctatgctgccctgcagcactggaccatccggggccctgaggccagcctggcccagctgatcagcgccctgcggcagcacagaagaaatgatgtggtggagaagatccggggcctgatggaggacaccacccagctggagacagacaagctggccctgcccatgagccccagccccctgagccccagccccatccccagccccaatgccaagctggagaacagcgccctgctgactgtggagcccagcccccaggacaagaacaagggcttctttgtggatgaaagtgagcccctgctgcgctgtgacagcaccagcagcggcagcagcgccctgagcagaaatggcagcttcatcaccaaggagaagaaggacacagtgctgcggcaggtgcggctggacccctgtgacctgcagcccatctttgatgacatgctgcacttcctgaaccctgaggagctgcgggtcatcgaggagatcccccaggccgaggacaagctggaccggctgtttgagatcattggagtgaagagccaggaggccagccagaccctgctggacagcgtgtacagccacctgcctgacctgctgtag

SEQ ID NO: 22350 - DNA, 1119 bp, Artificial Sequence
  Description of Artificial Sequence: Synthetic coding sequence
atggagcagaggccccggggctgtgccgctgtggccgccgccctgctgctggtgctgctgggcgcccgggcccagggcggcaccaggagcccccgctgtgactgtgccggggacttccacaagaagattggcctcttctgctgccggggctgcccagctgccagccaggtggccctggagaactgcagcgctgtggccgacacccgctgtggctgcaagccaggctggtttgtggagtgccaggtgtcccagtgtgtgagcagcagccccttctactgccagccctgcctggactgtggggccctgcaccgccacacccggctgctgtgcagccggcgggacacagactgtggcacctgcctgcccggcttctatgaacatggagatggctgtgtgtcctgccccaccagcaccctgggcagctgcccagagcgctgtgccgctgtgtgtggctggaggcagatgttctgggtgcaggtgctgctggccggcctggtggtgcccctgctgctgggcgccaccctgacctacacctaccgccactgctggccccacaagcccctggtgacagcagatgaggccggcatggaggccctgaccccacctccagccacccacctgagccccctggacagcgcccacaccctgctggcccccccagacagcagcgagaagatctgcaccgtgcagctggtgggcaacagctggaccccaggctacccagagacccaggaggccctgtgcccccaggtgacctggagctgggaccagctgcccagccgggccctgggccctgctgctgcccccaccctgagccctgagagccctgctggcagccctgccatgatgctgcagcccggcccccagctgtatgatgtgatggatgctgtgcctgcccggcgctggaaggagtttgtgaggaccctgggcctgcgggaggccgagattgaggccgtggaggtggagatcggccgcttccgggaccagcagtatgagatgctgaagcgctggaggcagcagcagcctgctggcctgggcgctgtgtatgctgccctggagaggatgggcctggatggctgtgtggaggacctgcggagccggctgcagaggggcccctag

SEQ ID NO: 22351 - DNA, 705 bp, Artificial Sequence
  Description of Artificial Sequence: Synthetic coding sequence
atggagcagaggccccggggctgtgccgctgtggccgccgccctgctgctggtgctgctgggcgcccgggcccagggcggcaccaggagcccccgctgtgactgtgccggggacttccacaagaagattggcctcttctgctgccggggctgcccagcagatgaggccggcatggaggccctgaccccacctccagccacccacctgagccccctggacagcgcccacaccctgctggcccccccagacagcagcgagaagatctgcaccgtgcagctggtgggcaacagctggaccccaggctacccagagacccaggaggccctgtgcccccaggtgacctggagctgggaccagctgcccagccgggccctgggccctgctgctgcccccaccctgagccctgagagccctgctggcagccctgccatgatgctgcagcccggcccccagctgtatgatgtgatggatgctgtgcctgcccggcgctggaaggagtttgtgaggaccctgggcctgcgggaggccgagattgaggccgtggaggtggagatcggccgcttccgggaccagcagtatgagatgctgaagcgctggaggcagcagcagcctgctggcctgggcgctgtgtatgctgccctggagaggatgggcctggatggctgtgtggaggacctgcggagccggctgcagaggggcccctag

SEQ ID NO: 22352 - DNA, 1143 bp, Artificial Sequence
  Description of Artificial Sequence: Synthetic coding sequence
atggagcagaggccccggggctgtgccgctgtggccgccgccctgctgctggtgctgctgggcgcccgggcccagggcggcaccaggagcccccgctgtgactgtgccggggacttccacaagaagattggcctcttctgctgccggggctgcccagctggccactacctgaaggccccctgcacagagccctgtggcaacagcacctgcctggtgtgcccccaggacaccttcctggcctgggagaaccaccacaacagtgaatgtgcccgctgccaggcctgtgatgagcaggccagccaggtggccctggagaactgcagcgctgtggccgacacccgctgtggctgcaagccaggctggtttgtggagtgccaggtgtcccagtgtgtgagcagcagccccttctactgccagccctgcctggactgtggggccctgcaccgccacacccggctgctgtgcagcagaagagacacagactgtggcacctgcctgcccggcttctatgagcacggagatggctgtgtgtcctgccccaccagcaccctgggcagctgcccagagcgctgtgccgctgtgtgtggctggaggcagaatgaggccggcatggaggccctgaccccacctccagccacccacctgagccccctggacagcgcccacaccctgctggcccccccagacagcagcgagaagatctgcaccgtgcagctggtgggcaacagctggaccccaggctacccagagacccaggaggccctgtgcccccaggtgacctggagctgggaccagctgcccagccgggccctgggccctgctgctgcccccaccctgagccctgagagccctgctggcagccctgccatgatgctgcagcccggcccccagctgtatgatgtgatggatgctgtgcctgcccggcgctggaaggagtttgtgaggaccctgggcctgcgggaggccgagattgaggccgtggaggtggagatcggccgcttccgggaccagcagtatgagatgctgaagcgctggaggcagcagcagcctgctggcctgggcgctgtgtatgctgccctggagaggatgggcctggatggctgtgtggaggacctgcggagccggctgcagaggggcccctag

SEQ ID NO: 22353 - DNA, 1254 bp, Artificial Sequence
  Description of Artificial Sequence: Synthetic coding sequence
atggagcagaggccccggggctgtgccgctgtggccgccgccctgctgctggtgctgctgggcgcccgggcccagggcggcaccaggagcccccgctgtgactgtgccggggacttccacaagaagattggcctcttctgctgccggggctgcccagctggccactacctgaaggccccctgcacagagccctgtggcaacagcacctgcctggtgtgcccccaggacaccttcctggcctgggagaaccaccacaacagtgaatgtgcccgctgccaggcctgtgatgagcaggccagccaggtggccctggagaactgcagcgctgtggccgacacccgctgtggctgcaagccaggctggtttgtggagtgccaggtgtcccagtgtgtgagcagcagccccttctactgccagccctgcctggactgtggggccctgcaccgccacacccggctgctgtgcagcagaagagacacagactgtggcacctgcctgcccggcttctatgagcacggagatggctgtgtgtcctgccccaccagcaccctgggcagctgcccagagcgctgtgccgctgtgtgtggctggaggcagatgttctgggtgcaggtgctgctggccggcctggtggtgcccctgctgctgggcgccaccctgacctacacctaccgccactgctggccccacaagcccctggtgacagcagatgaagctggcatggaggccctgaccccacctccagccacccacctgagccccctggacagcgcccacaccctgctggcccccccagacagcagcgagaagatctgcaccgtgcagctggtgggcaacagctggaccccaggctacccagagacccaggaggccctgtgcccccaggtgacctggagctgggaccagctgcccagccgggccctgggccctgctgctgcccccaccctgagccctgagagccctgctggcagccctgccatgatgctgcagcccggcccccagctgtatgatgtgatggatgctgtgcctgcccggcgctggaaggagtttgtgaggaccctgggcctgcgggaggccgagattgaagctgtggaggtggagatcggccgcttccgggaccagcagtatgagatgctgaagcgctggaggcagcagcagcctgctggcctgggcgctgtgtatgctgccctggagaggatgggcctggatggctgtgtggaggacctgcggagccggctgcagaggggcccctag

SEQ ID NO: 22354 - DNA, 1281 bp, Artificial Sequence
  Description of Artificial Sequence: Synthetic coding sequence
atggagcagaggccccggggctgtgccgctgtggccgccgccctgctgctggtgctgctgggcgcccgggcccagggcggcaccaggagcccccgctgtgactgtgccggggacttccacaagaagattggcctcttctgctgccggggctgcccagctggccactacctgaaggccccctgcacagagccctgtggcaacagcacctgcctggtgtgcccccaggacaccttcctggcctgggagaaccaccacaacagtgaatgtgcccgctgccaggcctgtgatgagcaggccagccaggtggccctggagaactgcagcgctgtggccgacacccgctgtggctgcaagccaggctggtttgtggagtgccaggtgtcccagtgtgtgagcagcagccccttctactgccagccctgcctggactgtggggccctgcaccgccacacccggctgctgtgcagcagaagagacacagactgtggcacctgcctgcccggcttctatgagcacggagatggctgtgtgtcctgccccaccccaccacccagcctggccggggccccctggggcgctgtgcagagcgctgtgcccctgtctgtggccggcggccgggtgggcgtcttctgggtgcaggtgctgctggccggcctggtggtgcccctgctgctgggcgccaccctgacctacacctaccgccactgctggccccacaagcccctggtgacagcagatgaggccggcatggaggccctgaccccacctccagccacccacctgagccccctggacagcgcccacaccctgctggcccccccagacagcagcgagaagatctgcaccgtgcagctggtgggcaacagctggaccccaggctacccagagacccaggaggccctgtgcccccaggtgacctggagctgggaccagctgcccagccgggccctgggccctgctgctgcccccaccctgagccctgagagccctgctggcagccctgccatgatgctgcagcccggcccccagctgtatgatgtgatggatgctgtgcctgcccggcgctggaaggagtttgtgaggaccctgggcctgcgggaggccgagattgaggccgtggaggtggagatcggccgcttccgggaccagcagtatgagatgctgaagcgctggaggcagcagcagcctgctggcctgggcgctgtgtatgctgccctggagaggatgggcctggatggctgtgtggaggacctgcggagccggctgcagaggggcccctag

SEQ ID NO: 22355 - DNA, 768 bp, Artificial Sequence
  Description of Artificial Sequence: Synthetic coding sequence
atgggcaacagctgctacaacatcgtggccaccctgctgctggtgctgaactttgagaggaccaggagcctgcaggacccctgcagcaactgcccagctggcaccttctgtgacaacaacagaaaccagatctgcagcccctgcccccccaacagcttcagcagcgctgggggccagaggacctgtgacatctgccggcagtgcaagggcgtcttccgcaccaggaaagaatgtagcagcaccagcaatgcagaatgtgactgcaccccaggcttccactgcctgggcgccggctgcagcatgtgtgagcaggactgcaagcagggccaggagctgaccaagaagggctgcaaggactgctgcttcggcaccttcaatgaccagaagaggggcatctgccggccctggaccaactgcagcctggatggcaagtctgtgctggtgaatggcaccaaggagagagatgtggtgtgtggccccagccctgctgacctgagccctggggccagctctgtgaccccaccagccccagcccgggagcccggccacagcccccagatcatctccttcttcctggccctgaccagcacagccctgctcttcctgctcttcttcctgaccctgcgcttctctgtggtgaagaggggcaggaagaagctgctgtacatcttcaagcagcccttcatgaggcctgtgcagaccacccaggaggaggatggctgcagctgccgcttccctgaggaggaggagggcggctgtgagctgtag

SEQ ID NO: 22356 - DNA, 5919 bp, Artificial Sequence
  Description of Artificial Sequence: Synthetic coding sequence
atggaccccaccggcagccagctggacagcgacttcagccagcaggacaccccctgcctgatcatcgaggacagccagcctgagagccaggtgctggaggatgacagcggcagccacttctccatgctgagccgccacctgcccaacctgcagacccacaaggaaaatcctgtgctggatgtggtgagcaaccctgagcagacagctggggaggagagaggagatggcaacagcggcttcaatgagcacctgaaggagaacaaggtggccgaccctgtggacagcagcaacctggacacctgtggcagcatcagccaggtgattgagcagctgccccagcccaacagaaccagctctgtgctgggcatgtctgtggagagcgccccagctgtggaggaggagaagggggaggagctggagcagaaggagaaggagaaggaggaggacaccagcggcaacaccacccacagcctgggcgctgaggacacagccagcagccagctgggcttcggcgtgctggagctgagccagagccaggatgtggaggagaacacagtgccctatgaggtggacaaggagcagctgcagagcgtgaccaccaacagcggctacacccggctgagtgatgtggatgccaacacagccatcaagcatgaggagcagagcaatgaagacatccccatcgccgagcagagcagcaaggacatccctgtgacagcccagcccagcaaggatgtgcacgtggtgaaggagcagaaccccccaccagcccggtctgaggacatgcccttcagccccaaggcctctgtggccgccatggaggccaaggagcagctgagcgcccaggagctgatggagagcggcctgcagatccagaagagccctgagcctgaggtgctgagcacccaggaggacctgtttgaccagagcaacaagacagtgtccagtgatggctgcagcacccccagccgggaggagggcggctgcagcctggccagcaccccagccaccaccctgcacctgctgcagctgagcggccagaggagcctggtgcaggacagcctgagcaccaacagcagtgacctggtggcccccagcccagatgccttccgcagcacccccttcatcgtgcccagcagccccacagagcaggagggccggcaggacaagcccatggacacctctgtgctgtctgaggagggcggggagcccttccagaagaagctgcagagcggggagcctgtggagctggagaacccccccctgctgcctgagagcacagtgagcccccaggccagcacccccatcagccagagcacccctgtgttccccccaggcagcctgcccatccccagccagccccagttcagccatgacatcttcatccccagccccagcctggaggagcagagcaatgatggcaagaaggatggagacatgcacagcagcagcctgactgtggagtgcagcaagaccagcgagattgagcccaagaacagccctgaggacctgggcctgagcctgactggagacagctgcaagctgatgctgagcaccagcgagtacagccagagccccaagatggagagcctgagcagccacagaattgatgaagatggagagaacacccagatcgaggacacagagcccatgagccctgtgctgaacagcaagtttgtgcctgcagaaaatgacagcatcctgatgaacccagcccaggatggagaggtgcagctgagccagaatgatgacaagaccaagggagatgacacagacaccagagatgacatcagcatcctggccaccggctgcaagggccgggaggagaccgtggctgaagatgtgtgcatcgacctgacctgtgacagcggcagccaggccgtgcccagccctgccaccaggtctgaggccctgagctctgtgctggaccaggaggaggccatggagatcaaggagcaccaccctgaggagggcagcagcggcagcgaggtggaggagatccctgagaccccctgtgagagccagggcgaggagctgaaggaggagaacatggagagcgtgcccctgcacctgagcctgacagagacccagagccagggcctgtgcctgcagaaggagatgcccaagaaggaatgttctgaggccatggaggtggagaccagcgtcatcagcattgacagcccccagaagctggccatcctggaccaggagctggagcacaaggagcaggaggcctgggaggaggccaccagcgaggacagctctgtggtgattgtggatgtgaaggagcccagcccccgggtggatgtgtcctgtgagcccctggagggcgtggagaagtgcagcgacagccagagctgggaggacatcgcccctgagattgagccctgtgctgaaaatcggctggacaccaaggaggagaagtctgtggagtatgaaggagacctgaagagcggcacagctgagacagagcctgtggagcaggacagcagccagcccagcctgcccctggtgcgggcagatgaccccctgcggctggaccaggagctgcagcagccccagacccaggagaagaccagcaacagcctgacagaggacagcaagatggccaatgccaagcagctgagcagtgatgctgaggcccagaagctgggcaagcccagcgcccacgccagccagagcttctgtgagagcagcagcgagacccccttccacttcaccctgcccaaggagggggacatcatcccccccctgactggagccaccccacccctcatcggccacctgaagctggagcccaagaggcacagcacccccatcggcatcagcaactacccagagagcaccatcgccaccagtgatgtgatgtctgagagcatggtggagacccatgaccccatcctgggcagcggcaagggggacagcggggccgccccagatgtggatgacaagctgtgcctgaggatgaagctggtgtccccagagacagaggccagcgaggagagcctgcagttcaacctggagaagccagccaccggggagaggaagaatggcagcacagctgtggccgagagcgtggccagcccccagaagaccatgtctgtgctgagctgcatctgtgaggcccggcaggagaatgaggcccggagtgaagatcctcccaccacccccatccggggcaacctgctgcacttccccagcagccagggcgaggaggagaaggagaagctggagggggaccacaccatccggcagagccagcagcccatgaagcccatcagccctgtgaaggaccctgtgtccccagccagccagaagatggtgatccagggccccagcagcccccagggcgaggccatggtgacagatgtgctggaggaccagaaggagggccgcagcaccaacaaggagaaccccagcaaggccctgattgaaagacccagccagaacaacatcggcatccagaccatggagtgcagcctgcgggtgcctgagaccgtgtctgctgccacccagaccatcaagaatgtgtgtgagcagggcaccagcacagtggaccagaactttgggaagcaggatgccaccgtgcagacagagcggggcagcggggagaagcctgtgtctgcccctggagatgacacagagagcctgcacagccagggcgaggaggagtttgacatgccccagcccccccacggccacgtgctgcaccgccacatgaggaccatccgggaggtgaggaccctggtgaccagggtcatcacagatgtgtactacgtggatggaacagaggtggagaggaaggtgacagaggagacagaggagcccatcgtggagtgccaggagtgtgaaacagaggtgagccccagccagacaggaggcagcagcggggacctgggggacatcagcagcttcagcagcaaggccagcagcctgcacaggaccagcagcggcaccagcctgagcgccatgcacagcagcggcagcagcggcaagggggccggccccctgcggggcaagaccagcggcacagagcctgctgactttgccctgcccagcagccggggcggccctgggaagctgagccccaggaaaggagtgtcccagacaggcacccctgtgtgtgaagaagatggagatgctggcctgggcatccggcagggcggcaaggcccctgtgaccccccggggccggggccggcggggccggccccccagcaggaccaccggcacccgggagacagctgtgcccggccccctgggcatcgaggacatcagccccaacctgagcccagatgacaagagcttcagccgggtggtgccccgggtgcctgacagcaccaggagaacagatgtgggcgctggggccctgcggcggagtgacagccctgagatccccttccaggccgctgctggccccagtgatggcctggatgccagcagccctggcaacagctttgtgggcctgcgggtggtggccaagtggagcagcaatggctacttctacagcggcaagatcaccagagatgtgggcgctgggaagtacaagctgctgtttgatgatggctatgaatgtgatgtgctgggcaaggacatcctgctgtgtgaccccatccccctggacacagaggtgacagccctgtctgaagatgagtacttctctgctggggtggtgaagggccacaggaaggagagcggggagctgtactacagcattgagaaggagggccagaggaagtggtacaagaggatggctgtgatcctgagcctggagcagggcaaccggctgcgggagcagtatggcctgggcccctatgaagctgtgacccccctgaccaaggctgctgacatcagcctggacaacctggtggagggcaagaggaagagaagaagcaatgtgagcagccctgccacccccacagccagcagcagcagcagcaccacccccaccaggaagatcacagagagcccccgggcctccatgggcgtgctgagcggcaagaggaagctgatcaccagcgaggaggagaggagccctgccaagaggggcaggaagagcgccaccgtgaagccaggagctgtgggcgctggggagtttgtgagcccctgtgagagcggggacaacacaggagagcccagcgccctggaggagcagaggggccccctgcccctgaacaagaccctcttcctgggctacgccttcctgctgaccatggccaccaccagtgacaagctggccagccgcagcaagctgcctgatggccccaccggcagcagcgaggaggaggaggagttcctggagatcccccccttcaacaagcagtacacagagagccagctgcgggccggggccggctacatcctggaggacttcaatgaggcccagtgcaacacagcctaccagtgcctgctgattgctgaccagcactgcaggaccaggaagtacttcctgtgcctggccagcggcatcccctgtgtgagccacgtgtgggtgcatgacagctgccacgccaaccagctgcagaactacagaaactacctgctgcctgctggctacagcctggaggagcagaggatcctggactggcagccccgggagaaccccttccagaacctgaaggtgctgctggtgtctgaccagcagcagaacttcctggagctgtggagcgagatcctgatgactggaggagctgcctctgtgaagcagcaccacagcagcgcccacaacaaggacatcgccctgggcgtgtttgatgtggtggtgacagaccccagctgcccagcctctgtgctgaagtgtgccgaggccctgcagctgcctgtggtgtcccaggagtgggtgatccagtgcctgattgtgggggagagaattggcttcaagcagcaccccaagtacaagcatgactatgtgagccactag

SEQ ID NO: 22357 - DNA, 5784 bp, Artificial Sequence
  Description of Artificial Sequence: Synthetic coding sequence
atgcctggagagcagatggaccccaccggcagccagctggacagcgacttcagccagcaggacaccccctgcctgatcatcgaggacagccagcctgagagccaggtgctggaggatgattctggcagccacttctccatgctgagccgccacctgcccaacctgcagacccacaaggagaaccctgtgctggatgtggtgagcaaccctgagcagacagctggggaggagagaggagatggcaacagcggcttcaatgagcacctgaaggagaacaaggtggccgaccctgtggacagcagcaacctggacacctgtggcagcatcagccaggtgattgagcagctgccccagcccaacagaaccagctctgtgctgggcatgtctgtggagagcgccccagctgtggaggaggagaagggggaggagctggagcagaaggagaaggagaaggaggaggacaccagcggcaacaccacccacagcctgggcgctgaggacacagccagcagccagctgggctttggagtgctggagctgagccagagccaggatgtggaggagaacacagtgccctatgaggtggacaaggagcagctgcagagcgtgaccaccaacagcggctacacccggctgagtgatgtggatgccaacacagccatcaagcatgaggagcagagcaatgaagacatccccatcgccgagcagagcagcaaggacatccctgtgacagcccagcccagcaaggatgtgcacgtggtgaaggagcagaaccccccaccagcccggtctgaggacatgcccttcagccccaaggcctctgtggccgccatggaggccaaggagcagctgagcgcccaggagctgatggagagcggcctgcagatccagaagagccctgagcctgaggtgctgagcacccaggaggacctgtttgaccagagcaacaagacagtgtccagtgatggctgcagcacccccagccgggaggagggcggctgcagcctggccagcaccccagccaccaccctgcacctgctgcagctgagcggccagaggagcctggtgcaggacagcctgagcaccaacagcagtgacctggtggcccccagcccagatgccttccgcagcacccccttcatcgtgcccagcagccccacagagcaggagggccggcaggacaagcccatggacacctctgtgctgtctgaggagggcggggagcccttccagaagaagctgcagagcggggagcctgtggagctggagaacccccccctgctgcctgagagcacagtgagcccccaggccagcacccccatcagccagagcacccctgtgtttcctcctggcagcctgcccatccccagccagccccagttcagccatgacatcttcatccccagccccagcctggaggagcagagcaatgatggcaagaaggatggagacatgcacagcagcagcctgactgtggagtgcagcaagaccagcgagattgagcccaagaacagccctgaggacctgggcctgagcctgaccggggacagctgcaagctgatgctgagcaccagcgagtacagccagagccccaagatggagagcctgagcagccacagaattgatgaagatggagagaacacccagatcgaggacacagagcccatgagccctgtgctgaacagcaagtttgtgcctgcagaaaatgacagcatcctgatgaacccagcccaggatggagaggtgcagctgagccagaatgatgacaagaccaagggagatgacacagacaccagagatgacatcagcatcctggccaccggctgcaagggccgggaggagaccgtggccgaggatgtgtgcatcgacctgacctgtgacagcggcagccaggccgtgcccagccctgccaccaggtctgaggccctgagctctgtgctggaccaggaggaggccatggagatcaaggagcaccaccctgaggagggcagcagcggcagcgaggtggaggagatccctgagaccccctgtgagagccagggcgaggagctgaaggaggagaacatggagagcgtgcccctgcacctgagcctgacagagacccagagccagggcctgtgcctgcagaaggagatgcccaagaaggagtgcagcgaggccatggaggtggagaccagcgtcatcagcattgacagcccccagaagctggccatcctggaccaggagctggagcacaaggagcaggaggcctgggaggaggccaccagcgaggacagctctgtggtgattgtggatgtgaaggagcccagcccccgggtggatgtgtcctgtgagcccctggagggcgtggagaagtgcagcgacagccagagctgggaggacatcgcccctgagattgagccctgtgccgagaaccggctggacaccaaggaggagaagtctgtggagtatgaaggagacctgaagtctggaacagctgagacagagcctgtggagcaggacagcagccagcccagcctgcccctggtgcgggcagatgaccccctgcggctggaccaggagctgcagcagccccagacccaggagaagaccagcaacagcctgacagaggacagcaagatggccaatgccaagcagctgagcagtgatgctgaggcccagaagctgggcaagcccagcgcccacgccagccagagcttctgtgagagcagcagcgagacccccttccacttcaccctgcccaaggagggggacatcatcccccccctgaccggggccaccccacccctgattggccacctgaagctggagcccaagaggcacagcacccccatcggcatcagcaactacccagagagcaccatcgccaccagtgatgtgatgtctgagagcatggtggagacccatgaccccatcctgggcagcgggaaaggagacagcggggccgccccagatgtggatgacaagctgtgcctgaggatgaagctggtgtccccagagacagaggccagcgaggagagcctgcagttcaacctggagaagccagccactggagagaggaagaatggcagcacagctgtggccgagagcgtggccagcccccagaagaccatgtctgtgctgagctgcatctgtgaggcccggcaggagaatgaggcccggtctgaggacccccccaccacccccatccggggcaacctgctgcacttccccagcagccagggcgaggaggagaaggagaagctggagggggaccacaccatccggcagagccagcagcccatgaagcccatcagccctgtgaaggaccctgtgtccccagccagccagaagatggtgatccagggccccagcagcccccagggcgaggccatggtgacagatgtgctggaggaccagaaggagggccgcagcaccaacaaggagaaccccagcaaggccctgattgagcggcccagccagaacaacatcggcatccagaccatggagtgcagcctgcgggtgcctgagaccgtgtctgctgccacccagaccatcaagaatgtgtgtgagcagggcaccagcacagtggaccagaactttgggaagcaggatgccaccgtgcagacagagcggggcagcggggagaagcctgtgtctgcccctggagatgacacagagagcctgcacagccagggcgaggaggagtttgacatgccccagccccctcatggccacgtgctgcaccgccacatgaggaccatccgggaggtgaggaccctggtgaccagggtcatcacagatgtgtactacgtggatggaacagaggtggagaggaaggtgacagaggagacagaggagcccatcgtggagtgccaggagtgtgaaacagaggtgagccccagccagacaggaggcagcagcggggacctgggggacatcagcagcttcagcagcaaggccagcagcctgcacaggaccagcagcggcaccagcctgagcgccatgcacagcagcggcagcagtggaaaaggagctggccccctgcggggcaagaccagcggcacagagcctgctgactttgccctgcccagcagcagaggaggccctgggaagctgcgggagacagctgtgcccggccccctgggcatcgaggacatcagccccaacctgagcccagatgacaagagcttcagccgggtggtgccccgggtgcctgacagcaccaggagaacagatgtgggcgctggggccctgcggcggagtgacagccctgagatccccttccaggccgccgccggccccagtgatggcctggatgccagcagccctggcaacagctttgtgggcctgcgggtggtggccaagtggagcagcaatggctacttctacagcggcaagatcaccagagatgtgggcgccggcaagtacaagctgctgtttgatgatggctatgaatgtgatgtgctgggcaaggacatcctgctgtgtgaccccatccccctggacacagaggtgacagccctgtctgaagatgagtacttctctgctggggtggtgaagggccacaggaaggagagcggggagctgtactacagcattgagaaggagggccagaggaagtggtacaagaggatggccgtcatcctgagcctggagcagggcaaccggctgcgggagcagtatggcctgggcccctatgaggccgtgacccccctgaccaaggctgctgacatcagcctggacaacctggtggagggcaagaggaagaggaggagcaatgtgagcagccctgccacccccacagccagcagcagcagcagcaccacccccaccaggaagatcacagagagcccccgggcctccatgggcgtgctgagcggcaagaggaagctgatcaccagcgaggaggagaggagccctgccaagaggggcaggaagagcgccaccgtgaagccaggagctgtgggcgctggggagtttgtgagcccctgtgagagcggggacaacacaggagagcccagcgccctggaggagcagaggggccccctgcccctgaacaagaccctcttcctgggctacgccttcctgctgaccatggccaccaccagtgacaagctggccagccgcagcaagctgcctgatggccccaccggcagcagcgaggaggaggaggagttcctggagatcccccccttcaacaagcagtacacagagagccagctgcgggccggggccggctacatcctggaggacttcaatgaggcccagtgcaacacagcctaccagtgcctgctgattgctgaccagcactgcaggaccaggaagtacttcctgtgcctggccagcggcatcccctgtgtgagccacgtgtgggtgcatgacagctgccacgccaaccagctgcagaactacagaaactacctgctgcctgctggctacagcctggaggagcagaggatcctggactggcagccccgggagaaccccttccagaacctgaaggtgctgctggtgtctgaccagcagcagaacttcctggagctgtggagcgagatcctgatgactggaggagctgcctctgtgaagcagcaccacagcagcgcccacaacaaggacatcgccctgggcgtgtttgatgtggtggtgacagaccccagctgcccagcctctgtgctgaagtgtgccgaggccctgcagctgcctgtggtgtcccaggagtgggtgatccagtgcctgattgtgggggagcgcatcggcttcaagcagcaccccaagtacaagcatgactatgtgagccactag

SEQ ID NO: 22358 - DNA, 5934 bp, Artificial Sequence
  Description of Artificial Sequence: Synthetic coding sequence
atgcctggagagcagatggaccccaccggcagccagctggacagcgacttcagccagcaggacaccccctgcctgatcatcgaggacagccagcctgagagccaggtgctggaggatgattctggcagccacttctccatgctgagccgccacctgcccaacctgcagacccacaaggagaaccctgtgctggatgtggtgagcaaccctgagcagacagctggggaggagagaggagatggcaacagcggcttcaatgagcacctgaaggagaacaaggtggccgaccctgtggacagcagcaacctggacacctgtggcagcatcagccaggtgattgagcagctgccccagcccaacagaaccagctctgtgctgggcatgtctgtggagagcgccccagctgtggaggaggagaagggggaggagctggagcagaaggagaaggagaaggaggaggacaccagcggcaacaccacccacagcctgggcgctgaggacacagccagcagccagctgggctttggagtgctggagctgagccagagccaggatgtggaggagaacacagtgccctatgaggtggacaaggagcagctgcagagcgtgaccaccaacagcggctacacccggctgagtgatgtggatgccaacacagccatcaagcatgaggagcagagcaatgaagacatccccatcgccgagcagagcagcaaggacatccctgtgacagcccagcccagcaaggatgtgcacgtggtgaaggagcagaaccccccaccagcccggtctgaggacatgcccttcagccccaaggcctctgtggccgccatggaggccaaggagcagctgagcgcccaggagctgatggagagcggcctgcagatccagaagagccctgagcctgaggtgctgagcacccaggaggacctgtttgaccagagcaacaagacagtgtccagtgatggctgcagcacccccagccgggaggagggcggctgcagcctggccagcaccccagccaccaccctgcacctgctgcagctgagcggccagaggagcctggtgcaggacagcctgagcaccaacagcagtgacctggtggcccccagcccagatgccttccgcagcacccccttcatcgtgcccagcagccccacagagcaggagggccggcaggacaagcccatggacacctctgtgctgtctgaggagggcggggagcccttccagaagaagctgcagagcggggagcctgtggagctggagaacccccccctgctgcctgagagcacagtgagcccccaggccagcacccccatcagccagagcacccctgtgtttcctcctggcagcctgcccatccccagccagccccagttcagccatgacatcttcatccccagccccagcctggaggagcagagcaatgatggcaagaaggatggagacatgcacagcagcagcctgactgtggagtgcagcaagaccagcgagattgagcccaagaacagccctgaggacctgggcctgagcctgaccggggacagctgcaagctgatgctgagcaccagcgagtacagccagagccccaagatggagagcctgagcagccacagaattgatgaagatggagagaacacccagatcgaggacacagagcccatgagccctgtgctgaacagcaagtttgtgcctgcagaaaatgacagcatcctgatgaacccagcccaggatggagaggtgcagctgagccagaatgatgacaagaccaagggagatgacacagacaccagagatgacatcagcatcctggccaccggctgcaagggccgggaggagaccgtggccgaggatgtgtgcatcgacctgacctgtgacagcggcagccaggccgtgcccagccctgccaccaggtctgaggccctgagctctgtgctggaccaggaggaggccatggagatcaaggagcaccaccctgaggagggcagcagcggcagcgaggtggaggagatccctgagaccccctgtgagagccagggcgaggagctgaaggaggagaacatggagagcgtgcccctgcacctgagcctgacagagacccagagccagggcctgtgcctgcagaaggagatgcccaagaaggagtgcagcgaggccatggaggtggagaccagcgtcatcagcattgacagcccccagaagctggccatcctggaccaggagctggagcacaaggagcaggaggcctgggaggaggccaccagcgaggacagctctgtggtgattgtggatgtgaaggagcccagcccccgggtggatgtgtcctgtgagcccctggagggcgtggagaagtgcagcgacagccagagctgggaggacatcgcccctgagattgagccctgtgccgagaaccggctggacaccaaggaggagaagtctgtggagtatgaaggagacctgaagtctggaacagctgagacagagcctgtggagcaggacagcagccagcccagcctgcccctggtgcgggcagatgaccccctgcggctggaccaggagctgcagcagccccagacccaggagaagaccagcaacagcctgacagaggacagcaagatggccaatgccaagcagctgagcagtgatgctgaggcccagaagctgggcaagcccagcgcccacgccagccagagcttctgtgagagcagcagcgagacccccttccacttcaccctgcccaaggagggggacatcatcccccccctgaccggggccaccccacccctgattggccacctgaagctggagcccaagaggcacagcacccccatcggcatcagcaactacccagagagcaccatcgccaccagtgatgtgatgtctgagagcatggtggagacccatgaccccatcctgggcagcgggaaaggagacagcggggccgccccagatgtggatgacaagctgtgcctgaggatgaagctggtgtccccagagacagaggccagcgaggagagcctgcagttcaacctggagaagccagccactggagagaggaagaatggcagcacagctgtggccgagagcgtggccagcccccagaagaccatgtctgtgctgagctgcatctgtgaggcccggcaggagaatgaggcccggtctgaggacccccccaccacccccatccggggcaacctgctgcacttccccagcagccagggcgaggaggagaaggagaagctggagggggaccacaccatccggcagagccagcagcccatgaagcccatcagccctgtgaaggaccctgtgtccccagccagccagaagatggtgatccagggccccagcagcccccagggcgaggccatggtgacagatgtgctggaggaccagaaggagggccgcagcaccaacaaggagaaccccagcaaggccctgattgagcggcccagccagaacaacatcggcatccagaccatggagtgcagcctgcgggtgcctgagaccgtgtctgctgccacccagaccatcaagaatgtgtgtgagcagggcaccagcacagtggaccagaactttgggaagcaggatgccaccgtgcagacagagcggggcagcggggagaagcctgtgtctgcccctggagatgacacagagagcctgcacagccagggcgaggaggagtttgacatgccccagccccctcatggccacgtgctgcaccgccacatgaggaccatccgggaggtgaggaccctggtgaccagggtcatcacagatgtgtactacgtggatggaacagaggtggagaggaaggtgacagaggagacagaggagcccatcgtggagtgccaggagtgtgaaacagaggtgagccccagccagacaggaggcagcagcggggacctgggggacatcagcagcttcagcagcaaggccagcagcctgcacaggaccagcagcggcaccagcctgagcgccatgcacagcagcggcagcagtggaaaaggagctggccccctgcggggcaagaccagcggcacagagcctgctgactttgccctgcccagcagcagaggaggccctgggaagctgagccccaggaagggcgtgtcccagacaggcacccctgtgtgtgaggaggatggagatgctggcctgggcatccggcagggcggcaaggcccctgtgaccccccggggccggggcagaagaggccggccccccagcaggaccaccggcacccgggagacagctgtgcccggccccctgggcatcgaggacatcagccccaacctgagcccagatgacaagagcttcagccgggtggtgccccgggtgcctgacagcaccaggagaacagatgtgggcgctggggccctgcggcggagtgacagccctgagatccccttccaggccgccgccggccccagtgatggcctggatgccagcagccctggcaacagctttgtgggcctgcgggtggtggccaagtggagcagcaatggctacttctacagcggcaagatcaccagagatgtgggcgccggcaagtacaagctgctgtttgatgatggctatgaatgtgatgtgctgggcaaggacatcctgctgtgtgaccccatccccctggacacagaggtgacagccctgtctgaagatgagtacttctctgctggggtggtgaagggccacaggaaggagagcggggagctgtactacagcattgagaaggagggccagaggaagtggtacaagaggatggccgtcatcctgagcctggagcagggcaaccggctgcgggagcagtatggcctgggcccctatgaggccgtgacccccctgaccaaggctgctgacatcagcctggacaacctggtggagggcaagaggaagaggaggagcaatgtgagcagccctgccacccccacagccagcagcagcagcagcaccacccccaccaggaagatcacagagagcccccgggcctccatgggcgtgctgagcggcaagaggaagctgatcaccagcgaggaggagaggagccctgccaagaggggcaggaagagcgccaccgtgaagccaggagctgtgggcgctggggagtttgtgagcccctgtgagagcggggacaacacaggagagcccagcgccctggaggagcagaggggccccctgcccctgaacaagaccctcttcctgggctacgccttcctgctgaccatggccaccaccagtgacaagctggccagccgcagcaagctgcctgatggccccaccggcagcagcgaggaggaggaggagttcctggagatcccccccttcaacaagcagtacacagagagccagctgcgggccggggccggctacatcctggaggacttcaatgaggcccagtgcaacacagcctaccagtgcctgctgattgctgaccagcactgcaggaccaggaagtacttcctgtgcctggccagcggcatcccctgtgtgagccacgtgtgggtgcatgacagctgccacgccaaccagctgcagaactacagaaactacctgctgcctgctggctacagcctggaggagcagaggatcctggactggcagccccgggagaaccccttccagaacctgaaggtgctgctggtgtctgaccagcagcagaacttcctggagctgtggagcgagatcctgatgactggaggagctgcctctgtgaagcagcaccacagcagcgcccacaacaaggacatcgccctgggcgtgtttgatgtggtggtgacagaccccagctgcccagcctctgtgctgaagtgtgccgaggccctgcagctgcctgtggtgtcccaggagtgggtgatccagtgcctgattgtgggggagcgcatcggcttcaagcagcaccccaagtacaagcatgactatgtgagccactag

SEQ ID NO: 22359 - DNA, 5928 bp, Artificial Sequence
  Description of Artificial Sequence: Synthetic coding sequence
atgcctggagagcagatggaccccaccggcagccagctggacagcgacttcagccagcaggacaccccctgcctgatcatcgaggacagccagcctgagagccaggtgctggaggatgattctggcagccacttctccatgctgagccgccacctgcccaacctgcagacccacaaggagaaccctgtgctggatgtggtgagcaaccctgagcagacagctggggaggagagaggagatggcaacagcggcttcaatgagcacctgaaggagaacaaggtggccgaccctgtggacagcagcaacctggacacctgtggcagcatcagccaggtgattgagcagctgccccagcccaacagaaccagctctgtgctgggcatgtctgtggagagcgccccagctgtggaggaggagaagggggaggagctggagcagaaggagaaggagaaggaggaggacaccagcggcaacaccacccacagcctgggcgctgaggacacagccagcagccagctgggctttggagtgctggagctgagccagagccaggatgtggaggagaacacagtgccctatgaggtggacaaggagcagctgcagagcgtgaccaccaacagcggctacacccggctgagtgatgtggatgccaacacagccatcaagcatgaggagcagagcaatgaagacatccccatcgccgagcagagcagcaaggacatccctgtgacagcccagcccagcaaggatgtgcacgtggtgaaggagcagaaccccccaccagcccggtctgaggacatgcccttcagccccaaggcctctgtggccgccatggaggccaaggagcagctgagcgcccaggagctgatggagagcggcctgcagatccagaagagccctgagcctgaggtgctgagcacccaggaggacctgtttgaccagagcaacaagacagtgtccagtgatggctgcagcacccccagccgggaggagggcggctgcagcctggccagcaccccagccaccaccctgcacctgctgcagctgagcggccagaggagcctggtgcaggacagcctgagcaccaacagcagtgacctggtggcccccagcccagatgccttccgcagcacccccttcatcgtgcccagcagccccacagagcaggagggccggcaggacaagcccatggacacctctgtgctgtctgaggagggcggggagcccttccagaagaagctgcagagcggggagcctgtggagctggagaacccccccctgctgcctgagagcacagtgagcccccaggccagcacccccatcagccagagcacccctgtgtttcctcctggcagcctgcccatccccagccagccccagttcagccatgacatcttcatccccagccccagcctggaggagcagagcaatgatggcaagaaggatggagacatgcacagcagcagcctgactgtggagtgcagcaagaccagcgagattgagcccaagaacagccctgaggacctgggcctgagcctgaccggggacagctgcaagctgatgctgagcaccagcgagtacagccagagccccaagatggagagcctgagcagccacagaattgatgaagatggagagaacacccagatcgaggacacagagcccatgagccctgtgctgaacagcaagtttgtgcctgcagaaaatgacagcatcctgatgaacccagcccaggatggagaggtgcagctgagccagaatgatgacaagaccaagggagatgacacagacaccagagatgacatcagcatcctggccaccggctgcaagggccgggaggagaccgtggccgaggatgtgtgcatcgacctgacctgtgacagcggcagccaggccgtgcccagccctgccaccaggtctgaggccctgagctctgtgctggaccaggaggaggccatggagatcaaggagcaccaccctgaggagggcagcagcggcagcgaggtggaggagatccctgagaccccctgtgagagccagggcgaggagctgaaggaggagaacatggagagcgtgcccctgcacctgagcctgacagagacccagagccagggcctgtgcctgcagaaggagatgcccaagaaggagtgcagcgaggccatggaggtggagaccagcgtcatcagcattgacagcccccagaagctggccatcctggaccaggagctggagcacaaggagcaggaggcctgggaggaggccaccagcgaggacagctctgtggtgattgtggatgtgaaggagcccagcccccgggtggatgtgtcctgtgagcccctggagggcgtggagaagtgcagcgacagccagagctgggaggacatcgcccctgagattgagccctgtgccgagaaccggctggacaccaaggaggagaagtctgtggagtatgaaggagacctgaagtctggaacagctgagacagagcctgtggagcaggacagcagccagcccagcctgcccctggtgcgggcagatgaccccctgcggctggaccaggagctgcagcagccccagacccaggagaagaccagcaacagcctgacagaggacagcaagatggccaatgccaagcagctgagcagtgatgctgaggcccagaagctgggcaagcccagcgcccacgccagccagagcttctgtgagagcagcagcgagacccccttccacttcaccctgcccaaggagggggacatcatcccccccctgaccggggccaccccacccctgattggccacctgaagctggagcccaagaggcacagcacccccatcggcatcagcaactacccagagagcaccatcgccaccagtgatgtgatgtctgagagcatggtggagacccatgaccccatcctgggcagcgggaaaggagacagcggggccgccccagatgtggatgacaagctgtgcctgaggatgaagctggtgtccccagagacagaggccagcgaggagagcctgcagttcaacctggagaagccagccactggagagaggaagaatggcagcacagctgtggccgagagcgtggccagcccccagaagaccatgtctgtgctgagctgcatctgtgaggcccggcaggagaatgaggcccggtctgaggacccccccaccacccccatccggggcaacctgctgcacttccccagcagccagggcgaggaggagaaggagaagctggagggggaccacaccatccggcagagccagcagcccatgaagcccatcagccctgtgaaggaccctgtgtccccagccagccagaagatggtgatccagggccccagcagcccccagggcgaggccatggtgacagatgtgctggaggaccagaaggagggccgcagcaccaacaaggagaaccccagcaaggccctgattgagcggcccagccagaacaacatcggcatccagaccatggagtgcagcctgcgggtgcctgagaccgtgtctgctgccacccagaccatcaagaatgtgtgtgagcagggcaccagcacagtggaccagaactttgggaagcaggatgccaccgtgcagacagagcggggcagcggggagaagcctgtgtctgcccctggagatgacacagagagcctgcacagccagggcgaggaggagtttgacatgccccagccccctcatggccacgtgctgcaccgccacatgaggaccatccgggaggtgaggaccctggtgaccagggtcatcacagatgtgtactacgtggatggaacagaggtggagaggaaggtgacagaggagacagaggagcccatcgtggagtgccaggagtgtgaaacagaggtgagccccagccagacaggaggcagcagcggggacctgggggacatcagcagcttcagcagcaaggccagcagcctgcacaggaccagcagcggcaccagcctgagcgccatgcacagcagcggcagcagtggaaaaggagctggccccctgcggggcaagaccagcggcacagagcctgctgactttgccctgcccagcagcagaggaggccctgggaagctgagccccaggaagggcgtgtcccagacaggcacccctgtgtgtgaggaggatggagatgctggcctgggcatccggcagggcggcaaggcccctgtgaccccccggggccggggcagaagaggccggccccccagcaggaccaccggcacccgggagacagctgtgcccggccccctgggcatcgaggacatcagccccaacctgagcccagatgacaagagcttcagccgggtggtgccccgggtgcctgacagcaccaggagaacagatgtgggcgctggggccctgcggcggagtgacagccctgagatccccttccaggccgccgccggccccagtgatggcctggatgccagcagccctggcaacagctttgtgggcctgcgggtggtggccaagtggagcagcaatggctacttctacagcggcaagatcaccagagatgtgggcgccggcaagtacaagctgctgtttgatgatggctatgaatgtgatgtgctgggcaaggacatcctgctgtgtgaccccatccccctggacacagaggtgacagccctgtctgaagatgagtacttctctgctggggtggtgaagggccacaggaaggagagcggggagctgtactacagcattgagaaggagggccagaggaagtggtacaagaggatggccgtcatcctgagcctggagcagggcaaccggctgcgggagcagtatggcctgggcccctatgaggccgtgacccccctgaccaaggctgctgacatcagcctggacaacctggtggagggcaagaggaagaggaggagcaatgtgagcagccctgccacccccacagccagcagcagcagcagcaccacccccaccaggaagatcacagagagcccccgggcctccatgggcgtgctgagcggcaagaggaagctgatcaccagcgaggaggagaggagccctgccaagaggggcaggaagagcgccaccgtgaagcctgtgggcgctggggagtttgtgagcccctgtgagagcggggacaacacaggagagcccagcgccctggaggagcagaggggccccctgcccctgaacaagaccctcttcctgggctacgccttcctgctgaccatggccaccaccagtgacaagctggccagccgcagcaagctgcctgatggccccaccggcagcagcgaggaggaggaggagttcctggagatcccccccttcaacaagcagtacacagagagccagctgcgggccggggccggctacatcctggaggacttcaatgaggcccagtgcaacacagcctaccagtgcctgctgattgctgaccagcactgcaggaccaggaagtacttcctgtgcctggccagcggcatcccctgtgtgagccacgtgtgggtgcatgacagctgccacgccaaccagctgcagaactacagaaactacctgctgcctgctggctacagcctggaggagcagaggatcctggactggcagccccgggagaaccccttccagaacctgaaggtgctgctggtgtctgaccagcagcagaacttcctggagctgtggagcgagatcctgatgactggaggagctgcctctgtgaagcagcaccacagcagcgcccacaacaaggacatcgccctgggcgtgtttgatgtggtggtgacagaccccagctgcccagcctctgtgctgaagtgtgccgaggccctgcagctgcctgtggtgtcccaggagtgggtgatccagtgcctgattgtgggggagcgcatcggcttcaagcagcaccccaagtacaagcatgactatgtgagccactag

SEQ ID NO: 22360 - DNA, 1623 bp, Artificial Sequence
  Description of Artificial Sequence: Synthetic coding sequence
atggcccagagcacagccaccagcccagatggcggcaccacctttgagcacctgtggagcagcctggagccagacagcacctactttgacctgccccagagcagccggggcaacaatgaggtggtgggcggcacagacagctccatggatgtgttccacctggagggcatgaccacctctgtgatggcccagttcaacctgctgagcagcaccatggaccagatgagcagcagagctgccagcgccagcccctacaccccagagcacgccgcctctgtgcccacccacagcccctatgcccagcccagcagcacctttgacaccatgagccctgcccctgtgatccccagcaacacagactacccaggcccccaccactttgaggtgaccttccagcagagcagcacagccaagagcgccacctggacctacagccccctgctgaagaagctgtactgccagatcgccaagacctgccccatccagatcaaggtgtccaccccacctcctcctggaacagccatccgggccatgcctgtgtacaagaaggccgagcacgtgacagatgtggtgaagcgctgccccaaccacgagctgggccgggacttcaatgaaggccagagcgccccagccagccacctgatccgggtggagggcaacaacctgagccagtatgtggatgatcctgtgacaggccggcagagcgtggtggtgccctatgagcccccccaggtgggcacagagttcaccaccatcctgtacaacttcatgtgcaacagcagctgtgtgggcggcatgaacagaagacccatcctgatcatcatcaccctggagatgagagatggccaggtgctgggcagaagaagctttgagggccgcatctgtgcctgccccggccgggacaggaaggcagatgaggaccactaccgggagcagcaggccctgaatgaatcttctgccaagaatggagctgccagcaagagggccttcaagcagagccccccagctgtgcctgccctgggcgctggggtgaagaagagaagacatggagatgaggacacctactacctgcaggtgcggggcagagaaaattttgagatcctgatgaagctgaaggagagcctggagctgatggagctggtgccccagcccctggtggacagctaccggcagcagcagcagctgctgcagaggcccttcctgaccggcctgggctgccccaactgcatcgagtacttcaccagccagggcctgcagagcatctaccacctgcagaacctgaccatcgaggacctgggcgccctgaagatccctgagcagtacaggatgaccatctggaggggcctgcaggacctgaagcagggccatgactacagcacagcccagcagctgctgcggagcagcaatgctgccaccatcagcattggaggcagcggggagctgcagaggcagagggtgatggaggccgtgcacttccgggtgcgccacaccatcaccatccccaacagaggaggccctgggggcggcccagatgagtgggccgactttggatttgacctgcctgactgcaaggccaggaagcagcccatcaaggaggagttcacagaagctgagatccactag

SEQ ID NO: 22361 - DNA, 1500 bp, Artificial Sequence
  Description of Artificial Sequence: Synthetic coding sequence
atggcccagagcacagccaccagcccagatggcggcaccacctttgagcacctgtggagcagcctggagccagacagcacctactttgacctgccccagagcagccggggcaacaatgaggtggtgggcggcacagacagctccatggatgtgttccacctggagggcatgaccacctctgtgatggcccagttcaacctgctgagcagcaccatggaccagatgagcagcagagctgccagcgccagcccctacaccccagagcacgccgcctctgtgcccacccacagcccctatgcccagcccagcagcacctttgacaccatgagccctgcccctgtgatccccagcaacacagactacccaggcccccaccactttgaggtgaccttccagcagagcagcacagccaagagcgccacctggacctacagccccctgctgaagaagctgtactgccagatcgccaagacctgccccatccagatcaaggtgtccaccccacctcctcctggaacagccatccgggccatgcctgtgtacaagaaggccgagcacgtgacagatgtggtgaagcgctgccccaaccacgagctgggccgggacttcaatgaaggccagagcgccccagccagccacctgatccgggtggagggcaacaacctgagccagtatgtggatgatcctgtgacaggccggcagagcgtggtggtgccctatgagcccccccaggtgggcacagagttcaccaccatcctgtacaacttcatgtgcaacagcagctgtgtgggcggcatgaacagaagacccatcctgatcatcatcaccctggagatgagagatggccaggtgctgggcagaagaagctttgagggccgcatctgtgcctgccccggccgggacaggaaggcagatgaggaccactaccgggagcagcaggccctgaatgaatcttctgccaagaatggagctgccagcaagagggccttcaagcagagccccccagctgtgcctgccctgggcgctggggtgaagaagagaagacatggagatgaggacacctactacctgcaggtgcggggcagagaaaattttgagatcctgatgaagctgaaggagagcctggagctgatggagctggtgccccagcccctggtggacagctaccggcagcagcagcagctgctgcagaggcccagccacctgcagccccccagctatggccctgtgctgagccccatgaacaaggtgcacggcggcatgaacaagctgcccagcgtgaaccagctggtgggccagcccccaccccacagcagcgctgccacccccaacctgggccctgtgggccctggcatgctgaacaaccacggccatgctgtgcctgccaatggagagatgagcagcagccacagcgcccagagcatggtgtctggcagccactgcaccccacctccaccctaccacgccgaccccagcctggtgaggacctggggcccctag

SEQ ID NO: 22362 - DNA, 1668 bp, Artificial Sequence
  Description of Artificial Sequence: Synthetic coding sequence
atggcccagagcacagccaccagcccagatggcggcaccacctttgagcacctgtggagcagcctggagccagacagcacctactttgacctgccccagagcagccggggcaacaatgaggtggtgggcggcacagacagctccatggatgtgttccacctggagggcatgaccacctctgtgatggcccagttcaacctgctgagcagcaccatggaccagatgagcagcagagctgccagcgccagcccctacaccccagagcacgccgcctctgtgcccacccacagcccctatgcccagcccagcagcacctttgacaccatgagccctgcccctgtgatccccagcaacacagactacccaggcccccaccactttgaggtgaccttccagcagagcagcacagccaagagcgccacctggacctacagccccctgctgaagaagctgtactgccagatcgccaagacctgccccatccagatcaaggtgtccaccccacctcctcctggaacagccatccgggccatgcctgtgtacaagaaggccgagcacgtgacagatgtggtgaagcgctgccccaaccacgagctgggccgggacttcaatgaaggccagagcgccccagccagccacctgatccgggtggagggcaacaacctgagccagtatgtggatgatcctgtgacaggccggcagagcgtggtggtgccctatgagcccccccaggtgggcacagagttcaccaccatcctgtacaacttcatgtgcaacagcagctgtgtgggcggcatgaacagaagacccatcctgatcatcatcaccctggagatgagagatggccaggtgctgggcagaagaagctttgagggccgcatctgtgcctgccccggccgggacaggaaggcagatgaggaccactaccgggagcagcaggccctgaatgaatcttctgccaagaatggagctgccagcaagagggccttcaagcagagccccccagctgtgcctgccctgggcgctggggtgaagaagagaagacatggagatgaggacacctactacctgcaggtgcggggcagagaaaattttgagatcctgatgaagctgaaggagagcctggagctgatggagctggtgccccagcccctggtggacagctaccggcagcagcagcagctgctgcagaggcccccaagagatgcccagcagccctggcccaggtctgccagccagaggagagatgagcagcagccccagaggcctgtgcacggcctgggcgtgcccctgcacagcgccacccccctgccccggcggccccagccccggcaggacctgggcgccctgaagatccctgagcagtacaggatgaccatctggaggggcctgcaggacctgaagcagggccatgactacagcacagcccagcagctgctgcggagcagcaatgctgccaccatcagcatcggcggcagcggggagctgcagaggcagagggtgatggaggccgtgcacttccgggtgcgccacaccatcaccatccccaacagaggaggccctgggggcggcccagatgagtgggccgactttggatttgacctgcctgactgcaaggccaggaagcagcccatcaaggaggagttcacagaggccgagatccactag

SEQ ID NO: 22363 - DNA, 1281 bp, Artificial Sequence
  Description of Artificial Sequence: Synthetic coding sequence
atgctgtatgtgggggaccctgcccggcacctggccacagcccagttcaacctgctgagcagcaccatggaccagatgagcagccgggccgccagcgccagcccctacaccccagagcacgccgcctctgtgcccacccacagcccctatgcccagcccagcagcacctttgacaccatgagccctgcccctgtgatccccagcaacacagactacccaggcccccaccactttgaggtgaccttccagcagagcagcacagccaagagcgccacctggacctacagccccctgctgaagaagctgtactgccagatcgccaagacctgccccatccagatcaaggtgtccaccccacctcctcctggaacagccatccgggccatgcctgtgtacaagaaggccgagcacgtgacagatgtggtgaagcgctgccccaaccacgagctgggccgggacttcaatgaaggccagagcgccccagccagccacctgatccgggtggagggcaacaacctgagccagtatgtggatgatcctgtgacaggccggcagagcgtggtggtgccctatgagcccccccaggtgggcacagagttcaccaccatcctgtacaacttcatgtgcaacagcagctgtgtgggcggcatgaacagaagacccatcctgatcatcatcaccctggagatgagagatggccaggtgctgggccgccgcagctttgagggccgcatctgtgcctgccccggccgggacaggaaggcagatgaggaccactaccgggagcagcaggccctgaatgaaagcagcgccaagaatggagctgccagcaagagggccttcaagcagagccccccagctgtgcctgccctgggcgccggcgtgaagaagagaagacatggagatgaggacacctactacctgcaggtgcggggccgggagaactttgagatcctgatgaagctgaaggagagcctggagctgatggagctggtgccccagcccctggtggacagctaccggcagcagcagcagctgctgcagaggcccccaagagatgcccagcagccctggcccaggtctgccagccagaggagagatgagcagcagccccagaggcctgtgcacggcctgggcgtgcccctgcacagcgccacccccctgccccggcggccccagccccggcagttcttcaacagaattggagtgtccaagctgcacagggtcttccacctgccccgggtgacagagcacctgcccccagctgagccagaccactag

SEQ ID NO: 22364 - DNA, 1353 bp, Artificial Sequence
  Description of Artificial Sequence: Synthetic coding sequence
atgctgtatgtgggggaccctgcccggcacctggccacagcccagttcaacctgctgagcagcaccatggaccagatgagcagccgggccgccagcgccagcccctacaccccagagcacgccgcctctgtgcccacccacagcccctatgcccagcccagcagcacctttgacaccatgagccctgcccctgtgatccccagcaacacagactacccaggcccccaccactttgaggtgaccttccagcagagcagcacagccaagagcgccacctggacctacagccccctgctgaagaagctgtactgccagatcgccaagacctgccccatccagatcaaggtgtccaccccacctcctcctggaacagccatccgggccatgcctgtgtacaagaaggccgagcacgtgacagatgtggtgaagcgctgccccaaccacgagctgggccgggacttcaatgaaggccagagcgccccagccagccacctgatccgggtggagggcaacaacctgagccagtatgtggatgatcctgtgacaggccggcagagcgtggtggtgccctatgagcccccccaggtgggcacagagttcaccaccatcctgtacaacttcatgtgcaacagcagctgtgtgggcggcatgaacagaagacccatcctgatcatcatcaccctggagatgagagatggccaggtgctgggccgccgcagctttgagggccgcatctgtgcctgccccggccgggacaggaaggcagatgaggaccactaccgggagcagcaggccctgaatgaaagcagcgccaagaatggagctgccagcaagagggccttcaagcagagccccccagctgtgcctgccctgggcgccggcgtgaagaagagaagacatggagatgaggacacctactacctgcaggtgcggggccgggagaactttgagatcctgatgaagctgaaggagagcctggagctgatggagctggtgccccagcccctggtggacagctaccggcagcagcagcagctgctgcagaggcccagccacctgcagcccccatcctatggccctgtgctgagccccatgaacaaggtgcatggaggcatgaacaagctgcccagcgtgaaccagctggtgggccagcccccaccccacagcagcgctgccacccccaacctgggccctgtgggccctggcatgctgaacaaccacggccatgctgtgcctgccaacggggagatgagcagcagccacagcgcccagagcatggtgtctggcagccactgcaccccacctccaccctaccacgccgaccccagcctggtgaggacctggggcccctag

SEQ ID NO: 22365 - DNA, 1764 bp, Artificial Sequence
  Description of Artificial Sequence: Synthetic coding sequence
atgctgtatgtgggggaccctgcccggcacctggccacagcccagttcaacctgctgagcagcaccatggaccagatgagcagccgggccgccagcgccagcccctacaccccagagcacgccgcctctgtgcccacccacagcccctatgcccagcccagcagcacctttgacaccatgagccctgcccctgtgatccccagcaacacagactacccaggcccccaccactttgaggtgaccttccagcagagcagcacagccaagagcgccacctggacctacagccccctgctgaagaagctgtactgccagatcgccaagacctgccccatccagatcaaggtgtccaccccacctcctcctggaacagccatccgggccatgcctgtgtacaagaaggccgagcacgtgacagatgtggtgaagcgctgccccaaccacgagctgggccgggacttcaatgaaggccagagcgccccagccagccacctgatccgggtggagggcaacaacctgagccagtatgtggatgatcctgtgacaggccggcagagcgtggtggtgccctatgagcccccccaggtgggcacagagttcaccaccatcctgtacaacttcatgtgcaacagcagctgtgtgggcggcatgaacagaagacccatcctgatcatcatcaccctggagatgagagatggccaggtgctgggccgccgcagctttgagggccgcatctgtgcctgccccggccgggacaggaaggcagatgaggaccactaccgggagcagcaggccctgaatgaaagcagcgccaagaatggagctgccagcaagagggccttcaagcagagccccccagctgtgcctgccctgggcgccggcgtgaagaagagaagacatggagatgaggacacctactacctgcaggtgcggggccgggagaactttgagatcctgatgaagctgaaggagagcctggagctgatggagctggtgccccagcccctggtggacagctaccggcagcagcagcagctgctgcagaggcccagccacctgcagcccccatcctatggccctgtgctgagccccatgaacaaggtgcatggaggcatgaacaagctgcccagcgtgaaccagctggtgggccagcccccaccccacagcagcgctgccacccccaacctgggccctgtgggccctggcatgctgaacaaccacggccatgctgtgcctgccaacggggagatgagcagcagccacagcgcccagagcatggtgtctggcagccactgcaccccacctccaccctaccacgccgaccccagcctggtgtccttcctgaccggcctgggctgccccaactgcatcgagtacttcaccagccagggcctgcagagcatctaccacctgcagaacctgaccatcgaggacctgggcgccctgaagatccctgagcagtacaggatgaccatctggaggggcctgcaggacctgaagcagggccatgactacagcacagcccagcagctgctgcggagcagcaatgctgccaccatcagcatcggcggcagcggggagctgcagaggcagagggtgatggaggccgtgcacttccgggtgcgccacaccatcaccatccccaacagaggaggccctgggggcggcccagatgagtgggccgactttggatttgacctgcctgactgcaaggccaggaagcagcccatcaaggaggagttcacagaggccgagatccactag

SEQ ID NO: 22366 - DNA, 1698 bp, Artificial Sequence
  Description of Artificial Sequence: Synthetic coding sequence
atggaccagatgagcagccgggccgccagcgccagcccctacaccccagagcacgccgcctctgtgcccacccacagcccctatgcccagcccagcagcacctttgacaccatgagccctgcccctgtgatccccagcaacacagactacccaggcccccaccactttgaggtgaccttccagcagagcagcacagccaagagcgccacctggacctacagccccctgctgaagaagctgtactgccagatcgccaagacctgccccatccagatcaaggtgtccaccccacctcctcctggaacagccatccgggccatgcctgtgtacaagaaggccgagcacgtgacagatgtggtgaagcgctgccccaaccacgagctgggccgggacttcaatgaaggccagagcgccccagccagccacctgatccgggtggagggcaacaacctgagccagtatgtggatgatcctgtgacaggccggcagagcgtggtggtgccctatgagcccccccaggtgggcacagagttcaccaccatcctgtacaacttcatgtgcaacagcagctgtgtgggcggcatgaacagaagacccatcctgatcatcatcaccctggagatgagagatggccaggtgctgggccgccgcagctttgagggccgcatctgtgcctgccccggccgggacaggaaggcagatgaggaccactaccgggagcagcaggccctgaatgaaagcagcgccaagaatggagctgccagcaagagggccttcaagcagagccccccagctgtgcctgccctgggcgccggcgtgaagaagagaagacatggagatgaggacacctactacctgcaggtgcggggccgggagaactttgagatcctgatgaagctgaaggagagcctggagctgatggagctggtgccccagcccctggtggacagctaccggcagcagcagcagctgctgcagaggcccagccacctgcagcccccatcctatggccctgtgctgagccccatgaacaaggtgcatggaggcatgaacaagctgcccagcgtgaaccagctggtgggccagcccccaccccacagcagcgctgccacccccaacctgggccctgtgggccctggcatgctgaacaaccacggccatgctgtgcctgccaacggggagatgagcagcagccacagcgcccagagcatggtgtctggcagccactgcaccccacctccaccctaccacgccgaccccagcctggtgtccttcctgaccggcctgggctgccccaactgcatcgagtacttcaccagccagggcctgcagagcatctaccacctgcagaacctgaccatcgaggacctgggcgccctgaagatccctgagcagtacaggatgaccatctggaggggcctgcaggacctgaagcagggccatgactacagcacagcccagcagctgctgcggagcagcaatgctgccaccatcagcatcggcggcagcggggagctgcagaggcagagggtgatggaggccgtgcacttccgggtgcgccacaccatcaccatccccaacagaggaggccctgggggcggcccagatgagtgggccgactttggatttgacctgcctgactgcaaggccaggaagcagcccatcaaggaggagttcacagaggccgagatccactag

SEQ ID NO: 22367 - DNA, 1911 bp, Artificial Sequence
  Description of Artificial Sequence: Synthetic coding sequence
atggcccagagcacagccaccagcccagatggcggcaccacctttgagcacctgtggagcagcctggagccagacagcacctactttgacctgccccagagcagccggggcaacaatgaggtggtgggcggcacagacagctccatggatgtgttccacctggagggcatgaccacctctgtgatggcccagttcaacctgctgagcagcaccatggaccagatgagcagcagagctgccagcgccagcccctacaccccagagcacgccgcctctgtgcccacccacagcccctatgcccagcccagcagcacctttgacaccatgagccctgcccctgtgatccccagcaacacagactacccaggcccccaccactttgaggtgaccttccagcagagcagcacagccaagagcgccacctggacctacagccccctgctgaagaagctgtactgccagatcgccaagacctgccccatccagatcaaggtgtccaccccacctcctcctggaacagccatccgggccatgcctgtgtacaagaaggccgagcacgtgacagatgtggtgaagcgctgccccaaccacgagctgggccgggacttcaatgaaggccagagcgccccagccagccacctgatccgggtggagggcaacaacctgagccagtatgtggatgatcctgtgacaggccggcagagcgtggtggtgccctatgagcccccccaggtgggcacagagttcaccaccatcctgtacaacttcatgtgcaacagcagctgtgtgggcggcatgaacagaagacccatcctgatcatcatcaccctggagatgagagatggccaggtgctgggcagaagaagctttgagggccgcatctgtgcctgccccggccgggacaggaaggcagatgaggaccactaccgggagcagcaggccctgaatgaatcttctgccaagaatggagctgccagcaagagggccttcaagcagagccccccagctgtgcctgccctgggcgctggggtgaagaagagaagacatggagatgaggacacctactacctgcaggtgcggggcagagaaaattttgagatcctgatgaagctgaaggagagcctggagctgatggagctggtgccccagcccctggtggacagctaccggcagcagcagcagctgctgcagaggcccagccacctgcagccccccagctatggccctgtgctgagccccatgaacaaggtgcacggcggcatgaacaagctgcccagcgtgaaccagctggtgggccagcccccaccccacagcagcgctgccacccccaacctgggccctgtgggccctggcatgctgaacaaccacggccatgctgtgcctgccaatggagagatgagcagcagccacagcgcccagagcatggtgtctggcagccactgcaccccacctccaccctaccacgccgaccccagcctggtgtccttcctgaccggcctgggctgccccaactgcatcgagtacttcaccagccagggcctgcagagcatctaccacctgcagaacctgaccatcgaggacctgggcgccctgaagatccctgagcagtacaggatgaccatctggaggggcctgcaggacctgaagcagggccatgactacagcacagcccagcagctgctgcggagcagcaatgctgccaccatcagcattggaggcagcggggagctgcagaggcagagggtgatggaggccgtgcacttccgggtgcgccacaccatcaccatccccaacagaggaggccctgggggcggcccagatgagtgggccgactttggatttgacctgcctgactgcaaggccaggaagcagcccatcaaggaggagttcacagaagctgagatccactag

SEQ ID NO: 22368 - DNA, 1053 bp, Artificial Sequence
  Description of Artificial Sequence: Synthetic coding sequence
atgggcgctggggccagcgctgaggagaagcacagccgggagctggagaagaagctgaaggaggatgctgagaaggatgccaggacagtgaagctgctgctgctgggcgctggggagagcggcaagagcaccatcgtgaagcagatgaagatcatccaccaggacggctacagcctggaggagtgcctggagttcatcgccatcatctacggcaacaccctgcagagcatcctggccatcgtgcgggccatgaccaccctgaacatccagtatggagacagcgcccggcaggatgatgccaggaagctgatgcacatggctgacaccatcgaggagggcaccatgcccaaggagatgtctgacatcatccagaggctgtggaaggacagcggcatccaggcctgctttgagcgggccagcgagtaccagctgaatgattctgctggctactacctgagtgacctggagcggctggtgaccccaggctacgtgcccacagagcaggatgtgctgcggagccgggtgaagaccaccggcatcatcgagacccagttctccttcaaggacctgaacttcaggatgtttgatgtgggcggccagaggtctgagaggaagaagtggatccactgctttgaaggagtgacctgcatcatcttcatcgccgccctgagcgcctatgacatggtgctggtggaggatgatgaggtgaacaggatgcatgagagcctgcacctgttcaacagcatctgcaaccaccgctactttgccaccaccagcatcgtgctcttcctgaacaagaaggatgtgttctttgagaagatcaagaaggcccacctgagcatctgcttcccagactatgatggccccaacacctatgaagatgctggcaactacatcaaggtgcagttcctggagctgaacatgagaagagatgtgaaggagatctacagccacatgacctgtgccacagacacccagaatgtgaagtttgtgtttgatgctgtgacagacatcatcatcaaggagaacctgaaggactgtggcctcttctag

SEQ ID NO: 22369 - DNA, 609 bp, Artificial Sequence
  Description of Artificial Sequence: Synthetic coding sequence
atgatgcaggatgtgagcagcagccctgtgtccccagcagatgacagcctgagcaacagcgaggaggagccagaccggcagcagcccccatctgggaagagaggaggcaggaagagaagaagcagcagaagatctgctgggggcggggccggccctgggggcgccgccggcggcggcgtgggcggcggagatgagcccggcagccctgcccagggcaagaggggcaagaagtctgctggctgcggcggcggcggcggggccggcggcggcggcggcagcagcagcggcggcggcagcccccagagctatgaggagctgcagacccagagggtgatggccaacgtgcgggagcggcagaggacccagagcctgaatgaggcctttgctgccctgaggaagatcatccccaccctgcccagcgacaagctgagcaagatccagaccctgaagctggccgcccgctacatcgacttcctgtaccaggtgctgcagagtgatgagctggacagcaagatggccagctgcagctatgtggcccacgagcggctgtcctatgccttctctgtgtggaggatggagggcgcctggagcatgtctgccagccactag

SEQ ID NO: 22370 - DNA, 741 bp, Artificial Sequence
  Description of Artificial Sequence: Synthetic coding sequence
atgggagaccgggagcagctgctgcagagggcccggctggccgagcaggccgagagatatgatgacatggccagcgccatgaaggctgtgacagagctgaatgagcccctgagcaatgaagatagaaacctgctgtctgtggcctacaagaatgtggtgggcgcccggcgcagctcctggagggtcatcagcagcattgagcagaagaccatggctgatggaaatgagaagaagctggagaaggtgaaggcctaccgggagaagattgagaaggagctggagaccgtgtgcaatgatgtgctgagcctgctggacaagttcctgatcaagaactgcaatgacttccagtatgagagcaaggtgttctacctgaagatgaagggggactactaccgctacctggccgaggtggccagcggggagaagaagaacagcgtggtggaggccagcgaggccgcctacaaggaggcctttgagatcagcaaggagcagatgcagcccacccaccccatccggctgggcctggccctgaacttcagcgtcttctactatgagatccagaatgcccctgagcaggcctgcctgctggccaagcaggcctttgatgatgccatcgccgagctggacaccctgaatgaagattcctacaaggacagcaccctcatcatgcagctgctgcgggacaacctgaccctgtggaccagtgaccagcaggatgaggaggccggggagggcaactag

SEQ ID NO: 22371 - DNA, 1626 bp, Artificial Sequence
  Description of Artificial Sequence: Synthetic coding sequence
atggtgtggagggtgccccccttcctgctgcccatcctcttcctgggcacccactaccagctggatgtgcagctgtaccactgcaccctgctgggccctgccagccccccagcccacgtgctgctgcccccatctggccccccagcccccaggcacctgcacgcccaggccctgagtgacagcgagatccagctgacctggaagcaccctgaggccctgcccggccccatcagcaaatatgtggtggaggtgcaggtggccggcggggccggggaccccctgtggattgatgtggacaggcctgaggagaccagcaccatcatccggggcctgaatgccagcacccgctacctgttcaggatgagggccagcatccagggcctgggggactggagcaacacagtggaggagagcaccctgggcaatggcctgcaggccgagggccctgtgcaggagagcagagctgctgaggagggcctggaccagcagctgatcctggccgtggtgggctctgtgtctgccacctgcctgaccatcctggccgccctgctgaccctggtgtgcatccgccgcagctgcctgcacagaagaaggaccttcacctaccagagcggcagcggggaggagaccatcctgcagttcagcagcggcaccctgaccctgacccggcggcccaagctgcagcctgagcccctgagctaccctgtgctggagtgggaggacatcacctttgaagatctcatcggggagggcaactttggccaggtgatccgggccatgatcaagaaggatggcctgaagatgaatgctgccatcaagatgctgaaggagtatgcctctgaaaatgaccaccgggactttgctggggagctggaggtgctgtgcaagctgggccaccaccccaacatcatcaacctgctgggcgcctgcaagaacagaggctacctgtacatcgccatcgagtatgccccctacggcaacctgctggacttcctgaggaagagccgggtgctggagacagatcctgcctttgcccgggagcacggcacagccagcaccctgagcagccggcagctgctgcgctttgccagtgatgctgccaacggcatgcagtacctgtctgagaagcagttcatccaccgggacctggccgccagaaatgtgctggtgggggagaacctggccagcaagattgctgactttggcctgagcagaggagaggaggtgtatgtgaagaagaccatgggccgcctgcctgtgcgctggatggccatcgagagcctgaactacagcgtgtacaccaccaagagtgatgtgtggagctttggagtgctgctgtgggagatcgtgtccctgggcggcaccccctactgcggcatgacctgtgccgagctgtatgagaagctgccccagggctacaggatggagcagcccaggaactgtgatgatgaggtgtatgagctgatgaggcagtgctggagggaccggccctatgaaagacctccatttgcccagatcgccctgcagctgggccgcatgctggaggccaggaaggcctacgtgaacatgagcctgtttgagaacttcacctacgccggcattgatgccacagctgaggaggcctag

SEQ ID NO: 22372 - DNA, 3417 bp, Artificial Sequence
  Description of Artificial Sequence: Synthetic coding sequence
atggtgtggagggtgccccccttcctgctgcccatcctcttcctggccagccacgtgggcgctgctgtggacctgaccctgctggccaacctgcggctgacagacccccagcgcttcttcctgacctgtgtgtctggagaggccggggccggccggggcagtgatgcctggggcccccccctgctgctggagaaggatgacagaattgtgaggaccccacctggcccccccctgcggctggccagaaatggcagccaccaggtgaccctgcggggcttcagcaagcccagcgacctggtgggcgtcttcagctgtgtgggcggggccggggcccggaggaccagggtcatctacgtgcacaacagccctggggcccacctgctgcctgacaaggtgacccacacagtgaacaagggggacacagctgtgctgagcgcccgggtgcacaaggagaagcagacagatgtgatctggaagagcaatggcagctacttctacaccctggactggcatgaggcccaggacggccgcttcctgctgcagctgcccaacgtgcagccccccagcagcggcatctacagcgccacctacctggaggccagccccctgggcagcgccttcttccggctgattgtgcggggctgtggggccggccgctggggccctggctgcaccaaggaatgtcctggctgcctgcatggaggagtgtgccacgaccatgatggagaatgtgtgtgccccccaggcttcaccggcacccgctgtgagcaggcctgccgggagggccgcttcggccagagctgccaggagcagtgccccggcatcagcggctgccggggcctgaccttctgcctgcctgacccctacggctgcagctgtggcagcggctggaggggcagccagtgccaggaggcctgtgcccctggccactttggagctgactgccgcctgcagtgccagtgccagaatggaggcacctgtgaccgcttcagcggctgtgtgtgccccagcggctggcacggcgtgcactgtgagaagagtgaccgcatcccccagatcctgaacatggccagcgagctggagttcaacctggagaccatgccccgcatcaactgtgccgctgctggcaaccccttccctgtgcggggcagcattgagctgaggaagccagatggcaccgtgctgctgagcaccaaggccatcgtggagcctgagaagaccacagctgagtttgaggtgccccggctggtgctggccgacagcggcttctgggagtgccgggtgtccaccagcggcggccaggacagccgccgcttcaaggtgaatgtgaaggtgccccctgtgcccctggccgccccccggctgctgaccaagcagagccggcagctggtggtgagccccctggtgtccttctctggagatggccccatcagcacagtgcggctgcactaccggccccaggacagcaccatggactggagcaccatcgtggtggaccccagtgaaaatgtgaccctgatgaacctgcggcccaagacaggctacagcgtgcgggtgcagctgagcaggcctggagagggcggggagggcgcctggggcccccccaccctgatgaccacagactgcccagagcccctgctgcagccctggctggagggctggcacgtggagggcacagaccggctgcgggtgtcctggagcctgcccctggtgcccggccccctggtgggagatggcttcctgctgcggctgtgggatggcacccggggccaggagaggagagaaaatgtgagcagcccccaggccaggacagccctgctgaccggcctgaccccaggcacccactaccagctggatgtgcagctgtaccactgcaccctgctgggccctgccagccccccagcccacgtgctgctgccccccagcggccccccagcccccaggcacctgcacgcccaggccctgagtgacagcgagatccagctgacctggaagcaccctgaggccctgcccggccccatcagcaaatatgtggtggaggtgcaggtggccggcggggccggggaccccctgtggattgatgtggacaggcctgaggagaccagcaccatcatccggggcctgaatgccagcacccgctacctgttcaggatgagggccagcatccagggcctgggggactggagcaacacagtggaggagagcaccctgggcaatggcctgcaggccgagggccctgtgcaggagagcagagctgctgaggagggcctggaccagcagctgatcctggccgtggtgggctctgtgtctgccacctgcctgaccatcctggccgccctgctgaccctggtgtgcatcagaagaagctgcctgcacagaagaaggaccttcacctaccagagcggcagcggggaggagaccatcctgcagttcagcagcggcaccctgaccctgacccggcggcccaagctgcagcctgagcccctgagctaccctgtgctggagtgggaggacatcacctttgaggacctgattggagagggcaactttggccaggtgatccgggccatgatcaagaaggatggcctgaagatgaatgctgccatcaagatgctgaaggagtatgcctctgaaaatgaccaccgggactttgctggggagctggaggtgctgtgcaagctgggccaccaccccaacatcatcaacctgctgggcgcctgcaagaacagaggctacctgtacatcgccattgaatatgccccctacggcaacctgctggacttcctgaggaagagccgggtgctggagacagatcctgcctttgcccgggagcacggcacagccagcaccctgagcagccggcagctgctgcgctttgccagtgatgctgccaacggcatgcagtacctgtctgagaagcagttcatccaccgggacctggccgccagaaatgtgctggtgggggagaacctggccagcaagattgctgactttggcctgagcagaggagaggaggtgtatgtgaagaagaccatgggccgcctgcctgtgcgctggatggccatcgagagcctgaactacagcgtgtacaccaccaagagtgatgtgtggagctttggagtgctgctgtgggagatcgtgtccctgggcggcaccccctactgcggcatgacctgtgccgagctgtatgagaagctgccccagggctacaggatggagcagcccaggaactgtgatgatgaggtgtatgagctgatgaggcagtgctggagggaccggccctatgagcggcccccatttgcccagatcgccctgcagctgggccgcatgctggaggccaggaaggcctacgtgaacatgagcctgtttgagaacttcacctacgccggcattgatgccacagctgaggaggcctag

SEQ ID NO: 22373 - DNA, 2352 bp, Artificial Sequence
  Description of Artificial Sequence: Synthetic coding sequence
atggccagcgagctggagttcaacctggagaccatgccccgcatcaactgtgccgccgccggcaaccccttccctgtgcggggcagcattgagctgaggaagccagatggcaccgtgctgctgagcaccaaggccatcgtggagcctgagaagaccacagctgagtttgaggtgccccggctggtgctggccgacagcggcttctgggagtgccgggtgtccaccagcggcggccaggacagccgccgcttcaaggtgaatgtgaaggtgccccctgtgcccctggccgccccccggctgctgaccaagcagagccggcagctggtggtgagccccctggtgtccttctctggagatggccccatcagcacagtgcggctgcactaccggccccaggacagcaccatggactggagcaccatcgtggtggaccccagtgaaaatgtgaccctgatgaacctgcggcccaagacaggctacagcgtgcgggtgcagctgagcaggcctggagagggcggggagggcgcctggggcccccccaccctgatgaccacagactgcccagagcccctgctgcagccctggctggagggctggcacgtggagggcacagaccggctgcgggtgtcctggagcctgcccctggtgcccggccccctggtgggagatggcttcctgctgcggctgtgggatggcacccggggccaggagcggcgggagaatgtgagcagcccccaggccaggacagccctgctgaccggcctgaccccaggcacccactaccagctggatgtgcagctgtaccactgcaccctgctgggccctgccagccccccagcccacgtgctgctgcccccatctggccccccagcccccaggcacctgcacgcccaggccctgagtgacagcgagatccagctgacctggaagcaccctgaggccctgcccggccccatcagcaaatatgtggtggaggtgcaggtggccggcggggccggggaccccctgtggattgatgtggacaggcctgaggagaccagcaccatcatccggggcctgaatgccagcacccgctacctgttcaggatgagggccagcatccagggcctgggggactggagcaacacagtggaggagagcaccctgggcaatggcctgcaggccgagggccctgtgcaggagagcagagctgctgaggagggcctggaccagcagctgatcctggccgtggtgggctctgtgtctgccacctgcctgaccatcctggccgccctgctgaccctggtgtgcatccgccgcagctgcctgcacagaagaaggaccttcacctaccagagcggcagcggggaggagaccatcctgcagttcagcagcggcaccctgaccctgacccggcggcccaagctgcagcctgagcccctgagctaccctgtgctggagtgggaggacatcacctttgaagatctcatcggggagggcaactttggccaggtgatccgggccatgatcaagaaggatggcctgaagatgaatgctgccatcaagatgctgaaggagtatgcctctgaaaatgaccaccgggactttgctggggagctggaggtgctgtgcaagctgggccaccaccccaacatcatcaacctgctgggcgcctgcaagaacagaggctacctgtacatcgccatcgagtatgccccctacggcaacctgctggacttcctgaggaagagccgggtgctggagacagatcctgcctttgcccgggagcacggcacagccagcaccctgagcagccggcagctgctgcgctttgccagtgatgctgccaacggcatgcagtacctgtctgagaagcagttcatccaccgggacctggccgccagaaatgtgctggtgggggagaacctggccagcaagattgctgactttggcctgagcagaggagaggaggtgtatgtgaagaagaccatgggccgcctgcctgtgcgctggatggccatcgagagcctgaactacagcgtgtacaccaccaagagtgatgtgtggagctttggagtgctgctgtgggagatcgtgtccctgggcggcaccccctactgcggcatgacctgtgccgagctgtatgagaagctgccccagggctacaggatggagcagcccaggaactgtgatgatgaggtgtatgagctgatgaggcagtgctggagggaccggccctatgaaagacctccatttgcccagatcgccctgcagctgggccgcatgctggaggccaggaaggcctacgtgaacatgagcctgtttgagaacttcacctacgccggcattgatgccacagctgaggaggcctag

SEQ ID NO: 22374 - DNA, 954 bp, Artificial Sequence
  Description of Artificial Sequence: Synthetic coding sequence
atggtgtggagggtgccccccttcctgctgcccatcctcttcctggccagccacgtgggcgctgctgtggacctgaccctgctggccaacctgcggctgacagacccccagcgcttcttcctgacctgtgtgtctggagaggccggggccggccggggcagtgatgcctggggcccccccctgctgctggagaaggatgacagaattgtgaggaccccacctggcccccccctgcggctggccagaaatggcagccaccaggtgaccctgcggggcttcagcaagcccagcgacctggtgggcgtcttcagctgtgtgggcggggccggggcccggaggaccagggtcatctacgtgcacaacagccctggggcccacctgctgcctgacaaggtgacccacacagtgaacaagggggacacagctgtgctgagcgcccgggtgcacaaggagaagcagacagatgtgatctggaagagcaatggcagctacttctacaccctggactggcatgaggcccaggacggccgcttcctgctgcagctgcccaacgtgcagccccccagcagcggcatctacagcgccacctacctggaggccagccccctgggcagcgccttcttccggctgattgtgcggggctgtggggccggccgctggggccctggctgcaccaaggaatgtcctggctgcctgcatggaggagtgtgccacgaccatgatggagaatgtgtgtgccccccaggcttcaccggcacccgctgtgagcaggcctgccgggagggccgcttcggccagagctgccaggagcagtgccccggcatcagcggctgccggggcctgaccttctgcctgcctgacccctacggctgcagctgtggcagcggctggaggggcagccagtgccaggaggtgcaccagggccactgtggggcccgggaggaccacagctag

SEQ ID NO: 22375 - DNA, 1266 bp, Artificial Sequence
  Description of Artificial Sequence: Synthetic coding sequence
atgagggccagcatccagggcctgggggactggagcaacacagtggaggagagcaccctgggcaatggcctgcaggccgagggccctgtgcaggagagcagagctgctgaggagggcctggaccagcagctgatcctggccgtggtgggctctgtgtctgccacctgcctgaccatcctggccgccctgctgaccctggtgtgcatccgccgcagctgcctgcacagaagaaggaccttcacctaccagagcggcagcggggaggagaccatcctgcagttcagcagcggcaccctgaccctgacccggcggcccaagctgcagcctgagcccctgagctaccctgtgctggagtgggaggacatcacctttgaagatctcatcggggagggcaactttggccaggtgatccgggccatgatcaagaaggatggcctgaagatgaatgctgccatcaagatgctgaaggagtatgcctctgaaaatgaccaccgggactttgctggggagctggaggtgctgtgcaagctgggccaccaccccaacatcatcaacctgctgggcgcctgcaagaacagaggctacctgtacatcgccatcgagtatgccccctacggcaacctgctggacttcctgaggaagagccgggtgctggagacagatcctgcctttgcccgggagcacggcacagccagcaccctgagcagccggcagctgctgcgctttgccagtgatgctgccaacggcatgcagtacctgtctgagaagcagttcatccaccgggacctggccgccagaaatgtgctggtgggggagaacctggccagcaagattgctgactttggcctgagcagaggagaggaggtgtatgtgaagaagaccatgggccgcctgcctgtgcgctggatggccatcgagagcctgaactacagcgtgtacaccaccaagagtgatgtgtggagctttggagtgctgctgtgggagatcgtgtccctgggcggcaccccctactgcggcatgacctgtgccgagctgtatgagaagctgccccagggctacaggatggagcagcccaggaactgtgatgatgaggtgtatgagctgatgaggcagtgctggagggaccggccctatgaaagacctccatttgcccagatcgccctgcagctgggccgcatgctggaggccaggaaggcctacgtgaacatgagcctgtttgagaacttcacctacgccggcattgatgccacagctgaggaggcctag

SEQ ID NO: 22376 - DNA, 1140 bp, Artificial Sequence
  Description of Artificial Sequence: Synthetic coding sequence
atggtgtggagggtgccccccttcctgctgcccatcctcttcctggccagccacgtgggcgctgctgtggacctgaccctgctggccaacctgcggctgacagacccccagcgcttcttcctgacctgtgtgtctggagaggccggggccggccggggcagtgatgcctggggcccccccctgctgctggagaaggatgacagaattgtgaggaccccacctggcccccccctgcggctggccagaaatggcagccaccaggtgaccctgcggggcttcagcaagcccagcgacctggtgggcgtcttcagctgtgtgggcggggccggggcccggaggaccagggtcatctacgtgcacaacagccctggggcccacctgctgcctgacaaggtgacccacacagtgaacaagggggacacagctgtgctgagcgcccgggtgcacaaggagaagcagacagatgtgatctggaagagcaatggcagctacttctacaccctggactggcatgaggcccaggacggccgcttcctgctgcagctgcccaacgtgcagccccccagcagcggcatctacagcgccacctacctggaggccagccccctgggcagcgccttcttccggctgattgtgcggggctgtggggccggccgctggggccctggctgcaccaaggaatgtcctggctgcctgcatggaggagtgtgccacgaccatgatggagaatgtgtgtgccccccaggcttcaccggcacccgctgtgagcaggcctgccgggagggccgcttcggccagagctgccaggagcagtgccccggcatcagcggctgccggggcctgaccttctgcctgcctgacccctacggctgcagctgtggcagcggctggaggggcagccagtgccaggaggcctgtgcccctggccactttggagctgactgccgcctgcagtgccagtgccagaatggaggcacctgtgaccgcttcagcggctgtgtgtgccccagcggctggcacggcgtgcactgtgagaagagcggctggagggactgggtggacaccagcacagagaagcagaacacagatgagggccgctttggaggccacgtgtctgcccctgtgggcgcccctggatag

SEQ ID NO: 22377 - DNA, 819 bp, Artificial Sequence
  Description of Artificial Sequence: Synthetic coding sequence
atggccctgctggtgcgggtgctgaggaaccagaccagcatcagccagtgggtgcctgtgtgcagccgcctcatccctgtgagccccacccagggccagggcgaccgggccctgagcaggaccagccagtggccccagatgagccagagccgggcctgtggcggcagcgagcagatccctggcatcgacatccagctgaacaggaagtaccacaccaccaggaagctgagcaccaccaaggacagcccccagcctgtggaggagaaggtgggcgccttcaccaagatcatcgaggccatgggcttcaccggccccctgaagtaccgctgccagatgccagacaccttcaacagctggttcctgatcaccctgctgcacgtgtggatgtgcctggtgaggatgaagcaggagggccgcagcggcaagtacatgtgccgcatcatcgtgcacttcatgtgggaggatgtgcagcagaggggccgggtgatgggcgtgaacccctacatcctgaagaagaacatgatcctgatgaccaaccacttctatgctgccatcctgggctatgatgagggcatcctgagtgatgaccacggcctggccgccgccctgtggaggaccttcttcaacagaaaatgtgaggaccccaggcacctggagctgctggtggagtatgtgaggaagcagatccagtacctggacagcatgaatggagaggacctgctgctgactggagaggtgtcctggaggcccctggtggagaagaacccccagagcatcctgaagccccacagccccacctacaatgatgagggcctgtag

SEQ ID NO: 22378 - DNA, 564 bp, Artificial Sequence
  Description of Artificial Sequence: Synthetic coding sequence
atgcagcccatcgacacctgtgtgtcctaccccaggactggaggccagggctctgtgagccacttccctggctgccagatgccagacaccttcaacagctggttcctgatcaccctgctgcacgtgtggatgtgcctggtgaggatgaagcaggagggccgcagcggcaagtacatgtgccgcatcatcgtgcacttcatgtgggaggatgtgcagcagaggggccgggtgatgggcgtgaacccctacatcctgaagaagaacatgatcctgatgaccaaccacttctacgccgccatcctgggctatgatgagggcatcctgagtgatgaccacggcctggccgccgccctgtggaggaccttcttcaacagaaaatgtgaggaccccaggcacctggagctgctggtggagtatgtgaggaagcagatccagtacctggacagcatgaatggagaggacctgctgctgaccggggaggtgtcctggaggcccctggtggagaagaacccccagagcatcctgaagccccacagccccacctacaatgatgagggcctgtag

SEQ ID NO: 22379 - DNA, 696 bp, Artificial Sequence
  Description of Artificial Sequence: Synthetic coding sequence
atggccctgctggtgcgggtgctgaggaaccagaccagcatcagccagtgggtgcctgtgtgcagccgcctcatccctgtgagccccacccagggccagggcgaccgggccctgagcaggaccagccagaagatcaagattgctgccctgaggatgtacaccagctgtgtggagaagacagactttgaggagttcttcctgcgctgccagatgccagacaccttcaacagctggttcctgatcaccctgctgcacgtgtggatgtgcctggtgaggatgaagcaggagggccgcagcggcaagtacatgtgccgcatcatcgtgcacttcatgtgggaggatgtgcagcagaggggccgggtgatgggcgtgaacccctacatcctgaagaagaacatgatcctgatgaccaaccacttctacgccgccatcctgggctatgatgagggcatcctgagtgatgaccacggcctggccgccgccctgtggaggaccttcttcaacagaaaatgtgaggaccccaggcacctggagctgctggtggagtatgtgaggaagcagatccagtacctggacagcatgaatggagaggacctgctgctgaccggggaggtgtcctggaggcccctggtggagaagaacccccagagcatcctgaagccccacagccccacctacaatgatgagggcctgtag

SEQ ID NO: 22380 - DNA, 822 bp, Artificial Sequence
  Description of Artificial Sequence: Synthetic coding sequence
atggccctgctggtgcgggtgctgaggaaccagaccagcatcagccagtgggtgcctgtgtgcagccgcctcatccctgtgagccccacccagggccagggcgaccgggccctgagcaggaccagccagtggccccagatgagccagagccgggcctgtggcggcagcgagcagatccctggcatcgacatccagctgaacaggaagtaccacaccaccaggaagctgagcaccaccaaggacagcccccagcctgtggaggagaaggtgggcgccttcaccaagatcatcgaggccatgggcttcaccggccccctgaagtacagcaagtggaagatcaagattgctgccctgaggatgtacaccagctgtgtggagaagacagactttgaggagttcttcctgcgctgccagatgccagacaccttcaacagctggttcctgatcaccctgctgcacgtgtggatgtgcctggtgaggatgaagcaggagggccgcagcggcaagtacatgtgccgcatcatcgtgcacttcatgtgggaggatgtgcagcagaggggccgggtgatgggcggcatcctgagtgatgaccacggcctggccgccgccctgtggaggaccttcttcaacagaaaatgtgaggaccccaggcacctggagctgctggtggagtatgtgaggaagcagatccagtacctggacagcatgaatggagaggacctgctgctgaccggggaggtgtcctggaggcccctggtggagaagaacccccagagcatcctgaagccccacagccccacctacaatgatgagggcctgtag

SEQ ID NO: 22381 - DNA, 900 bp, Artificial Sequence
  Description of Artificial Sequence: Synthetic coding sequence
atggccctgctggtgcgggtgctgaggaaccagaccagcatcagccagtgggtgcctgtgtgcagccgcctcatccctgtgagccccacccagggccagggcgaccgggccctgagcaggaccagccagtggccccagatgagccagagccgggcctgtggcggcagcgagcagatccctggcatcgacatccagctgaacaggaagtaccacaccaccaggaagctgagcaccaccaaggacagcccccagcctgtggaggagaaggtgggcgccttcaccaagatcatcgaggccatgggcttcaccggccccctgaagtacagcaagtggaagatcaagattgctgccctgaggatgtacaccagctgtgtggagaagacagactttgaggagttcttcctgcgctgccagatgccagacaccttcaacagctggttcctgatcaccctgctgcacgtgtggatgtgcctggtgaggatgaagcaggagggccgcagcggcaagtacatgtgccgcatcatcgtgcacttcatgtgggaggatgtgcagcagaggggccgggtgatgggcgtgaacccctacatcctgaagaagaacatgatcctgatgaccaaccacttctacgccgccatcctgggctatgatgagggcatcctgagtgatgaccacggcctggccgccgccctgtggaggaccttcttcaacagaaaatgtgaggaccccaggcacctggagctgctggtggagtatgtgaggaagcagatccagtacctggacagcatgaatggagaggacctgctgctgaccggggaggtgtcctggaggcccctggtggagaagaacccccagagcatcctgaagccccacagccccacctacaatgatgagggcctgtag

SEQ ID NO: 22382 - DNA, 603 bp, Artificial Sequence
  Description of Artificial Sequence: Synthetic coding sequence
atgggcttcaccggccccctgaagtacagcaagtggaagatcaagattgctgccctgaggatgtacaccagctgtgtggagaagacagactttgaggagttcttcctgcgctgccagatgccagacaccttcaacagctggttcctgatcaccctgctgcacgtgtggatgtgcctggtgaggatgaagcaggagggccgcagcggcaagtacatgtgccgcatcatcgtgcacttcatgtgggaggatgtgcagcagaggggccgggtgatgggcgtgaacccctacatcctgaagaagaacatgatcctgatgaccaaccacttctatgctgccatcctgggctatgatgagggcatcctgagtgatgaccacggcctggccgccgccctgtggaggaccttcttcaacagaaaatgtgaggaccccaggcacctggagctgctggtggagtatgtgaggaagcagatccagtacctggacagcatgaatggagaggacctgctgctgactggagaggtgtcctggaggcccctggtggagaagaacccccagagcatcctgaagccccacagccccacctacaatgatgagggcctgtag

SEQ ID NO: 22383 - DNA, 489 bp, Artificial Sequence
  Description of Artificial Sequence: Synthetic coding sequence
atggccctgctggtgcgggtgctgaggaaccagaccagcatcagccagtgggtgcctgtgtgcagccgcctcatccctgtgagccccacccagggccagggcgaccgggccctgagcaggaccagccagtggccccagatgagccagagccgggcctgtggcggcagcgagcagatccctggcatcgacatccagctgaacaggaagtaccacaccacccccatcctgggctatgatgagggcatcctgagtgatgaccacggcctggccgccgccctgtggaggaccttcttcaacagaaaatgtgaggaccccaggcacctggagctgctggtggagtatgtgaggaagcagatccagtacctggacagcatgaatggagaggacctgctgctgactggagaggtgtcctggaggcccctggtggagaagaacccccagagcatcctgaagccccacagccccacctacaatgatgagggcctgtag

SEQ ID NO: 22384 - DNA, 435 bp, Artificial Sequence
  Description of Artificial Sequence: Synthetic coding sequence
atgtgcctggtgaggatgaagcaggagggccgcagcggcaagtacatgtgccgcatcatcgtgcacttcatgtgggaggatgtgcagcagaggggccgggtgatgggcgtgaacccctacatcctgaagaagaacatgatcctgatgaccaaccacttctatgctgccatcctgggctatgatgagggcatcctgagtgatgaccacggcctggccgccgccctgtggaggaccttcttcaacagaaaatgtgaggaccccaggcacctggagctgctggtggagtatgtgaggaagcagatccagtacctggacagcatgaatggagaggacctgctgctgactggagaggtgtcctggaggcccctggtggagaagaacccccagagcatcctgaagccccacagccccacctacaatgatgagggcctgtag

SEQ ID NO: 22385 - DNA, 447 bp, Artificial Sequence
  Description of Artificial Sequence: Synthetic coding sequence
atggccctgctggtgcgggtgctgaggaaccagaccagcatcagccagtgggtgcctgtgtgcagccgcctcatccctgtgagccccacccagggccagggcgaccgggccctgagcaggaccagccagtggccccagatgagccagagccgggcctgtggcggcagcgagcagatccctggcatcgacatccagctgaacaggaagtaccacaccaccaggaagctgagcaccaccaaggacagcccccagcctgtggaggagaaggtgggcgccttcaccaagatcatcgaggccatgggcttcaccggccccctgaagtacagcaagtgggatgtgagcagccccaatgaagctggccggcctgagtgggaggtgcacgtgtcctaccacagcagcttctacgtgggcggctgcagcgctgcccggcagagccacggcggctag

SEQ ID NO: 22386 - DNA, 825 bp, Artificial Sequence
  Description of Artificial Sequence: Synthetic coding sequence
atgctgtctgtggccagccgcagcggcccctttgcccctgtgctgagcgccaccagcagaggagtggccggggccctgcggcccctggtgcaggccaccgtgcctgccaccccagagcagcctgtgctggacctgaagaggcccttcctgagccgggagagcctgagcggccaggccgtgagaagacccctggtggcctctgtgggcctgaatgtgcctgcctctgtgtgctacagccacacagacatcaaggtgcctgacttcagcgagtaccgccgcctggaggtgctggacagcaccaagagcagccgggagagcagcgaggccaggaagggcttctcctacctggtgactggagtgaccaccgtgggcgtggcctatgctgccaagaatgctgtgacccagtttgtgtcctccatgtctgccagcgcagatgtgctggccctggccaagattgagatcaagctgagtgacatccctgagggcaagaacatggccttcaagtggaggggcaagcccctgtttgtgcgccacaggacccagaaggagattgagcaggaggccgctgtggagctgagccagctgcgggacccccagcacgacctggacagagtgaagaagccagagtgggtgatcctgattggagtgtgcacccacctgggctgtgtgcccatcgccaatgctggggactttggaggctactactgcccctgccacggcagccactatgatgccagcggccgcatccggctgggccctgcccccctgaacctggaggtgcccacctatgagttcaccagtgatgacatggtgattgtgggctag

SEQ ID NO: 22387 - DNA, 1221 bp, Artificial Sequence
  Description of Artificial Sequence: Synthetic coding sequence
atggctgctggagctggagctggcagcgccccccgctggctgcgggccctgtctgagcccctgtctgctgcccagctgcggcggctggaggagcaccgctacagcgctgctggggtgtccctgctggagccccccctgcagctgtactggacctggctgctgcagtggatccccctgtggatggcccccaacagcatcaccctgctgggcctggccgtgaatgtggtgaccaccctggtgctgatctcctactgccccacagccacagaggaggccccctactggacctacctgctgtgtgccctgggcctcttcatctaccagagcctggatgccattgatggcaagcaggcccggaggaccaacagctgcagccccctgggggagctgtttgaccacggctgtgacagcctgagcaccgtcttcatggctgtgggcgccagcattgctgcccggctgggcacctacccagactggttcttcttctgcagcttcatcggcatgtttgtgttctactgtgcccactggcagacctacgtgtctggcatgctgcgctttgggaaggtggatgtgacagagatccagatcgccctggtgattgtgtttgtgctgagcgcctttggaggagccaccatgtgggactacaccatccccatcctggagatcaagctgaagatcctgcctgtgctgggcttcctgggcggcgtcatcttcagctgcagcaactacttccacgtgatcctgcatggaggagtgggcaagaatggcagcaccatcgccggcacctctgtgctgagccctggcctgcacatcggcctcatcatcatcctggccatcatgatctacaagaagagcgccacagatgtgtttgagaagcacccctgcctgtacatcctgatgtttggctgtgtgtttgccaaggtgtcccagaagctggtggtggcccacatgaccaagtctgagctgtacctgcaggacacagtgttcctgggccctggcctgctcttcctggaccagtacttcaacaacttcattgatgaatatgtggtgctgtggatggccatggtgatcagcagctttgacatggtgatctacttcagcgccctgtgcctgcagatcagccgccacctgcacctgaacatcttcaagacagcctgccaccaggcccctgagcaggtgcaggtgctgagcagcaagagccaccagaacaacatggactag

SEQ ID NO: 22388 - DNA, 2508 bp, Artificial Sequence
  Description of Artificial Sequence: Synthetic coding sequence
atggccgagctgtctgaggaggccctgctgtctgtgctgcccaccatccgggtgcccaaggccggggacagagtgcacaaggatgaatgtgccttctcctttgacaccccagagagcgagggcggcctgtacatctgcatgaacaccttcctgggctttgggaagcagtatgtggagcggcacttcaacaagacaggccagagggtgtacctgcacctgcggaggacccggcggcccaaggaggaggaccctgccaccggcaccggggacccccccaggaagaagcccacccggctggccatcggcgtggagggcggctttgacctgtctgaggagaagtttgagctggatgaagatgtgaagatcgtcatcctgcctgactacctggagatcgccagagatggcctgggcggcctgcctgacatcgtgcgggacagagtgaccagcgctgtggaggccctgctgtctgctgacagcgccagcaggaagcaggaggtgcaggcctgggatggagaggtgcggcaggtgtccaagcacgccttcagcctgaagcagctggacaacccagcccgcatccccccctgtggctggaagtgcagcaaatgtgacatgagggagaacctgtggctgaacctgacagatggcagcatcctgtgtggccgccgctactttgatggcagcggcggcaacaaccacgctgtggagcactaccgggagaccggctaccccctggccgtgaagctgggcaccatcaccccagatggagcagatgtgtacagctatgatgaagatgacatggtgctggaccccagcctggccgagcacctgagccactttggaattgacatgctgaagatgcagaagacagacaagaccatgacagagctggagattgacatgaaccagagaattggagagtgggagctgatccaggagagcggcgtgcccctgaagcccctgtttggacctggctacacaggcatccggaacctgggcaacagctgctacctgaacagcgtggtgcaggtgctcttcagcatcccagacttccagaggaaatatgtggacaagctggagaagatcttccagaatgcccccacagaccccacccaggacttcagcacccaggtggccaagctgggccacggcctgctgagcggggagtacagcaagcctgtgcctgagagcggagatggagagcgggtgcctgagcagaaggaggtgcaggacggcatcgcccccaggatgttcaaggccctgattggcaagggccaccctgagttcagcaccaaccggcagcaggatgcccaggagttcttcctgcacctgatcaacatggtggagaggaactgccgcagcagcgagaaccccaatgaggtgttccgcttcctggtggaggagaagatcaagtgcctggccacagagaaggtgaagtacacccagagggtggactacatcatgcagctgcctgtgcccatggatgctgccctgaacaaggaggagctgctggagtatgaggagaagaagaggcaggccgaggaggagaagatggccctgcctgagctggtgcgggcccaggtgcccttcagcagctgcctggaggcctacggggcccctgagcaggtggatgacttctggagcacagccctgcaggccaagtctgtggccgtgaagaccaccaggtttgccagcttcccagactacctggtgatccagatcaagaagttcaccttcggcctggactgggtgcccaagaagctggatgtgtccattgagatgcctgaggagctggacatcagccagctgcggggcaccggcctgcagcctggagaggaggagctgcctgacatcgccccacccctggtgaccccagatgagcccaaggcccccatgctggatgaatctgtcatcatccagctggtggagatgggcttccccatggatgcctgcaggaaggctgtgtactacacaggcaacagcggggctgaggccgccatgaactgggtgatgagccacatggatgatcctgactttgccaaccccctcatcctgcccggcagcagcggccctggcagcaccagcgctgctgctgaccccccacctgaggactgtgtgaccaccatcgtgtccatgggcttcagccgggaccaggccctgaaggccctgcgggccaccaacaacagcctggagagagctgtggactggatcttcagccacattgatgacctggatgctgaggccgccatggacatcagcgagggccgctctgctgctgacagcatcagcgagagcgtgcctgtgggccccaaggtgagagatggccctgggaagtaccagctgtttgccttcatcagccacatgggcaccagcaccatgtgtggccactacgtgtgccacatcaagaaggagggccgctgggtgatctacaatgaccagaaggtgtgtgccagcgagaagccacccaaggacctgggctacatctacttctaccagagggtggccagctag

SEQ ID NO: 22389 - DNA, 2385 bp, Artificial Sequence
  Description of Artificial Sequence: Synthetic coding sequence
atggctgatgcctgggaggagatccggcggctggccgctgacttccagagggcccagtttgctgaggccacccagaggctgtctgagaggaactgcattgaaattgtgaacaagctgattgcccagaagcagctggaggtggtgcacaccctggatggcaaggagtacatcaccccagcccagatcagcaaggagatgagagatgagctgcacgtgcggggcggccgggtgaacatcgtggacctgcagcaggtgatcaacgtggacctgatccacatcgagaacagaattggagacatcatcaagtctgagaagcacgtgcagctggtgctgggccagctgattgatgagaactacctggaccggctggccgaggaggtgaatgacaagctgcaggagagcggccaggtgaccatcagcgagctgtgcaagacctatgacctgcccggcaacttcctgacccaggccctgacccagaggctgggccgcatcatcagcggccacatcgacctggacaacagaggagtcatcttcacagaggcctttgtggcccggcacaaggcccgcatccggggcctcttcagcgccatcacccggcccacagctgtgaacagcctcatcagcaaatatggcttccaggagcagctgctgtacagcgtgctggaggagctggtgaacagcggccgcctgcggggcaccgtggtgggcggccggcaggacaaggctgtgtttgtgcctgacatctacagcaggacccagagcacctgggtggacagcttcttccggcagaatggctacctggagtttgatgccctgagccggctgggcatcccagatgctgtgtcctacatcaagaagcgctacaagaccacccagctgctcttcctgaaggccgcctgtgtgggccagggcctggtggaccaggtggaggcctctgtggaggaggccatcagcagcggcacctgggtggacatcgcccccctgctgcccaccagcctgtctgtggaggatgctgccatcctgctgcagcaggtgatgagggccttcagcaagcaggccagcacagtggtgttcagtgacacagtggtggtgtctgagaagttcatcaatgactgcacagagctgttccgggagctgatgcaccagaaggccgagaaggagatgaagaacaaccctgtgcacctgatcacagaggaggacctgaagcagatcagcaccctggagagcgtgtccaccagcaagaaggacaagaaggatgaaagaagaaggaaggccacagagggcagcggctccatgaggggcggcggcggcggcaatgcccgggagtacaagatcaagaaggtgaagaagaagggcaggaaggatgatgacagtgatgatgagagccagagcagccacacaggcaagaagaagccagagatctccttcatgttccaggatgaaattgaggacttcctgaggaagcacatccaggatgcccctgaggagttcatcagcgagctggccgagtacctgatcaagcccctgaacaagacctacctggaggtggtgcgctctgtgttcatgagcagcaccaccagcgccagcggcactggaaggaagaggaccatcaaggacctgcaggaggaggtgagcaacctgtacaacaacatccggctgtttgagaagggcatgaagttctttgctgatgacacccaggccgccctgaccaagcacctgctgaagtctgtgtgcacagacatcaccaacctgatcttcaacttcctggccagtgacctgatgatggctgtggatgatcctgctgccatcaccagcgagatcaggaagaagatcctgagcaagctgtctgaggagaccaaggtggccctgaccaagctgcacaacagcctgaatgagaagagcattgaggacttcatcagctgcctggacagcgctgctgaggcctgtgacatcatggtgaagagaggagacaagaagcgggagcggcagatcctcttccagcaccggcaggccctggccgagcagctgaaggtgacagaggaccctgccctgatcctgcacctgacctctgtgctgctcttccagttcagcacccacagcatgctgcacgcccctggccgctgtgtgccccagatcatcgccttcctgaacagcaagatccctgaggaccagcacgccctgctggtgaagtaccagggcctggtggtgaagcagctggtgtcccagagcaagaagacaggccagggcgactaccccctgaacaatgagctggacaaggagcaggaggatgtggccagcaccaccaggaaggagctgcaggagctgagcagcagcatcaaggacctggtgctgaagagcaggaagagctctgtgacagaggagtag

SEQ ID NO: 22390 - DNA, 942 bp, Artificial Sequence
  Description of Artificial Sequence: Synthetic coding sequence
atgattggccagaagaccctgtacagcttcttcagccccagccctgccaggaagagacatgcccccagccctgagcctgctgtgcagggcactggagtggccggcgtgcctgaggagagcggagatgctgctgccatcccagccaagaaggccccagctggccaggaggagcccggcaccccacccagcagccccctgtctgctgagcagctggaccgcatccagaggaacaaggccgccgccctgctgcggctggccgccagaaatgtgcctgtgggctttggagagagctggaagaagcacctgtctggagaatttgggaagccctacttcatcaagctgatgggctttgtggccgaggagaggaagcactacacagtgtaccccccaccccaccaggtgttcacctggacccagatgtgtgacatcaaggatgtgaaggtggtgatcctgggccaggacccctaccacggccccaaccaggcccacggcctgtgcttctctgtgcagaggcctgtgcccccaccacccagcctggagaacatctacaaggagctgagcacagacattgaagattttgtgcaccctggccacggggacctgagcggctgggccaagcagggcgtgctgctgctgaatgctgtgctgactgtgcgggcccaccaggccaacagccacaaggagcggggctgggagcagttcacagatgctgtggtgtcctggctgaaccagaacagcaatggcctggtgttcctgctgtggggcagctatgcccagaagaagggcagcgccatcgacaggaagaggcaccacgtgctgcagacagcccaccccagccccctgtctgtgtaccggggcttcttcggctgccgccacttcagcaagaccaatgagctgctgcagaagagcggcaagaagcccatcgactggaaggagctgtag

SEQ ID NO: 22391 - DNA, 915 bp, Artificial Sequence
  Description of Artificial Sequence: Synthetic coding sequence
atgggcgtcttctgcctgggcccctggggcctgggcaggaagctgcggacccctgggaagggccccctgcagctgctgagccggctgtgtggggaccacctgcaggccatcccagccaagaaggccccagctggccaggaggagcccggcaccccacccagcagccccctgtctgctgagcagctggaccgcatccagaggaacaaggctgctgccctgctgcggctggccgccagaaatgtgcctgtgggctttggagagagctggaagaagcacctgagcggggagtttgggaagccctacttcatcaagctgatgggctttgtggccgaggagaggaagcactacacagtgtaccccccaccccaccaggtgttcacctggacccagatgtgtgacatcaaggatgtgaaggtggtgatcctgggccaggacccctaccacggccccaaccaggcccacggcctgtgcttctctgtgcagaggcctgtgcccccaccacccagcctggagaacatctacaaggagctgagcacagacatcgaggactttgtgcaccctggccatggagacctgagcggctgggccaagcagggcgtgctgctgctgaatgctgtgctgactgtgcgggcccaccaggccaacagccacaaggagcggggctgggagcagttcacagatgctgtggtgtcctggctgaaccagaacagcaatggcctggtgttcctgctgtggggcagctatgcccagaagaagggcagcgccatcgacaggaagaggcaccacgtgctgcagacagcccaccccagccccctgtctgtgtaccggggcttcttcggctgccgccacttcagcaagaccaatgagctgctgcagaagagcggcaagaagcccatcgactggaaggagctgtag

SEQ ID NO: 22392 - DNA, 813 bp, Artificial Sequence
  Description of Artificial Sequence: Synthetic coding sequence
atgggcgtcttctgcctgggcccctggggcctgggcaggaagctgcggacccctgggaagggccccctgtctgctgagcagctggaccgcatccagaggaacaaggctgctgccctgctgcggctggccgccagaaatgtgcctgtgggctttggagagagctggaagaagcacctgagcggggagtttgggaagccctacttcatcaagctgatgggctttgtggccgaggagaggaagcactacacagtgtaccccccaccccaccaggtgttcacctggacccagatgtgtgacatcaaggatgtgaaggtggtgatcctgggccaggacccctaccacggccccaaccaggcccacggcctgtgcttctctgtgcagaggcctgtgcccccaccacccagcctggagaacatctacaaggagctgagcacagacatcgaggactttgtgcaccctggccatggagacctgagcggctgggccaagcagggcgtgctgctgctgaatgctgtgctgactgtgcgggcccaccaggccaacagccacaaggagcggggctgggagcagttcacagatgctgtggtgtcctggctgaaccagaacagcaatggcctggtgttcctgctgtggggcagctatgcccagaagaagggcagcgccatcgacaggaagaggcaccacgtgctgcagacagcccaccccagccccctgtctgtgtaccggggcttcttcggctgccgccacttcagcaagaccaatgagctgctgcagaagagcggcaagaagcccatcgactggaaggagctgtag

SEQ ID NO: 22393 - DNA, 9288 bp, Artificial Sequence
  Description of Artificial Sequence: Synthetic coding sequence
atggtgtttgaatctgtggtggtggatgtgctgaaccgcttcctgggggactatgtggtggacctggacaccagccagctgagcctgggcatctggaagggagctgtggccctgaagaacctgcagatcaaggaaaatgccctgagccagctggatgtgcccttcaaggtgaaggtgggccacatcggcaacctgaagctgatcatcccctggaagaacctgtacacccagcctgtggaggccgtgctggaggagatctacctgctgattgtgcccagcagccgcatcaagtatgaccccctgaaggaggagaagcagctgatggaggccaagcagcaggagctgaagagaattgaggaggccaagcagaaggtggtggaccaggagcagcacctgcctgagaagcaggacacctttgctgagaagctggtgacccagatcatcaagaacctgcaggtgaagatcagcagcatccacatccgctatgaagatgacatcaccaacagagacaagcccctgagctttggcatcagcctgcagaacctgtccatgcagaccacagaccagtactgggtgccctgcctgcatgatgaaacagagaagctggtgaggaagctgatccggctggacaacctgtttgcctactggaatgtgaagagccagatgttctacctgagtgactatgacaacagcctggatgacctgaagaatggaattgtgaatgaaaacatcgtgcctgagggctatgactttgtgttccggcccatcagcgccaatgccaagctggtgatgaacagaagaagtgactttgacttcagcgcccccaagatcaacctggagattgagctgcacaacatcgccatcgagttcaacaagccccagtacttcagcatcatggagctgctggagagcgtggacatgatggcccagaacctgccctacaggaagttcaagccagatgtgcccctgcaccaccacgcccgggagtggtgggcctatgccatccacggcgtgctggaggtgaatgtgtgcccccggctgtggatgtggagctggaagcacatcaggaagcaccggcagaaggtgaagcagtacaaggagctgtacaagaagaagctgaccagcaagaagcccccaggagagctgctggtgtccctggaggagctggagaagaccctggatgtgttcaacatcaccatcgcccggcagacagctgaggtggaggtgaagaaggccggctacaagatctacaaggagggcgtgaaggaccctgaggacaacaagggctggttctcctggctgtggagctggagcgagcagaacaccaatgagcagcagccagatgtgcagcctgagaccctggaggagatgctgaccccagaggagaaggccctgctgtatgaggccatcggctacagcgagacagctgtggaccccaccctgctgaagacctttgaggccctgaagttctttgtgcacctgaagtccatgagcatcgtgctgcgggagaaccaccagaagccagagctggtggacatcgtgattgaggagttcagcaccctcatcgtgcagaggcctggggcccaggccatcaagtttgagaccaagattgacagcttccacatcaccggcctgcctgacaacagcgagaagccccggctgctgagcagcctggatgatgccatgagcctcttccagatcacctttgagatcaaccccctggatgaaacagtgtcccagcgctgcatcatcgaggccgagcccctggagatcatctatgatgccaggacagtgaacagcatcgtggagttcttccggccccccaaggaggtgcacctggcccagctgacagctgccaccctgaccaagctggaggagttccgcagcaagacagccaccggcctgctgtacatcatcgagacccagaaggtgctggacctgaagatcaacctgaaggccagctacatcatcgtgccccaggacggcatcttcagccccaccagcaacctgctgctgctggacctgggccacctgaaggtgaccagcaagagccgctctgagctgcctgatgtgaagcagggcgaggccaacctgaaggagatcatggaccgggcctatgacagctttgacatccagctgacctctgtgcagctgctgtacagccgggtgggggacaactggagggaggccaggaagctgtctgtgtccacccagcacatcctggtgcccatgcacttcaacctggagctgagcaaggccatggtgttcatggatgtgaggatgcccaagttcaagatctacggcaagctgcccctcatcagcctgcgcatcagtgacaagaagctgcagggcatcatggagctgattgagagcatccccaagccagagcctgtgacagaggtgtctgcccctgtgaagagcttccagatccagaccagcaccagcctgggcaccagccagatcagccagaagatcatccccctgctggagctgcccagcgtgtctgaagatgattctgaggaggagttctttgatgccccctgcagccccctggaggagcccctgcagttccccactggagtgaagagcatccgcaccaggaagctgcagaagcaggactgcagcgtgaacatgaccaccttcaagatccgctttgaggtgcccaaggtgctgattgagttctaccacctggtgggggactgtgagctgtctgtggtggagatcctggtgctgggcctgggcgctgagattgagatccgcacctatgacctgaaggccaatgccttcctgaaggagttctgcctgaagtgcccagagtacctggatgagaacaagaagcctgtgtacctggtgaccaccctggacaacaccatggaggacctgctgaccctggagtatgtgaaggccgagaagaatgtgcctgacctgaagagcacctacaacaacgtgctgcagctgatcaaggtgaacttcagcagcctggacatccacctgcacacagaggccctgctgaacaccatcaactacctgcacaacatcctgccccagagcgaggagaagagcgcccctgtgtccaccacagaaacagaggacaagggagatgtgatcaagaagctggccctgaagctgagcaccaatgaagacatcatcaccctgcagatcctggccgagctgagctgcctgcagatcttcatccaggaccagaagtgcaacatcagcgagatcaagattgagggcctggacagcgagatgatcatgaggccttctgaaacagagatcaatgccaagctgaggaacatcatcgtgctggacagcgacatcacagccatctacaagaaggctgtgtacatcaccgggaaggaggtgttctccttcaagatggtgtcctacatggatgccacagctggcagcgcctacacagacatgaatgtggtggacatccaggtgaacctgattgtgggctgcatcgaggtggtgtttgtgaccaagttcctgtacagcatcctggccttcatcgacaacttccaggccgccaagcaggccctggccgaggccaccgtgcaggccgccggcatggccgccactggagtgaaggagctggcccagaggagcagcaggatggccctggacatcaacatcaaggcccctgtggtggtgatcccccagagccctgtgtctgaaaatgtgtttgtggccgactttggcctcatcaccatgaccaacaccttccacatgatcacagagagccagagcagccccccacctgtgattgacctgatcaccatcaagctgtctgagatgaggctgtaccgcagccgcttcatcaatgatgcctaccaggaggtgctggacctgctgctgcccctgaacctggaggtggtggtggagaggaacctgtgctgggagtggtaccaggaggtgccctgcttcaacgtgaatgcccagctgaagcccatggagttcatcctgagccaggaggacatcaccaccatcttcaagaccctgcacggcaacatctggtatgagaaggatggcagcgccagccctgctgtgaccaaggaccagtacagcgccaccagcggcgtgaccaccaatgccagccaccacagcggcggggccaccgtggtgacagctgctgtggtggaggtgcacagccgggccctgctggtgaagaccaccctgaacatctccttcaagacagatgacctgaccatggtgctgtacagccctggccccaagcaggccagcttcacagatgtgcgggaccccagcctgaagctggccgagttcaagctggagaacatcatcagcaccctgaagatgtacacagatggcagcaccttcagcagcttcagcctgaagaactgcatcctggatgacaagaggccccacgtgaagaaggccacccccaggatgattggcctgactgtgggctttgacaagaaggacatgatggacatcaagtacaggaaggtgagagatggctgtgtgacagatgctgtgttccaggagatgtacatctgtgcctctgtggagttcctgcagacagtggccaacgtgttcctggaggcctacaccactggaacagctgtggagacctctgtgcagacctggacagccaaggaggaggtgcccacccaggagagcgtgaagtgggagatcaacgtcatcatcaagaaccctgagatcgtgtttgtggccgacatgaccaagaatgatgccccagccctggtgatcaccacccagtgtgagatctgctacaagggcaacctggagaacagcaccatgacagctgccatcaaggacctgcaggtgcgggcctgccccttcctgcctgtgaagaggaagggcaagatcaccaccgtgctgcagccctgtgacctcttctaccagaccacccagaagggcacagacccccaggtgattgacatgtctgtgaagagcctgaccctgaaggtgtcccctgtgatcatcaacaccatgatcaccatcaccagcgccctgtacaccaccaaggagaccatccctgaggagacagccagcagcacagcccacctgtgggagaagaaggacaccaagaccctgaagatgtggttcctggaggagagcaatgaaacagagaagatcgcccccaccacagagctggtgcccaagggggagatgatcaagatgaacatcgacagcatcttcatcgtgctggaggccggcatcggccacaggacagtgcccatgctgctggccaagagccgcttcagcggggagggcaagaactggagcagcctcatcaacctgcactgccagctggagctggaggtgcactactacaatgagatgtttggagtgtgggagcccctgctggagcccctggagattgaccagacagaggacttccggccctggaacctgggcatcaagatgaagaagaaggccaagatggccatcgtggagagtgaccctgaggaggagaactacaaggtgcctgagtacaagacagtcatctccttccacagcaaggaccagctgaacatcaccctgagcaaatgtggcctggtgatgctgaacaacctggtgaaggccttcacagaagctgccaccggcagcagcgctgactttgtgaaggacctggcccccttcatgatcctgaacagcctgggcctgaccatctctgtgagccccagcgacagcttctctgtgctgaacatccccatggccaagagctatgtgctgaagaatggagagagcctgtccatggactacatccgcaccaaggacaatgaccacttcaatgccatgaccagcctgagcagcaagctgttcttcatcctgctgacccctgtgaaccacagcacagctgacaagatccccctgaccaaggtgggcagaagactctacacagtgcgccaccgggagagcggcgtggagaggagcatcgtgtgccagattgacacagtggagggcagcaagaaggtgaccatccgcagccctgtgcagatccggaaccacttctctgtgcccctgtctgtgtatgaaggagacaccctgctgggcacagccagcccagaaaatgagttcaacatccccctgggcagctaccgctccttcatcttcctgaagccagaagatgagaactaccagatgtgtgagggcatcgactttgaggagatcatcaagaatgatggagccctgctgaagaagaagtgccgcagcaagaaccccagcaaggagagcttcctgatcaacatcgtgcctgagaaggacaacctgaccagcctgtctgtgtacagtgaagatggctgggacctgccctacatcatgcacctgtggccacccatcctgctgaggaacctgctgccctacaagatcgcctactacatcgagggcattgaaaattctgtgttcaccctgtctgagggccacagcgcccagatctgcacagcccagctgggcaaggcccggctgcacctgaagctgctggactacctgaaccacgactggaagtctgagtaccacatcaagcccaaccagcaggacatcagctttgtgtccttcacctgtgtgacagagatggagaagacagacctggacattgctgtgcacatgacctacaacacaggccagacagtggtggccttccacagcccctactggatggtgaacaagacaggccgcatgctgcagtacaaggcagatggcatccacaggaagcacccccccaactacaagaagcctgtgctcttctccttccagcccaaccacttcttcaacaacaacaaggtgcagctgatggtgacagacagcgagctgagcaaccagttcagcattgacacagtgggcagccacggggctgtgaagtgcaagggcctgaagatggactaccaggtgggcgtgaccatcgacctgagcagcttcaacatcacccgcatcgtgaccttcacccccttctacatgatcaagaacaagagcaagtaccacatctctgtggccgaggagggcaatgacaagtggctgagcctggacctggagcagtgcatccccttctggccagaatatgccagcagcaagctgctgatccaggtggagaggagtgaagatcctcccaagaggatctacttcaacaagcaggagaactgcatcctgctgcggctggacaatgagctgggcggcatcatcgccgaggtgaacctggccgagcacagcaccgtcatcaccttcctggactaccatgatggagctgccaccttcctgctgatcaaccacaccaagaatgagctggtgcagtacaaccagagcagcctgtctgaaattgaggacagcctgcccccaggcaaggctgtgttctacacctgggccgaccctgtgggcagccggcggctgaagtggcgctgcaggaagagccacggggaggtgacccagaaggatgacatgatgatgcccatcgacctgggggagaagaccatctacctggtgtccttctttgagggcctgcagaggatcatcctcttcacagaggaccccagggtcttcaaggtgacctatgagagcgagaaggccgagctggccgagcaggagattgctgtggccctgcaggatgtgggcatcagcctggtgaacaactacaccaagcaggaggtggcctacatcggcatcaccagcagtgatgtggtgtgggagaccaagcccaagaagaaggcccgctggaagcccatgtctgtgaagcacacagagaagctggagcgggagttcaaggagtacacagagagcagccccagcgaggacaaggtgatccagctggacaccaacgtgcctgtgcggctgacccccaccggccacaacatgaagatcctgcagccccacgtgattgccctgcggaggaactacctgcctgccctgaaggtggagtacaacaccagcgcccaccagagcagcttccgcatccagatctaccgcatccagatccagaaccagatccatggagctgtgttcccctttgtgttctaccctgtgaagccacccaagtctgtgaccatggacagcgcccccaagcccttcacagatgtgtccatcgtgatgaggtctgctggccacagccagatcagccgcatcaagtacttcaaggtgctgatccaggagatggacctgcggctggacctgggcttcatctatgccctgacagacctgatgacagaggccgaggtgacagagaacacagaggtggagctgttccacaaggacatcgaggccttcaaggaggagtacaagacagccagcctggtggaccagagccaggtgtccctgtatgagtacttccacatcagccccatcaagctgcacctgtctgtgtccctgagcagcggccgggaggaggccaaggacagcaagcagaatggaggcctcatccctgtgcacagcctgaacctgctgctgaagagcattggagccaccctgacagatgtgcaggatgtggtgttcaagctggccttctttgagctgaactaccagttccacaccaccagtgacctgcagagcgaggtgatccgccactacagcaagcaggccatcaagcagatgtatgtgctgatcctgggcctggatgtgctgggcaaccccttcggcctcatccgggagttcagcgagggcgtggaggccttcttctatgagccctaccagggcgccatccagggccctgaggagtttgtggagggcatggccctgggcctgaaggccctggtgggcggcgctgtgggcggcctggccggggccgccagcaagatcactggagccatggccaagggcgtggccgccatgaccatggatgaggactaccagcagaagagaagagaggccatgaacaagcagcctgctggcttccgggagggcatcacccggggcggcaagggcctggtgtctggctttgtgtctggcatcaccggcatcgtgaccaagcccatcaagggggcccagaagggcggggccgccggcttcttcaagggcgtgggcaagggcctggtgggcgctgtggcccggcccaccggcggcatcatcgacatggccagcagcaccttccagggcatcaagagggccacagagaccagcgaggtggagagcctgcggcccccacgcttcttcaatgaagatggagtcatccggccctaccgcctgagagatggcactggaaaccagatgctgcagaagatccagttctaccgggagtggatcatgacccacagcagcagcagtgatgatgatgatgatgatgatgatgatgatgaaagtgacctgaaccactag

SEQ ID NO: 22394 - DNA, 9525 bp, Artificial Sequence
  Description of Artificial Sequence: Synthetic coding sequence
atggtgtttgaatctgtggtggtggatgtgctgaaccgcttcctgggggactatgtggtggacctggacaccagccagctgagcctgggcatctggaagggagctgtggccctgaagaacctgcagatcaaggaaaatgccctgagccagctggatgtgcccttcaaggtgaaggtgggccacatcggcaacctgaagctgatcatcccctggaagaacctgtacacccagcctgtggaggccgtgctggaggagatctacctgctgattgtgcccagcagccgcatcaagtatgaccccctgaaggaggagaagcagctgatggaggccaagcagcaggagctgaagagaattgaggaggccaagcagaaggtggtggaccaggagcagcacctgcctgagaagcaggacacctttgctgagaagctggtgacccagatcatcaagaacctgcaggtgaagatcagcagcatccacatccgctatgaagatgacatcaccaacagagacaagcccctgagctttggcatcagcctgcagaacctgtccatgcagaccacagaccagtactgggtgccctgcctgcatgatgaaacagagaagctggtgaggaagctgatccggctggacaacctgtttgcctactggaatgtgaagagccagatgttctacctgagtgactatgacaacagcctggatgacctgaagaatggaattgtgaatgaaaacatcgtgcctgagggctatgactttgtgttccggcccatcagcgccaatgccaagctggtgatgaacagaagaagtgactttgacttcagcgcccccaagatcaacctggagattgagctgcacaacatcgccatcgagttcaacaagccccagtacttcagcatcatggagctgctggagagcgtggacatgatggcccagaacctgccctacaggaagttcaagccagatgtgcccctgcaccaccacgcccgggagtggtgggcctatgccatccacggcgtgctggaggtgaatgtgtgcccccggctgtggatgtggagctggaagcacatcaggaagcaccggcagaaggtgaagcagtacaaggagctgtacaagaagaagctgaccagcaagaagcccccaggagagctgctggtgtccctggaggagctggagaagaccctggatgtgttcaacatcaccatcgcccggcagacagctgaggtggaggtgaagaaggccggctacaagatctacaaggagggcgtgaaggaccctgaggacaacaagggctggttctcctggctgtggagctggagcgagcagaacaccaatgagcagcagccagatgtgcagcctgagaccctggaggagatgctgaccccagaggagaaggccctgctgtatgaggccatcggctacagcgagacagctgtggaccccaccctgctgaagacctttgaggccctgaagttctttgtgcacctgaagtccatgagcatcgtgctgcgggagaaccaccagaagccagagctggtggacatcgtgattgaggagttcagcaccctcatcgtgcagaggcctggggcccaggccatcaagtttgagaccaagattgacagcttccacatcaccggcctgcctgacaacagcgagaagccccggctgctgagcagcctggatgatgccatgagcctcttccagatcacctttgagatcaaccccctggatgaaacagtgtcccagcgctgcatcatcgaggccgagcccctggagatcatctatgatgccaggacagtgaacagcatcgtggagttcttccggccccccaaggaggtgcacctggcccagctgacagctgccaccctgaccaagctggaggagttccgcagcaagacagccaccggcctgctgtacatcatcgagacccagaaggtgctggacctgaagatcaacctgaaggccagctacatcatcgtgccccaggacggcatcttcagccccaccagcaacctgctgctgctggacctgggccacctgaaggtgaccagcaagagccgctctgagctgcctgatgtgaagcagggcgaggccaacctgaaggagatcatggaccgggcctatgacagctttgacatccagctgacctctgtgcagctgctgtacagccgggtgggggacaactggagggaggccaggaagctgtctgtgtccacccagcacatcctggtgcccatgcacttcaacctggagctgagcaaggccatggtgttcatggatgtgaggatgcccaagttcaagatctacggcaagctgcccctcatcagcctgcgcatcagtgacaagaagctgcagggcatcatggagctgattgagagcatccccaagccagagcctgtgacagaggtgtctgcccctgtgaagagcttccagatccagaccagcaccagcctgggcaccagccagatcagccagaagatcatccccctgctggagctgcccagcgtgtctgaagatgattctgaggaggagttctttgatgccccctgcagccccctggaggagcccctgcagttccccactggagtgaagagcatccgcaccaggaagctgcagaagcaggactgcagcgtgaacatgaccaccttcaagatccgctttgaggtgcccaaggtgctgattgagttctaccacctggtgggggactgtgagctgtctgtggtggagatcctggtgctgggcctgggcgctgagattgagatccgcacctatgacctgaaggccaatgccttcctgaaggagttctgcctgaagtgcccagagtacctggatgagaacaagaagcctgtgtacctggtgaccaccctggacaacaccatggaggacctgctgaccctggagtatgtgaaggccgagaagaatgtgcctgacctgaagagcacctacaacaacgtgctgcagctgatcaaggtgaacttcagcagcctggacatccacctgcacacagaggccctgctgaacaccatcaactacctgcacaacatcctgccccagagcgaggagaagagcgcccctgtgtccaccacagaaacagaggacaagggagatgtgatcaagaagctggccctgaagctgagcaccaatgaagacatcatcaccctgcagatcctggccgagctgagctgcctgcagatcttcatccaggaccagaagtgcaacatcagcgagatcaagattgagggcctggacagcgagatgatcatgaggccttctgaaacagagatcaatgccaagctgaggaacatcatcgtgctggacagcgacatcacagccatctacaagaaggctgtgtacatcaccgggaaggaggtgttctccttcaagatggtgtcctacatggatgccacagctggcagcgcctacacagacatgaatgtggtggacatccaggtgaacctgattgtgggctgcatcgaggtggtgtttgtgaccaagttcctgtacagcatcctggccttcatcgacaacttccaggccgccaagcaggccctggccgaggccaccgtgcaggccgccggcatggccgccactggagtgaaggagctggcccagaggagcagcaggatggccctggacatcaacatcaaggcccctgtggtggtgatcccccagagccctgtgtctgaaaatgtgtttgtggccgactttggcctcatcaccatgaccaacaccttccacatgatcacagagagccagagcagccccccacctgtgattgacctgatcaccatcaagctgtctgagatgaggctgtaccgcagccgcttcatcaatgatgcctaccaggaggtgctggacctgctgctgcccctgaacctggaggtggtggtggagaggaacctgtgctgggagtggtaccaggaggtgccctgcttcaacgtgaatgcccagctgaagcccatggagttcatcctgagccaggaggacatcaccaccatcttcaagaccctgcacggcaacatctggtatgagaaggatggcagcgccagccctgctgtgaccaaggaccagtacagcgccaccagcggcgtgaccaccaatgccagccaccacagcggcggggccaccgtggtgacagctgctgtggtggaggtgcacagccgggccctgctggtgaagaccaccctgaacatctccttcaagacagatgacctgaccatggtgctgtacagccctggccccaagcaggccagcttcacagatgtgcgggaccccagcctgaagctggccgagttcaagctggagaacatcatcagcaccctgaagatgtacacagatggcagcaccttcagcagcttcagcctgaagaactgcatcctggatgacaagaggccccacgtgaagaaggccacccccaggatgattggcctgactgtgggctttgacaagaaggacatgatggacatcaagtacaggaaggtgagagatggctgtgtgacagatgctgtgttccaggagatgtacatctgtgcctctgtggagttcctgcagacagtggccaacgtgttcctggaggcctacaccactggaacagctgtggagacctctgtgcagacctggacagccaaggaggaggtgcccacccaggagagcgtgaagtgggagatcaacgtcatcatcaagaaccctgagatcgtgtttgtggccgacatgaccaagaatgatgccccagccctggtgatcaccacccagtgtgagatctgctacaagggcaacctggagaacagcaccatgacagctgccatcaaggacctgcaggtgcgggcctgccccttcctgcctgtgaagaggaagggcaagatcaccaccgtgctgcagccctgtgacctcttctaccagaccacccagaagggcacagacccccaggtgattgacatgtctgtgaagagcctgaccctgaaggtgtcccctgtgatcatcaacaccatgatcaccatcaccagcgccctgtacaccaccaaggagaccatccctgaggagacagccagcagcacagcccacctgtgggagaagaaggacaccaagaccctgaagatgtggttcctggaggagagcaatgaaacagagaagatcgcccccaccacagagctggtgcccaagggggagatgatcaagatgaacatcgacagcatcttcatcgtgctggaggccggcatcggccacaggacagtgcccatgctgctggccaagagccgcttcagcggggagggcaagaactggagcagcctcatcaacctgcactgccagctggagctggaggtgcactactacaatgagatgtttggagtgtgggagcccctgctggagcccctggagattgaccagacagaggacttccggccctggaacctgggcatcaagatgaagaagaaggccaagatggccatcgtggagagtgaccctgaggaggagaactacaaggtgcctgagtacaagacagtcatctccttccacagcaaggaccagctgaacatcaccctgagcaaatgtggcctggtgatgctgaacaacctggtgaaggccttcacagaagctgccaccggcagcagcgctgactttgtgaaggacctggcccccttcatgatcctgaacagcctgggcctgaccatctctgtgagccccagcgacagcttctctgtgctgaacatccccatggccaagagctatgtgctgaagaatggagagagcctgtccatggactacatccgcaccaaggacaatgaccacttcaatgccatgaccagcctgagcagcaagctgttcttcatcctgctgacccctgtgaaccacagcacagctgacaagatccccctgaccaaggtgggcagaagactctacacagtgcgccaccgggagagcggcgtggagaggagcatcgtgtgccagattgacacagtggagggcagcaagaaggtgaccatccgcagccctgtgcagatccggaaccacttctctgtgcccctgtctgtgtatgaaggagacaccctgctgggcacagccagcccagaaaatgagttcaacatccccctgggcagctaccgctccttcatcttcctgaagccagaagatgagaactaccagatgtgtgagggcatcgactttgaggagatcatcaagaatgatggagccctgctgaagaagaagtgccgcagcaagaaccccagcaaggagagcttcctgatcaacatcgtgcctgagaaggacaacctgaccagcctgtctgtgtacagtgaagatggctgggacctgccctacatcatgcacctgtggccacccatcctgctgaggaacctgctgccctacaagatcgcctactacatcgagggcattgaaaattctgtgttcaccctgtctgagggccacagcgcccagatctgcacagcccagctgggcaaggcccggctgcacctgaagctgctggactacctgaaccacgactggaagtctgagtaccacatcaagcccaaccagcaggacatcagctttgtgtccttcacctgtgtgacagagatggagaagacagacctggacattgctgtgcacatgacctacaacacaggccagacagtggtggccttccacagcccctactggatggtgaacaagacaggccgcatgctgcagtacaaggcagatggcatccacaggaagcacccccccaactacaagaagcctgtgctcttctccttccagcccaaccacttcttcaacaacaacaaggtgcagctgatggtgacagacagcgagctgagcaaccagttcagcattgacacagtgggcagccacggggctgtgaagtgcaagggcctgaagatggactaccaggtgggcgtgaccatcgacctgagcagcttcaacatcacccgcatcgtgaccttcacccccttctacatgatcaagaacaagagcaagtaccacatctctgtggccgaggagggcaatgacaagtggctgagcctggacctggagcagtgcatccccttctggccagaatatgccagcagcaagctgctgatccaggtggagaggagtgaagatcctcccaagaggatctacttcaacaagcaggagaactgcatcctgctgcggctggacaatgagctgggcggcatcatcgccgaggtgaacctggccgagcacagcaccgtcatcaccttcctggactaccatgatggagctgccaccttcctgctgatcaaccacaccaagaatgagctggtgcagtacaaccagagcagcctgtctgaaattgaggacagcctgcccccaggcaaggctgtgttctacacctgggccgaccctgtgggcagccggcggctgaagtggcgctgcaggaagagccacggggaggtgacccagaaggatgacatgatgatgcccatcgacctgggggagaagaccatctacctggtgtccttctttgagggcctgcagaggatcatcctcttcacagaggaccccagggtcttcaaggtgacctatgagagcgagaaggccgagctggccgagcaggagattgctgtggccctgcaggatgtgggcatcagcctggtgaacaactacaccaagcaggaggtggcctacatcggcatcaccagcagtgatgtggtgtgggagaccaagcccaagaagaaggcccgctggaagcccatgtctgtgaagcacacagagaagctggagcgggagttcaaggagtacacagagagcagccccagcgaggacaaggtgatccagctggacaccaacgtgcctgtgcggctgacccccaccggccacaacatgaagatcctgcagccccacgtgattgccctgcggaggaactacctgcctgccctgaaggtggagtacaacaccagcgcccaccagagcagcttccgcatccagatctaccgcatccagatccagaaccagatccatggagctgtgttcccctttgtgttctaccctgtgaagccacccaagtctgtgaccatggacagcgcccccaagcccttcacagatgtgtccatcgtgatgaggtctgctggccacagccagatcagccgcatcaagtacttcaaggtgctgatccaggagatggacctgcggctggacctgggcttcatctatgccctgacagacctgatgacagaggccgaggtgacagagaacacagaggtggagctgttccacaaggacatcgaggccttcaaggaggagtacaagacagccagcctggtggaccagagccaggtgtccctgtatgagtacttccacatcagccccatcaagctgcacctgtctgtgtccctgagcagcggccgggaggaggccaaggacagcaagcagaatggaggcctcatccctgtgcacagcctgaacctgctgctgaagagcattggagccaccctgacagatgtgcaggatgtggtgttcaagctggccttctttgagctgaactaccagttccacaccaccagtgacctgcagagcgaggtgatccgccactacagcaagcaggccatcaagcagatgtatgtgctgatcctgggcctggatgtgctgggcaaccccttcggcctcatccgggagttcagcgagggcgtggaggccttcttctatgagccctaccagggcgccatccagggccctgaggagtttgtggagggcatggccctgggcctgaaggccctggtgggcggcgctgtgggcggcctggccggggccgccagcaagatcactggagccatggccaagggcgtggccgccatgaccatggatgaggactaccagcagaagagaagagaggccatgaacaagcagcctgctggcttccgggagggcatcacccggggcggcaagggcctggtgtctggctttgtgtctggcatcaccggcatcgtgaccaagcccatcaagggggcccagaagggcggggccgccggcttcttcaagggcgtgggcaagggcctggtgggcgctgtggcccggcccaccggcggcatcatcgacatggccagcagcaccttccagggcatcaagagggccacagagaccagcgaggtggagagcctgcggcccccacgcttcttcaatgaagatggagtcatccggccctaccgcctgagagatggcactggaaaccagatgctgcaggtgatggagaatggccgctttgccaagtacaagtacttcacccacgtgatgatcaacaagacagacatgctgatgatcaccaggagaggagtgctgtttgtgaccaagggcaccttcggccagctgacctgtgagtggcagtacagctttgatgagttcaccaaggagcccttcatcgtgcacggccggcggctgcgcatcgaggccaaggagcgggtgaagagcgtcttccacgcccgggagtttgggaagatcatcaacttcaagaccccagaagatgcccgctggatcctgaccaagctgcaggaggcccgggagcccagccccagcctgtag

SEQ ID NO: 22395 - DNA, 9210 bp, Artificial Sequence
  Description of Artificial Sequence: Synthetic coding sequence
atggtgtttgaatctgtggtggtggatgtgctgaaccgcttcctgggggactatgtggtggacctggacaccagccagctgagcctgggcatctggaagggagctgtggccctgaagaacctgcagatcaaggaaaatgccctgagccagctggatgtgcccttcaaggtgaaggtgggccacatcggcaacctgaagctgatcatcccctggaagaacctgtacacccagcctgtggaggccgtgctggaggagatctacctgctgattgtgcccagcagccgcatcaagtatgaccccctgaaggaggagaagcagctgatggaggccaagcagcaggagctgaagagaattgaggaggccaagcagaaggtggtggaccaggagcagcacctgcctgagaagcaggacacctttgctgagaagctggtgacccagatcatcaagaacctgcaggtgaagatcagcagcatccacatccgctatgaagatgacatcaccaacagagacaagcccctgagctttggcatcagcctgcagaacctgtccatgcagaccacagaccagtactgggtgccctgcctgcatgatgaaacagagaagctggtgaggaagctgatccggctggacaacctgtttgcctactggaatgtgaagagccagatgttctacctgagtgactatgacaacagcctggatgacctgaagaatggaattgtgaatgaaaacatcgtgcctgagggctatgactttgtgttccggcccatcagcgccaatgccaagctggtgatgaacagaagaagtgactttgacttcagcgcccccaagatcaacctggagattgagctgcacaacatcgccatcgagttcaacaagccccagtacttcagcatcatggagctgctggagagcgtggacatgatggcccagaacctgccctacaggaagttcaagccagatgtgcccctgcaccaccacgcccgggagtggtgggcctatgccatccacggcgtgctggaggtgaatgtgtgcccccggctgtggatgtggagctggaagcacatcaggaagcaccggcagaaggtgaagcagtacaaggagctgtacaagaagaagctgaccagcaagaagcccccaggagagctgctggtgtccctggaggagctggagaagaccctggatgtgttcaacatcaccatcgcccggcagacagctgaggtggaggtgaagaaggccggctacaagatctacaaggagggcgtgaaggaccctgaggacaacaagggctggttctcctggctgtggagctggagcgagcagaacaccaatgagcagcagccagatgtgcagcctgagaccctggaggagatgctgaccccagaggagaaggccctgctgtatgaggccatcggctacagcgagacagctgtggaccccaccctgctgaagacctttgaggccctgaagttctttgtgcacctgaagtccatgagcatcgtgctgcgggagaaccaccagaagccagagctggtggacatcgtgattgaggagttcagcaccctcatcgtgcagaggcctggggcccaggccatcaagtttgagaccaagattgacagcttccacatcaccggcctgcctgacaacagcgagaagccccggctgctgagcagcctggatgatgccatgagcctcttccagatcacctttgagatcaaccccctggatgaaacagtgtcccagcgctgcatcatcgaggccgagcccctggagatcatctatgatgccaggacagtgaacagcatcgtggagttcttccggccccccaaggaggtgcacctggcccagctgacagctgccaccctgaccaagctggaggagttccgcagcaagacagccaccggcctgctgtacatcatcgagacccagaaggtgctggacctgaagatcaacctgaaggccagctacatcatcgtgccccaggacggcatcttcagccccaccagcaacctgctgctgctggacctgggccacctgaaggtgaccagcaagagccgctctgagctgcctgatgtgaagcagggcgaggccaacctgaaggagatcatggaccgggcctatgacagctttgacatccagctgacctctgtgcagctgctgtacagccgggtgggggacaactggagggaggccaggaagctgtctgtgtccacccagcacatcctggtgcccatgcacttcaacctggagctgagcaaggccatggtgttcatggatgtgaggatgcccaagttcaagatctacggcaagctgcccctcatcagcctgcgcatcagtgacaagaagctgcagggcatcatggagctgattgagagcatccccaagccagagcctgtgacagaggtgtctgcccctgtgaagagcttccagatccagaccagcaccagcctgggcaccagccagatcagccagaagatcatccccctgctggagctgcccagcgtgtctgaagatgattctgaggaggagttctttgatgccccctgcagccccctggaggagcccctgcagttccccactggagtgaagagcatccgcaccaggaagctgcagaagcaggactgcagcgtgaacatgaccaccttcaagatccgctttgaggtgcccaaggtgctgattgagttctaccacctggtgggggactgtgagctgtctgtggtggagatcctggtgctgggcctgggcgctgagattgagatccgcacctatgacctgaaggccaatgccttcctgaaggagttctgcctgaagtgcccagagtacctggatgagaacaagaagcctgtgtacctggtgaccaccctggacaacaccatggaggacctgctgaccctggagtatgtgaaggccgagaagaatgtgcctgacctgaagagcacctacaacaacgtgctgcagctgatcaaggtgaacttcagcagcctggacatccacctgcacacagaggccctgctgaacaccatcaactacctgcacaacatcctgccccagagcgaggagaagagcgcccctgtgtccaccacagaaacagaggacaagggagatgtgatcaagaagctggccctgaagctgagcaccaatgaagacatcatcaccctgcagatcctggccgagctgagctgcctgcagatcttcatccaggaccagaagtgcaacatcagcgagatcaagattgagggcctggacagcgagatgatcatgaggccttctgaaacagagatcaatgccaagctgaggaacatcatcgtgctggacagcgacatcacagccatctacaagaaggctgtgtacatcaccgggaaggaggtgttctccttcaagatggtgtcctacatggatgccacagctggcagcgcctacacagacatgaatgtggtggacatccaggtgaacctgattgtgggctgcatcgaggtggtgtttgtgaccaagttcctgtacagcatcctggccttcatcgacaacttccaggccgccaagcaggccctggccgaggccaccgtgcaggccgccggcatggccgccactggagtgaaggagctggcccagaggagcagcaggatggccctggacatcaacatcaaggcccctgtggtggtgatcccccagagccctgtgtctgaaaatgtgtttgtggccgactttggcctcatcaccatgaccaacaccttccacatgatcacagagagccagagcagccccccacctgtgattgacctgatcaccatcaagctgtctgagatgaggctgtaccgcagccgcttcatcaatgatgcctaccaggaggtgctggacctgctgctgcccctgaacctggaggtggtggtggagaggaacctgtgctgggagtggtaccaggaggtgccctgcttcaacgtgaatgcccagctgaagcccatggagttcatcctgagccaggaggacatcaccaccatcttcaagaccctgcacggcaacatctggtatgagaaggatggcagcgccagccctgctgtgaccaaggaccagtacagcgccaccagcggcgtgaccaccaatgccagccaccacagcggcggggccaccgtggtgacagctgctgtggtggaggtgcacagccgggccctgctggtgaagaccaccctgaacatctccttcaagacagatgacctgaccatggtgctgtacagccctggccccaagcaggccagcttcacagatgtgcgggaccccagcctgaagctggccgagttcaagctggagaacatcatcagcaccctgaagatgtacacagatggcagcaccttcagcagcttcagcctgaagaactgcatcctggatgacaagaggccccacgtgaagaaggccacccccaggatgattggcctgactgtgggctttgacaagaaggacatgatggacatcaagtacaggaaggtgagagatggctgtgtgacagatgctgtgttccaggagatgtacatctgtgcctctgtggagttcctgcagacagtggccaacgtgttcctggaggcctacaccactggaacagctgtggagacctctgtgcagacctggacagccaaggaggaggtgcccacccaggagagcgtgaagtgggagatcaacgtcatcatcaagaaccctgagatcgtgtttgtggccgacatgaccaagaatgatgccccagccctggtgatcaccacccagtgtgagatctgctacaagggcaacctggagaacagcaccatgacagctgccatcaaggacctgcaggtgcgggcctgccccttcctgcctgtgaagaggaagggcaagatcaccaccgtgctgcagccctgtgacctcttctaccagaccacccagaagggcacagacccccaggtgattgacatgtctgtgaagagcctgaccctgaaggtgtcccctgtgatcatcaacaccatgatcaccatcaccagcgccctgtacaccaccaaggagaccatccctgaggagacagccagcagcacagcccacctgtgggagaagaaggacaccaagaccctgaagatgtggttcctggaggagagcaatgaaacagagaagatcgcccccaccacagagctggtgcccaagggggagatgatcaagatgaacatcgacagcatcttcatcgtgctggaggccggcatcggccacaggacagtgcccatgctgctggccaagagccgcttcagcggggagggcaagaactggagcagcctcatcaacctgcactgccagctggagctggaggtgcactactacaatgagatgtttggagtgtgggagcccctgctggagcccctggagattgaccagacagaggacttccggccctggaacctgggcatcaagatgaagaagaaggccaagatggccatcgtggagagtgaccctgaggaggagaactacaaggtgcctgagtacaagacagtcatctccttccacagcaaggaccagctgaacatcaccctgagcaaatgtggcctggtgatgctgaacaacctggtgaaggccttcacagaagctgccaccggcagcagcgctgactttgtgaaggacctggcccccttcatgatcctgaacagcctgggcctgaccatctctgtgagccccagcgacagcttctctgtgctgaacatccccatggccaagagctatgtgctgaagaatggagagagcctgtccatggactacatccgcaccaaggacaatgaccacttcaatgccatgaccagcctgagcagcaagctgttcttcatcctgctgacccctgtgaaccacagcacagctgacaagatccccctgaccaaggtgggcagaagactctacacagtgcgccaccgggagagcggcgtggagaggagcatcgtgtgccagattgacacagtggagggcagcaagaaggtgaccatccgcagccctgtgcagatccggaaccacttctctgtgcccctgtctgtgtatgaaggagacaccctgctgggcacagccagcccagaaaatgagttcaacatccccctgggcagctaccgctccttcatcttcctgaagccagaagatgagaactaccagatgtgtgagggcatcgactttgaggagatcatcaagaatgatggagccctgctgaagaagaagtgccgcagcaagaaccccagcaaggagagcttcctgatcaacatcgtgcctgagaaggacaacctgaccagcctgtctgtgtacagtgaagatggctgggacctgccctacatcatgcacctgtggccacccatcctgctgaggaacctgctgccctacaagatcgcctactacatcgagggcattgaaaattctgtgttcaccctgtctgagggccacagcgcccagatctgcacagcccagctgggcaaggcccggctgcacctgaagctgctggactacctgaaccacgactggaagtctgagtaccacatcaagcccaaccagcaggacatcagctttgtgtccttcacctgtgtgacagagatggagaagacagacctggacattgctgtgcacatgacctacaacacaggccagacagtggtggccttccacagcccctactggatggtgaacaagacaggccgcatgctgcagtacaaggcagatggcatccacaggaagcacccccccaactacaagaagcctgtgctcttctccttccagcccaaccacttcttcaacaacaacaaggtgcagctgatggtgacagacagcgagctgagcaaccagttcagcattgacacagtgggcagccacggggctgtgaagtgcaagggcctgaagatggactaccaggtgggcgtgaccatcgacctgagcagcttcaacatcacccgcatcgtgaccttcacccccttctacatgatcaagaacaagagcaagtaccacatctctgtggccgaggagggcaatgacaagtggctgagcctggacctggagcagtgcatccccttctggccagaatatgccagcagcaagctgctgatccaggtggagaggagtgaagatcctcccaagaggatctacttcaacaagcaggagaactgcatcctgctgcggctggacaatgagctgggcggcatcatcgccgaggtgaacctggccgagcacagcaccgtcatcaccttcctggactaccatgatggagctgccaccttcctgctgatcaaccacaccaagaatgagctggtgcagtacaaccagagcagcctgtctgaaattgaggacagcctgcccccaggcaaggctgtgttctacacctgggccgaccctgtgggcagccggcggctgaagtggcgctgcaggaagagccacggggaggtgacccagaaggatgacatgatgatgcccatcgacctgggggagaagaccatctacctggtgtccttctttgagggcctgcagaggatcatcctcttcacagaggaccccagggtcttcaaggtgacctatgagagcgagaaggccgagctggccgagcaggagattgctgtggccctgcaggatgtgggcatcagcctggtgaacaactacaccaagcaggaggtggcctacatcggcatcaccagcagtgatgtggtgtgggagaccaagcccaagaagaaggcccgctggaagcccatgtctgtgaagcacacagagaagctggagcgggagttcaaggagtacacagagagcagccccagcgaggacaaggtgatccagctggacaccaacgtgcctgtgcggctgacccccaccggccacaacatgaagatcctgcagccccacgtgattgccctgcggaggaactacctgcctgccctgaaggtggagtacaacaccagcgcccaccagagcagcttccgcatccagatctaccgcatccagatccagaaccagatccatggagctgtgttcccctttgtgttctaccctgtgaagccacccaagtctgtgaccatggacagcgcccccaagcccttcacagatgtgtccatcgtgatgaggtctgctggccacagccagatcagccgcatcaagtacttcaaggtgctgatccaggagatggacctgcggctggacctgggcttcatctatgccctgacagacctgatgacagaggccgaggtgacagagaacacagaggtggagctgttccacaaggacatcgaggccttcaaggaggagtacaagacagccagcctggtggaccagagccaggtgtccctgtatgagtacttccacatcagccccatcaagctgcacctgtctgtgtccctgagcagcggccgggaggaggccaaggacagcaagcagaatggaggcctcatccctgtgcacagcctgaacctgctgctgaagagcattggagccaccctgacagatgtgcaggatgtggtgttcaagctggccttctttgagctgaactaccagttccacaccaccagtgacctgcagagcgaggtgatccgccactacagcaagcaggccatcaagcagatgtatgtgctgatcctgggcctggatgtgctgggcaaccccttcggcctcatccgggagttcagcgagggcgtggaggccttcttctatgagccctaccagggcgccatccagggccctgaggagtttgtggagggcatggccctgggcctgaaggccctggtgggcggcgctgtgggcggcctggccggggccgccagcaagatcactggagccatggccaagggcgtggccgccatgaccatggatgaggactaccagcagaagagaagagaggccatgaacaagcagcctgctggcttccgggagggcatcacccggggcggcaagggcctggtgtctggctttgtgtctggcatcaccggcatcgtgaccaagcccatcaagggggcccagaagggcggggccgccggcttcttcaagggcgtgggcaagggcctggtgggcgctgtggcccggcccaccggcggcatcatcgacatggccagcagcaccttccagggcatcaagagggccacagagaccagcgaggtggagagcctgcggcccccacgcttcttcaatgaagatggagtcatccggccctaccgcctgagagatggcactggaaaccagatgctgcaggccagcaagagcctcatctag

SEQ ID NO: 22396 - DNA, 9408 bp, Artificial Sequence
  Description of Artificial Sequence: Synthetic coding sequence
atggtgtttgaatctgtggtggtggatgtgctgaaccgcttcctgggggactatgtggtggacctggacaccagccagctgagcctgggcatctggaagggagctgtggccctgaagaacctgcagatcaaggaaaatgccctgagccagctggatgtgcccttcaaggtgaaggtgggccacatcggcaacctgaagctgatcatcccctggaagaacctgtacacccagcctgtggaggccgtgctggaggagatctacctgctgattgtgcccagcagccgcatcaagtatgaccccctgaaggaggagaagcagctgatggaggccaagcagcaggagctgaagagaattgaggaggccaagcagaaggtggtggaccaggagcagcacctgcctgagaagcaggacacctttgctgagaagctggtgacccagatcatcaagaacctgcaggtgaagatcagcagcatccacatccgctatgaagatgacatcaccaacagagacaagcccctgagctttggcatcagcctgcagaacctgtccatgcagaccacagaccagtactgggtgccctgcctgcatgatgaaacagagaagctggtgaggaagctgatccggctggacaacctgtttgcctactggaatgtgaagagccagatgttctacctgagtgactatgacaacagcctggatgacctgaagaatggaattgtgaatgaaaacatcgtgcctgagggctatgactttgtgttccggcccatcagcgccaatgccaagctggtgatgaacagaagaagtgactttgacttcagcgcccccaagatcaacctggagattgagctgcacaacatcgccatcgagttcaacaagccccagtacttcagcatcatggagctgctggagagcgtggacatgatggcccagaacctgccctacaggaagttcaagccagatgtgcccctgcaccaccacgcccgggagtggtgggcctatgccatccacggcgtgctggaggtgaatgtgtgcccccggctgtggatgtggagctggaagcacatcaggaagcaccggcagaaggtgaagcagtacaaggagctgtacaagaagaagctgaccagcaagaagcccccaggagagctgctggtgtccctggaggagctggagaagaccctggatgtgttcaacatcaccatcgcccggcagacagctgaggtggaggtgaagaaggccggctacaagatctacaaggagggcgtgaaggaccctgaggacaacaagggctggttctcctggctgtggagctggagcgagcagaacaccaatgagcagcagccagatgtgcagcctgagaccctggaggagatgctgaccccagaggagaaggccctgctgtatgaggccatcggctacagcgagacagctgtggaccccaccctgctgaagacctttgaggccctgaagttctttgtgcacctgaagtccatgagcatcgtgctgcgggagaaccaccagaagccagagctggtggacatcgtgattgaggagttcagcaccctcatcgtgcagaggcctggggcccaggccatcaagtttgagaccaagattgacagcttccacatcaccggcctgcctgacaacagcgagaagccccggctgctgagcagcctggatgatgccatgagcctcttccagatcacctttgagatcaaccccctggatgaaacagtgtcccagcgctgcatcatcgaggccgagcccctggagatcatctatgatgccaggacagtgaacagcatcgtggagttcttccggccccccaaggaggtgcacctggcccagctgacagctgccaccctgaccaagctggaggagttccgcagcaagacagccaccggcctgctgtacatcatcgagacccagaaggtgctggacctgaagatcaacctgaaggccagctacatcatcgtgccccaggacggcatcttcagccccaccagcaacctgctgctgctggacctgggccacctgaaggtgaccagcaagagccgctctgagctgcctgatgtgaagcagggcgaggccaacctgaaggagatcatggaccgggcctatgacagctttgacatccagctgacctctgtgcagctgctgtacagccgggtgggggacaactggagggaggccaggaagctgtctgtgtccacccagcacatcctggtgcccatgcacttcaacctggagctgagcaaggccatggtgttcatggatgtgaggatgcccaagttcaagatctacggcaagctgcccctcatcagcctgcgcatcagtgacaagaagctgcagggcatcatggagctgattgagagcatccccaagccagagcctgtgacagaggtgtctgcccctgtgaagagcttccagatccagaccagcaccagcctgggcaccagccagatcagccagaagatcatccccctgctggagctgcccagcgtgtctgaagatgattctgaggaggagttctttgatgccccctgcagccccctggaggagcccctgcagttccccactggagtgaagagcatccgcaccaggaagctgcagaagcaggactgcagcgtgaacatgaccaccttcaagatccgctttgaggtgcccaaggtgctgattgagttctaccacctggtgggggactgtgagctgtctgtggtggagatcctggtgctgggcctgggcgctgagattgagatccgcacctatgacctgaaggccaatgccttcctgaaggagttctgcctgaagtgcccagagtacctggatgagaacaagaagcctgtgtacctggtgaccaccctggacaacaccatggaggacctgctgaccctggagtatgtgaaggccgagaagaatgtgcctgacctgaagagcacctacaacaacgtgctgcagctgatcaaggtgaacttcagcagcctggacatccacctgcacacagaggccctgctgaacaccatcaactacctgcacaacatcctgccccagagcgaggagaagagcgcccctgtgtccaccacagaaacagaggacaagggagatgtgatcaagaagctgggcctggacagcgagatgatcatgaggcccagcgagacagagatcaatgccaagctgaggaacatcatcgtgctggacagcgacatcacagccatctacaagaaggctgtgtacatcaccgggaaggaggtgttctccttcaagatggtgtcctacatggatgccacagctggcagcgcctacacagacatgaatgtggtggacatccaggtgaacctgattgtgggctgcatcgaggtggtgtttgtgaccaagttcctgtacagcatcctggccttcatcgacaacttccaggccgccaagcaggccctggccgaggccaccgtgcaggccgccggcatggccgccaccggggtgaaggagctggcccagaggagcagcaggatggccctggacatcaacatcaaggcccctgtggtggtgatcccccagagccctgtgtctgaaaatgtgtttgtggccgactttggcctcatcaccatgaccaacaccttccacatgatcacagagagccagagcagccccccacctgtgattgacctgatcaccatcaagctgtctgagatgaggctgtaccgcagccgcttcatcaatgatgcctaccaggaggtgctggacctgctgctgcccctgaacctggaggtggtggtggagaggaacctgtgctgggagtggtaccaggaggtgccctgcttcaacgtgaatgcccagctgaagcccatggagttcatcctgagccaggaggacatcaccaccatcttcaagaccctgcacggcaacatctggtatgagaaggatggcagcgccagccctgctgtgaccaaggaccagtacagcgccaccagcggcgtgaccaccaatgccagccaccacagcggcggggccaccgtggtgacagctgctgtggtggaggtgcacagccgggccctgctggtgaagaccaccctgaacatctccttcaagacagatgacctgaccatggtgctgtacagccctggccccaagcaggccagcttcacagatgtgcgggaccccagcctgaagctggccgagttcaagctggagaacatcatcagcaccctgaagatgtacacagatggcagcaccttcagcagcttcagcctgaagaactgcatcctggatgacaagaggcctcatgtgaagaaggccacccccaggatgattggcctgactgtgggctttgacaagaaggacatgatggacatcaagtacaggaaggtgagagatggctgtgtgacagatgctgtgttccaggagatgtacatctgtgcctctgtggagttcctgcagacagtggccaacgtgttcctggaggcctacaccaccggcacagctgtggagacctctgtgcagacctggacagccaaggaggaggtgcccacccaggagagcgtgaagtgggagatcaacgtcatcatcaagaaccctgagatcgtgtttgtggccgacatgaccaagaatgatgccccagccctggtgatcaccacccagtgtgagatctgctacaagggcaacctggagaacagcaccatgacagctgccatcaaggacctgcaggtgcgggcctgccccttcctgcctgtgaagaggaagggcaagatcaccaccgtgctgcagccctgtgacctcttctaccagaccacccagaagggcacagacccccaggtgattgacatgtctgtgaagagcctgaccctgaaggtgtcccctgtgatcatcaacaccatgatcaccatcaccagcgccctgtacaccaccaaggagaccatccctgaggagacagccagcagcacagcccacctgtgggagaagaaggacaccaagaccctgaagatgtggttcctggaggagagcaatgaaacagagaagatcgcccccaccacagagctggtgcccaagggggagatgatcaagatgaacatcgacagcatcttcatcgtgctggaggccggcatcggccacaggacagtgcccatgctgctggccaagagccgcttctctggagagggcaagaactggagcagcctcatcaacctgcactgccagctggagctggaggtgcactactacaatgagatgtttggagtgtgggagcccctgctggagcccctggagattgaccagacagaggacttccggccctggaacctgggcatcaagatgaagaagaaggccaagatggccatcgtggagagtgaccctgaggaggagaactacaaggtgcctgagtacaagacagtcatctccttccacagcaaggaccagctgaacatcaccctgagcaaatgtggcctggtgatgctgaacaacctggtgaaggccttcacagaggccgccaccggcagcagcgctgactttgtgaaggacctggcccccttcatgatcctgaacagcctgggcctgaccatctctgtgagccccagcgacagcttctctgtgctgaacatccccatggccaagagctatgtgctgaagaatggagagagcctgtccatggactacatccgcaccaaggacaatgaccacttcaatgccatgaccagcctgagcagcaagctgttcttcatcctgctgacccctgtgaaccacagcacagctgacaagatccccctgaccaaggtgggccggcggctgtacacagtgcgccaccgggagagcggcgtggagaggagcatcgtgtgccagattgacacagtggagggcagcaagaaggtgaccatccgcagccctgtgcagatccggaaccacttctctgtgcccctgtctgtgtatgaaggagacaccctgctgggcacagccagcccagaaaatgagttcaacatccccctgggcagctaccgctccttcatcttcctgaagccagaagatgagaactaccagatgtgtgagggcatcgactttgaggagatcatcaagaatgatggagccctgctgaagaagaagtgccgcagcaagaaccccagcaaggagagcttcctgatcaacatcgtgcctgagaaggacaacctgaccagcctgtctgtgtacagtgaagatggctgggacctgccctacatcatgcacctgtggccacccatcctgctgaggaacctgctgccctacaagatcgcctactacatcgagggcatcgagaacagcgtcttcaccctgtctgagggccacagcgcccagatctgcacagcccagctgggcaaggcccggctgcacctgaagctgctggactacctgaaccacgactggaagtctgagtaccacatcaagcccaaccagcaggacatcagctttgtgtccttcacctgtgtgacagagatggagaagacagacctggacattgctgtgcacatgacctacaacacaggccagacagtggtggccttccacagcccctactggatggtgaacaagacaggccgcatgctgcagtacaaggcagatggcatccacaggaagcacccccccaactacaagaagcctgtgctcttctccttccagcccaaccacttcttcaacaacaacaaggtgcagctgatggtgacagattctgagctgagcaaccagttcagcattgacacagtgggcagccatggagctgtgaagtgcaagggcctgaagatggactaccaggtgggcgtgaccatcgacctgagcagcttcaacatcaccagaattgtgaccttcacccccttctacatgatcaagaacaagagcaagtaccacatctctgtggccgaggagggcaatgacaagtggctgagcctggacctggagcagtgcatccccttctggccagaatatgccagcagcaagctgctgatccaggtggagaggtctgaggacccccccaagaggatctacttcaacaagcaggagaactgcatcctgctgcggctggacaatgagctgggcggcatcatcgccgaggtgaacctggccgagcacagcaccgtcatcaccttcctggactaccatgatggagctgccaccttcctgctgatcaaccacaccaagaatgagctggtgcagtacaaccagagcagcctgtctgaaattgaggacagcctgcccccaggcaaggctgtgttctacacctgggccgaccctgtgggcagccggcggctgaagtggcgctgcaggaagagccatggagaggtgacccagaaggatgacatgatgatgcccatcgacctgggggagaagaccatctacctggtgtccttctttgagggcctgcagaggatcatcctcttcacagaggaccccagggtcttcaaggtgacctatgaaagtgagaaggccgagctggccgagcaggagattgctgtggccctgcaggatgtgggcatcagcctggtgaacaactacaccaagcaggaggtggcctacatcggcatcaccagcagtgatgtggtgtgggagaccaagcccaagaagaaggcccgctggaagcccatgtctgtgaagcacacagagaagctggagcgggagttcaaggagtacacagagagcagccccagcgaggacaaggtgatccagctggacaccaacgtgcctgtgcggctgacccccaccggccacaacatgaagatcctgcagccccacgtgattgccctgcggaggaactacctgcctgccctgaaggtggagtacaacaccagcgcccaccagagcagcttccgcatccagatctaccgcatccagatccagaaccagatccacggggctgtgttcccctttgtgttctaccctgtgaagccacccaagtctgtgaccatggattctgcccccaagcccttcacagatgtgtccatcgtgatgaggtctgctggccacagccagatcagccgcatcaagtacttcaaggtgctgatccaggagatggacctgcggctggacctgggcttcatctatgccctgacagacctgatgacagaagctgaggtgacagaaaatacagaggtggagctgttccacaaggacatcgaggccttcaaggaggagtacaagacagccagcctggtggaccagagccaggtgtccctgtatgagtacttccacatcagccccatcaagctgcacctgtctgtgtccctgagcagcggccgggaggaggccaaggacagcaagcagaatggaggcctcatccctgtgcacagcctgaacctgctgctgaagagcatcggggccaccctgacagatgtgcaggatgtggtgttcaagctggccttctttgagctgaactaccagttccacaccaccagtgacctgcagagcgaggtgatccgccactacagcaagcaggccatcaagcagatgtatgtgctgatcctgggcctggatgtgctgggcaaccccttcggcctcatccgggagttcagcgagggcgtggaggccttcttctatgagccctaccagggcgccatccagggccctgaggagtttgtggagggcatggccctgggcctgaaggccctggtgggcggcgctgtgggcggcctggccggggccgccagcaagatcaccggggccatggccaagggcgtggccgccatgaccatggatgaggactaccagcagaagaggcgggaggccatgaacaagcagcctgctggcttccgggagggcatcacccggggcggcaagggcctggtgtctggctttgtgtctggcatcactggaattgtgaccaagcccatcaagggggcccagaagggcggcgctgctggcttcttcaagggcgtgggcaagggcctggtgggcgctgtggcccggcccactggaggcatcatcgacatggccagcagcaccttccagggcatcaagagggccacagagaccagcgaggtggagagcctgcggcccccacgcttcttcaatgaagatggagtcatccggccctaccgcctgagagatggcaccggcaaccagatgctgcaggtgatggagaatggccgctttgccaagtacaagtacttcacccacgtgatgatcaacaagacagacatgctgatgatcacccggcggggcgtgctgtttgtgaccaagggcaccttcggccagctgacctgtgagtggcagtacagctttgatgagttcaccaaggagcccttcatcgtgcatggaagaaggctgagaattgaggccaaggagcgggtgaagtctgtgttccacgcccgggagtttgggaagatcatcaacttcaagaccccagaagatgcccgctggatcctgaccaagctgcaggaggcccgggagcccagccccagcctgtag

SEQ ID NO: 22397 - DNA, 1317 bp, Artificial Sequence
  Description of Artificial Sequence: Synthetic coding sequence
atgaatgaggtgtctgtcatcaaggagggctggctgcacaagagaggagagtacatcaagacctggaggccccgctacttcctgctgaagagtgatggcagcttcatcggctacaaggagaggcctgaggccccagaccagaccctgccccccctgaacaacttctctgtggccgagtgccagctgatgaagacagagcggccccggcccaacacctttgtgatccgctgcctgcagtggaccaccgtcatcgagaggaccttccacgtggacagcccagatgagcgggaggagtggatgagggccatccagatggtggccaacagcctgaagcagagggcccctggagaggaccccatggactacaagtgtggcagccccagcgacagcagcaccacagaggagatggaggtggccgtgtccaaggcccgggccaaggtgaccatgaatgactttgactacctgaagctgctgggcaagggcaccttcggcaaggtgatcctggtgcgggagaaggccaccggccgctactatgccatgaagatcctgaggaaggaggtgatcatcgccaaggatgaggtggcccacacagtgacagagagccgggtgctgcagaacaccaggcaccccttcctgacagccctgaagtatgccttccagacccatgaccggctgtgctttgtgatggagtatgccaatggaggagagctgttcttccacctgagccgggagagggtcttcacagaggagcgggcccgcttctatggagctgagatcgtgtctgccctggagtacctgcacagcagagatgtggtgtacagagacatcaaggtgctggaggacaatgactatggccgggctgtggactggtggggcctgggcgtggtgatgtatgagatgatgtgtggccgcctgcccttctacaaccaggaccacgagcggctgtttgagctgatcctgatggaggagatccgcttccccaggaccctgagccctgaggccaagagcctgctggccggcctgctgaagaaggaccccaagcagaggctgggcggcggccccagtgatgccaaggaggtgatggagcaccgcttcttcctgagcatcaactggcaggatgtggtgcagaagaagctgctgccccccttcaagccccaggtgaccagcgaggtggacacccgctactttgatgatgagttcaccgcccagagcatcaccatcaccccaccagacagatatgacagcctgggcctgctggagctggaccagaggacccacttcccccagttctcctacagcgccagcatccgggagtag

SEQ ID NO: 22398 - DNA, 444 bp, Artificial Sequence
  Description of Artificial Sequence: Synthetic coding sequence
atgcgctgcctgagcagcaagaaggccggcagcacctctgtggtgaagtacatcaagacctggaggccccgctacttcctgctgaagagtgatggcagcttcatcggctacaaggagaggcctgaggccccagaccagaccctgccccccctgaacaacttctctgtggccgagtgccagctgatgaagacagagcggccccggcccaacaccttcgtcatccgctgcctgcagtggaccaccgtgattgaaagaaccttccacgtggacagcccagatgagcgggaggagtggatgagggccatccagatggtggccaacagcctgcagccccacctgtgtgcccagacccgcatctggaagaccccacctccagcccaggcctgggccgtgggccgcctggagatccaggtgctgatccacaccagccccagcgagggctag

SEQ ID NO: 22399 - DNA, 1149 bp, Artificial Sequence
  Description of Artificial Sequence: Synthetic coding sequence
atgagggccatccagatggtggccaacagcctgaagcagagggcccctggagaggaccccatggactacaagtgtggcagccccagcgacagcagcaccacagaggagatggaggtggccgtgtccaaggcccgggccaaggtgaccatgaatgactttgactacctgaagctgctgggcaagggcaccttcggcaaggtgatcctggtgcgggagaaggccaccggccgctactatgccatgaagatcctgaggaaggaggtgatcatcgccaaggatgaggtggcccacacagtgacagagagccgggtgctgcagaacaccaggcaccccttcctgacagccctgaagtatgccttccagacccatgaccggctgtgctttgtgatggagtatgccaacggcggggagctgttcttccacctgagccgggagagggtcttcacagaggagcgggcccgcttctacggggctgagatcgtgtctgccctggagtacctgcacagcagagatgtggtgtacagagacatcaagctggagaacctgatgctggacaaggatggccacatcaagatcacagactttggcctgtgcaaggagggcatcagtgatggagccaccatgaagaccttctgtggcaccccagagtacctggcccctgaggtgctggaggacaatgactatggccgggctgtggactggtggggcctgggcgtggtgatgtatgagatgatgtgtggccgcctgcccttctacaaccaggaccacgagcggctgtttgagctgatcctgatggaggagatccgcttccccaggaccctgagccctgaggccaagagcctgctggccggcctgctgaagaaggaccccaagcagaggctgggcggcggccccagtgatgccaaggaggtgatggagcaccgcttcttcctgagcatcaactggcaggatgtggtgcagaagaagctgctgccccccttcaagccccaggtgaccagcgaggtggacacccgctactttgatgatgagttcaccgcccagagcatcaccatcaccccaccagacagatatgacagcctgggcctgctggagctggaccagaggacccacttcccccagttctcctacagcgccagcatccgggagtag

SEQ ID NO: 22400 - DNA, 402 bp, Artificial Sequence
  Description of Artificial Sequence: Synthetic coding sequence
atgaatgaggtgtctgtcatcaaggagggctggctgcacaagagaggagagtacatcaagacctggaggccccgctacttcctgctgaagagtgatggcagcttcatcggctacaaggagaggcctgaggccccagaccagaccctgccccccctgaacaacttctctgtggccgagtgccagctgatgaagacagagcggccccggcccaacacctttgtgatccgctgcctgcagtggaccaccgtcatcgagaggaccttccacgtggacagcccagatgagcgggaggagtggatgagggccatccagatggtggccaacagcctgaagcagagggcccctggagaggaccccatggactacaagtgtggcagccccagcgacagcagcaccacctag

SEQ ID NO: 22401 - DNA, 1446 bp, Artificial Sequence
  Description of Artificial Sequence: Synthetic coding sequence
atgaatgaggtgtctgtcatcaaggagggctggctgcacaagagaggagagtacatcaagacctggaggccccgctacttcctgctgaagagtgatggcagcttcatcggctacaaggagaggcctgaggccccagaccagaccctgccccccctgaacaacttctctgtggccgagtgccagctgatgaagacagagcggccccggcccaacacctttgtgatccgctgcctgcagtggaccaccgtcatcgagaggaccttccacgtggacagcccagatgagcgggaggagtggatgagggccatccagatggtggccaacagcctgaagcagagggcccctggagaggaccccatggactacaagtgtggcagccccagcgacagcagcaccacagaggagatggaggtggccgtgtccaaggcccgggccaaggtgaccatgaatgactttgactacctgaagctgctgggcaagggcaccttcggcaaggtgatcctggtgcgggagaaggccaccggccgctactatgccatgaagatcctgaggaaggaggtgatcatcgccaaggatgaggtggcccacacagtgacagagagccgggtgctgcagaacaccaggcaccccttcctgacagccctgaagtatgccttccagacccatgaccggctgtgctttgtgatggagtatgccaatggaggagagctgttcttccacctgagccgggagagggtcttcacagaggagcgggcccgcttctatggagctgagatcgtgtctgccctggagtacctgcacagcagagatgtggtgtacagagacatcaagctggagaacctgatgctggacaaggatggccacatcaagatcacagactttggcctgtgcaaggagggcatcagtgatggagccaccatgaagaccttctgtggcaccccagagtacctggcccctgaggtgctggaggacaatgactatggccgggctgtggactggtggggcctgggcgtggtgatgtatgagatgatgtgtggccgcctgcccttctacaaccaggaccacgagcggctgtttgagctgatcctgatggaggagatccgcttccccaggaccctgagccctgaggccaagagcctgctggccggcctgctgaagaaggaccccaagcagaggctgggcggcggccccagtgatgccaaggaggtgatggagcaccgcttcttcctgagcatcaactggcaggatgtggtgcagaagaagctgctgccccccttcaagccccaggtgaccagcgaggtggacacccgctactttgatgatgagttcaccgcccagagcatcaccatcaccccaccagacagatatgacagcctgggcctgctggagctggaccagaggacccacttcccccagttctcctacagcgccagcatccgggagtag

SEQ ID NO: 22402 - DNA, 402 bp, Artificial Sequence; identical to SEQ ID NO: 22400
  Description of Artificial Sequence: Synthetic coding sequence

SEQ ID NO: 22403 - DNA, 291 bp, Artificial Sequence
  Description of Artificial Sequence: Synthetic coding sequence
atgaatgaggtgtctgtcatcaaggagggctggctgcacaagagaggagagtacatcaagacctggaggccccgctacttcctgctgaagagtgatggcagcttcatcggctacaaggagaggcctgaggccccagaccagaccctgccccccctgaacaacttctctgtggccgagtgccagctgatgaagacagagcggccccggcccaacacctttgtgatccgctgcctgcagtggaccaccgtcatcgagaggaccttccacgtggacagcccagatgagaggtag

SEQ ID NO: 22404 - DNA, 360 bp, Artificial Sequence
  Description of Artificial Sequence: Synthetic coding sequence
atgaatgaggtgtctgtcatcaaggagggctggctgcacaagagaggagagtacatcaagacctggaggccccgctacttcctgctgaagagtgatggcagcttcatcggctacaaggagaggcctgaggccccagaccagaccctgccccccctgaacaacttctctgtggccgagtgccagctgatgaagacagagcggccccggcccaacacctttgtgatccgctgcctgcagtggaccaccgtcatcgagaggaccttccacgtggacagcccagatgagcgggaggagtggatgagggccatccagatggtggccaacagcctgaagcagagggcccctggagaggacccctag

SEQ ID NO: 22405 - DNA, 1446 bp, Artificial Sequence; identical to SEQ ID NO: 22401
  Description of Artificial Sequence: Synthetic coding sequence

SEQ ID NO: 22406 - DNA, 204 bp, Artificial Sequence
  Description of Artificial Sequence: Synthetic coding sequence
atgaatgaggtgtctgtcatcaaggagggctggctgcacaagagaggagagtacatcaagacctggaggccccgctacttcctgctgaagagtgatggcagcttcatcggctacaaggagaggcctgaggccccagaccagaccctgccccccctgaacaacttctctgtggccgagtgccagctgatgaagacagaaagatag

SEQ ID NO: 22407 - DNA, 144 bp, Artificial Sequence
  Description of Artificial Sequence: Synthetic coding sequence
atgaatgaggtgtctgtcatcaaggagggctggctgcacaagagaggagagtacatcaagacctggaggccccgctacttcctgctgaagagtgatggcagcttcatcggctacaaggagaggcctgaggccccagaccagtag

SEQ ID NO: 22408 - DNA, 405 bp, Artificial Sequence
  Description of Artificial Sequence: Synthetic coding sequence
atgaatgaggtgtctgtcatcaaggagggctggctgcacaagagaggagagtacatcaagacctggaggccccgctacttcctgctgaagagtgatggcagcttcatcggctacaaggagaggcctgaggccccagaccagaccctgccccccctgaacaacttctctgtggccgagtgccagctgatgaagacagagcggccccggcccaacacctttgtgatccgctgcctgcagtggaccaccgtcatcgagaggaccttccacgtggacagcccagatgagcgggaggagtggatgagggccatccagatggtggccaacagcctgaagcagagggcccctggagaggaccccatggactacaagtgtggcagccccagcgacagcagcaccacagaatag

SEQ ID NO: 22409 - DNA, 324 bp, Artificial Sequence
  Description of Artificial Sequence: Synthetic coding sequence
atgaatgaggtgtctgtcatcaaggagggctggctgcacaagagaggagagtacatcaagacctggaggccccgctacttcctgctgaagagtgatggcagcttcatcggctacaaggagaggcctgaggccccagaccagaccctgccccccctgaacaacttctctgtggccgagtgccagctgatgaagacagagcggccccggcccaacacctttgtgatccgctgcctgcagtggaccaccgtcatcgagaggaccttccacgtggacagcccagatgagcgggaggagtggatgagggccatccagatggtggcctag

SEQ ID NO: 22410 - DNA, 867 bp, Artificial Sequence
  Description of Artificial Sequence: Synthetic coding sequence
atgaatgaggtgtctgtcatcaaggagggctggctgcacaagagaggagagtacatcaagacctggaggccccgctacttcctgctgaagagtgatggcagcttcatcggctacaaggagaggcctgaggccccagaccagaccctgccccccctgaacaacttctctgtggccgagtgccagctgatgaagacagagcggccccggcccaacacctttgtgatccgctgcctgcagtggaccaccgtcatcgagaggaccttccacgtggacagcccagatgagcgggaggagtggatgagggccatccagatggtggccaacagcctgaagcagagggcccctggagaggaccccatggactacaagtgtggcagccccagcgacagcagcaccacagaggagatggaggtggccgtgtccaaggcccgggccaaggtgaccatgaatgactttgactacctgaagctgctgggcaagggcaccttcggcaaggtgatcctggtgcgggagaaggccaccggccgctactatgccatgaagatcctgaggaaggaggtgatcatcgccaaggatgaggtggcccacacagtgacagagagccgggtgctgcagaacaccaggcaccccttcctgactgtgtcctgcccccccctgccccggcagtgtgaggccagcctgtggacagagctgcgggagcgggccctgatcttctggtacaaggcccagagctggggccggcctgggggccagggcaaggtgctgctgcggcctgccaagagcagcgagcccaggcatgtggtgggcgtgtcccggctgggggagtgggagggggacagcttcttcattgatggcggcttcatgtag

SEQ ID NO: 22411 - DNA, 1440 bp, Artificial Sequence
  Description of Artificial Sequence: Synthetic coding sequence
atgtctgatgtgaccatcgtgaaggagggctgggtgcagaagagaggagagtacatcaagaactggaggccccgctacttcctgctgaagacagatggcagcttcatcggctacaaggagaagccccaggatgtggacctgccctaccccctgaacaacttctctgtggccaagtgccagctgatgaagacagagcggcccaagcccaacaccttcatcatccgctgcctgcagtggaccaccgtgattgaaagaaccttccacgtggacaccccagaggagcgggaggagtggacagaggccatccaggccgtggccgaccggctgcagaggcaggaggaggagaggatgaactgcagccccaccagccagattgacaacatcggggaggaggagatggatgccagcaccacccaccacaagaggaagaccatgaatgactttgactacctgaagctgctgggcaagggcaccttcggcaaggtgatcctggtgcgggagaaggccagcggcaagtactatgccatgaagatcctgaagaaggaggtgatcatcgccaaggatgaggtggcccacaccctgacagagagccgggtgctgaagaacaccaggcaccccttcctgaccagcctgaagtacagcttccagaccaaggaccggctgtgctttgtgatggagtatgtgaatggaggagagctgttcttccacctgagccgggagagggtcttcagcgaggacaggacccgcttctatggagctgagatcgtgtctgccctggactacctgcacagcggcaagatcgtgtacagagacctgaagctggagaacctgatgctggacaaggatggccacatcaagatcacagactttggcctgtgcaaggagggcatcacagatgctgccaccatgaagaccttctgtggcaccccagagtacctggcccctgaggtgctggaggacaatgactatggccgggctgtggactggtggggcctgggcgtggtgatgtatgagatgatgtgtggccgcctgcccttctacaaccaggaccacgagaagctgtttgagctgatcctgatggaggacatcaagttccccaggaccctgagcagtgatgccaagagcctgctgagcggcctgctgatcaaggaccccaacaagaggctgggcggcggcccagatgatgccaaggagatcatgaggcacagcttcttcagcggcgtgaactggcaggatgtgtatgacaagaagctggtgccccccttcaagccccaggtgaccagcgagacagacacccgctactttgatgaggagttcaccgcccagaccatcaccatcaccccacctgagaagtatgatgaagatggcatggactgcatggacaatgaaagaagaccccacttcccccagttctcctacagcgccagcggccgggagtag

SEQ ID NO: 22412 - DNA, 1398 bp, Artificial Sequence
  Description of Artificial Sequence: Synthetic coding sequence
atgtctgatgtgaccatcgtgaaggagggctgggtgcagaagagaggagagtacatcaagaactggaggccccgctacttcctgctgaagacagatggcagcttcatcggctacaaggagaagccccaggatgtggacctgccctaccccctgaacaacttctctgtggccaagtgccagctgatgaagacagagcggcccaagcccaacaccttcatcatccgctgcctgcagtggaccaccgtgattgaaagaaccttccacgtggacaccccagaggagcgggaggagtggacagaggccatccaggccgtggccgaccggctgcagaggcaggaggaggagaggatgaactgcagccccaccagccagattgacaacatcggggaggaggagatggatgccagcaccacccaccacaagaggaagaccatgaatgactttgactacctgaagctgctgggcaagggcaccttcggcaaggtgatcctggtgcgggagaaggccagcggcaagtactatgccatgaagatcctgaagaaggaggtgatcatcgccaaggatgaggtggcccacaccctgacagagagccgggtgctgaagaacaccaggcaccccttcctgaccagcctgaagtacagcttccagaccaaggaccggctgtgctttgtgatggagtatgtgaatggaggagagctgttcttccacctgagccgggagagggtcttcagcgaggacaggacccgcttctatggagctgagatcgtgtctgccctggactacctgcacagcggcaagatcgtgtacagagacctgaagctggagaacctgatgctggacaaggatggccacatcaagatcacagactttggcctgtgcaaggagggcatcacagatgctgccaccatgaagaccttctgtggcaccccagagtacctggcccctgaggtgctggaggacaatgactatggccgggctgtggactggtggggcctgggcgtggtgatgtatgagatgatgtgtggccgcctgcccttctacaaccaggaccacgagaagctgtttgagctgatcctgatggaggacatcaagttccccaggaccctgagcagtgatgccaagagcctgctgagcggcctgctgatcaaggaccccaacaagaggctgggcggcggcccagatgatgccaaggagatcatgaggcacagcttcttcagcggcgtgaactggcaggatgtgtatgacaagaagctggtgccccccttcaagccccaggtgaccagcgagacagacacccgctactttgatgaggagttcaccgcccagaccatcaccatcaccccacctgagaagtgccagcagagcgactgtggcatgctgggcaactggaagaagtag

SEQ ID NO: 22413 - DNA, 1440 bp, Artificial Sequence; identical to SEQ ID NO: 22411
  Description of Artificial Sequence: Synthetic coding sequence

SEQ ID NO: 22414 - DNA, 1398 bp, Artificial Sequence; identical to SEQ ID NO: 22412
  Description of Artificial Sequence: Synthetic coding sequence

SEQ ID NO: 22415 - DNA, 420 bp, Artificial Sequence
  Description of Artificial Sequence: Synthetic coding sequence
atgtctgatgtgaccatcgtgaaggagggctgggtgcagaagagaggagagtacatcaagaactggaggccccgctacttcctgctgaagacagatggcagcttcatcggctacaaggagaagccccaggatgtggacctgccctaccccctgaacaacttctctgtggccaagtgccagctgatgaagacagagcggcccaagcccaacaccttcatcatccgctgcctgcagtggaccaccgtgattgaaagaaccttccacgtggacaccccagaggagcgggaggagtggacagaggccatccaggccgtggccgaccggctgcagaggcaggaggaggagaggatgaactgcagccccaccagccagattgacaacatcggggaggaggagatggatgccagcaccacccactag

SEQ ID NO: 22416 - DNA, 624 bp, Artificial Sequence
  Description of Artificial Sequence: Synthetic coding sequence
atgagccccctgctgcggcggctgctgctggccgccctgctgcagctggccccagcccaggcccctgtgtcccagccagatgcccctggccaccagaggaaggtggtgtcctggattgatgtgtacacccgggccacctgccagccccgggaggtggtggtgcccctgactgtggagctgatgggcaccgtggccaagcagctggtgcccagctgtgtgacagtgcagagatgtggcggctgctgcccagatgatggcctggagtgtgtgcccaccggccagcaccaggtgaggatgcagatcctgatgatccgctaccccagcagccagctgggggagatgagcctggaggagcacagccagtgtgaatgtcggcccaagaagaaggacagcgctgtgaagccagaccgggccgccaccccccaccaccggccccagcccaggtctgtgcccggctgggacagcgcccctggggcccccagccctgctgacatcacccaccccaccccagcccctggccccagcgcccacgccgcccccagcaccaccagcgccctgaccccaggccctgctgctgctgctgctgatgctgctgccagctctgtggccaagggcggggcctag

SEQ ID NO: 22417 - DNA, 567 bp, Artificial Sequence
  Description of Artificial Sequence: Synthetic coding sequence
atgagccccctgctgcggcggctgctgctggccgccctgctgcagctggccccagcccaggcccctgtgtcccagccagatgcccctggccaccagaggaaggtggtgtcctggattgatgtgtacacccgggccacctgccagccccgggaggtggtggtgcccctgactgtggagctgatgggcaccgtggccaagcagctggtgcccagctgtgtgacagtgcagagatgtggcggctgctgcccagatgatggcctggagtgtgtgcccaccggccagcaccaggtgaggatgcagatcctgatgatccgctaccccagcagccagctgggggagatgagcctggaggagcacagccagtgtgaatgtcggcccaagaagaaggacagcgctgtgaagccagacagcccccggcccctgtgcccccgctgcacccagcaccaccagaggccagaccccaggacctgccgctgccgctgcagaagaagaagcttcctgcgctgccagggccggggcctggagctgaacccagacacctgccgctgcaggaagctgcggaggtag

SEQ ID NO: 22418 - DNA, 1143 bp, Artificial Sequence
  Description of Artificial Sequence: Synthetic coding sequence
atgtctgagaccgtcatctgcagcagccgggccaccgtgatgctgtatgatgatggcaacaagcgctggctgcctgctggcaccggcccccaggccttcagccgggtgcagatctaccacaaccccacagccaacagcttccgggtggtgggcaggaagatgcagcctgaccagcaggtggtgatcaactgtgccatcgtgcggggcgtgaagtacaaccaggccacccccaacttccaccagtggagagatgcccggcaggtgtggggcctgaactttggcagcaaagaagatgctgcccagtttgctgctggcatggccagcgccctggaggccctggagggcggcggccccccacctcctccagccctgcccacctggagcgtgcccaacggccccagccctgaggaggtggagcagcagaagaggcagcagcccggccccagcgagcacatcgagcggcgggtgtccaatgccggcggccccccagcccctcctgctgggggccccccacctcctcctggccccccacctcctcctggccccccacctcctcctggcctgcccccatctggagtgcctgctgctgcccacggggccggcggcggccccccaccagccccacccctgcctgctgcccagggccctgggggcggcggggccggggcccctggcctggccgccgccatcgccggggccaagctgaggaaggtgtccaagcaggaggaggccagcggcggccccacagcccccaaggccgagagcggccgcagcggcggcggcggcctgatggaggagatgaatgccatgctggcccggcggaggaaggccacccaggtgggggagaagacccccaaggatgaaagtgccaaccaggaggagcctgaggcccgggtgcctgcccagagcgagagcgtgagaagaccctgggagaagaacagcaccaccctgcccaggatgaagagcagcagctctgtgaccaccagcgagacccagccctgcacccccagcagcagtgactacagcgacctgcagagggtgaagcaggagctgctggaggaggtgaagaaggagctgcagaaggtgaaggaggagatcatcgaggcctttgtgcaggagctgaggaagaggggcagcccctag

SEQ ID NO: 22419 - DNA, 915 bp, Artificial Sequence
  Description of Artificial Sequence: Synthetic coding sequence
atggccggcaactttgattctgaggagaggagctcctggtactggggccgcctgagccggcaggaggccgtggccctgctgcagggccagagacatggagtcttcctggtgcgggacagcagcaccagccctggggactatgtgctgtctgtgtctgagaacagccgggtgagccactacatcatcaacagcagcggccccaggcctcctgtgccccccagccctgcccagcccccacctggggtgagccccagccggctgagaattggagaccaggagtttgacagcctgcctgccctgctggagttctacaagatccactacctggacaccaccaccctgattgagcctgtgagccgcagccggcagggcagcggggtcatcctgcggcaggaggaggccgagtatgtgcgggccctgtttgacttcaatggaaatgatgaggaggacctgcccttcaagaagggggacatcctgcgcatccgggacaagccagaggagcagtggtggaatgcagaagattctgagggcaagaggggcatgatccctgtgccctacgtggagaagtacagacctgccagcgcctctgtgtctgccctgattggaggcaaccaggagggcagccacccccagcccctgggcggccctgagcccggcccctatgcccagcccagcgtgaacacccccctgcccaacctgcagaatggccccatctatgcccgggtcatccagaagagggtgcccaatgcctatgacaagacagccctggccctggaggtgggggagctggtgaaggtgaccaagatcaacgtgtctggccagtgggagggggagtgcaatggcaagaggggccacttccccttcacccacgtgcggctgctggaccagcagaacccagatgaggacttctcctag

SEQ ID NO: 22420 - DNA, 615 bp, Artificial Sequence
  Description of Artificial Sequence: Synthetic coding sequence
atggccggcaactttgattctgaggagaggagctcctggtactggggccgcctgagccggcaggaggccgtggccctgctgcagggccagagacatggagtcttcctggtgcgggacagcagcaccagccctggggactatgtgctgtctgtgtctgagaacagccgggtgagccactacatcatcaacagcagcggccccaggcctcctgtgccccccagccctgcccagcccccacctggggtgagccccagccggctgagaattggagaccaggagtttgacagcctgcctgccctgctggagttctacaagatccactacctggacaccaccaccctgattgagcctgtgagccgcagccggcagggcagcggggtcatcctgcggcaggaggaggccgagtatgtgcgggccctgtttgacttcaatggaaatgatgaggaggacctgcccttcaagaagggggacatcctgcgcatccgggacaagccagaggagcagtggtggaatgcagaagattctgagggcaagaggggcatgatccctgtgccctacgtggagaagtacagacctgccagcgcctctgtgtctgccctgattggaggccgctag

SEQ ID NO: 22421 - DNA, 2196 bp, Artificial Sequence
  Description of Artificial Sequence: Synthetic coding sequence
tgaaaaccagccaccggcctgtgggtgtgggtgtccctgctggtggccgccggcaccgtgcagcccagcgacagccagagcgtgtgtgccggcacagagaacaagctgagcagcctgagtgacctggagcagcagtaccgggccctgaggaagtactatgagaactgtgaggtggtgatgggcaacctggagatcaccagcattgagcacaacagagacctgtccttcctgcggtctgtgcgggaggtgacaggctacgtgctggtggccctgaaccagttccgctacctgcccctggagaacctgcgcatcatccggggcaccaagctgtatgaggacagatatgccctggccatcttcctgaactacaggaaggatggcaactttggcctgcaggagctgggcctgaagaacctgacagagatcctgaatggaggagtgtatgtggaccagaacaagttcctgtgctacgccgacaccatccactggcaggacatcgtgaggaacccctggcccagcaacctgaccctggtgtccaccaacggcagcagcggctgcggccgctgccacaagagctgcaccggccgctgctggggccccacagagaaccactgccagaccctgaccaggacagtgtgtgccgagcagtgtgatggccgctgctacggcccctacgtgtctgactgctgccacagagaatgtgccggcggctgcagcggccccaaggacacagactgctttgcctgcatgaacttcaatgattctggggcctgtgtgacccagtgcccccagacctttgtgtacaaccccaccaccttccagctggagcacaacttcaatgccaagtacacctatggagccttctgtgtgaagaagtgcccccacaactttgtggtggacagcagcagctgtgtgcgggcctgccccagcagcaagatggaggtggaggagaatggcatcaagatgtgcaagccctgcacagacatctgccccaaggcctgtgatggcattggaacaggcagcctgatgtctgcccagacagtggacagcagcaacatcgacaagttcatcaactgcaccaagatcaatggaaacctgatcttcctggtgacaggcatccacggggacccctacaatgccatcgaggccatcgaccctgagaagctgaatgtgttcagaacagtgcgggagatcaccggcttcctgaacatccagagctggccacccaacatgacagacttctctgtgttcagcaacctggtgaccatcggcggccgggtgctgtacagcggcctgagcctgctgatcctgaagcagcagggcatcaccagcctgcagttccagagcctgaaggagatctctgctggcaacatctacatcacagacaacagcaacctgtgctactaccacaccatcaactggaccaccctcttcagcaccatcaaccagagaattgtcatccgggacaacaggaaggccgagaactgcacagctgagggcatggtgtgcaaccacctgtgcagcagtgatggctgctggggccctggccctgaccagtgcctgagctgccgccgcttcagccggggccgcatctgcatcgagagctgcaacctgtatgatggagagttccgggagtttgaaaatggcagcatctgtgtggagtgtgacccccagtgtgagaagatggaggatggcctgctgacctgccacggccctggccctgacaactgcaccaagtgcagccacttcaaggatggccccaactgtgtggagaagtgcccagatggcctgcagggcgccaacagcttcatcttcaagtatgctgaccctgaccgggagtgccacccctgccaccccaactgcacccagggctgcatcggcagcagcattgaggactgcatcggcctgatggacaggacccccctgattgctgctggggtcatcggcggcctcttcatcctggtgattgtgggcctgacctttgctgtgtatgtgcggaggaagagcatcaagaagaagagggccctgcggcgcttcctggagacagagctggtggagcccctgaccccatctggaacagcccccaaccaggcccagctgcgcatcctgaaggagacagagctgaagagggtgaaggtgctgggcagcggggcctttggaacagtgtacaagggcatctgggtgcctgagggctag

SEQ ID NO: 22422 - DNA, 3927 bp, Artificial Sequence
  Description of Artificial Sequence: Synthetic coding sequence
atgaagccagccaccggcctgtgggtgtgggtgtccctgctggtggccgccggcaccgtgcagcccagcgacagccagagcgtgtgtgccggcacagagaacaagctgagcagcctgagtgacctggagcagcagtaccgggccctgaggaagtactatgagaactgtgaggtggtgatgggcaacctggagatcaccagcattgagcacaacagagacctgtccttcctgcggtctgtgcgggaggtgacaggctacgtgctggtggccctgaaccagttccgctacctgcccctggagaacctgcgcatcatccggggcaccaagctgtatgaggacagatatgccctggccatcttcctgaactacaggaaggatggcaactttggcctgcaggagctgggcctgaagaacctgacagagatcctgaatggaggagtgtatgtggaccagaacaagttcctgtgctacgccgacaccatccactggcaggacatcgtgaggaacccctggcccagcaacctgaccctggtgtccaccaacggcagcagcggctgcggccgctgccacaagagctgcaccggccgctgctggggccccacagagaaccactgccagaccctgaccaggacagtgtgtgccgagcagtgtgatggccgctgctacggcccctacgtgtctgactgctgccacagagaatgtgccggcggctgcagcggccccaaggacacagactgctttgcctgcatgaacttcaatgattctggggcctgtgtgacccagtgcccccagacctttgtgtacaaccccaccaccttccagctggagcacaacttcaatgccaagtacacctatggagccttctgtgtgaagaagtgcccccacaactttgtggtggacagcagcagctgtgtgcgggcctgccccagcagcaagatggaggtggaggagaatggcatcaagatgtgcaagccctgcacagacatctgccccaaggcctgtgatggcattggaacaggcagcctgatgtctgcccagacagtggacagcagcaacatcgacaagttcatcaactgcaccaagatcaatggaaacctgatcttcctggtgacaggcatccacggggacccctacaatgccatcgaggccatcgaccctgagaagctgaatgtgttcagaacagtgcgggagatcaccggcttcctgaacatccagagctggccacccaacatgacagacttctctgtgttcagcaacctggtgaccatcggcggccgggtgctgtacagcggcctgagcctgctgatcctgaagcagcagggcatcaccagcctgcagttccagagcctgaaggagatctctgctggcaacatctacatcacagacaacagcaacctgtgctactaccacaccatcaactggaccaccctcttcagcaccatcaaccagagaattgtcatccgggacaacaggaaggccgagaactgcacagctgagggcatggtgtgcaaccacctgtgcagcagtgatggctgctggggccctggccctgaccagtgcctgagctgccgccgcttcagccggggccgcatctgcatcgagagctgcaacctgtatgatggagagttccgggagtttgaaaatggcagcatctgtgtggagtgtgacccccagtgtgagaagatggaggatggcctgctgacctgccacggccctggccctgacaactgcaccaagtgcagccacttcaaggatggccccaactgtgtggagaagtgcccagatggcctgcagggcgccaacagcttcatcttcaagtatgctgaccctgaccgggagtgccacccctgccaccccaactgcacccagggctgcaatggccccaccagccatgactgcatctactacccctggacaggccacagcaccctgccccagcacgcccggacccccctgattgctgctggggtcatcggcggcctcttcatcctggtgattgtgggcctgacctttgctgtgtatgtgcggaggaagagcatcaagaagaagagggccctgcggcgcttcctggagacagagctggtggagcccctgaccccatctggaacagcccccaaccaggcccagctgcgcatcctgaaggagacagagctgaagagggtgaaggtgctgggcagcggggcctttggaacagtgtacaagggcatctgggtgcctgagggggagaccgtgaagatccctgtggccatcaagatcctgaatgagaccaccggccccaaggccaacgtggagttcatggatgaggccctgatcatggcctccatggaccacccccacctggtgcggctgctgggcgtgtgcctgagccccaccatccagctggtgacccagctgatgcctcatggctgcctgctggagtatgtgcatgagcacaaggacaacatcggcagccagctgctgctgaactggtgtgtgcagatcgccaagggcatgatgtacctggaggagcggcggctggtgcaccgggacctggccgccagaaatgtgctggtgaagagccccaaccacgtgaagatcacagactttggcctggcccggctgctggagggagatgagaaggagtacaatgctgatggcggcaagatgcccatcaagtggatggccctggagtgcatccactacaggaagttcacccaccagagtgatgtgtggagctatggagtgaccatctgggagctgatgaccttcggcggcaagccctatgatggcatccccacccgggagatcccagacctgctggagaagggggagcggctgccccagccccccatctgcaccattgatgtgtacatggtgatggtgaagtgctggatgattgatgctgacagccggcccaagttcaaggagctggccgctgagttcagcaggatggcccgggacccccagcgctacctggtgatccagggagatgacaggatgaagctgcccagccccaatgacagcaagttcttccagaacctgctggatgaggaggacctggaggacatgatggatgctgaggagtacctggtgccccaggccttcaacatccccccacccatctacaccagccgggccagaattgacagcaacagaagtgagatcggccacagccccccaccagcctacacccccatgagcggcaaccagtttgtgtacagagatggcggctttgctgctgagcagggcgtgtctgtgccctaccgggcccccaccagcaccatccctgaggcccctgtggcccagggcgccacagctgagatctttgatgacagctgctgcaatggcaccctgaggaagcctgtggccccccacgtgcaggaggacagcagcacccagcgctacagcgctgaccccaccgtgtttgcccctgagaggagccccagaggagagctggatgaggagggctacatgacccccatgagggacaagcccaagcaggagtacctgaaccctgtggaggagaacccctttgtgtccaggaggaagaatggagacctgcaggccctggacaaccctgagtaccacaatgccagcaatggaccacccaaggcagaagatgaatatgtgaatgagcccctgtacctgaacacctttgccaacaccctgggcaaggccgagtacctgaagaacaacatcctgtccatgcctgagaaggccaagaaggcctttgacaacccagactactggaaccacagcctgccccccaggagcaccctgcagcacccagactacctgcaggagtacagcaccaagtacttctacaagcagaatggccgcatccggcccatcgtggccgagaaccctgagtacctgtctgagttcagcctgaagccaggcaccgtgctgcccccaccaccctaccgccacaggaacacagtggtgtag

SEQ ID NO: 22423 - DNA, 3897 bp, Artificial Sequence
  Description of Artificial Sequence: Synthetic coding sequence
atgaagccagccaccggcctgtgggtgtgggtgtccctgctggtggccgccggcaccgtgcagcccagcgacagccagagcgtgtgtgccggcacagagaacaagctgagcagcctgagtgacctggagcagcagtaccgggccctgaggaagtactatgagaactgtgaggtggtgatgggcaacctggagatcaccagcattgagcacaacagagacctgtccttcctgcggtctgtgcgggaggtgacaggctacgtgctggtggccctgaaccagttccgctacctgcccctggagaacctgcgcatcatccggggcaccaagctgtatgaggacagatatgccctggccatcttcctgaactacaggaaggatggcaactttggcctgcaggagctgggcctgaagaacctgacagagatcctgaatggaggagtgtatgtggaccagaacaagttcctgtgctacgccgacaccatccactggcaggacatcgtgaggaacccctggcccagcaacctgaccctggtgtccaccaacggcagcagcggctgcggccgctgccacaagagctgcaccggccgctgctggggccccacagagaaccactgccagaccctgaccaggacagtgtgtgccgagcagtgtgatggccgctgctacggcccctacgtgtctgactgctgccacagagaatgtgccggcggctgcagcggccccaaggacacagactgctttgcctgcatgaacttcaatgattctggggcctgtgtgacccagtgcccccagacctttgtgtacaaccccaccaccttccagctggagcacaacttcaatgccaagtacacctatggagccttctgtgtgaagaagtgcccccacaactttgtggtggacagcagcagctgtgtgcgggcctgccccagcagcaagatggaggtggaggagaatggcatcaagatgtgcaagccctgcacagacatctgccccaaggcctgtgatggcattggaacaggcagcctgatgtctgcccagacagtggacagcagcaacatcgacaagttcatcaactgcaccaagatcaatggaaacctgatcttcctggtgacaggcatccacggggacccctacaatgccatcgaggccatcgaccctgagaagctgaatgtgttcagaacagtgcgggagatcaccggcttcctgaacatccagagctggccacccaacatgacagacttctctgtgttcagcaacctggtgaccatcggcggccgggtgctgtacagcggcctgagcctgctgatcctgaagcagcagggcatcaccagcctgcagttccagagcctgaaggagatctctgctggcaacatctacatcacagacaacagcaacctgtgctactaccacaccatcaactggaccaccctcttcagcaccatcaaccagagaattgtcatccgggacaacaggaaggccgagaactgcacagctgagggcatggtgtgcaaccacctgtgcagcagtgatggctgctggggccctggccctgaccagtgcctgagctgccgccgcttcagccggggccgcatctgcatcgagagctgcaacctgtatgatggagagttccgggagtttgaaaatggcagcatctgtgtggagtgtgacccccagtgtgagaagatggaggatggcctgctgacctgccacggccctggccctgacaactgcaccaagtgcagccacttcaaggatggccccaactgtgtggagaagtgcccagatggcctgcagggcgccaacagcttcatcttcaagtatgctgaccctgaccgggagtgccacccctgccaccccaactgcacccagggctgcatcggcagcagcattgaggactgcatcggcctgatggacaggacccccctgattgctgctggggtcatcggcggcctcttcatcctggtgattgtgggcctgacctttgctgtgtatgtgcggaggaagagcatcaagaagaagagggccctgcggcgcttcctggagacagagctggtggagcccctgaccccatctggaacagcccccaaccaggcccagctgcgcatcctgaaggagacagagctgaagagggtgaaggtgctgggcagcggggcctttggaacagtgtacaagggcatctgggtgcctgagggggagaccgtgaagatccctgtggccatcaagatcctgaatgagaccaccggccccaaggccaacgtggagttcatggatgaggccctgatcatggcctccatggaccacccccacctggtgcggctgctgggcgtgtgcctgagccccaccatccagctggtgacccagctgatgcctcatggctgcctgctggagtatgtgcatgagcacaaggacaacatcggcagccagctgctgctgaactggtgtgtgcagatcgccaagggcatgatgtacctggaggagcggcggctggtgcaccgggacctggccgccagaaatgtgctggtgaagagccccaaccacgtgaagatcacagactttggcctggcccggctgctggagggagatgagaaggagtacaatgctgatggcggcaagatgcccatcaagtggatggccctggagtgcatccactacaggaagttcacccaccagagtgatgtgtggagctatggagtgaccatctgggagctgatgaccttcggcggcaagccctatgatggcatccccacccgggagatcccagacctgctggagaagggggagcggctgccccagccccccatctgcaccattgatgtgtacatggtgatggtgaagtgctggatgattgatgctgacagccggcccaagttcaaggagctggccgctgagttcagcaggatggcccgggacccccagcgctacctggtgatccagggagatgacaggatgaagctgcccagccccaatgacagcaagttcttccagaacctgctggatgaggaggacctggaggacatgatggatgctgaggagtacctggtgccccaggccttcaacatccccccacccatctacaccagccgggccagaattgacagcaacagaagtgagatcggccacagccccccaccagcctacacccccatgagcggcaaccagtttgtgtacagagatggcggctttgctgctgagcagggcgtgtctgtgccctaccgggcccccaccagcaccatccctgaggcccctgtggcccagggcgccacagctgagatctttgatgacagctgctgcaatggcaccctgaggaagcctgtggccccccacgtgcaggaggacagcagcacccagcgctacagcgctgaccccaccgtgtttgcccctgagaggagccccagaggagagctggatgaggagggctacatgacccccatgagggacaagcccaagcaggagtacctgaaccctgtggaggagaacccctttgtgtccaggaggaagaatggagacctgcaggccctggacaaccctgagtaccacaatgccagcaatggaccacccaaggcagaagatgaatatgtgaatgagcccctgtacctgaacacctttgccaacaccctgggcaaggccgagtacctgaagaacaacatcctgtccatgcctgagaaggccaagaaggcctttgacaacccagactactggaaccacagcctgccccccaggagcaccctgcagcacccagactacctgcaggagtacagcaccaagtacttctacaagcagaatggccgcatccggcccatcgtggccgagaaccctgagtacctgtctgagttcagcctgaagccaggcaccgtgctgcccccaccaccctaccgccacaggaacacagtggtgtag

SEQ ID NO: 22424 - DNA, 387 bp, Artificial Sequence
  Description of Artificial Sequence: Synthetic coding sequence
atgggcaacctggagatcaccagcattgagcacaacagagacctgtccttcctgcggtctgtgcgggaggtgacaggctacgtgctggtggccctgaaccagttccgctacctgcccctggagaacctgcgcatcatccggggcaccaagctgtatgaagatagatatgccctggccatcttcctgaactacaggaaggatggcaactttggcctgcaggagctgggcctgaagaacctgacagagatcctgaatggaggagtgtatgtggaccagaacaagttcctgtgctatgctgacaccatccactggcaggacatcgtgaggaacccctggcccagcaacctgaccctggtgtccaccaacggcagcagcggctgcggctag

SEQ ID NO: 22425 - DNA, 3879 bp, Artificial Sequence
  Description of Artificial Sequence: Synthetic coding sequence
atgaagccagccaccggcctgtgggtgtgggtgtccctgctggtggccgccggcaccgtgcagcccagcgacagccagagcgtgtgtgccggcacagagaacaagctgagcagcctgagtgacctggagcagcagtaccgggccctgaggaagtactatgagaactgtgaggtggtgatgggcaacctggagatcaccagcattgagcacaacagagacctgtccttcctgcggtctgtgcgggaggtgacaggctacgtgctggtggccctgaaccagttccgctacctgcccctggagaacctgcgcatcatccggggcaccaagctgtatgaggacagatatgccctggccatcttcctgaactacaggaaggatggcaactttggcctgcaggagctgggcctgaagaacctgacagagatcctgaatggaggagtgtatgtggaccagaacaagttcctgtgctacgccgacaccatccactggcaggacatcgtgaggaacccctggcccagcaacctgaccctggtgtccaccaacggcagcagcggctgcggccgctgccacaagagctgcaccggccgctgctggggccccacagagaaccactgccagaccctgaccaggacagtgtgtgccgagcagtgtgatggccgctgctacggcccctacgtgtctgactgctgccacagagaatgtgccggcggctgcagcggccccaaggacacagactgctttgcctgcatgaacttcaatgattctggggcctgtgtgacccagtgcccccagacctttgtgtacaaccccaccaccttccagctggagcacaacttcaatgccaagtacacctatggagccttctgtgtgaagaagtgcccccacaactttgtggtggacagcagcagctgtgtgcgggcctgccccagcagcaagatggaggtggaggagaatggcatcaagatgtgcaagccctgcacagacatctgccccaaggcctgtgatggcattggaacaggcagcctgatgtctgcccagacagtggacagcagcaacatcgacaagttcatcaactgcaccaagatcaatggaaacctgatcttcctggtgacaggcatccacggggacccctacaatgccatcgaggccatcgaccctgagaagctgaatgtgttcagaacagtgcgggagatcaccggcttcctgaacatccagagctggccacccaacatgacagacttctctgtgttcagcaacctggtgaccatcggcggccgggtgctgtacagcggcctgagcctgctgatcctgaagcagcagggcatcaccagcctgcagttccagagcctgaaggagatctctgctggcaacatctacatcacagacaacagcaacctgtgctactaccacaccatcaactggaccaccctcttcagcaccatcaaccagagaattgtcatccgggacaacaggaaggccgagaactgcacagctgagggcatggtgtgcaaccacctgtgcagcagtgatggctgctggggccctggccctgaccagtgcctgagctgccgccgcttcagccggggccgcatctgcatcgagagctgcaacctgtatgatggagagttccgggagtttgaaaatggcagcatctgtgtggagtgtgacccccagtgtgagaagatggaggatggcctgctgacctgccacggccctggccctgacaactgcaccaagtgcagccacttcaaggatggccccaactgtgtggagaagtgcccagatggcctgcagggcgccaacagcttcatcttcaagtatgctgaccctgaccgggagtgccacccctgccaccccaactgcacccagggctgcaatggccccaccagccatgactgcatctactacccctggacaggccacagcaccctgccccagcacgcccggacccccctgattgctgctggggtcatcggcggcctcttcatcctggtgattgtgggcctgacctttgctgtgtatgtgcggaggaagagcatcaagaagaagagggccctgcggcgcttcctggagacagagctggtggagcccctgaccccatctggaacagcccccaaccaggcccagctgcgcatcctgaaggagacagagctgaagagggtgaaggtgctgggcagcggggcctttggaacagtgtacaagggcatctgggtgcctgagggggagaccgtgaagatccctgtggccatcaagatcctgaatgagaccaccggccccaaggccaacgtggagttcatggatgaggccctgatcatggcctccatggaccacccccacctggtgcggctgctgggcgtgtgcctgagccccaccatccagctggtgacccagctgatgcctcatggctgcctgctggagtatgtgcatgagcacaaggacaacatcggcagccagctgctgctgaactggtgtgtgcagatcgccaagggcatgatgtacctggaggagcggcggctggtgcaccgggacctggccgccagaaatgtgctggtgaagagccccaaccacgtgaagatcacagactttggcctggcccggctgctggagggagatgagaaggagtacaatgctgatggcggcaagatgcccatcaagtggatggccctggagtgcatccactacaggaagttcacccaccagagtgatgtgtggagctatggagtgaccatctgggagctgatgaccttcggcggcaagccctatgatggcatccccacccgggagatcccagacctgctggagaagggggagcggctgccccagccccccatctgcaccattgatgtgtacatggtgatggtgaagtgctggatgattgatgctgacagccggcccaagttcaaggagctggccgctgagttcagcaggatggcccgggacccccagcgctacctggtgatccagggagatgacaggatgaagctgcccagccccaatgacagcaagttcttccagaacctgctggatgaggaggacctggaggacatgatggatgctgaggagtacctggtgccccaggccttcaacatccccccacccatctacaccagccgggccagaattgacagcaacagaaaccagtttgtgtacagagatggcggctttgctgctgagcagggcgtgtctgtgccctaccgggcccccaccagcaccatccctgaggcccctgtggcccagggcgccacagctgagatctttgatgacagctgctgcaatggcaccctgaggaagcctgtggccccccacgtgcaggaggacagcagcacccagcgctacagcgctgaccccaccgtgtttgcccctgagaggagccccagaggagagctggatgaggagggctacatgacccccatgagggacaagcccaagcaggagtacctgaaccctgtggaggagaacccctttgtgtccaggaggaagaatggagacctgcaggccctggacaaccctgagtaccacaatgccagcaatggaccacccaaggcagaagatgaatatgtgaatgagcccctgtacctgaacacctttgccaacaccctgggcaaggccgagtacctgaagaacaacatcctgtccatgcctgagaaggccaagaaggcctttgacaacccagactactggaaccacagcctgccccccaggagcaccctgcagcacccagactacctgcaggagtacagcaccaagtacttctacaagcagaatggccgcatccggcccatcgtggccgagaaccctgagtacctgtctgagttcagcctgaagccaggcaccgtgctgcccccaccaccctaccgccacaggaacacagtggtgtag

SEQ ID NO: 22426 - DNA, 4029 bp, Artificial Sequence
  Description of Artificial Sequence: Synthetic coding sequence
atgagggccaatgatgccctgcaggtgctgggcctgctcttcagcctggcccggggcagcgaggtgggcaacagccaggccgtgtgccccggcaccctgaatggcctgtctgtgactggagatgctgagaaccagtaccagaccctgtacaagctgtatgagcgctgtgaggtggtgatgggcaacctggagatcgtgctgaccggccacaatgctgacctgtccttcctgcagtggatccgggaggtgacaggctacgtgctggtggccatgaatgagttcagcaccctgcccctgcccaacctgcgggtggtgcggggcacccaggtgtatgatggcaagtttgccatctttgtgatgctgaactacaacaccaacagcagccacgccctgcggcagctgcggctgacccagctgacagagatcctgagcggcggcgtgtacatcgagaagaatgacaagctgtgccacatggacaccatcgactggagggacatcgtgcgggacagagatgctgagatcgtggtgaaggacaatggccgcagctgccccccctgccacgaggtgtgcaagggccgctgctggggccctggcagcgaggactgccagaccctgaccaagaccatctgtgccccccagtgcaatggccactgcttcggccccaaccccaaccagtgctgccatgatgaatgtgccggcggctgcagcggcccccaggacacagactgctttgcctgccgccacttcaatgacagcggggcctgtgtgccccgctgcccccagcccctggtgtacaacaagctgaccttccagctggagcccaacccccacaccaagtaccagtatggaggagtgtgtgtggccagctgcccccacaactttgtggtggaccagaccagctgtgtgcgggcctgccccccagacaagatggaggtggacaagaatggcctgaagatgtgtgagccctgtggcggcctgtgccccaaggcctgtgagggcaccggcagcggcagccgcttccagacagtggacagcagcaacattgatggctttgtgaactgcaccaagatcctgggcaacctggacttcctgatcaccggcctgaatggagacccctggcacaagatcccagccctggaccctgagaagctgaatgtgttcagaacagtgcgggagatcaccggctacctgaacatccagagctggccaccccacatgcacaacttcagcgtcttcagcaacctgaccaccatcggcggccgcagcctgtacaacagaggcttcagcctgctgatcatgaagaacctgaatgtgaccagcctgggcttccgcagcctgaaggagatctctgctggccgcatctacatcagcgccaaccggcagctgtgctaccaccacagcctgaactggaccaaggtgctgcggggccccacagaggagcggctggacatcaagcacaaccggccccggcgggactgtgtggccgagggcaaggtgtgtgaccccctgtgcagcagcggcggctgctggggccctggccctggccagtgcctgagctgcaggaactacagccggggcggcgtgtgtgtgacccactgcaacttcctgaatggagagccccgggagtttgcccatgaagctgagtgcttcagctgccaccctgagtgccagcccatggagggcacagccacctgcaatggcagcggcagtgacacctgtgcccagtgtgcccacttcagagatggcccccactgtgtgagcagctgcccccatggagtgctgggcgccaagggccccatctacaagtacccagatgtgcagaatgaatgtcggccctgccacgagaactgcacccagggctgcaagggccctgagctgcaggactgcctgggccagaccctggtgctgattggcaagacccacctgaccatggccctgactgtgattgctggcctggtggtgatcttcatgatgctgggcggcaccttcctgtactggagaggaagacgcatccagaacaagagggccatgaggcgctacctggagcggggggagagcattgagcccctggaccccagcgagaaggccaacaaggtgctggcccgcatcttcaaggagacagagctgaggaagctgaaggtgctgggcagcggcgtgtttggcaccgtgcacaagggcgtgtggatccctgagggggagagcatcaagatccctgtgtgcatcaaggtgattgaggacaagagcggccggcagagcttccaggccgtgacagaccacatgctggccatcggcagcctggaccacgcccacatcgtgcggctgctgggcctgtgccccggcagcagcctgcagctggtgacccagtacctgcccctgggcagcctgctggaccacgtgcggcagcacagaggagccctgggcccccagctgctgctgaactggggcgtgcagatcgccaagggcatgtactacctggaggagcacggcatggtgcacaggaacctggccgccagaaatgtgctgctgaagagccccagccaggtgcaggtggccgactttggagtggccgacctgctgcccccagatgacaagcagctgctgtacagcgaggccaagacccccatcaagtggatggccctggagagcatccactttgggaagtacacccaccagagtgatgtgtggagctatggagtgacagtgtgggagctgatgacctttggagctgagccctatgccggcctgcggctggccgaggtgcctgacctgctggagaagggggagcggctggcccagccccagatctgcaccattgatgtgtacatggtgatggtgaagtgctggatgattgatgagaacatccggcccaccttcaaggagctggccaatgagttcaccaggatggcccgggaccccccacgctacctggtgatcaagcgggagagcggccctggcatcgcccctggccctgagccccacggcctgaccaacaagaagctggaggaggtggagctggagcctgagctggacctggacctggacctggaggccgaggaggacaacctggccaccaccaccctgggcagcgccctgagcctgcctgtgggcaccctgaaccggccccggggcagccagagcctgctgagccccagcagcggctacatgcccatgaaccagggcaacctgggggagagctgccaggagagcgctgtgtctggcagcagcgagcgctgccccaggcctgtgtccctgcaccccatgccccggggctgcctggccagcgagagcagcgagggccacgtgacaggcagcgaggccgagctgcaggagaaggtgtccatgtgccgcagccgcagccgcagccgcagcccccggcccaggggggacagcgcctaccacagccagaggcacagcctgctgacccctgtgacccccctgagccccccaggcctggaggaggaggatgtgaatggctacgtgatgccagacacccacctgaagggcacccccagcagccgggagggcaccctgagctctgtgggcctgagctctgtgctgggcacagaggaggaggatgaagatgaggagtatgagtacatgaacagaagaagaagacacagccccccccaccccccccggcccagcagcctggaggagctgggctatgagtacatggatgtgggcagtgacctgagcgccagcctgggcagcacccagagctgccccctgcaccctgtgcccatcatgcccacagctggcaccaccccagatgaggactatgagtacatgaaccggcagagagatggcggcggccctggaggagactatgctgccatgggcgcctgcccagccagcgagcagggctatgaggagatgagggccttccagggccctggccaccaggccccccacgtgcactacgcccggctgaagaccctgcggagcctggaggccacagattctgcctttgacaacccagactactggcacagccgcctcttccccaaggccaatgcccagaggacatag

SEQ ID NO: 22427 - DNA, 996 bp, Artificial Sequence
  Description of Artificial Sequence: Synthetic coding sequence
atgagggccaatgatgccctgcaggtgctgggcctgctcttcagcctggcccggggcagcgaggtgggcaacagccaggccgtgtgccccggcaccctgaatggcctgtctgtgactggagatgctgagaaccagtaccagaccctgtacaagctgtatgagcgctgtgaggtggtgatgggcaacctggagatcgtgctgaccggccacaatgctgacctgtccttcctgcagtggatccgggaggtgacaggctacgtgctggtggccatgaatgagttcagcaccctgcccctgcccaacctgcgggtggtgcggggcacccaggtgtatgatggcaagtttgccatctttgtgatgctgaactacaacaccaacagcagccacgccctgcggcagctgcggctgacccagctgacagagatcctgagcggcggcgtgtacatcgagaagaatgacaagctgtgccacatggacaccatcgactggagggacatcgtgcgggacagagatgctgagatcgtggtgaaggacaatggccgcagctgccccccctgccacgaggtgtgcaagggccgctgctggggccctggcagcgaggactgccagaccctgaccaagaccatctgtgccccccagtgcaatggccactgcttcggccccaaccccaaccagtgctgccatgatgaatgtgccggcggctgcagcggcccccaggacacagactgctttgcctgccgccacttcaatgacagcggggcctgtgtgccccgctgcccccagcccctggtgtacaacaagctgaccttccagctggagcccaacccccacaccaagtaccagtatggaggagtgtgtgtggccagctgcccccacaactttgtggtggaccagaccagctgtgtgcgggcctgccccccagacaagatggaggtggacaagaatggcctgaagatgtgtgagccctgtggcggcctgtgccccaaggtgttctag

SEQ ID NO: 22428 - DNA, 552 bp, Artificial Sequence
  Description of Artificial Sequence: Synthetic coding sequence
atgagggccaatgatgccctgcaggtgctgggcctgctcttcagcctggcccggggcagcgaggtgggcaacagccaggccgtgtgccccggcaccctgaatggcctgtctgtgactggagatgctgagaaccagtaccagaccctgtacaagctgtatgagcgctgtgaggtggtgatgggcaacctggagatcgtgctgaccggccacaatgctgacctgtccttcctgcagtggatccgggaggtgacaggctacgtgctggtggccatgaatgagttcagcaccctgcccctgcccaacctgcgggtggtgcggggcacccaggtgtatgatggcaagtttgccatctttgtgatgctgaactacaacaccaacagcagccacgccctgcggcagctgcggctgacccagctgaccggccagttccccatggtgcccagcggcctgaccccccagcctgcccaggactggtacctgctggatgatgacccccggctgctgaccctgagcgccagcagcaaggtgcctgtgaccctggccgctgtgtag

SEQ ID NO: 22429 - DNA, 3852 bp, Artificial Sequence
  Description of Artificial Sequence: Synthetic coding sequence
atgggcaacctggagatcgtgctgaccggccacaatgctgacctgtccttcctgcagtggatccgggaggtgacaggctacgtgctggtggccatgaatgagttcagcaccctgcccctgcccaacctgcgggtggtgcggggcacccaggtgtatgatggcaagtttgccatctttgtgatgctgaactacaacaccaacagcagccacgccctgcggcagctgcggctgacccagctgacagagatcctgtctggaggagtgtacatcgagaagaatgacaagctgtgccacatggacaccatcgactggagggacatcgtgcgggacagagatgctgagatcgtggtgaaggacaatggccgcagctgccccccctgccacgaggtgtgcaagggccgctgctggggccctggcagcgaggactgccagaccctgaccaagaccatctgtgccccccagtgcaatggccactgcttcggccccaaccccaaccagtgctgccatgatgaatgtgccggcggctgcagcggcccccaggacacagactgctttgcctgccgccacttcaatgattctggggcctgtgtgccccgctgcccccagcccctggtgtacaacaagctgaccttccagctggagcccaacccccacaccaagtaccagtatggaggagtgtgtgtggccagctgcccccacaactttgtggtggaccagaccagctgtgtgcgggcctgccccccagacaagatggaggtggacaagaatggcctgaagatgtgtgagccctgtggcggcctgtgccccaaggcctgtgagggcactggaagtggcagccgcttccagacagtggacagcagcaacattgatggctttgtgaactgcaccaagatcctgggcaacctggacttcctgatcaccggcctgaatggagacccctggcacaagatcccagccctggaccctgagaagctgaatgtgttcagaacagtgcgggagatcaccggctacctgaacatccagagctggccaccccacatgcacaacttctctgtgttcagcaacctgaccaccatcggcggccgcagcctgtacaacagaggcttcagcctgctgatcatgaagaacctgaatgtgaccagcctgggcttccgcagcctgaaggagatctctgctggccgcatctacatcagcgccaaccggcagctgtgctaccaccacagcctgaactggaccaaggtgctgcggggccccacagaggagcggctggacatcaagcacaaccggccccggcgggactgtgtggccgagggcaaggtgtgtgaccccctgtgcagcagcggcggctgctggggccctggccctggccagtgcctgagctgcaggaactacagcagaggaggagtgtgtgtgacccactgcaacttcctgaatggagagccccgggagtttgcccacgaggccgagtgcttcagctgccaccctgagtgccagcccatggagggcacagccacctgcaatggaagtggcagtgacacctgtgcccagtgtgcccacttcagagatggcccccactgtgtgagcagctgcccccacggcgtgctgggcgccaagggccccatctacaagtacccagatgtgcagaatgaatgtcggccctgccacgagaactgcacccagggctgcaagggccctgagctgcaggactgcctgggccagaccctggtgctgattggcaagacccacctgaccatggccctgactgtgattgctggcctggtggtgatcttcatgatgctgggcggcaccttcctgtactggaggggccgccgcatccagaacaagagggccatgaggcgctacctggagcggggggagagcattgagcccctggaccccagcgagaaggccaacaaggtgctggcccgcatcttcaaggagacagagctgaggaagctgaaggtgctgggcagcggcgtgtttggaacagtgcacaagggcgtgtggatccctgagggggagagcatcaagatccctgtgtgcatcaaggtgattgaggacaagagcggccggcagagcttccaggccgtgacagaccacatgctggccatcggcagcctggaccacgcccacatcgtgcggctgctgggcctgtgccccggcagcagcctgcagctggtgacccagtacctgcccctgggcagcctgctggaccacgtgcggcagcacagaggagccctgggcccccagctgctgctgaactggggcgtgcagatcgccaagggcatgtactacctggaggagcacggcatggtgcacaggaacctggccgccagaaatgtgctgctgaagagccccagccaggtgcaggtggccgactttggagtggccgacctgctgcccccagatgacaagcagctgctgtacagcgaggccaagacccccatcaagtggatggccctggagagcatccactttgggaagtacacccaccagagtgatgtgtggagctatggagtgacagtgtgggagctgatgaccttcggggctgagccctatgccggcctgcggctggccgaggtgcctgacctgctggagaagggggagcggctggcccagccccagatctgcaccattgatgtgtacatggtgatggtgaagtgctggatgattgatgagaacatccggcccaccttcaaggagctggccaatgagttcaccaggatggcccgggaccccccacgctacctggtgatcaagcgggagagcggccctggcatcgcccctggccctgagccccacggcctgaccaacaagaagctggaggaggtggagctggagcctgagctggacctggacctggacctggaggccgaggaggacaacctggccaccaccaccctgggcagcgccctgagcctgcctgtgggcaccctgaaccggccccggggcagccagagcctgctgagccccagcagcggctacatgcccatgaaccagggcaacctgggggagagctgccaggagagcgctgtgtctggcagcagcgagcgctgccccaggcctgtgtccctgcaccccatgccccggggctgcctggccagcgagagcagcgagggccacgtgactggaagtgaagctgagctgcaggagaaggtgtccatgtgccgcagccgcagccgcagccgcagcccccggcccaggggggacagcgcctaccacagccagaggcacagcctgctgacccctgtgacccccctgagccccccaggcctggaggaggaggatgtgaatggctacgtgatgccagacacccacctgaagggcacccccagcagccgggagggcaccctgagctctgtgggcctgagctctgtgctgggcacagaggaggaggatgaagatgaggagtatgagtacatgaacagaagaagaagacacagccccccccaccccccccggcccagcagcctggaggagctgggctatgagtacatggatgtgggcagtgacctgagcgccagcctgggcagcacccagagctgccccctgcaccctgtgcccatcatgcccacagctggcaccaccccagatgaagattatgagtacatgaaccggcagagagatggcggcggccctggaggagactatgctgccatgggcgcctgcccagccagcgagcagggctatgaggagatgagggccttccagggccctggccaccaggcccctcatgtgcactacgcccggctgaagaccctgcggagcctggaggccacagacagcgcctttgacaacccagactactggcacagccgcctcttccccaaggccaatgcccagaggacatag

SEQ ID NO: 22430 - DNA, 2100 bp, Artificial Sequence
  Description of Artificial Sequence: Synthetic coding sequence
atggccctgactgtgattgctggcctggtggtgatcttcatgatgctgggcggcaccttcctgtactggaggggccgccgcatccagaacaagagggccatgaggcgctacctggagcggggggagagcattgagcccctggaccccagcgagaaggccaacaaggtgctggcccgcatcttcaaggagacagagctgaggaagctgaaggtgctgggcagcggcgtgtttggaacagtgcacaagggcgtgtggatccctgagggggagagcatcaagatccctgtgtgcatcaaggtgattgaggacaagagcggccggcagagcttccaggccgtgacagaccacatgctggccatcggcagcctggaccacgcccacatcgtgcggctgctgggcctgtgccccggcagcagcctgcagctggtgacccagtacctgcccctgggcagcctgctggaccacgtgcggcagcacagaggagccctgggcccccagctgctgctgaactggggcgtgcagatcgccaagggcatgtactacctggaggagcacggcatggtgcacaggaacctggccgccagaaatgtgctgctgaagagccccagccaggtgcaggtggccgactttggagtggccgacctgctgcccccagatgacaagcagctgctgtacagcgaggccaagacccccatcaagtggatggccctggagagcatccactttgggaagtacacccaccagagtgatgtgtggagctatggagtgacagtgtgggagctgatgaccttcggggctgagccctatgccggcctgcggctggccgaggtgcctgacctgctggagaagggggagcggctggcccagccccagatctgcaccattgatgtgtacatggtgatggtgaagtgctggatgattgatgagaacatccggcccaccttcaaggagctggccaatgagttcaccaggatggcccgggaccccccacgctacctggtgatcaagcgggagagcggccctggcatcgcccctggccctgagccccacggcctgaccaacaagaagctggaggaggtggagctggagcctgagctggacctggacctggacctggaggccgaggaggacaacctggccaccaccaccctgggcagcgccctgagcctgcctgtgggcaccctgaaccggccccggggcagccagagcctgctgagccccagcagcggctacatgcccatgaaccagggcaacctgggggagagctgccaggagagcgctgtgtctggcagcagcgagcgctgccccaggcctgtgtccctgcaccccatgccccggggctgcctggccagcgagagcagcgagggccacgtgactggaagtgaagctgagctgcaggagaaggtgtccatgtgccgcagccgcagccgcagccgcagcccccggcccaggggggacagcgcctaccacagccagaggcacagcctgctgacccctgtgacccccctgagccccccaggcctggaggaggaggatgtgaatggctacgtgatgccagacacccacctgaagggcacccccagcagccgggagggcaccctgagctctgtgggcctgagctctgtgctgggcacagaggaggaggatgaagatgaggagtatgagtacatgaacagaagaagaagacacagccccccccaccccccccggcccagcagcctggaggagctgggctatgagtacatggatgtgggcagtgacctgagcgccagcctgggcagcacccagagctgccccctgcaccctgtgcccatcatgcccacagctggcaccaccccagatgaagattatgagtacatgaaccggcagagagatggcggcggccctggaggagactatgctgccatgggcgcctgcccagccagcgagcagggctatgaggagatgagggccttccagggccctggccaccaggcccctcatgtgcactacgcccggctgaagaccctgcggagcctggaggccacagacagcgcctttgacaacccagactactggcacagccgcctcttccccaaggccaatgcccagaggacatag

SEQ ID NO: 22431 - DNA, 381 bp, Artificial Sequence
  Description of Artificial Sequence: Synthetic coding sequence
atgagggccaatgatgccctgcaggtgctgggcctgctcttcagcctggcccggggcagcgaggtgggcaacagccaggccgtgtgccccggcaccctgaatggcctgtctgtgactggagatgctgagaaccagtaccagaccctgtacaagctgtatgagcgctgtgaggtggtgatgggcaacctggagatcgtgctgaccggccacaatgctgacctgtccttcctgcagtggatccgggaggtgacaggctacgtgctggtggccatgaatgagttcagcaccctgcccctgcccaacctgcgggtggtgcggggcacccaggtgtatgatggcaagtttgccatctttgtgatgctgaactacaacaccaactag

SEQ ID NO: 22432 - DNA, 2766 bp, Artificial Sequence
  Description of Artificial Sequence: Synthetic coding sequence
atgagggccaatgatgccctgcaggtgctgggcctgctcttcagcctggcccggggcagcgaggtgggcaacagccaggccgtgtgccccggcaccctgaatggcctgtctgtgactggagatgctgagaaccagtaccagaccctgtacaagctgtatgagcgctgtgaggtggtgatgggcaacctggagatcgtgctgaccggccacaatgctgacctgtccttcctgcagtggatccgggaggtgacaggctacgtgctggtggccatgaatgagttcagcaccctgcccctgcccaacctgcgggtggtgcggggcacccaggtgtatgatggcaagtttgccatctttgtgatgctgaactacaacaccaacagcagccacgccctgcggcagctgcggctgacccagctgacagagatcctgagcggcggcgtgtacatcgagaagaatgacaagctgtgccacatggacaccatcgactggagggacatcgtgcgggacagagatgctgagatcgtggtgaaggacaatggccgcagctgccccccctgccacgaggtgtgcaagggccgctgctggggccctggcagcgaggactgccagaccctgaccaagaccatctgtgccccccagtgcaatggccactgcttcggccccaaccccaaccagtgctgccatgatgaatgtgccggcggctgcagcggcccccaggacacagactgctttgcctgccgccacttcaatgacagcggggcctgtgtgccccgctgcccccagcccctggtgtacaacaagctgaccttccagctggagcccaacccccacaccaagtaccagtatggaggagtgtgtgtggccagctgcccccacaactttgtggtggaccagaccagctgtgtgcgggcctgccccccagacaagatggaggtggacaagaatggcctgaagatgtgtgagccctgtggcggcctgtgccccaaggcctgtgagggcaccggcagcggcagccgcttccagacagtggacagcagcaacattgatggctttgtgaactgcaccaagatcctgggcaacctggacttcctgatcaccggcctgaatggagacccctggcacaagatcccagccctggaccctgagaagctgaatgtgttcagaacagtgcgggagatcaccggctacctgaacatccagagctggccaccccacatgcacaacttcagcgtcttcagcaacctgaccaccatcggcggccgcagcctgtacaacagaggcttcagcctgctgatcatgaagaacctgaatgtgaccagcctgggcttccgcagcctgaaggagatctctgctggccgcatctacatcagcgccaaccggcagctgtgctaccaccacagcctgaactggaccaaggtgctgcggggccccacagaggagcggctggacatcaagcacaaccggccccggcgggactgtgtggccgagggcaaggtgtgtgaccccctgtgcagcagcggcggctgctggggccctggccctggccagtgcctgagctgcaggaactacagccggggcggcgtgtgtgtgacccactgcaacttcctgaatggagagccccgggagtttgcccatgaagctgagtgcttcagctgccaccctgagtgccagcccatggagggcacagccacctgcaatggcagcggcagtgacacctgtgcccagtgtgcccacttcagagatggcccccactgtgtgagcagctgcccccatggagtgctgggcgccaagggccccatctacaagtacccagatgtgcagaatgaatgtcggccctgccacgagaactgcacccagggctgcaagggccctgagctgcaggactgcctgggccagaccctggtgctgattggcaagacccacctgaccatggccctgactgtgattgctggcctggtggtgatcttcatgatgctgggcggcaccttcctgtactggagaggaagacgcatccagaacaagagggccatgaggcgctacctggagcggggggagagcattgagcccctggaccccagcgagaaggccaacaaggtgctggcccgcatcttcaaggagacagagctgaggaagctgaaggtgctgggcagcggcgtgtttggcaccgtgcacaagggcgtgtggatccctgagggggagagcatcaagatccctgtgtgcatcaaggtgattgaggacaagagcggccggcagagcttccaggccgtgacagaccacatgctggccatcggcagcctggaccacgcccacatcgtgcggctgctgggcctgtgccccggcagcagcctgcagctggtgacccagtacctgcccctgggcagcctgctggaccacgtgcggcagcacagaggagccctgggcccccagctgctgctgaactggggcgtgcagatcgccaagggcatgtactacctggaggagcacggcatggtgcacaggaacctggccgccagaaatgtgctgctgaagagccccagccaggtgcaggtggccgactttggagtggccgacctgctgcccccagatgacaagcagctgctgtacagcgaggccaagacccccatcaagtggatggccctggagagcatccactttgggaagtacacccaccagagtgatgtgtggagctatggccagtgcatctggatgcccagcctgcccagcctggcccctgtgagcaacctgccctttgagacccccagctag

SEQ ID NO: 22433 - DNA, 10191 bp, Artificial Sequence
  Description of Artificial Sequence: Synthetic coding sequence
atgttcatcaacatcaagagcatcctgtggatgtgcagcaccctcatcgtgacccacgccctgcacaaggtgaaggtgggcaagagcccccctgtgcggggcagcctgagcggcaaggtgtccctgccctgccacttcagcaccatgcccaccctgcccccatcctacaacaccagcgagttcctgcgcatcaagtggagcaagattgaggtggacaagaatggcaaggacctgaaggagaccaccgtgctggtggcccagaatggaaacatcaagattggccaggactacaagggccgggtgtctgtgcccacccaccctgaggccgtgggagatgccagcctgactgtggtgaagctgctggccagtgatgctggcctgtaccgctgtgatgtgatgtatggaattgaggacacccaggacacagtgtccctgactgtggatggagtggtgttccactaccgggccgccaccagccgctacaccctgaactttgaagctgcccagaaggcctgcctggatgtgggcgctgtgattgccaccccagagcagctgtttgctgcctatgaagatggctttgagcagtgtgatgctggctggctggccgaccagacagtgcgctaccccatccgggccccccgggtgggctgctacggggacaagatgggcaaggccggcgtgaggacctacggcttccgcagcccccaggagacctatgatgtgtactgctacgtggaccacctggatggagatgtgttccacctgactgtgcccagcaagttcacctttgaggaggccgccaaggaatgtgagaaccaggatgcccggctggccaccgtgggggagctgcaggccgcctggagaaatggatttgaccagtgtgactatggctggctgagtgatgcctctgtgcgccaccctgtgacagtggcccgggcccagtgtggcggcggcctgctgggcgtgaggaccctgtacagatttgagaaccagacaggcttccccccaccagacagcagatttgatgcctactgcttcaagcccaaggaggccaccaccatcgacctgagcatcctggccgagacagccagccccagcctgagcaaggagccccagatggtgtctgacaggaccacccccatcatccccctggtggatgagctgcctgtgatccccacagagttcccccctgtgggcaacatcgtgtcctttgagcagaaggccaccgtgcagccccaggccatcacagacagcctggccaccaagctgcccacccccaccggcagcaccaagaagccctgggacatggatgactacagccccagcgccagcggccccctgggcaagctggacatcagcgagatcaaggaggaggtgctgcagagcaccaccggggtgagccactacgccacagacagctgggatggagtggtggaggacaagcagacccaggagagcgtgacccagatcgagcagatcgaggtgggccccctggtgacctccatggagatcctgaagcacatccccagcaaggagttccctgtgacagagacccccctggtgacagccaggatgatcctggagagcaagacagagaagaagatggtgtccacagtgtctgagctggtgaccaccggccactacggcttcaccctgggggaggaggatgatgaggacaggaccctgactgtgggcagtgatgagagcaccctcatctttgaccagatccctgaggtgatcaccgtgtccaagaccagcgaggacaccatccacacccacctggaggacctggagagcgtgtctgccagcaccaccgtgagccccctcatcatgccagacaacaacggcagctccatggatgactgggaggagcggcagaccagcggccgcatcacagaggagttcctgggcaagtacctgagcaccacccccttccccagccagcacaggacagaaattgagctgttcccctacagcggggacaagatcctggtggagggcatcagcaccgtcatctaccccagcctgcagacagagatgacccacagaagagagaggacagagaccctcatccctgagatgaggacagacacctacacagatgagatccaggaggagatcaccaagagccccttcatgggcaagacagaggaggaggtgttcagcggcatgaagctgagcaccagcctgtctgagcccatccacgtgacagagagctctgtggagatgaccaagagctttgacttccccaccctcatcaccaagctgtctgctgagcccacagaggtgcgggacatggaggaggacttcaccgccaccccaggcaccaccaagtatgatgagaacatcaccaccgtgctgctggcccacggcaccctgtctgtggaggccgccaccgtgtccaagtggagctgggatgaggacaacaccaccagcaagcccctggagagcacagagcccagcgccagcagcaagctgcccccagccctgctgaccaccgtgggcatgaatggcaaggacaaggacatccccagcttcacagaagatggagcagatgagttcaccctcatcccagacagcacccagaagcagctggaggaggtgacagatgaagatattgctgcccacggcaagttcaccatccgcttccagcccaccaccagcactggaattgctgagaagagcaccctgcgggacagcaccacagaggagaaggtgccccccatcaccagcacagagggccaggtgtatgccaccatggagggcagcgccctgggggaggtggaggatgtggacctgagcaagcctgtgtccacagtgccccagtttgcccacaccagcgaggtggagggcctggcctttgtgtcctacagcagcacccaggagcccaccacctacgtggacagcagccacaccatccccctgagcgtcatccccaagacagactggggcgtgctggtgcccagcgtgcccagtgaagatgaggtgctgggggagcccagccaggacatcctggtgattgaccagacccggctggaggccaccatcagccctgagaccatgaggaccaccaagatcacagagggcaccacccaggaggagttcccctggaaggagcagacagctgagaagcctgtgcctgccctgagcagcacagcctggacccccaaggaggccgtgacccccctggatgagcaggagggagatggcagcgcctacacagtgtctgaagatgagctgctgaccggcagcgagcgggtgcctgtgctggagaccacccctgtgggcaagattgaccacagcgtgtcctacccacctggagctgtgacagagcacaaggtgaagacagatgaggtggtgaccctgaccccccgcatcggccccaaggtgtccctgagccctggccctgagcagaagtatgaaacagagggcagcagcaccaccggcttcaccagcagcctgagccccttcagcacccacatcacccagctgatggaggagaccaccacagagaagaccagcctggaggacatcgacctgggcagcggcctgtttgagaagcccaaggccacagagctgattgagttcagcaccatcaaggtgacagtgcccagcgacatcaccacagccttcagctctgtggaccggctgcacaccaccagcgccttcaagcccagcagcgccatcaccaagaagccacccctgattgaccgggagcccggggaggagaccaccagtgacatggtgatcattggagagagcaccagccacgtgccccccaccaccctggaggacatcgtggccaaggagacagaaacagacatcgaccgggagtacttcaccaccagcagccccccagccacccagcccacccggcccccaacagtggaggacaaggaggccttcggcccccaggccctgagcaccccccagcccccagccagcaccaagttccacccagacatcaacgtgtacatcatcgaggtgcgggagaacaagacaggccgcatgtctgacctgtctgtgattggccaccccattgattctgagagcaaagaagatgagccctgcagcgaggagacagatcctgtgcatgacctgatggccgagatcctgcctgagttcccagacatcattgaaattgacctgtaccacagcgaggagaatgaggaggaggaggaggagtgtgccaatgccacagatgtgaccaccaccccatctgtgcagtacatcaacgggaagcacctggtgaccaccgtgcccaaggaccctgaggccgctgaggcccggcggggccagtttgagagcgtggcccccagccagaacttcagtgacagcagcgagagtgacacccaccccttcgtcatcgccaagacagagctgagcacagctgtgcagcccaatgaaagcacagagaccacagagagcctggaggtgacctggaagccagagacctacccagagaccagcgagcacttcagcggcggggagccagatgtgttccccaccgtgcccttccacgaggagtttgagagcggcacagccaagaagggagctgagagcgtgacagagcgggacacagaggtgggccaccaggcccacgagcacacagagcctgtgtccctcttccctgaggagagcagcggggagatcgccatcgaccaggagagccagaagatcgcctttgcccgggccacagaggtgaccttcggggaggaggtggagaagagcacctctgtgacctacacccccaccatcgtgcccagcagcgccagcgcctacgtgtctgaggaggaggccgtgaccctcatcggcaacccctggccagatgacctgctgagcaccaaggagagctgggtggaggccaccccccggcaggtggtggagctgagcggcagcagcagcatccccatcacagagggcagcggggaggccgaggaggatgaggacaccatgttcaccatggtgacagacctgagccagaggaacaccacagacaccctcatcaccctggacaccagccgcatcatcacagagagcttctttgaggtgcctgccaccaccatctaccctgtgtctgagcagcccagcgccaaggtggtgcccaccaagtttgtgtctgaaacagacaccagcgagtggatcagcagcaccaccgtggaggagaagaagaggaaggaggaggagggcaccaccggcacagccagcacctttgaggtgtacagcagcacccagaggagtgaccagctgatcctgccctttgagctggagagccccaacgtggccaccagcagtgacagcggcaccaggaagagcttcatgagcctgaccacccccacccagagcgagcgggagatgacagacagcacccctgtgttcacagagaccaacaccctggagaacctgggcgcccagaccacagagcacagcagcatccaccagcccggggtgcaggagggcctgaccaccctgcccaggagccctgccagcgtcttcatggagcagggcagcggggaggccgctgctgaccctgagaccaccaccgtgtcctccttcagcctgaatgtggagtatgccatccaggccgagaaggaggtggccggcaccctgagcccccacgtggagaccaccttcagcacagagcccaccggcctggtgctgagcacagtgatggacagagtggtggccgagaacatcacccagaccagccgggagatcgtcatcagcgagcggctgggggagcccaactatggagctgagatccggggcttcagcacaggcttccccctggaggaggacttcagcggggacttccgggagtacagcacagtgagccaccccatcgccaaggaggagaccgtgatgatggagggcagcggagatgctgccttccgggacacccagaccagccccagcacagtgcccacctctgtgcacatcagccacatcagtgacagcgagggccccagcagcaccatggtgtccaccagcgccttcccctgggaggagttcaccagcagcgctgagggcagcggggagcagctggtgacagtgagcagctctgtggtgcctgtgctgcccagcgctgtgcagaagttcagcggcacagccagcagcatcattgatgagggcctgggggaggtgggcaccgtgaatgaaattgaccggcgcagcaccatcctgcccacagctgaggtggagggcaccaaggcccctgtggagaaggaggaggtgaaggtgtctggaacagtgtccaccaacttcccccagaccatcgagcccgccaagctgtggagccggcaggaggtgaaccctgtgcggcaggagattgagagcgagaccaccagcgaggagcagatccaggaggagaagagctttgagagcccccagaacagccctgccacagagcagaccatctttgacagccagaccttcacagaaacagagctgaagaccacagactacagcgtgctgaccaccaagaagacctacagtgatgacaaggagatgaaggaggaggacaccagcctggtgaacatgagcaccccagaccctgatgccaacggcctggagagctacaccaccctgcctgaggccacagagaagagccacttcttcctggccacagccctggtgacagagagcatcccagctgagcacgtggtgacagacagccccatcaagaaggaggagagcaccaagcacttccccaagggcatgaggcccaccatccaggagagtgacacagagctgctcttcagcggcctgggcagcggggaggaggtgctgcccaccctgcccacagagagcgtgaacttcacagaggtggagcagatcaacaacaccctgtacccccacaccagccaggtggagagcaccagcagtgacaagattgaggacttcaacaggatggagaatgtggccaaggaggtgggccccctggtgtcccagacagacatctttgagggcagcggctctgtgaccagcaccaccctgattgagatcctgagtgacacaggagctgagggccccaccgtggcccccctgcccttcagcacagacatcggccacccccagaaccagacagtgcgctgggccgaggagatccagaccagccggccccagaccatcacagagcaggacagcaacaagaacagcagcacagctgagatcaatgagaccaccaccagcagcacagacttcctggcccgggcctacggctttgagatggccaaggagtttgtgaccagcgcccccaagcccagcgacctgtactatgagcccagcggggagggcagcggggaggtggacatcgtggacagcttccacaccagcgccaccacccaggccacccggcaggagagcagcaccacctttgtgtctgatggcagcctggagaagcaccctgaggtgcccagcgccaaggctgtgacagcagatggcttccccaccgtgtctgtgatgctgcccctgcacagcgagcagaacaagagcagcccagaccccaccagcaccctgagcaacacagtgtcctatgaaagaagcacagatggcagcttccaggaccgcttccgggagtttgaggacagcaccctgaagcccaacaggaagaagcccacagagaacatcatcatcgacctggacaaggaggacaaggacctgatcctgaccatcacagagagcaccatcctggagatcctgcctgagctgaccagtgacaagaacaccatcatcgacatcgaccacaccaagcctgtgtatgaggacatcctgggcatgcagacagacatcgacacagaggtgcccagcgagccccatgacagcaatgatgagagcaatgatgacagcacccaggtgcaggagatctatgaagctgctgtgaacctgagcctgacagaggagacctttgagggcagcgcagatgtgctggccagctacacccaggccacccatgatgagagcatgacctatgaggacaggagccagctggaccacatgggcttccacttcaccaccggcatcccagcccccagcacagaaacagagctggatgtgctgctgcccacagccaccagcctgcccatccccaggaagagcgccaccgtcatccctgagattgagggcatcaaggccgaggccaaggccctggatgacatgtttgagagcagcaccctgagtgatggccaggccatcgctgaccagagcgagatcatccccaccctgggccagtttgagaggacccaggaggagtatgaggacaagaagcatgctggccccagcttccagcctgagttcagcagtggagctgaggaggccctggtggaccacaccccctacctgagcatcgccaccacccacctgatggaccagagcgtgacagaggtgcctgatgtgatggagggcagcaaccccccctactacacagacaccaccctggccgtgtccacctttgccaagctgagcagccagacccccagcagccccctgaccatctacagcggcagcgaggccagcggccacacagagatcccccagcccagcgccctgcccggcattgatgtgggcagctctgtgatgagcccccaggacagcttcaaggagatccacgtgaacatcgaggccaccttcaagcccagcagcgaggagtacctgcacatcacagagccccccagcctgagcccagacaccaagctggagcccagtgaagatgatggcaagccagagctgctggaggagatggaggccagccccacagagctgattgctgtggagggcacagagatcctgcaggacttccagaacaagacagatggccaggtgtctggagaggccatcaagatgttccccaccatcaagaccccagaggccggcaccgtcatcaccacagcagatgaaattgagctggagggcgccacccagtggccccacagcaccagcgccagcgccacctacggcgtggaggccggcgtggtgccctggctgagcccccagaccagcgagcggcccaccctgagcagcagccctgagatcaaccctgagacccaggccgccctgatccggggccaggacagcaccatcgccgccagcgagcagcaggtggccgcccgcatcctggacagcaatgaccaggccaccgtgaaccctgtggagttcaacacagaggtggccaccccacccttcagcctgctggagaccagcaatgaaacagacttcctgattggcatcaatgaggagagcgtggagggcacagccatctacctgcccggccctgaccgctgcaagatgaacccctgcctgaatggaggcacctgctaccccacagagaccagctatgtgtgcacctgtgtgcccggctacagcggggaccagtgtgagctggactttgatgagtgccacagcaacccctgcagaaatggagccacctgtgtggatggcttcaacaccttccgctgcctgtgcctgcccagctatgtgggcgccctgtgtgagcaggacacagagacctgtgactatggctggcacaagttccagggccagtgctacaagtactttgcccacaggaggacctgggatgctgctgagcgggagtgccgcctgcagggcgcccacctgaccagcatcctgagccatgaggagcagatgtttgtgaacagagtgggccatgactaccagtggattggcctgaatgacaagatgtttgaacatgacttccgctggacagatggcagcaccctgcagtatgagaactggaggcccaaccagcctgacagcttcttctctgctggggaggactgtgtggtgatcatctggcatgaaaatggccagtggaatgatgtgccctgcaactaccacctgacctacacctgcaagaagggcaccgtggcctgtggccagccccctgtggtggagaatgccaagaccttcggcaagatgaagcccaggtatgagatcaacagcctcatccgctaccactgcaaggatggcttcatccagaggcacctgcccaccatccgctgcctgggcaatggccgctgggccatccccaagatcacctgcatgaaccccagcgcctaccagaggacctacagcatgaagtacttcaagaacagcagcagcgccaaggacaacagcatcaacaccagcaagcatgaccaccgctggagccgccgctggcaggagagcagaagatag

SEQ ID NO: 22434 - DNA, 4929 bp, Artificial Sequence
  Description of Artificial Sequence: Synthetic coding sequence
atgttcatcaacatcaagagcatcctgtggatgtgcagcaccctcatcgtgacccacgccctgcacaaggtgaaggtgggcaagagcccccctgtgcggggcagcctgagcggcaaggtgtccctgccctgccacttcagcaccatgcccaccctgcccccatcctacaacaccagcgagttcctgcgcatcaagtggagcaagattgaggtggacaagaatggcaaggacctgaaggagaccaccgtgctggtggcccagaatggaaacatcaagattggccaggactacaagggccgggtgtctgtgcccacccaccctgaggccgtgggagatgccagcctgactgtggtgaagctgctggccagtgatgctggcctgtaccgctgtgatgtgatgtatggaattgaggacacccaggacacagtgtccctgactgtggatggagtggtgttccactaccgggccgccaccagccgctacaccctgaactttgaagctgcccagaaggcctgcctggatgtgggcgctgtgattgccaccccagagcagctgtttgctgcctatgaagatggctttgagcagtgtgatgctggctggctggccgaccagacagtgcgctaccccatccgggccccccgggtgggctgctacggggacaagatgggcaaggccggcgtgaggacctacggcttccgcagcccccaggagacctatgatgtgtactgctacgtggaccacctggatggagatgtgttccacctgactgtgcccagcaagttcacctttgaggaggccgccaaggaatgtgagaaccaggatgcccggctggccaccgtgggggagctgcaggccgcctggagaaatggatttgaccagtgtgactatggctggctgagtgatgcctctgtgcgccaccctgtgacagtggcccgggcccagtgtggcggcggcctgctgggcgtgaggaccctgtacagatttgagaaccagacaggcttccccccaccagacagcagatttgatgcctactgcttcaagcccaaggaggccaccaccatcgacctgagcatcctggccgagacagccagccccagcctgagcaaggagccccagatggtgtctgacaggaccacccccatcatccccctggtggatgagctgcctgtgatccccacagagttcccccctgtgggcaacatcgtgtcctttgagcagaaggccaccgtgcagccccaggccatcacagacagcctggccaccaagctgcccacccccaccggcagcaccaagaagccctgggacatggatgactacagccccagcgccagcggccccctgggcaagctggacatcagcgagatcaaggaggaggtgctgcagagcaccaccggggtgagccactacgccacagacagctgggatggagtggtggaggacaagcagacccaggagagcgtgacccagatcgagcagatcgaggtgggccccctggtgacctccatggagatcctgaagcacatccccagcaaggagttccctgtgacagagacccccctggtgacagccaggatgatcctggagagcaagacagagaagaagatggtgtccacagtgtctgagctggtgaccaccggccactacggcttcaccctgggggaggaggatgatgaggacaggaccctgactgtgggcagtgatgagagcaccctcatctttgaccagatccctgaggtgatcaccgtgtccaagaccagcgaggacaccatccacacccacctggaggacctggagagcgtgtctgccagcaccaccgtgagccccctcatcatgccagacaacaacggcagctccatggatgactgggaggagcggcagaccagcggccgcatcacagaggagttcctgggcaagtacctgagcaccacccccttccccagccagcacaggacagaaattgagctgttcccctacagcggggacaagatcctggtggagggcatcagcaccgtcatctaccccagcctgcagacagagatgacccacagaagagagaggacagagaccctcatccctgagatgaggacagacacctacacagatgagatccaggaggagatcaccaagagccccttcatgggcaagacagaggaggaggtgttcagcggcatgaagctgagcaccagcctgtctgagcccatccacgtgacagagagctctgtggagatgaccaagagctttgacttccccaccctcatcaccaagctgtctgctgagcccacagaggtgcgggacatggaggaggacttcaccgccaccccaggcaccaccaagtatgatgagaacatcaccaccgtgctgctggcccacggcaccctgtctgtggaggccgccaccgtgtccaagtggagctgggatgaggacaacaccaccagcaagcccctggagagcacagagcccagcgccagcagcaagctgcccccagccctgctgaccaccgtgggcatgaatggcaaggacaaggacatccccagcttcacagaagatggagcagatgagttcaccctcatcccagacagcacccagaagcagctggaggaggtgacagatgaagatattgctgcccacggcaagttcaccatccgcttccagcccaccaccagcactggaattgctgagaagagcaccctgcgggacagcaccacagaggagaaggtgccccccatcaccagcacagagggccaggtgtatgccaccatggagggcagcgccctgggggaggtggaggatgtggacctgagcaagcctgtgtccacagtgccccagtttgcccacaccagcgaggtggagggcctggcctttgtgtcctacagcagcacccaggagcccaccacctacgtggacagcagccacaccatccccctgagcgtcatccccaagacagactggggcgtgctggtgcccagcgtgcccagtgaagatgaggtgctgggggagcccagccaggacatcctggtgattgaccagacccggctggaggccaccatcagccctgagaccatgaggaccaccaagatcacagagggcaccacccaggaggagttcccctggaaggagcagacagctgagaagcctgtgcctgccctgagcagcacagcctggacccccaaggaggccgtgacccccctggatgagcaggagggagatggcagcgcctacacagtgtctgaagatgagctgctgaccggcagcgagcgggtgcctgtgctggagaccacccctgtgggcaagattgaccacagcgtgtcctacccacctggagctgtgacagagcacaaggtgaagacagatgaggtggtgaccctgaccccccgcatcggccccaaggtgtccctgagccctggccctgagcagaagtatgaaacagagggcagcagcaccaccggcttcaccagcagcctgagccccttcagcacccacatcacccagctgatggaggagaccaccacagagaagaccagcctggaggacatcgacctgggcagcggcctgtttgagaagcccaaggccacagagctgattgagttcagcaccatcaaggtgacagtgcccagcgacatcaccacagccttcagctctgtggaccggctgcacaccaccagcgccttcaagcccagcagcgccatcaccaagaagccacccctgattgaccgggagcccggggaggagaccaccagtgacatggtgatcattggagagagcaccagccacgtgccccccaccaccctggaggacatcgtggccaaggagacagaaacagacatcgaccgggagtacttcaccaccagcagccccccagccacccagcccacccggcccccaacagtggaggacaaggaggccttcggcccccaggccctgagcaccccccagcccccagccagcaccaagttccacccagacatcaacgtgtacatcatcgaggtgcgggagaacaagacaggccctgaccgctgcaagatgaacccctgcctgaatggaggcacctgctaccccacagagaccagctatgtgtgcacctgtgtgcccggctacagcggggaccagtgtgagctggactttgatgagtgccacagcaacccctgcagaaatggagccacctgtgtggatggcttcaacaccttccgctgcctgtgcctgcccagctatgtgggcgccctgtgtgagcaggacacagagacctgtgactatggctggcacaagttccagggccagtgctacaagtactttgcccacaggaggacctgggatgctgctgagcgggagtgccgcctgcagggcgcccacctgaccagcatcctgagccatgaggagcagatgtttgtgaacagagtgggccatgactaccagtggattggcctgaatgacaagatgtttgaacatgacttccgctggacagatggcagcaccctgcagtatgagaactggaggcccaaccagcctgacagcttcttctctgctggggaggactgtgtggtgatcatctggcatgaaaatggccagtggaatgatgtgccctgcaactaccacctgacctacacctgcaagaagggcaccgtggcctgtggccagccccctgtggtggagaatgccaagaccttcggcaagatgaagcccaggtatgagatcaacagcctcatccgctaccactgcaaggatggcttcatccagaggcacctgcccaccatccgctgcctgggcaatggccgctgggccatccccaagatcacctgcatgaaccccagcgcctaccagaggacctacagcatgaagtacttcaagaacagcagcagcgccaaggacaacagcatcaacaccagcaagcatgaccaccgctggagccgccgctggcaggagagcagaagatag

SEQ ID NO: 22435 - DNA, 7230 bp, Artificial Sequence
  Description of Artificial Sequence: Synthetic coding sequence
atgttcatcaacatcaagagcatcctgtggatgtgcagcaccctcatcgtgacccacgccctgcacaaggtgaaggtgggcaagagcccccctgtgcggggcagcctgagcggcaaggtgtccctgccctgccacttcagcaccatgcccaccctgcccccatcctacaacaccagcgagttcctgcgcatcaagtggagcaagattgaggtggacaagaatggcaaggacctgaaggagaccaccgtgctggtggcccagaatggaaacatcaagattggccaggactacaagggccgggtgtctgtgcccacccaccctgaggccgtgggagatgccagcctgactgtggtgaagctgctggccagtgatgctggcctgtaccgctgtgatgtgatgtatggaattgaggacacccaggacacagtgtccctgactgtggatggagtggtgttccactaccgggccgccaccagccgctacaccctgaactttgaagctgcccagaaggcctgcctggatgtgggcgctgtgattgccaccccagagcagctgtttgctgcctatgaagatggctttgagcagtgtgatgctggctggctggccgaccagacagtgcgctaccccatccgggccccccgggtgggctgctacggggacaagatgggcaaggccggcgtgaggacctacggcttccgcagcccccaggagacctatgatgtgtactgctacgtggaccacctggatggagatgtgttccacctgactgtgcccagcaagttcacctttgaggaggccgccaaggaatgtgagaaccaggatgcccggctggccaccgtgggggagctgcaggccgcctggagaaatggatttgaccagtgtgactatggctggctgagtgatgcctctgtgcgccaccctgtgacagtggcccgggcccagtgtggcggcggcctgctgggcgtgaggaccctgtacagatttgagaaccagacaggcttccccccaccagacagcagatttgatgcctactgcttcaagaggaggatgtctgacctgagcgtcatcggccaccccatcgacagcgagagcaaggaggatgagccctgcagcgaggagacagatcctgtgcatgacctgatggccgagatcctgcctgagttcccagacatcatcgagattgacctgtaccacagtgaagaaaatgaggaggaggaggaggagtgtgccaatgccacagatgtgaccaccacccccagcgtgcagtacatcaatggcaagcacctggtgaccaccgtgcccaaggaccctgaggccgctgaggcccggcggggccagtttgaatctgtggcccccagccagaacttcagtgacagcagcgagagtgacacccacccctttgtgattgccaagacagagctgagcacagctgtgcagcccaatgaaagcacagagaccacagagagcctggaggtgacctggaagccagagacctacccagagaccagcgagcacttctctggaggagagccagatgtgttccccaccgtgcccttccacgaggagtttgaaagtggcacagccaagaagggagctgagagcgtgacagagcgggacacagaggtgggccaccaggcccacgagcacacagagcctgtgtccctcttccctgaggagagcagtggagagatcgccatcgaccaggagagccagaagatcgcctttgcccgggccacagaggtgacctttggagaggaggtggagaagagcacctctgtgacctacacccccaccatcgtgcccagcagcgccagcgcctacgtgtctgaggaggaggccgtgaccctgattggcaacccctggccagatgacctgctgagcaccaaggagagctgggtggaggccaccccccggcaggtggtggagctgagcggcagcagcagcatccccatcacagagggcagcggggaggccgaggaggatgaggacaccatgttcaccatggtgacagacctgagccagaggaacaccacagacaccctcatcaccctggacaccagccgcatcatcacagagagcttctttgaggtgcctgccaccaccatctaccctgtgtctgagcagcccagcgccaaggtggtgcccaccaagtttgtgtctgaaacagacaccagcgagtggatcagcagcaccaccgtggaggagaagaagaggaaggaggaggagggcaccactggaacagccagcacctttgaggtgtacagcagcacccagaggagtgaccagctgatcctgccctttgagctggagagccccaacgtggccaccagcagtgacagcggcaccaggaagagcttcatgagcctgaccacccccacccagagcgagcgggagatgacagacagcacccctgtgttcacagagaccaacaccctggagaacctgggcgcccagaccacagagcacagcagcatccaccagcccggggtgcaggagggcctgaccaccctgcccaggagccctgcctctgtgttcatggagcagggcagcggggaggccgctgctgaccctgagaccaccaccgtgagcagcttcagcctgaatgtggagtatgccatccaggccgagaaggaggtggccggcaccctgagcccccacgtggagaccaccttcagcacagagcccaccggcctggtgctgagcacagtgatggacagagtggtggccgagaacatcacccagaccagccgggagatcgtcatcagcgagcggctgggggagcccaactacggggctgagatccggggcttcagcacaggcttccccctggaggaggacttcagcggggacttccgggagtacagcacagtgagccaccccatcgccaaggaggagaccgtgatgatggagggcagcggagatgctgccttccgggacacccagaccagccccagcacagtgcccacctctgtgcacatcagccacatcagtgacagcgagggccccagcagcaccatggtgtccaccagcgccttcccctgggaggagttcaccagcagcgctgagggcagcggggagcagctggtgacagtgagcagctctgtggtgcctgtgctgcccagcgctgtgcagaagttctctggaacagccagcagcatcattgatgagggcctgggggaggtgggcaccgtgaatgaaattgacagaagaagcaccatcctgcccacagctgaggtggagggcaccaaggcccctgtggagaaggaggaggtgaaggtgtctggcaccgtgtccaccaacttcccccagaccattgaaccagccaagctgtggagccggcaggaggtgaaccctgtgcggcaggagattgaaagtgagaccaccagcgaggagcagatccaggaggagaagagctttgagagcccccagaacagccctgccacagagcagaccatctttgacagccagaccttcacagaaacagagctgaagaccacagactacagcgtgctgaccaccaagaagacctacagtgatgacaaggagatgaaggaggaggacaccagcctggtgaacatgagcaccccagaccctgatgccaacggcctggagagctacaccaccctgcctgaggccacagagaagagccacttcttcctggccacagccctggtgacagagagcatcccagctgagcacgtggtgacagacagccccatcaagaaggaggagagcaccaagcacttccccaagggcatgaggcccaccatccaggagagtgacacagagctgctcttcagcggcctgggcagcggggaggaggtgctgcccaccctgcccacagaatctgtgaacttcacagaggtggagcagatcaacaacaccctgtacccccacaccagccaggtggagagcaccagcagtgacaagattgaggacttcaacaggatggagaatgtggccaaggaggtgggccccctggtgtcccagacagacatctttgagggcagcggctctgtgaccagcaccaccctcatcgagatcctgagtgacaccggggctgagggccccaccgtggcccccctgcccttcagcacagacatcggccacccccagaaccagacagtgcgctgggccgaggagatccagaccagccggccccagaccatcacagagcaggacagcaacaagaacagcagcacagctgagatcaatgagaccaccaccagcagcacagacttcctggcccgggcctacggctttgagatggccaaggagtttgtgaccagcgcccccaagcccagcgacctgtactatgagcccagcggggagggcagcggggaggtggacatcgtggacagcttccacaccagcgccaccacccaggccacccggcaggagagcagcaccacctttgtgtctgatggcagcctggagaagcaccctgaggtgcccagcgccaaggctgtgacagcagatggcttccccaccgtgtctgtgatgctgcccctgcacagcgagcagaacaagagcagcccagaccccaccagcaccctgagcaacacagtgtcctatgaaagaagcacagatggcagcttccaggaccgcttccgggagtttgaggacagcaccctgaagcccaacaggaagaagcccacagagaacatcatcatcgacctggacaaggaggacaaggacctgatcctgaccatcacagagagcaccatcctggagatcctgcctgagctgaccagtgacaagaacaccatcattgatattgaccacaccaagcctgtgtatgaggacatcctgggcatgcagacagacatcgacacagaggtgcccagcgagccccatgacagcaatgatgagagcaatgatgacagcacccaggtgcaggagatctatgaggccgctgtgaacctgagcctgacagaggagacctttgagggcagcgcagatgtgctggccagctacacccaggccacccatgatgagagcatgacctatgaagatagaagccagctggaccacatgggcttccacttcaccaccggcatcccagcccccagcacagaaacagagctggatgtgctgctgcccacagccaccagcctgcccatccccaggaagagcgccaccgtcatccctgagattgagggcatcaaggccgaggccaaggccctggatgacatgtttgagagcagcaccctgagtgatggccaggccatcgctgaccagagcgagatcatccccaccctgggccagtttgagaggacccaggaggagtatgaggacaagaagcacgccggccccagcttccagcctgagttcagcagcggggctgaggaggccctggtggaccacaccccctacctgagcatcgccaccacccacctgatggaccagagcgtgacagaggtgcctgatgtgatggagggcagcaaccccccctactacacagacaccaccctggccgtgtccacctttgccaagctgagcagccagacccccagcagccccctgaccatctacagcggcagcgaggccagcggccacacagagatcccccagcccagcgccctgcccggcattgatgtgggcagctctgtgatgagcccccaggacagcttcaaggagatccacgtgaacatcgaggccaccttcaagcccagcagcgaggagtacctgcacatcacagagccccccagcctgagcccagacaccaagctggagcccagtgaagatgatggcaagccagagctgctggaggagatggaggccagccccacagagctgattgctgtggagggcacagagatcctgcaggacttccagaacaagacagatggccaggtgtctggagaggccatcaagatgttccccaccatcaagaccccagaggccggcaccgtcatcaccacagcagatgaaattgagctggagggcgccacccagtggccccacagcaccagcgccagcgccacctatggagtggaggccggcgtggtgccctggctgagcccccagaccagcgagcggcccaccctgagcagcagccctgagatcaaccctgagacccaggccgccctgatccggggccaggacagcaccatcgccgccagcgagcagcaggtggccgcccgcatcctggacagcaatgaccaggccaccgtgaaccctgtggagttcaacacagaggtggccaccccacccttcagcctgctggagaccagcaatgaaacagacttcctgattggcatcaatgaggagagcgtggagggcacagccatctacctgcccggccctgaccgctgcaagatgaacccctgcctgaatggaggcacctgctaccccacagagaccagctatgtgtgcacctgtgtgcccggctacagcggggaccagtgtgagctggactttgatgagtgccacagcaacccctgcagaaatggagccacctgtgtggatggcttcaacaccttccgctgcctgtgcctgcccagctatgtgggcgccctgtgtgagcaggacacagagacctgtgactatggctggcacaagttccagggccagtgctacaagtactttgcccacaggaggacctgggatgctgctgagagagaatgtcggctgcagggcgcccacctgaccagcatcctgagccatgaggagcagatgtttgtgaacagagtgggccatgactaccagtggattggcctgaatgacaagatgtttgaacatgacttccgctggacagatggcagcaccctgcagtatgagaactggaggcccaaccagcctgacagcttcttctctgctggggaggactgtgtggtgatcatctggcatgaaaatggccagtggaatgatgtgccctgcaactaccacctgacctacacctgcaagaagggcaccgtggcctgtggccagccccctgtggtggagaatgccaagaccttcggcaagatgaagcccaggtatgagatcaacagcctcatccgctaccactgcaaggatggcttcatccagaggcacctgcccaccatccgctgcctgggcaatggccgctgggccatccccaagatcacctgcatgaaccccagcgcctaccagaggacctacagcatgaagtacttcaagaacagcagcagcgccaaggacaacagcatcaacaccagcaagcatgaccaccgctggagccgccgctggcaggagagcagaagatag

SEQ ID NO: 22436 - DNA, 4785 bp, Artificial Sequence
  Description of Artificial Sequence: Synthetic coding sequence
atgcccaccctgcccccatcctacaacaccagcgagttcctgcgcatcaagtggagcaagattgaggtggacaagaatggcaaggacctgaaggagaccaccgtgctggtggcccagaatggaaacatcaagattggccaggactacaagggccgggtgtctgtgcccacccaccctgaggccgtgggagatgccagcctgactgtggtgaagctgctggccagtgatgctggcctgtaccgctgtgatgtgatgtatggaattgaggacacccaggacacagtgtccctgactgtggatggagtggtgttccactaccgggccgccaccagccgctacaccctgaactttgaagctgcccagaaggcctgcctggatgtgggcgctgtgattgccaccccagagcagctgtttgctgcctatgaagatggctttgagcagtgtgatgctggctggctggccgaccagacagtgcgctaccccatccgggccccccgggtgggctgctacggggacaagatgggcaaggccggcgtgaggacctacggcttccgcagcccccaggagacctatgatgtgtactgctacgtggaccacctggatggagatgtgttccacctgactgtgcccagcaagttcacctttgaggaggccgccaaggaatgtgagaaccaggatgcccggctggccaccgtgggggagctgcaggccgcctggagaaatggatttgaccagtgtgactatggctggctgagtgatgcctctgtgcgccaccctgtgacagtggcccgggcccagtgtggcggcggcctgctgggcgtgaggaccctgtacagatttgagaaccagacaggcttccccccaccagacagcagatttgatgcctactgcttcaagcccaaggaggccaccaccatcgacctgagcatcctggccgagacagccagccccagcctgagcaaggagccccagatggtgtctgacaggaccacccccatcatccccctggtggatgagctgcctgtgatccccacagagttcccccctgtgggcaacatcgtgtcctttgagcagaaggccaccgtgcagccccaggccatcacagacagcctggccaccaagctgcccacccccaccggcagcaccaagaagccctgggacatggatgactacagccccagcgccagcggccccctgggcaagctggacatcagcgagatcaaggaggaggtgctgcagagcaccaccggggtgagccactacgccacagacagctgggatggagtggtggaggacaagcagacccaggagagcgtgacccagatcgagcagatcgaggtgggccccctggtgacctccatggagatcctgaagcacatccccagcaaggagttccctgtgacagagacccccctggtgacagccaggatgatcctggagagcaagacagagaagaagatggtgtccacagtgtctgagctggtgaccaccggccactacggcttcaccctgggggaggaggatgatgaggacaggaccctgactgtgggcagtgatgagagcaccctcatctttgaccagatccctgaggtgatcaccgtgtccaagaccagcgaggacaccatccacacccacctggaggacctggagagcgtgtctgccagcaccaccgtgagccccctcatcatgccagacaacaacggcagctccatggatgactgggaggagcggcagaccagcggccgcatcacagaggagttcctgggcaagtacctgagcaccacccccttccccagccagcacaggacagaaattgagctgttcccctacagcggggacaagatcctggtggagggcatcagcaccgtcatctaccccagcctgcagacagagatgacccacagaagagagaggacagagaccctcatccctgagatgaggacagacacctacacagatgagatccaggaggagatcaccaagagccccttcatgggcaagacagaggaggaggtgttcagcggcatgaagctgagcaccagcctgtctgagcccatccacgtgacagagagctctgtggagatgaccaagagctttgacttccccaccctcatcaccaagctgtctgctgagcccacagaggtgcgggacatggaggaggacttcaccgccaccccaggcaccaccaagtatgatgagaacatcaccaccgtgctgctggcccacggcaccctgtctgtggaggccgccaccgtgtccaagtggagctgggatgaggacaacaccaccagcaagcccctggagagcacagagcccagcgccagcagcaagctgcccccagccctgctgaccaccgtgggcatgaatggcaaggacaaggacatccccagcttcacagaagatggagcagatgagttcaccctcatcccagacagcacccagaagcagctggaggaggtgacagatgaagatattgctgcccacggcaagttcaccatccgcttccagcccaccaccagcactggaattgctgagaagagcaccctgcgggacagcaccacagaggagaaggtgccccccatcaccagcacagagggccaggtgtatgccaccatggagggcagcgccctgggggaggtggaggatgtggacctgagcaagcctgtgtccacagtgccccagtttgcccacaccagcgaggtggagggcctggcctttgtgtcctacagcagcacccaggagcccaccacctacgtggacagcagccacaccatccccctgagcgtcatccccaagacagactggggcgtgctggtgcccagcgtgcccagtgaagatgaggtgctgggggagcccagccaggacatcctggtgattgaccagacccggctggaggccaccatcagccctgagaccatgaggaccaccaagatcacagagggcaccacccaggaggagttcccctggaaggagcagacagctgagaagcctgtgcctgccctgagcagcacagcctggacccccaaggaggccgtgacccccctggatgagcaggagggagatggcagcgcctacacagtgtctgaagatgagctgctgaccggcagcgagcgggtgcctgtgctggagaccacccctgtgggcaagattgaccacagcgtgtcctacccacctggagctgtgacagagcacaaggtgaagacagatgaggtggtgaccctgaccccccgcatcggccccaaggtgtccctgagccctggccctgagcagaagtatgaaacagagggcagcagcaccaccggcttcaccagcagcctgagccccttcagcacccacatcacccagctgatggaggagaccaccacagagaagaccagcctggaggacatcgacctgggcagcggcctgtttgagaagcccaaggccacagagctgattgagttcagcaccatcaaggtgacagtgcccagcgacatcaccacagccttcagctctgtggaccggctgcacaccaccagcgccttcaagcccagcagcgccatcaccaagaagccacccctgattgaccgggagcccggggaggagaccaccagtgacatggtgatcattggagagagcaccagccacgtgccccccaccaccctggaggacatcgtggccaaggagacagaaacagacatcgaccgggagtacttcaccaccagcagccccccagccacccagcccacccggcccccaacagtggaggacaaggaggccttcggcccccaggccctgagcaccccccagcccccagccagcaccaagttccacccagacatcaacgtgtacatcatcgaggtgcgggagaacaagacaggccctgaccgctgcaagatgaacccctgcctgaatggaggcacctgctaccccacagagaccagctatgtgtgcacctgtgtgcccggctacagcggggaccagtgtgagctggactttgatgagtgccacagcaacccctgcagaaatggagccacctgtgtggatggcttcaacaccttccgctgcctgtgcctgcccagctatgtgggcgccctgtgtgagcaggacacagagacctgtgactatggctggcacaagttccagggccagtgctacaagtactttgcccacaggaggacctgggatgctgctgagcgggagtgccgcctgcagggcgcccacctgaccagcatcctgagccatgaggagcagatgtttgtgaacagagtgggccatgactaccagtggattggcctgaatgacaagatgtttgaacatgacttccgctggacagatggcagcaccctgcagtatgagaactggaggcccaaccagcctgacagcttcttctctgctggggaggactgtgtggtgatcatctggcatgaaaatggccagtggaatgatgtgccctgcaactaccacctgacctacacctgcaagaagggcaccgtggcctgtggccagccccctgtggtggagaatgccaagaccttcggcaagatgaagcccaggtatgagatcaacagcctcatccgctaccactgcaaggatggcttcatccagaggcacctgcccaccatccgctgcctgggcaatggccgctgggccatccccaagatcacctgcatgaaccccagcgcctaccagaggacctacagcatgaagtacttcaagaacagcagcagcgccaaggacaacagcatcaacaccagcaagcatgaccaccgctggagccgccgctggcaggagagcagaagatag

SEQ ID NO: 22437 - DNA, 1968 bp, Artificial Sequence
  Description of Artificial Sequence: Synthetic coding sequence
atgttcatcaacatcaagagcatcctgtggatgtgcagcaccctcatcgtgacccacgccctgcacaaggtgaaggtgggcaagagcccccctgtgcggggcagcctgagcggcaaggtgtccctgccctgccacttcagcaccatgcccaccctgcccccatcctacaacaccagcgagttcctgcgcatcaagtggagcaagattgaggtggacaagaatggcaaggacctgaaggagaccaccgtgctggtggcccagaatggaaacatcaagattggccaggactacaagggccgggtgtctgtgcccacccaccctgaggccgtgggagatgccagcctgactgtggtgaagctgctggccagtgatgctggcctgtaccgctgtgatgtgatgtatggaattgaggacacccaggacacagtgtccctgactgtggatggagtggtgttccactaccgggccgccaccagccgctacaccctgaactttgaagctgcccagaaggcctgcctggatgtgggcgctgtgattgccaccccagagcagctgtttgctgcctatgaagatggctttgagcagtgtgatgctggctggctggccgaccagacagtgcgctaccccatccgggccccccgggtgggctgctacggggacaagatgggcaaggccggcgtgaggacctacggcttccgcagcccccaggagacctatgatgtgtactgctacgtggaccacctggatggagatgtgttccacctgactgtgcccagcaagttcacctttgaggaggccgccaaggaatgtgagaaccaggatgcccggctggccaccgtgggggagctgcaggccgcctggagaaatggatttgaccagtgtgactatggctggctgagtgatgcctctgtgcgccaccctgtgacagtggcccgggcccagtgtggcggcggcctgctgggcgtgaggaccctgtacagatttgagaaccagacaggcttccccccaccagacagcagatttgatgcctactgcttcaagaggccagaccgctgcaagatgaacccctgcctgaatggaggcacctgctaccccacagagaccagctatgtgtgcacctgtgtgcccggctacagcggggaccagtgtgagctggactttgatgagtgccacagcaacccctgcagaaatggagccacctgtgtggatggcttcaacaccttccgctgcctgtgcctgcccagctatgtgggcgccctgtgtgagcaggacacagagacctgtgactatggctggcacaagttccagggccagtgctacaagtactttgcccacaggaggacctgggatgctgctgagagagaatgtcggctgcagggcgcccacctgaccagcatcctgagccatgaggagcagatgtttgtgaacagagtgggccatgactaccagtggattggcctgaatgacaagatgtttgaacatgacttccgctggacagatggcagcaccctgcagtatgagaactggaggcccaaccagcctgacagcttcttctctgctggggaggactgtgtggtgatcatctggcatgaaaatggccagtggaatgatgtgccctgcaactaccacctgacctacacctgcaagaagggcaccgtggcctgtggccagccccctgtggtggagaatgccaagaccttcggcaagatgaagcccaggtatgagatcaacagcctcatccgctaccactgcaaggatggcttcatccagaggcacctgcccaccatccgctgcctgggcaatggccgctgggccatccccaagatcacctgcatgaaccccagcgcctaccagaggacctacagcatgaagtacttcaagaacagcagcagcgccaaggacaacagcatcaacaccagcaagcatgaccaccgctggagccgccgctggcaggagagcagaagatag

SEQ ID NO: 22438 - DNA, 1440 bp, Artificial Sequence
  Description of Artificial Sequence: Synthetic coding sequence
atggccagcaccatcaaggaggccctgtctgtggtgtctgaggaccagagcctgtttgaatgtgcctacggcaccccccacctggccaagacagagatgacagccagcagcagcagtgactatggccagaccagcaagatgagcccccgggtgccccagcaggactggctgagccagcccccagcccgggtgaccatcaagatggagtgcaaccccagccaggtgaatggcagcaggaacagcccagatgagtgcagcgtggccaagggcggcaagatggtgggcagcccagacacagtgggcatgaactacggcagctacatggaggagaagcacatgcccccacccaacatgaccaccaatgaaagaagagtcatcgtgcctgctgaccccaccctgtggagcacagaccacgtgcggcagtggctggagtgggccgtgaaggagtatggcctgcctgatgtgaacatcctgctcttccagaacattgatggcaaggagctgtgcaagatgaccaaggatgacttccagaggctgacccccagctacaatgctgacatcctgctgagccacctgcactacctgcgggagacccccctgccccacctgaccagtgatgatgtggacaaggccctgcagaacagcccccggctgatgcacgccaggaacacaggaggagctgccttcatcttccccaacacctctgtgtacccagaggccacccagaggatcaccaccaggccagacctgccctatgagcccccccggcgcagcgcctggacaggccacggccaccccaccccccagagcaaggccgcccagcccagccccagcacagtgcccaagacagaggaccagaggccccagctggacccctaccagatcctgggccccaccagcagccggctggccaaccctggcagcggccagatccagctgtggcagttcctgctggagctgctgagtgacagcagcaacagcagctgcatcacctgggagggcaccaacggggagttcaagatgacagatcctgatgaggtggcccggcgctggggcgagaggaagagcaagcccaacatgaactatgacaagctgagccgggccctgcgctactactatgacaagaacatcatgaccaaggtgcacggcaagagatatgcctacaagtttgacttccatggaattgcccaggccctgcagccccaccccccagagagcagcctgtacaagtaccccagcgacctgccctacatgggcagctaccacgcccacccccagaagatgaactttgtggccccccaccccccagccctgcctgtgaccagcagcagcttctttgctgcccccaacccctactggaacagccccactggaggcatctaccccaacacccggctgcccaccagccacatgcccagccacctgggcacctactactag

SEQ ID NO: 22439 - DNA, 1092 bp, Artificial Sequence
  Description of Artificial Sequence: Synthetic coding sequence
atggtgggcagcccagacacagtgggcatgaactacggcagctacatggaggagaagcacatgcccccacccaacatgaccaccaatgaaagaagagtcatcgtgcctgctgaccccaccctgtggagcacagaccacgtgcggcagtggctggagtgggccgtgaaggagtatggcctgcctgatgtgaacatcctgctcttccagaacattgatggcaaggagctgtgcaagatgaccaaggatgacttccagaggctgacccccagctacaatgctgacatcctgctgagccacctgcactacctgcgggagacccccctgccccacctgaccagtgatgatgtggacaaggccctgcagaacagcccccggctgatgcacgccaggaacacagacctgccctatgagcccccccggcgcagcgcctggacaggccacggccaccccaccccccagagcaaggccgcccagcccagccccagcacagtgcccaagacagaggaccagaggccccagctggacccctaccagatcctgggccccaccagcagccggctggccaaccctggcagcggccagatccagctgtggcagttcctgctggagctgctgagtgacagcagcaacagcagctgcatcacctgggagggcaccaacggggagttcaagatgacagatcctgatgaggtggcccggcgctggggcgagaggaagagcaagcccaacatgaactatgacaagctgagccgggccctgcgctactactatgacaagaacatcatgaccaaggtgcacggcaagagatatgcctacaagtttgacttccatggaattgcccaggccctgcagccccaccccccagagagcagcctgtacaagtaccccagcgacctgccctacatgggcagctaccacgcccacccccagaagatgaactttgtggccccccaccccccagccctgcctgtgaccagcagcagcttctttgctgcccccaacccctactggaacagccccactggaggcatctaccccaacacccggctgcccaccagccacatgcccagccacctgggcacctactactag

SEQ ID NO: 22440 - DNA, 1389 bp, Artificial Sequence
  Description of Artificial Sequence: Synthetic coding sequence
atgatccagacagtgcctgaccctgctgcccacatcaaggaggccctgtctgtggtgtctgaggaccagagcctgtttgaatgtgcctacggcaccccccacctggccaagacagagatgacagccagcagcagcagtgactatggccagaccagcaagatgagcccccgggtgccccagcaggactggctgagccagcccccagcccgggtgaccatcaagatggagtgcaaccccagccaggtgaatggcagcaggaacagcccagatgaatgttctgtggccaagggcggcaagatggtgggcagcccagacacagtgggcatgaactacggcagctacatggaggagaagcacatgcccccacccaacatgaccaccaatgaaagaagagtgattgtgcctgctgaccccaccctgtggagcacagaccacgtgcggcagtggctggagtgggccgtgaaggagtatggcctgcctgatgtgaacatcctgctcttccagaacattgatggcaaggagctgtgcaagatgaccaaggatgacttccagaggctgacccccagctacaatgctgacatcctgctgagccacctgcactacctgcgggagacccccctgccccacctgaccagtgatgatgtggacaaggccctgcagaacagcccccggctgatgcacgccaggaacacagacctgccctatgagcccccaagaagaagtgcctggacaggccacggccaccccaccccccagagcaaggccgcccagcccagccccagcacagtgcccaagacagaggaccagaggccccagctggacccctaccagatcctgggccccaccagcagccggctggccaaccctggcagcggccagatccagctgtggcagttcctgctggagctgctgagtgacagcagcaacagcagctgcatcacctgggagggcaccaatggagagttcaagatgacagatcctgatgaggtggcccggcgctggggcgagaggaagagcaagcccaacatgaactatgacaagctgagccgggccctgcgctactactatgacaagaacatcatgaccaaggtgcacggcaagagatatgcctacaagtttgacttccacggcatcgcccaggccctgcagccccaccccccagagagcagcctgtacaagtaccccagcgacctgccctacatgggcagctaccacgcccacccccagaagatgaactttgtggccccccaccccccagccctgcctgtgaccagcagcagcttctttgctgcccccaacccctactggaacagccccaccggcggcatctaccccaacacccggctgcccaccagccacatgcccagccacctgggcacctactactag

SEQ ID NO: 22441 - DNA, 1461 bp, Artificial Sequence
  Description of Artificial Sequence: Synthetic coding sequence
atgatccagacagtgcctgaccctgctgcccacatcaaggaggccctgtctgtggtgtctgaggaccagagcctgtttgaatgtgcctacggcaccccccacctggccaagacagagatgacagccagcagcagcagtgactatggccagaccagcaagatgagcccccgggtgccccagcaggactggctgagccagcccccagcccgggtgaccatcaagatggagtgcaaccccagccaggtgaatggcagcaggaacagcccagatgaatgttctgtggccaagggcggcaagatggtgggcagcccagacacagtgggcatgaactacggcagctacatggaggagaagcacatgcccccacccaacatgaccaccaatgaaagaagagtgattgtgcctgctgaccccaccctgtggagcacagaccacgtgcggcagtggctggagtgggccgtgaaggagtatggcctgcctgatgtgaacatcctgctcttccagaacattgatggcaaggagctgtgcaagatgaccaaggatgacttccagaggctgacccccagctacaatgctgacatcctgctgagccacctgcactacctgcgggagacccccctgccccacctgaccagtgatgatgtggacaaggccctgcagaacagcccccggctgatgcacgccagaaatactggaggagctgccttcatcttccccaacacctctgtgtacccagaggccacccagaggatcaccaccaggccagacctgccctatgagcccccaagaagaagtgcctggacaggccacggccaccccaccccccagagcaaggccgcccagcccagccccagcacagtgcccaagacagaggaccagaggccccagctggacccctaccagatcctgggccccaccagcagccggctggccaaccctggcagcggccagatccagctgtggcagttcctgctggagctgctgagtgacagcagcaacagcagctgcatcacctgggagggcaccaatggagagttcaagatgacagatcctgatgaggtggcccggcgctggggcgagaggaagagcaagcccaacatgaactatgacaagctgagccgggccctgcgctactactatgacaagaacatcatgaccaaggtgcacggcaagagatatgcctacaagtttgacttccacggcatcgcccaggccctgcagccccaccccccagagagcagcctgtacaagtaccccagcgacctgccctacatgggcagctaccacgcccacccccagaagatgaactttgtggccccccaccccccagccctgcctgtgaccagcagcagcttctttgctgcccccaacccctactggaacagccccaccggcggcatctaccccaacacccggctgcccaccagccacatgcccagccacctgggcacctactactag

SEQ ID NO: 22442 - DNA, 1461 bp, Artificial Sequence; identical to SEQ ID NO: 22441
  Description of Artificial Sequence: Synthetic coding sequence

SEQ ID NO: 22443 - DNA, 516 bp, Artificial Sequence
  Description of Artificial Sequence: Synthetic coding sequence
atggccagcaccatcaaggaggccctgtctgtggtgtctgaggaccagagcctgtttgaatgtgcctacggcaccccccacctggccaagacagagatgacagccagcagcagcagtgactatggccagaccagcaagatgagcccccgggtgccccagcaggactggctgagccagcccccagcccgggtgaccatcaagatggagtgcaaccccagccaggtgaatggcagcaggaacagcccagatgagtgcagcgtggccaagggcggcaagatggtgggcagcccagacacagtgggcatgaactacggcagctacatggaggagaagcacatgcccccacccaacatgaccaccaatgaaagaagagtcatcgtgcctgctgacctgccctatgagcccccaagaagaagtgcctggacaggccacggccaccccaccccccagagcaagggcaccgtgctggcccccatgaccctgtccttcatgagccaggccgtggatgactgctag

SEQ ID NO: 22444 - DNA, 1389 bp, Artificial Sequence; identical to SEQ ID NO: 22440
  Description of Artificial Sequence: Synthetic coding sequence

SEQ ID NO: 22445 - DNA, 1164 bp, Artificial Sequence
  Description of Artificial Sequence: Synthetic coding sequence
atggtgggcagcccagacacagtgggcatgaactacggcagctacatggaggagaagcacatgcccccacccaacatgaccaccaatgaaagaagagtcatcgtgcctgctgaccccaccctgtggagcacagaccacgtgcggcagtggctggagtgggccgtgaaggagtatggcctgcctgatgtgaacatcctgctcttccagaacattgatggcaaggagctgtgcaagatgaccaaggatgacttccagaggctgacccccagctacaatgctgacatcctgctgagccacctgcactacctgcgggagacccccctgccccacctgaccagtgatgatgtggacaaggccctgcagaacagcccccggctgatgcacgccaggaacacaggaggagctgccttcatcttccccaacacctctgtgtacccagaggccacccagaggatcaccaccaggccagacctgccctatgagcccccccggcgcagcgcctggacaggccacggccaccccaccccccagagcaaggccgcccagcccagccccagcacagtgcccaagacagaggaccagaggccccagctggacccctaccagatcctgggccccaccagcagccggctggccaaccctggcagcggccagatccagctgtggcagttcctgctggagctgctgagtgacagcagcaacagcagctgcatcacctgggagggcaccaacggggagttcaagatgacagatcctgatgaggtggcccggcgctggggcgagaggaagagcaagcccaacatgaactatgacaagctgagccgggccctgcgctactactatgacaagaacatcatgaccaaggtgcacggcaagagatatgcctacaagtttgacttccatggaattgcccaggccctgcagccccaccccccagagagcagcctgtacaagtaccccagcgacctgccctacatgggcagctaccacgcccacccccagaagatgaactttgtggccccccaccccccagccctgcctgtgaccagcagcagcttctttgctgcccccaacccctactggaacagccccactggaggcatctaccccaacacccggctgcccaccagccacatgcccagccacctgggcacctactactag

SEQ ID NO: 22446 - DNA, 1410 bp, Artificial Sequence
  Description of Artificial Sequence: Synthetic coding sequence
atgaatgactttggcatcaagaacatggaccaggtggcccctgtggccaacagctaccggggcaccctgaagaggcagcctgcctttgacacctttgatggcagcctgtttgctgtgttccccagcctgaatgaggagcagaccctgcaggaggtgcccaccggcctggacagcatcagccatgattctgccaactgtgagctgcccctgctgaccccctgcagcaaggctgtgatgagccaggccctgaaggccaccttcagcggcttcaagaaggagcagaggcggctgggcatccccaagaacccctggctgtggagcgagcagcaggtgtgccagtggctgctgtgggccaccaatgagttcagcctggtgaatgtgaacctgcagcgcttcggcatgaatggccagatgctgtgcaacctgggcaaggagcgcttcctggagctggccccagactttgtgggggacatcctgtgggagcacctggagcagatgatcaaggagaaccaggagaagacagaggaccagtatgaggagaacagccacctgacctctgtgccccactggatcaacagcaacaccctgggcttcggcacagagcaggccccctacggcatgcagacccagaactaccccaagggcggcctgctggacagcatgtgcccagccagcacccccagcgtgctgagcagcgagcaggagttccagatgttccccaagagccggctgagctctgtgtctgtgacctactgcagcgtgtcccaggacttccctggcagcaacctgaacctgctgaccaacaacagcggcacccccaaggaccatgacagcccagaaaatggagctgacagctttgagagcagtgacagcctgctgcagagctggaacagccagagcagcctgctggatgtgcagagggtgcccagctttgagagctttgaagatgactgcagccagagcctgtgcctgaacaagcccaccatgtccttcaaggactacatccaggagaggagtgaccctgtggagcagggcaagcctgtgatcccagctgctgtgctggccggcttcaccggcagcggccccatccagctgtggcagttcctgctggagctgctgagtgacaagagctgccagagcttcatctcctggacaggagatggctgggagttcaagctggccgaccctgatgaggtggcccggcgctggggcaagaggaagaacaagcccaagatgaactatgagaagctgagccggggcctgcgctactactatgacaagaacatcatccacaagaccagcggcaagcgctacgtgtacagatttgtgtgtgacctgcagaacctgctgggcttcaccccagaggagctgcacgccatcctgggcgtgcagcctgacacagaggactag

SEQ ID NO: 22447 - DNA, 1410 bp, Artificial Sequence; identical to SEQ ID NO: 22446
  Description of Artificial Sequence: Synthetic coding sequence

SEQ ID NO: 22448 - DNA, 507 bp, Artificial Sequence
  Description of Artificial Sequence: Synthetic coding sequence
atgaatgactttggcatcaagaacatggaccaggtggcccctgtggccaacagctaccggggcaccctgaagaggcagcctgcctttgacacctttgatggcagcctgtttgctgtgttccccagcctgaatgaggagcagaccctgcaggaggtgcccaccggcctggacagcatcagccatgattctgccaactgtgagctgcccctgctgaccccctgcagcaaggctgtgatgagccaggccctgaaggccaccttcagcggcttcaagaaggagcagaggcggctgggcatccccaagaacccctggctgtggagcgagcagcaggtgtgccagtggctgctgtgggccaccaatgagttcagcctggtgaatgtgaacctgcagcgcttcggcatgaatggccagatgctgtgcaacctgggcaaggagcgcttcctggagctggccccagactttgtgggggacatcctgtgggagcacctggagcagatgatcaagtag

SEQ ID NO: 22449 - DNA, 813 bp, Artificial Sequence
  Description of Artificial Sequence: Synthetic coding sequence
atgaatgactttggcatcaagaacatggaccaggtggcccctgtggccaacagctaccggggcaccctgaagaggcagcctgcctttgacacctttgatggcagcctgtttgctgtgttccccagcctgaatgaggagcagaccctgcaggaggtgcccaccggcctggacagcatcagccatgattctgccaactgtgagctgcccctgctgaccccctgcagcaaggctgtgatgagccaggccctgaaggccaccttcagcggcttcaagaaggagcagaggcggctgggcatccccaagaacccctggctgtggagcgagcagcaggtgtgccagtggctgctgtgggccaccaatgagttcagcctggtgaatgtgaacctgcagcgcttcggcatgaatggccagatgctgtgcaacctgggcaaggagcgcttcctggagctggccccagactttgtgggggacatcctgtgggagcacctggagcagatgatcaaggagaaccaggagaagacagaggaccagtatgaggagaacagccacctgacctctgtgccccactggatcaacagcaacaccctgggcttcggcacagagcaggccccctacggcatgcagacccagaactaccccaagggcggcctgctggacagcatgtgcccagccagcacccccagcgtgctgagcagcgagcaggagttccagatgttccccaagagccggctgagctctgtgtctgtgacctactgcagcgtgtcccaggacttccctggcagcaacctgaacctgctgaccaacaacagctag

SEQ ID NO: 22450 - DNA, 570 bp, Artificial Sequence
  Description of Artificial Sequence: Synthetic coding sequence
atgacagagtacaagctggtggtggtgggcgctgggggcgtgggcaagagcgccctgaccatccagctgatccagaaccactttgtggatgaatatgaccccaccattgaagattcctacaggaagcaggtggtgattgatggagagacctgcctgctggacatcctggacacagctggccaggaggagtacagcgccatgagggaccagtacatgaggactggagagggcttcctgtgtgtgtttgccatcaacaacaccaagagctttgaggacatccaccagtaccgggagcagatcaagagggtgaaggacagtgatgatgtgcccatggtgctggtgggcaacaagtgtgacctggccgccaggacagtggagagccggcaggcccaggacctggcccggagctatggcatcccctacatcgagaccagcgccaagacccggcagggcgtggaggatgccttctacaccctggtgcgggagatccggcagcacaagctgaggaagctgaaccccccagatgaaagtggccctggctgcatgagctgcaagtgtgtgctgtcctag

SEQ ID NO: 22451 - DNA, 513 bp, Artificial Sequence
  Description of Artificial Sequence: Synthetic coding sequence
atgacagagtacaagctggtggtggtgggcgctgggggcgtgggcaagagcgccctgaccatccagctgatccagaaccactttgtggatgaatatgaccccaccattgaagattcctacaggaagcaggtggtgattgatggagagacctgcctgctggacatcctggacacagctggccaggaggagtacagcgccatgagggaccagtacatgaggactggagagggcttcctgtgtgtgtttgccatcaacaacaccaagagctttgaggacatccaccagtaccgggagcagatcaagagggtgaaggacagtgatgatgtgcccatggtgctggtgggcaacaagtgtgacctggccgccaggacagtggagagccggcaggcccaggacctggcccggagctatggcatcccctacatcgagaccagcgccaagacccggcagggcagccgcagcggcagcagcagcagcagcggcaccctgtgggaccccccaggccccatgtag

SEQ ID NO: 22452 - DNA, 570 bp, Artificial Sequence; identical to SEQ ID NO: 22450
  Description of Artificial Sequence: Synthetic coding sequence

SEQ ID NO: 22453 - DNA, 513 bp, Artificial Sequence; identical to SEQ ID NO: 22451
  Description of Artificial Sequence: Synthetic coding sequence

SEQ ID NO: 22454 - DNA, 570 bp, Artificial Sequence; identical to SEQ ID NO: 22450
  Description of Artificial Sequence: Synthetic coding sequence

SEQ ID NO: 22455 - DNA, 513 bp, Artificial Sequence; identical to SEQ ID NO: 22451
  Description of Artificial Sequence: Synthetic coding sequence

SEQ ID NO: 22456 - DNA, 609 bp, Artificial Sequence
  Description of Artificial Sequence: Synthetic coding sequence
atgctgcccccaggcacagccaccctgctgaccctgctgctggccgccggcagcctgggccagaagccccagaggcccaggaggcctgccagccccatcagcaccatccagcccaaggccaactttgatgcccagcagtttgctggcacctggctgctggtggccgtgggcagcgcctgccgcttcctgcaggagcagggccacagagctgaggccaccaccctgcacgtggccccccagggcacagccatggctgtgtccaccttcaggaagctggatggcatctgctggcaggtgcggcagctgtatggagacaccggggtgctgggccgcttcctgctgcaggccagagatgcccggggagctgtgcacgtggtggtggccgagacagactaccagagctttgctgtgctgtacctggagagagctggccagctgtctgtgaagctgtatgcccggagcctgcctgtgtctgacagcgtgctgagcggctttgagcagagggtgcaggaggcccacctgacagaggaccagatcttctacttccccaagtatggcttctgtgaggccgctgaccagttccacgtgctggatgaggtgagaagatag

SEQ ID NO: 22457 - DNA, 522 bp, Artificial Sequence
  Description of Artificial Sequence: Synthetic coding sequence
ggcttcctggtgcccctgtggctgatgaggaactgcttccggctgcaggaggagatgctgcagcgggaggaggccgagaacaccctgcagagcttccggcaggatgtggacaatgccagcctggcccggctggacctggagaggaaggtggagagcctgcaggaggagatcgccttcctgaagaagctgcacgaggaggagatccaggagctgcaggcccagatccaggagcagcacgtgcagattgatgtggatgtgtccaagccagacctgacagctgccctgagagatgtgcggcagcagtatgagagcgtggccgccaagaacctgcaggaggccgaggagtggtacaagagcaagtttgctgacctgtctgaggccgccaacagaaataatgatgccctgcggcaggccaagcaggagagcacagagtaccgccggcaggtgcagagcctgacctgtgaggtggatgccctgaagggcaccgtgtccaccaacccagctgtgaaggagggcaagtag

SEQ ID NO: 22458 - DNA, 687 bp, Artificial Sequence
  Description of Artificial Sequence: Synthetic coding sequence
atgaggaactgcttccggctgcaggaggagatgctgcagcgggaggaggccgagaacaccctgcagagcttccggcaggatgtggacaatgccagcctggcccggctggacctggagaggaaggtggagagcctgcaggaggagatcgccttcctgaagaagctgcacgaggaggagatccaggagctgcaggcccagatccaggagcagcacgtgcagattgatgtggatgtgtccaagccagacctgacagctgccctgagagatgtgcggcagcagtatgagagcgtggccgccaagaacctgcaggaggccgaggagtggtacaagagcaagtttgctgacctgtctgaggccgccaacagaaataatgatgccctgcggcaggccaagcaggagagcacagagtaccgccggcaggtgcagagcctgacctgtgaggtggatgccctgaagggcaccaatgaaagcctggagcggcagatgagggagatggaggagaactttgctgtggaggccgccaactaccaggacaccatcggccgcctgcaggatgagatccagaacatgaaggaggagatggcccggcacctgcgggagtaccaggacctgctgaatgtgaagatggccctggacattgaaattgccacctacaggaagctgctggagggggaggagagcaggtag

SEQ ID NO: 22459 - DNA, 1296 bp, Artificial Sequence
  Description of Artificial Sequence: Synthetic coding sequence
atgagcaccaggtctgtgagcagcagcagctacagaaggatgtttggaggccctggaacagccagccggcccagcagcagccgctcctatgtgaccaccagcaccaggacctacagcctgggcagcgccctgcggcccagcaccagccgcagcctgtatgccagcagccctggaggagtgtatgccaccaggagcagcgctgtgcggctgcggagctctgtgcctggggtgcggctgctgcaggacagcgtggacttcagcctggctgatgccatcaacacagagttcaagaacaccaggaccaatgagaaggtggagctgcaggagctgaatgacagatttgccaactacatcgacaaggtgcgcttcctggagcagcagaacaagatcctgctggccgagctggagcagctgaagggccagggcaagagccggctgggggacctgtatgaggaggagatgagggagctgcggcggcaggtggaccagctgaccaatgacaaggcccgggtggaggtggagcgggacaacctggccgaggacatcatgaggctgcgggagaagctgcaggaggagatgctgcagcgggaggaggccgagaacaccctgcagagcttccggcaggatgtggacaatgccagcctggcccggctggacctggagaggaaggtggagagcctgcaggaggagatcgccttcctgaagaagctgcacgaggaggagatccaggagctgcaggcccagatccaggagcagcacgtgcagattgatgtggatgtgtccaagccagacctgacagctgccctgagagatgtgcggcagcagtatgagagcgtggccgccaagaacctgcaggaggccgaggagtggtacaagagcaagtttgctgacctgtctgaggccgccaacagaaataatgatgccctgcggcaggccaagcaggagagcacagagtaccgccggcaggtgcagagcctgacctgtgaggtggatgccctgaagggcaccaatgaaagcctggagcggcagatgagggagatggaggagaactttgctgtggaggccgccaactaccaggacaccatcggccgcctgcaggatgagatccagaacatgaaggaggagatggcccggcacctgcgggagtaccaggacctgctgaatgtgaagatggccctggacattgaaattgccacctacaggaagctgctggagggggaggagagccgcatcagcctgcccctgcccaacttcagcagcctgaacctgcggggcaagcacttcatcagcctgtag

SEQ ID NO: 22460 - DNA, 1401 bp, Artificial Sequence
  Description of Artificial Sequence: Synthetic coding sequence
atgagcaccaggtctgtgagcagcagcagctacagaaggatgtttggaggccctggaacagccagccggcccagcagcagccgctcctatgtgaccaccagcaccaggacctacagcctgggcagcgccctgcggcccagcaccagccgcagcctgtatgccagcagccctggaggagtgtatgccaccaggagcagcgctgtgcggctgcggagctctgtgcctggggtgcggctgctgcaggacagcgtggacttcagcctggctgatgccatcaacacagagttcaagaacaccaggaccaatgagaaggtggagctgcaggagctgaatgacagatttgccaactacatcgacaaggtgcgcttcctggagcagcagaacaagatcctgctggccgagctggagcagctgaagggccagggcaagagccggctgggggacctgtatgaggaggagatgagggagctgcggcggcaggtggaccagctgaccaatgacaaggcccgggtggaggtggagcgggacaacctggccgaggacatcatgaggctgcgggagaagctgcaggaggagatgctgcagcgggaggaggccgagaacaccctgcagagcttccggcaggatgtggacaatgccagcctggcccggctggacctggagaggaaggtggagagcctgcaggaggagatcgccttcctgaagaagctgcacgaggaggagatccaggagctgcaggcccagatccaggagcagcacgtgcagattgatgtggatgtgtccaagccagacctgacagctgccctgagagatgtgcggcagcagtatgagagcgtggccgccaagaacctgcaggaggccgaggagtggtacaagagcaagtttgctgacctgtctgaggccgccaacagaaataatgatgccctgcggcaggccaagcaggagagcacagagtaccgccggcaggtgcagagcctgacctgtgaggtggatgccctgaagggcaccaatgaaagcctggagcggcagatgagggagatggaggagaactttgctgtggaggccgccaactaccaggacaccatcggccgcctgcaggatgagatccagaacatgaaggaggagatggcccggcacctgcgggagtaccaggacctgctgaatgtgaagatggccctggacattgaaattgccacctacaggaagctgctggagggggaggagagccgcatcagcctgcccctgcccaacttcagcagcctgaacctgcgggagaccaacctggacagcctgcccctggtggacacccacagcaagaggaccctgctgatcaagacagtggagaccagagatggccaggtgatcaatgagaccagccagcaccatgatgacctggagtag

SEQ ID NO: 22461 - DNA, 1224 bp, Artificial Sequence
  Description of Artificial Sequence: Synthetic coding sequence
atgtttggaggccctggaacagccagccggcccagcagcagccgctcctatgtgaccaccagcaccaggacctacagcctgggcagcgccctgcggcccagcaccagccgcagcctgtatgccagcagccctgggggcgtgtatgccaccaggagcagcgctgtgcggctgcggagctctgtgcctggggtgcggctgctgcaggacagcgtggacttcagcctggctgatgccatcaacacagagttcaagaacaccaggaccaatgagaaggtggagctgcaggagctgaatgacagatttgccaactacatcgacaaggtgcgcttcctggagcagcagaacaagatcctgctggccgagctggagcagctgaagggccagggcaagagccggctgggggacctgtatgaggaggagatgagggagctgcggcggcaggtggaccagctgaccaatgacaaggcccgggtggaggtggagcgggacaacctggccgaggacatcatgaggctgcgggagaagctgcaggaggagatgctgcagcgggaggaggccgagaacaccctgcagagcttccggcaggatgtggacaatgccagcctggcccggctggacctggagaggaaggtggagagcctgcaggaggagatcgccttcctgaagaagctgcacgaggaggagatccaggagctgcaggcccagatccaggagcagcacgtgcagattgatgtggatgtgtccaagccagacctgacagctgccctgagagatgtgcggcagcagtatgaatctgtggccgccaagaacctgcaggaggccgaggagtggtacaagagcaagtttgctgacctgtctgaggccgccaacagaaataatgatgccctgcggcaggccaagcaggagagcacagagtaccgccggcaggtgcagagcctgacctgtgaggtggatgccctgaagggcaccaatgaaagcctggagcggcagatgagggagatggaggagaactttgctgtggaggccgccaactaccaggacaccatcggccgcctgcaggatgagatccagaacatgaaggaggagatggcccggcacctgcgggagtaccaggacctgctgaatgtgaagatggccctggacatcgagatcgccacctacaggaagctgctggagggggaggagagccgcatcctgtgcctcttccagaccttccccccatag

SEQ ID NO: 22462 - DNA, 2256 bp, Artificial Sequence
  Description of Artificial Sequence: Synthetic coding sequence
atggaggacctgagcagcccagacagcaccctgctgcagggcggccacaacctgctgagcagcgccagcttccaggaggccgtgaccttcaaggatgtgattgtggacttcacccaggaggagtggaagcagctggaccccggccagagggacctcttcagagatgtgaccctggagaactacacccacctggtgtccatcggcctgcaggtgtccaagccagatgtgatcagccagctggagcagggcacagagccctggatcatggagcccagcatccctgtgggcacctgtgccgactgggagacccggctggagaacagcgtgtctgcccctgagccagacatcagcgaggaggagctgagccctgaggtgattgtggagaagcacaagagagatgacagctggagcagcaacctgctggagagctgggagtatgagggcagcctggagcggcagcaggccaaccagcagaccctgcccaaggagatcaaggtgacagagaagaccatccccagctgggagaagggccctgtgaacaatgaatttgggaagtctgtgaatgtgagcagcaacctggtgacccaggagcccagccctgaggagaccagcaccaagaggagcatcaagcagaacagcaaccctgtgaagaaggagaagagctgcaagtgcaatgaatgtgggaaggccttctcctactgcagcgccctgatccgccaccagaggacccacactggagagaagccctacaagtgcaatgaatgtgagaaggccttcagccgctcagaaaatctcatcaaccaccagaggatccacactggagacaagccctacaagtgtgaccagtgtgggaagggcttcatcgagggccccagcctgacccagcaccagaggatccacactggagagaagccctacaagtgtgatgaatgtgggaaggccttcagccagaggacccacctggtgcagcaccagaggatccacactggagagaagccctacacctgcaatgaatgtgggaaggccttcagccagaggggccacttcatggagcaccagaagatccacactggagagaagcccttcaagtgtgatgaatgtgacaagaccttcaccaggagcacccacctgacccagcaccagaagatccacactggagagaagacctacaagtgcaatgaatgtgggaaggccttcaacggccccagcaccttcatccgccaccacatgatccacactggagagaagccctatgaatgtaatgaatgtgggaaggccttcagccagcacagcaacctgacccagcaccagaagacccacactggagagaagccctatgactgtgccgagtgtgggaagagcttctcctactggagcagcctggcccagcacctgaagatccacactggagagaagccctacaagtgcaatgaatgtgggaaggccttctcctactgcagcagcctgacccagcaccggcgcatccacacccgggagaagccctttgaatgttctgaatgtgggaaggccttctcctacctgagcaacctgaaccagcaccagaagacccacacccaggagaaggcctatgagtgcaaggaatgtgggaaggccttcatccgcagcagcagcctggccaagcatgagcgcatccacactggagagaagccctaccagtgccatgaatgtgggaagaccttctcctatggcagcagcctcatccagcacaggaagatccacactggagagcggccctacaagtgcaatgaatgtggccgggccttcaaccagaacatccacctgacccagcacaagaggatccacactggagccaagccctatgaatgtgccgagtgtgggaaggccttccgccactgcagcagcctggcccagcaccagaagacccacacagaggagaagccctaccagtgcaacaagtgtgagaagaccttcagccagagcagccacctgacccagcaccagaggatccacactggagagaagccctacaagtgcaatgaatgtgacaaggccttcagccgcagcacccacctgacagagcaccagaacacccacactggagagaagccctacaactgcaatgaatgtaggaagaccttcagccagagcacctacctgatccagcaccagaggatccacagcggggagaagcccttcggctgcaatgactgtgggaagagcttccgctacagaagtgccctgaacaagcaccagaggctgcaccctggcatctag

SEQ ID NO: 22463 - DNA, 3201 bp, Artificial Sequence
  Description of Artificial Sequence: Synthetic coding sequence
atgcctgtgttccacaccaggaccatcgagagcatcctggagcctgtggcccagcagatcagccacctggtgatcatgcatgaggagggggaggtggatggcaaggccatcccagacctgacagcccctgtggccgctgtgcaggccgctgtgagcaacctggtgcgggtgggcaaggagaccgtgcagaccacagaggaccagatcctgaagagggacatgcccccagccttcatcaaggtggagaatgcctgcaccaagctggtgcaggccgcccagatgctgcagagcgacccctacagcgtgcctgcccgggactacctgattgatggcagccggggcatcctgagcggcaccagtgacctgctgctgacctttgatgaagctgaggtgaggaagatcatccgggtgtgcaagggcatcctggagtacctgactgtggccgaggtggtggagaccatggaggacctggtgacctacaccaagaacctgggccctggcatgaccaagatggccaagatgattgatgagcggcagcaggagctgacccaccaggagcaccgggtgatgctggtgaacagcatgaacacagtgaaggagctgctgcctgtgctgatcagcgccatgaagatctttgtgaccaccaagaacagcaagaaccagggcatcgaggaggccctgaagaacagaaacttcaccgtggagaagatgtctgctgagatcaatgagatcatccgggtgctgcagctgacctcctgggatgaagatgcctgggccagcaaggacacagaggccatgaagagggccctggccagcattgacagcaagctgaaccaggccaagggctggctgcgggaccccagcgccagccctggagatgctggggagcaggccatccggcagatcctggatgaggccggcaaggtgggggagctgtgtgccggcaaggagcggcgggagatcctgggcacctgcaagatgctgggccagatgacagaccaggtggccgacctgcgggcccggggccagggcagcagccctgtggccatgcagaaggcccagcaggtgtcccagggcctggatgtgctgacagccaaggtggagaatgctgccaggaagctggaggccatgaccaacagcaagcagagcatcgccaagaagattgatgctgcccagaactggctggccgaccccaatggaggccctgagggggaggagcagatccggggggccctggccgaggccaggaagattgctgagctgtgtgatgaccccaaggagagagatgacatcctgcggagcctgggggagatcagcgccctgaccagcaagctggccgacctgcggcggcagggcaaaggagacagccctgaggcccgggccctggccaagcaggtggccacagccctgcagaacctgcagaccaagaccaacagagctgtggccaacagcaggcctgccaaggctgctgtgcacctggagggcaagattgagcaggcccagcgctggattgacaaccccaccgtggatgacagaggagtgggccaggccgccatccggggcctggtggccgagggccaccggctggccaacgtgatgatgggcccctaccggcaggacctgctggccaagtgtgacagagtggaccagctgacagcccagctggccgacctggccgcccggggggagggggagagcccccaggcccgggccctggccagccagctgcaggacagcctgaaggacctgaaggccaggatgcaggaggccatgacccaggaggtgtctgatgtgttcagtgacaccaccacccccatcaagctgctggccgtggccgccacagcccccccagatgcccccaaccgggaggaggtgtttgatgagcgggccgccaactttgagaaccacagcggcaagctgggcgccacagctgagaaggctgctgctgtgggcacagccaacaagagcacagtggagggcatccaggcctctgtgaagacagcccgggagctgaccccccaggtggtgtctgctgcccgcatcctgctgaggaaccctggcaaccaggccgcctatgagcactttgagaccatgaagaaccagtggattgacaacgtggagaagatgacaggcctggtggatgaggccatcgacaccaagagcctgctggatgccagcgaggaggccatcaagaaggacctggacaagtgcaaggtggccatggccaacatccagccccagatgctggtggccggggccaccagcatcgcccggcgggccaaccgcatcctgctggtggccaagcgggaggtggagaacagcgaggaccccaagttccgggaggccgtgaaggccgccagtgatgagctgagcaagaccatcagccccatggtgatggatgccaaggctgtggccggcaacatcagtgaccccggcctgcagaagagcttcctggacagcggctaccgcatcctgggcgctgtggccaaggtgcgggaggccttccagccccaggagccagacttccccccacctcctccagacctggagcagctgcggctgacagatgagctggccccacccaagccacccctgcctgagggggaggtgcccccacccaggcctcctcctcctgaggagaaggatgaggagttccctgagcagaaggccggggaggtgatcaaccagcccatgatgatggccgcccggcagctgcatgatgaggccaggaagtggagcagcaaaggaaatgacatcatcgccgccgccaagaggatggccctgctgatggccgagatgagccggctggtgcggggcggcagcggcaccaagagggccctgatccagtgtgccaaggacatcgccaaggccagtgatgaggtgacccggctggccaaggaggtggccaagcagtgcacagacaagaggatccgcaccaacctgctgcaggtgtgtgagcgcatccccaccatcagcacccagctgaagatcctgagcacagtgaaggccaccatgctgggccgcaccaacatcagtgatgaggagagcgagcaggccacagagatgctggtgcacaatgcccagaacctgatgcagagcgtgaaggagaccgtgcgggaggccgaggccgccagcatcaagatcagaacagatgctggcttcaccctgcgctgggtgaggaagaccccctggtaccagtag

SEQ ID NO: 22464 - DNA, 2784 bp, Artificial Sequence
  Description of Artificial Sequence: Synthetic coding sequence
atgctgcagagcgacccctacagcgtgcctgcccgggactacctgattgatggcagccggggcatcctgagcggcaccagtgacctgctgctgacctttgatgaggccgaggtgaggaagatcatccgggtgtgcaagggcatcctggagtacctgactgtggccgaggtggtggagaccatggaggacctggtgacctacaccaagaacctgggccctggcatgaccaagatggccaagatgattgatgagcggcagcaggagctgacccaccaggagcaccgggtgatgctggtgaacagcatgaacacagtgaaggagctgctgcctgtgctgatcagcgccatgaagatctttgtgaccaccaagaacagcaagaaccagggcatcgaggaggccctgaagaacagaaacttcaccgtggagaagatgtctgctgagatcaatgagatcatccgggtgctgcagctgacctcctgggatgaagatgcctgggccagcaaggacacagaggccatgaagagggccctggccagcattgacagcaagctgaaccaggccaagggctggctgcgggaccccagcgccagccctggagatgctggggagcaggccatccggcagatcctggatgaagctgggaaggtgggggagctgtgtgccggcaaggagcggcgggagatcctgggcacctgcaagatgctgggccagatgacagaccaggtggccgacctgcgggcccggggccagggcagcagccctgtggccatgcagaaggcccagcaggtgtcccagggcctggatgtgctgacagccaaggtggagaatgctgccaggaagctggaggccatgaccaacagcaagcagagcatcgccaagaagattgatgctgcccagaactggctggccgaccccaacggcggccctgagggggaggagcagatccggggggccctggccgaggccaggaagattgctgagctgtgtgatgaccccaaggagagagatgacatcctgcggagcctgggggagatcagcgccctgaccagcaagctggccgacctgcggcggcagggcaagggggacagccctgaggcccgggccctggccaagcaggtggccacagccctgcagaacctgcagaccaagaccaacagagctgtggccaacagcaggcctgccaaggctgctgtgcacctggagggcaagattgagcaggcccagcgctggattgacaaccccaccgtggatgaccggggcgtgggccaggccgccatccggggcctggtggccgagggccaccggctggccaacgtgatgatgggcccctaccggcaggacctgctggccaagtgtgacagagtggaccagctgacagcccagctggccgacctggccgcccggggggagggggagagcccccaggcccgggccctggccagccagctgcaggacagcctgaaggacctgaaggccaggatgcaggaggccatgacccaggaggtgtctgatgtgttcagtgacaccaccacccccatcaagctgctggccgtggccgccacagcccccccagatgcccccaaccgggaggaggtgtttgatgaaagagctgccaactttgagaaccacagcggcaagctgggcgccacagctgagaaggctgctgctgtgggcacagccaacaagagcacagtggagggcatccaggcctctgtgaagacagcccgggagctgaccccccaggtggtgtctgctgcccgcatcctgctgagaaatcctggcaaccaggccgcctatgagcactttgagaccatgaagaaccagtggattgacaacgtggagaagatgacaggcctggtggatgaggccatcgacaccaagagcctgctggatgccagcgaggaggccatcaagaaggacctggacaagtgcaaggtggccatggccaacatccagccccagatgctggtggccggggccaccagcatcgcccggcgggccaaccgcatcctgctggtggccaagcgggaggtggagaacagcgaggaccccaagttccgggaggccgtgaaggccgccagtgatgagctgagcaagaccatcagccccatggtgatggatgccaaggctgtggccggcaacatcagtgaccccggcctgcagaagagcttcctggacagcggctaccgcatcctgggcgctgtggccaaggtgcgggaggccttccagccccaggagccagacttccccccacctcctccagacctggagcagctgcggctgacagatgagctggccccacccaagccacccctgcctgagggggaggtgcccccaccccggcccccacctcctgaggagaaggatgaggagttccctgagcagaaggccggggaggtgatcaaccagcccatgatgatggccgcccggcagctgcatgatgaggccaggaagtggagcagcaagccaggcatcccagctgctgaggtgggcatcggcgtggtggccgaggctgatgctgctgatgctgctggcttccctgtgcccccagacatggaggatgattatgagcctgagctgctgctgatgcccagcaaccagcctgtgaaccagcccatcctggccgccgcccagagcctgcaccgggaggccaccaagtggagcagcaaaggaaatgacatcatcgctgctgccaagaggatggccctgctgatggccgagatgagccggctggtgcggggcggctctgtgcccaggaccagcccccggccccagatgaggtag

SEQ ID NO: 22465 - DNA, 984 bp, Artificial Sequence
  Description of Artificial Sequence: Synthetic coding sequence
atgcctgtgttccacaccaggaccatcgagagcatcctggagcctgtggcccagcagatcagccacctggtgatcatgcatgaggagggggaggtggatggcaaggccatcccagacctgacagcccctgtggccgctgtgcaggccgctgtgagcaacctggtgcgggtgggcaaggagaccgtgcagaccacagaggaccagatcctgaagagggacatgcccccagccttcatcaaggtggagaatgcctgcaccaagctggtgcaggccgcccagatgctgcagagcgacccctacagcgtgcctgcccgggactacctgattgatggcagccggggcatcctgagcggcaccagtgacctgctgctgacctttgatgaagctgaggtgcccccaccccggcccccacctcctgaggagaaggatgaggagttccctgagcagaaggccggggaggtgatcaaccagcccatgatgatggccgcccggcagctgcatgatgaggccaggaagtggagcagcaaaggaaatgacatcatcgctgctgccaagaggatggccctgctgatggccgagatgagccggctggtgcggggcggcagcggcaccaagagggccctgatccagtgtgccaaggacatcgccaaggccagtgatgaggtgacccggctggccaaggaggtggccaagcagtgcacagacaagaggatccgcaccaacctgctgcaggtgtgtgagcgcatccccaccatcagcacccagctgaagatcctgagcacagtgaaggccaccatgctgggccgcaccaacatcagtgatgaggagagcgagcaggccacagagatgctggtgcacaatgcccagaacctgatgcagagcgtgaaggagaccgtgcgggaggccgaggccgccagcatcaagatcagaacagatgctggcttcaccctgcgctgggtgaggaagaccccctggtaccagtag

SEQ ID NO: 22466 - DNA, 2421 bp, Artificial Sequence
  Description of Artificial Sequence: Synthetic coding sequence
ggccagatgacagaccaggtggccgacctgcgggcccggggccagggcagcagccctgtggccatgcagaaggcccagcaggtgtcccagggcctggatgtgctgacagccaaggtggagaatgctgccaggaagctggaggccatgaccaacagcaagcagagcatcgccaagaagattgatgctgcccagaactggctggccgaccccaatggaggccctgagggggaggagcagatccggggggccctggccgaggccaggaagattgctgagctgtgtgatgaccccaaggagagagatgacatcctgcggagcctgggggagatcagcgccctgaccagcaagctggccgacctgcggcggcagggcaaaggagacagccctgaggcccgggccctggccaagcaggtggccacagccctgcagaacctgcagaccaagaccaacagagctgtggccaacagcaggcctgccaaggctgctgtgcacctggagggcaagattgagcaggcccagcgctggattgacaaccccaccgtggatgacagaggagtgggccaggccgccatccggggcctggtggccgagggccaccggctggccaacgtgatgatgggcccctaccggcaggacctgctggccaagtgtgacagagtggaccagctgacagcccagctggccgacctggccgcccggggggagggggagagcccccaggcccgggccctggccagccagctgcaggacagcctgaaggacctgaaggccaggatgcaggaggccatgacccaggaggtgtctgatgtgttcagtgacaccaccacccccatcaagctgctggccgtggccgccacagcccccccagatgcccccaaccgggaggaggtgtttgatgagcgggccgccaactttgagaaccacagcggcaagctgggcgccacagctgagaaggctgctgctgtgggcacagccaacaagagcacagtggagggcatccaggcctctgtgaagacagcccgggagctgaccccccaggtggtgtctgctgcccgcatcctgctgaggaaccctggcaaccaggccgcctatgagcactttgagaccatgaagaaccagtggattgacaacgtggagaagatgacaggcctggtggatgaggccatcgacaccaagagcctgctggatgccagcgaggaggccatcaagaaggacctggacaagtgcaaggtggccatggccaacatccagccccagatgctggtggccggggccaccagcatcgcccggcgggccaaccgcatcctgctggtggccaagcgggaggtggagaacagcgaggaccccaagttccgggaggccgtgaaggccgccagtgatgagctgagcaagaccatcagccccatggtgatggatgccaaggctgtggccggcaacatcagtgaccccggcctgcagaagagcttcctggacagcggctaccgcatcctgggcgctgtggccaaggtgcgggaggccttccagccccaggagccagacttccccccacctcctccagacctggagcagctgcggctgacagatgagctggccccacccaagccacccctgcctgagggggaggtgcccccacccaggcctcctcctcctgaggagaaggatgaggagttccctgagcagaaggccggggaggtgatcaaccagcccatgatgatggccgcccggcagctgcatgatgaggccaggaagtggagcagcaagccaggcatcccagctgctgaggtgggcattggagtggtggccgaggctgatgctgctgatgctgctggcttccctgtgcccccagacatggaggatgattatgagcctgagctgctgctgatgcccagcaaccagcctgtgaaccagcccatcctggccgccgcccagagcctgcaccgggaggccaccaagtggagcagcaaaggaaatgacatcatcgccgccgccaagaggatggccctgctgatggccgagatgagccggctggtgcggggcggcagcggcaccaagagggccctgatccagtgtgccaaggacatcgccaaggccagtgatgaggtgacccggctggccaaggaggtggccaagcagtgcacagacaagaggatccgcaccaacctgctgcaggtgtgtgagcgcatccccaccatcagcacccagctgaagatcctgagcacagtgaaggccaccatgctgggccgcaccaacatcagtgatgaggagagcgagcaggccacagagatgctggtgcacaatgcccagaacctgatgcagagcgtgaaggagaccgtgcgggaggccgaggccgccagcatcaagatcagaacagatgctggcttcaccctgcgctgggtgaggaagaccccctggtaccagtag

SEQ ID NO: 22467 - DNA, 3021 bp, Artificial Sequence
  Description of Artificial Sequence: Synthetic coding sequence
atgcccccagccttcatcaaggtggagaatgcctgcaccaagctggtgcaggccgcccagatgctgcagagcgacccctacagcgtgcctgcccgggactacctgattgatggcagccggggcatcctgagcggcaccagtgacctgctgctgacctttgatgaggccgaggtgaggaagatcatccgggtgtgcaagggcatcctggagtacctgactgtggccgaggtggtggagaccatggaggacctggtgacctacaccaagaacctgggccctggcatgaccaagatggccaagatgattgatgagcggcagcaggagctgacccaccaggagcaccgggtgatgctggtgaacagcatgaacacagtgaaggagctgctgcctgtgctgatcagcgccatgaagatctttgtgaccaccaagaacagcaagaaccagggcatcgaggaggccctgaagaacagaaacttcaccgtggagaagatgtctgctgagatcaatgagatcatccgggtgctgcagctgacctcctgggatgaagatgcctgggccagcaaggacacagaggccatgaagagggccctggccagcattgacagcaagctgaaccaggccaagggctggctgcgggaccccagcgccagccctggagatgctggggagcaggccatccggcagatcctggatgaagctgggaaggtgggggagctgtgtgccggcaaggagcggcgggagatcctgggcacctgcaagatgctgggccagatgacagaccaggtggccgacctgcgggcccggggccagggcagcagccctgtggccatgcagaaggcccagcaggtgtcccagggcctggatgtgctgacagccaaggtggagaatgctgccaggaagctggaggccatgaccaacagcaagcagagcatcgccaagaagattgatgctgcccagaactggctggccgaccccaacggcggccctgagggggaggagcagatccggggggccctggccgaggccaggaagattgctgagctgtgtgatgaccccaaggagagagatgacatcctgcggagcctgggggagatcagcgccctgaccagcaagctggccgacctgcggcggcagggcaagggggacagccctgaggcccgggccctggccaagcaggtggccacagccctgcagaacctgcagaccaagaccaacagagctgtggccaacagcaggcctgccaaggctgctgtgcacctggagggcaagattgagcaggcccagcgctggattgacaaccccaccgtggatgaccggggcgtgggccaggccgccatccggggcctggtggccgagggccaccggctggccaacgtgatgatgggcccctaccggcaggacctgctggccaagtgtgacagagtggaccagctgacagcccagctggccgacctggccgcccggggggagggggagagcccccaggcccgggccctggccagccagctgcaggacagcctgaaggacctgaaggccaggatgcaggaggccatgacccaggaggtgtctgatgtgttcagtgacaccaccacccccatcaagctgctggccgtggccgccacagcccccccagatgcccccaaccgggaggaggtgtttgatgaaagagctgccaactttgagaaccacagcggcaagctgggcgccacagctgagaaggctgctgctgtgggcacagccaacaagagcacagtggagggcatccaggcctctgtgaagacagcccgggagctgaccccccaggtggtgtctgctgcccgcatcctgctgagaaatcctggcaaccaggccgcctatgagcactttgagaccatgaagaaccagtggattgacaacgtggagaagatgacaggcctggtggatgaggccatcgacaccaagagcctgctggatgccagcgaggaggccatcaagaaggacctggacaagtgcaaggtggccatggccaacatccagccccagatgctggtggccggggccaccagcatcgcccggcgggccaaccgcatcctgctggtggccaagcgggaggtggagaacagcgaggaccccaagttccgggaggccgtgaaggccgccagtgatgagctgagcaagaccatcagccccatggtgatggatgccaaggctgtggccggcaacatcagtgaccccggcctgcagaagagcttcctggacagcggctaccgcatcctgggcgctgtggccaaggtgcgggaggccttccagccccaggagccagacttccccccacctcctccagacctggagcagctgcggctgacagatgagctggccccacccaagccacccctgcctgagggggaggtgcccccaccccggcccccacctcctgaggagaaggatgaggagttccctgagcagaaggccggggaggtgatcaaccagcccatgatgatggccgcccggcagctgcatgatgaggccaggaagtggagcagcaaaggaaatgacatcatcgctgctgccaagaggatggccctgctgatggccgagatgagccggctggtgcggggcggcagcggcaccaagagggccctgatccagtgtgccaaggacatcgccaaggccagtgatgaggtgacccggctggccaaggaggtggccaagcagtgcacagacaagaggatccgcaccaacctgctgcaggtgtgtgagcgcatccccaccatcagcacccagctgaagatcctgagcacagtgaaggccaccatgctgggccgcaccaacatcagtgatgaggagagcgagcaggccacagagatgctggtgcacaatgcccagaacctgatgcagagcgtgaaggagaccgtgcgggagctgaagctgctgcagagcaagtttgagcagatgctggacctgcactgtgccggcctggagcggctgcccggcaccagccgccacctggccgagcccggctggcacaggaacctgtactag

SEQ ID NO: 22468 - DNA, 570 bp, Artificial Sequence
  Description of Artificial Sequence: Synthetic coding sequence
atgacagagtacaagctggtggtggtgggcgctgggggcgtgggcaagagcgccctgaccatccagctgatccagaaccactttgtggatgaatatgaccccaccattgaagattcctacaggaagcaggtggtgattgatggagagacctgcctgctggacatcctggacacagctggccaggaggagtacagcgccatgagggaccagtacatgaggactggagagggcttcctgtgtgtgtttgccatcaacaacaccaagagctttgaggacatccaccactaccgggagcagatcaagagggtgaaggacagtgaagatgtgcccatggtgctggtgggcaacaagtgtgacctgcccagcaggacagtggacaccaagcaggcccaggacctggcccggagctatggcatccccttcatcgagaccagcgccaagacccggcagagggtggaggatgccttctacaccctggtgcgggagatccggcagtaccgcctgaagaagatcagcaaggaggagaagaccccaggctgtgtgaagatcaagaagtgcatcatcatgtag

SEQ ID NO: 22469 - DNA, 567 bp, Artificial Sequence
  Description of Artificial Sequence: Synthetic coding sequence
atgacagagtacaagctggtggtggtgggcgctgggggcgtgggcaagagcgccctgaccatccagctgatccagaaccactttgtggatgaatatgaccccaccattgaagattcctacaggaagcaggtggtgattgatggagagacctgcctgctggacatcctggacacagctggccaggaggagtacagcgccatgagggaccagtacatgaggactggagagggcttcctgtgtgtgtttgccatcaacaacaccaagagctttgaggacatccaccactaccgggagcagatcaagagggtgaaggacagtgaagatgtgcccatggtgctggtgggcaacaagtgtgacctgcccagcaggacagtggacaccaagcaggcccaggacctggcccggagctatggcatccccttcatcgagaccagcgccaagacccggcagggcgtggatgatgccttctacaccctggtgcgggagatcaggaagcacaaggagaagatgagcaaggatggcaagaagaagaagaagaagagcaagaccaagtgtgtgatcatgtag

SEQ ID NO: 22470 - DNA, 228 bp, Artificial Sequence
  Description of Artificial Sequence: Synthetic coding sequence
atgacagagtacaagctggtggtggtgggcgctgggggcgtgggcaagagcgccctgaccatccagctgatccagaaccactttgtggatgaatatgaccccaccatcgagggcgtggatgatgccttctacaccctggtgcgggagatcaggaagcacaaggagaagatgagcaaggatggcaagaagaagaagaagaagagcaagaccaagtgtgtgatcatgtag

SEQ ID NO: 22471 - DNA, 2931 bp, Artificial Sequence
  Description of Artificial Sequence: Synthetic coding sequence
atgagaggagcccggggggcctgggacttcctgtgtgtgctgctgctgctgctgcgggtgcagacaggcagcagccagcccagcgtgtccccaggagagcccagcccccccagcatccaccctgggaagagtgacctgattgtgcgggtgggagatgagatccggctgctgtgcacagatcctggctttgtgaagtggacctttgagatcctggatgagaccaatgaaaacaagcagaatgagtggatcacagagaaggccgaggccaccaacacaggcaagtacacctgcaccaacaagcacggcctgagcaacagcatctacgtgtttgtgcgggaccctgccaagctgttcctggtggacaggagcctgtatggcaaggaggacaatgacaccctggtgcgctgccccctgacagatcctgaggtgaccaactacagcctgaagggctgccagggcaagcccctgcccaaggacctgcgcttcatcccagaccccaaggccggcatcatgatcaagtctgtgaagagggcctaccaccggctgtgcctgcactgcagcgtggaccaggagggcaagtctgtgctgtctgagaagttcatcctgaaggtgcggcctgccttcaaggctgtgcctgtggtgtctgtgtccaaggccagctacctgctgcgggagggggaggagttcaccgtgacctgcaccatcaaggatgtgagcagctctgtgtacagcacctggaagcgggagaacagccagaccaagctgcaggagaagtacaacagctggcaccacggggacttcaactatgagcggcaggccaccctgaccatcagcagcgcccgggtgaatgattctggagtcttcatgtgctacgccaacaacaccttcggcagcgccaacgtgaccaccaccctggaggtggtggacaagggcttcatcaacatcttccccatgatcaacaccaccgtgtttgtgaatgatggagaaaatgtggacctgattgtggagtatgaggccttccccaagccagagcaccagcagtggatctacatgaacagaaccttcacagacaagtgggaggactaccccaagtcagaaaatgaaagcaacatccgctacgtgtctgagctgcacctgacccggctgaagggcacagaaggaggcacctacaccttcctggtgagcaacagtgatgtgaatgctgccatcgccttcaacgtgtatgtgaacaccaagccagagatcctgacctatgaccggctggtgaatggcatgctgcagtgtgtggccgccggcttccctgagcccaccatcgactggtacttctgccccggcacagagcagcgctgcagcgcctctgtgctgcctgtggatgtgcagaccctgaacagcagcggccccccatttgggaagctggtggtgcagagcagcattgacagcagcgccttcaagcacaacggcaccgtggagtgcaaggcctacaatgatgtgggcaagaccagcgcctacttcaactttgccttcaagggcaacaacaaggagcagatccacccccacaccctcttcacccccctgctgattggatttgtgattgtggccggcatgatgtgcatcatcgtgatgatcctgacctacaagtacctgcagaagcccatgtatgaggtgcagtggaaggtggtggaggagatcaatggaaacaactacgtgtacatcgaccccacccagctgccctatgaccacaagtgggagttccccaggaaccggctgagctttgggaagaccctgggcgctggggccttcggcaaggtggtggaggccacagcctacggcctcatcaagagtgatgctgccatgacagtggccgtgaagatgctgaagcccagcgcccacctgacagagcgggaggccctgatgtctgagctgaaggtgctgagctacctgggcaaccacatgaacatcgtgaacctgctgggcgcctgcaccatcggcggccccaccctggtgatcacagagtactgctgctatggagacctgctgaacttcctgcggaggaagagggacagcttcatctgcagcaagcaggaggaccacgccgaggccgccctgtacaagaacctgctgcacagcaaggagagcagctgcagcgacagcaccaatgagtacatggacatgaagccaggagtgtcctatgtggtgcccaccaaggctgacaagagaagatctgtgcgcatcggcagctacatcgagagagatgtgaccccagccatcatggaggatgatgagctggccctggacctggaggacctgctgtccttctcctaccaggtggccaagggcatggccttcctggccagcaagaactgcatccaccgggacctggccgccaggaacatcctgctgacccacggccgcatcaccaagatctgtgactttggcctggcccgggacatcaagaatgacagcaactacgtggtgaagggaaatgcccggctgcctgtgaagtggatggcccctgagagcatcttcaactgtgtgtacacctttgaaagtgatgtgtggagctatggcatcttcctgtgggagctgttcagcctgggcagcagcccctacccaggcatgcctgtggacagcaagttctacaagatgatcaaggagggcttcaggatgctgagccctgagcacgccccagctgagatgtatgacatcatgaagacctgctgggatgctgaccccctgaagaggcccaccttcaagcagatcgtgcagctgattgagaagcagatcagcgagagcaccaaccacatctacagcaacctggccaactgcagccccaaccggcagaagcctgtggtggaccacagcgtgcgcatcaacagcgtgggcagcacagccagcagcagccagcccctgctggtgcatgatgatgtgtag

SEQ ID NO: 22472 - DNA, 2919 bp, Artificial Sequence
  Description of Artificial Sequence: Synthetic coding sequence
atgagaggagcccggggggcctgggacttcctgtgtgtgctgctgctgctgctgcgggtgcagacaggcagcagccagcccagcgtgtccccaggagagcccagcccccccagcatccaccctgggaagagtgacctgattgtgcgggtgggagatgagatccggctgctgtgcacagatcctggctttgtgaagtggacctttgagatcctggatgagaccaatgaaaacaagcagaatgagtggatcacagagaaggccgaggccaccaacacaggcaagtacacctgcaccaacaagcacggcctgagcaacagcatctacgtgtttgtgcgggaccctgccaagctgttcctggtggacaggagcctgtatggcaaggaggacaatgacaccctggtgcgctgccccctgacagatcctgaggtgaccaactacagcctgaagggctgccagggcaagcccctgcccaaggacctgcgcttcatcccagaccccaaggccggcatcatgatcaagtctgtgaagagggcctaccaccggctgtgcctgcactgcagcgtggaccaggagggcaagtctgtgctgtctgagaagttcatcctgaaggtgcggcctgccttcaaggctgtgcctgtggtgtctgtgtccaaggccagctacctgctgcgggagggggaggagttcaccgtgacctgcaccatcaaggatgtgagcagctctgtgtacagcacctggaagcgggagaacagccagaccaagctgcaggagaagtacaacagctggcaccacggggacttcaactatgagcggcaggccaccctgaccatcagcagcgcccgggtgaatgattctggagtcttcatgtgctacgccaacaacaccttcggcagcgccaacgtgaccaccaccctggaggtggtggacaagggcttcatcaacatcttccccatgatcaacaccaccgtgtttgtgaatgatggagaaaatgtggacctgattgtggagtatgaggccttccccaagccagagcaccagcagtggatctacatgaacagaaccttcacagacaagtgggaggactaccccaagtcagaaaatgaaagcaacatccgctacgtgtctgagctgcacctgacccggctgaagggcacagaaggaggcacctacaccttcctggtgagcaacagtgatgtgaatgctgccatcgccttcaacgtgtatgtgaacaccaagccagagatcctgacctatgaccggctggtgaatggcatgctgcagtgtgtggccgccggcttccctgagcccaccatcgactggtacttctgccccggcacagagcagcgctgcagcgcctctgtgctgcctgtggatgtgcagaccctgaacagcagcggccccccatttgggaagctggtggtgcagagcagcattgacagcagcgccttcaagcacaacggcaccgtggagtgcaaggcctacaatgatgtgggcaagaccagcgcctacttcaactttgccttcaaggagcagatccacccccacaccctcttcacccccctgctgattggatttgtgattgtggccggcatgatgtgcatcatcgtgatgatcctgacctacaagtacctgcagaagcccatgtatgaggtgcagtggaaggtggtggaggagatcaatggaaacaactacgtgtacatcgaccccacccagctgccctatgaccacaagtgggagttccccaggaaccggctgagctttgggaagaccctgggcgctggggccttcggcaaggtggtggaggccacagcctacggcctcatcaagagtgatgctgccatgacagtggccgtgaagatgctgaagcccagcgcccacctgacagagcgggaggccctgatgtctgagctgaaggtgctgagctacctgggcaaccacatgaacatcgtgaacctgctgggcgcctgcaccatcggcggccccaccctggtgatcacagagtactgctgctatggagacctgctgaacttcctgcggaggaagagggacagcttcatctgcagcaagcaggaggaccacgccgaggccgccctgtacaagaacctgctgcacagcaaggagagcagctgcagcgacagcaccaatgagtacatggacatgaagccaggagtgtcctatgtggtgcccaccaaggctgacaagagaagatctgtgcgcatcggcagctacatcgagagagatgtgaccccagccatcatggaggatgatgagctggccctggacctggaggacctgctgtccttctcctaccaggtggccaagggcatggccttcctggccagcaagaactgcatccaccgggacctggccgccaggaacatcctgctgacccacggccgcatcaccaagatctgtgactttggcctggcccgggacatcaagaatgacagcaactacgtggtgaagggaaatgcccggctgcctgtgaagtggatggcccctgagagcatcttcaactgtgtgtacacctttgaaagtgatgtgtggagctatggcatcttcctgtgggagctgttcagcctgggcagcagcccctacccaggcatgcctgtggacagcaagttctacaagatgatcaaggagggcttcaggatgctgagccctgagcacgccccagctgagatgtatgacatcatgaagacctgctgggatgctgaccccctgaagaggcccaccttcaagcagatcgtgcagctgattgagaagcagatcagcgagagcaccaaccacatctacagcaacctggccaactgcagccccaaccggcagaagcctgtggtggaccacagcgtgcgcatcaacagcgtgggcagcacagccagcagcagccagcccctgctggtgcatgatgatgtgtag

SEQ ID NO: 22473 - DNA, 1242 bp, Artificial Sequence
  Description of Artificial Sequence: Synthetic coding sequence
atgagaggagcccggggggcctgggacttcctgtgtgtgctgctgctgctgctgcgggtgcagacaggcagcagccagcccagcgtgtccccaggagagcccagcccccccagcatccaccctgggaagagtgacctgattgtgcgggtgggagatgagatccggctgctgtgcacagatcctggctttgtgaagtggacctttgagatcctggatgagaccaatgaaaacaagcagaatgagtggatcacagagaaggccgaggccaccaacacaggcaagtacacctgcaccaacaagcacggcctgagcaacagcatctacgtgtttgtgcgggaccctgccaagctgttcctggtggacaggagcctgtatggcaaggaggacaatgacaccctggtgcgctgccccctgacagatcctgaggtgaccaactacagcctgaagggctgccagggcaagcccctgcccaaggacctgcgcttcatcccagaccccaaggccggcatcatgatcaagtctgtgaagagggcctaccaccggctgtgcctgcactgcagcgtggaccaggagggcaagtctgtgctgtctgagaagttcatcctgaaggtgcggcctgccttcaaggctgtgcctgtggtgtctgtgtccaaggccagctacctgctgcgggagggggaggagttcaccgtgacctgcaccatcaaggatgtgagcagctctgtgtacagcacctggaagcgggagaacagccagaccaagctgcaggagaagtacaacagctggcaccacggggacttcaactatgagcggcaggccaccctgaccatcagcagcgcccgggtgaatgattctggagtcttcatgtgctacgccaacaacaccttcggcagcgccaacgtgaccaccaccctggaggtggtggacaagggcttcatcaacatcttccccatgatcaacaccaccgtgtttgtgaatgatggagaaaatgtggacctgattgtggagtatgaggccttccccaagccagagcaccagcagtggatctacatgaacagaaccttcacagacaagtgggaggactaccccaagtcagaaaatgaaagcaacatccgctacgtgtctgagctgcacctgacccggctgaagggcacagaaggaggcacctacaccttcctggtgagcaacagtgatgtgaatgctgccatcgccttcaacgtgtatgtgaacagcaagctgtag

SEQ ID NO: 22474 - DNA, 1212 bp, Artificial Sequence
  Description of Artificial Sequence: Synthetic coding sequence
atggccagcgagctggccatgagcaacagcgacctgcccaccagccccctggccatggagtatgtgaatgactttgacctgatgaagtttgaggtgaagaaggagcctgtggagacagaccgcatcatcagccagtgtggccgcctgattgctgggggcagcctgagcagcacccccatgagcaccccctgcagctctgtgccccccagccccagcttcagcgcccccagccctggcagcggcagcgagcagaaggcccacctggaggactactactggatgacaggctacccccagcagctgaaccctgaggccctgggcttctccccagaagatgctgtggaggccctgatcagcaacagccaccagctgcagggcggctttgatggctacgcccggggggcccagcagctggccgctgctgctggggccggggccggggccagcctgggcggcagcggggaggagatgggccctgctgctgctgtggtgtctgctgtgattgctgctgctgctgcccagagcggggccggcccccactaccaccaccaccaccaccacgccgccggccaccaccaccaccccacagctggggcccctggagctgctggcagcgctgctgccagcgctgggggcgccggcggggccggcggcggcggccctgccagcgctgggggcggcggcggcggcggcggcggcggcggcggcggcggggccgccggggccggcggggccctgcacccccaccacgccgccggcggcctgcactttgatgaccgcttcagtgatgagcagctggtgaccatgtctgtgcgggagctgaaccggcagctgcggggcgtgtccaaggaggaggtgatccggctgaagcagaagaggaggaccctgaagaacagaggctacgcccagagctgccgcttcaagagggtgcagcagagacatgtgctggagagcgagaagaaccagctgctgcagcaggtggaccacctgaagcaggagatcagccggctggtgcgggagagagatgcctacaaggagaagtatgagaagctggtgagcagcggcttccgggagaatggcagcagcagtgacaaccccagcagccctgagttcttcatcacagagcccaccaggaagctggagcccagcgtgggctacgccaccttctggaagccccagcaccgggtgctgacctctgtgttcaccaagtag

SEQ ID NO: 22475 - DNA, 1122 bp, Artificial Sequence
  Description of Artificial Sequence: Synthetic coding sequence
atggccagcgagctggccatgagcaacagcgacctgcccaccagccccctggccatggagtatgtgaatgactttgacctgatgaagtttgaggtgaagaaggagcctgtggagacagaccgcatcatcagccagtgtggccgcctgattgctgggggcagcctgagcagcacccccatgagcaccccctgcagctctgtgccccccagccccagcttcagcgcccccagccctggcagcggcagcgagcagaaggcccacctggaggactactactggatgacaggctacccccagcagctgaaccctgaggccctgggcttctccccagaagatgctgtggaggccctgatcagcaacagccaccagctgcagggcggctttgatggctacgcccggggggcccagcagctggccgctgctgctggggccggggccggggccagcctgggcggcagcggggaggagatgggccctgctgctgctgtggtgtctgctgtgattgctgctgctgctgcccagagcggggccggcccccactaccaccaccaccaccaccacgccgccggccaccaccaccaccccacagctggggcccctggagctgctggcagcgctgctgccagcgctgggggcgccggcggggccggcggcggcggccctgccagcgctgggggcggcggcggcggcggcggcggcggcggcggcggcggggccgccggggccggcggggccctgcacccccaccacgccgccggcggcctgcactttgatgaccgcttcagtgatgagcagctggtgaccatgtctgtgcgggagctgaaccggcagctgcggggcgtgtccaaggaggaggtgatccggctgaagcagaagaggaggaccctgaagaacagaggctacgcccagagctgccgcttcaagagggtgcagcagagacatgtgctggagagcgagaagaaccagctgctgcagcaggtggaccacctgaagcaggagatcagccggctggtgcgggagagagatgcctacaaggagaagtatgagaagctggtgagcagcggcttccgggagaatggcagcagcagtgacaaccccagcagccctgagttcttcatgtag

SEQ ID NO: 22476 - DNA, 1062 bp, Artificial Sequence
  Description of Artificial Sequence: Synthetic coding sequence
atggctgctgagctggccatgggcgctgagctgcccagcagccccctggccatcgagtatgtgaatgactttgacctgatgaagtttgaggtgaagaaggagcccccagaggccgagcgcttctgccaccggctgcccccaggcagcctgagcagcacccccctgagcaccccctgcagctctgtgcccagcagccccagcttctgtgcccccagccctggcactggaggcggcggcggggccggcggcggcggcggcagcagccaggccggcggggcccctggcccccccagcggcggccctggagctgtgggcggcaccagcggcaagccagccctggaggacctgtactggatgagcggctaccagcaccacctgaaccctgaggccctgaacctgaccccagaagatgctgtggaggccctgattggcagcggccaccacggggcccaccacggggcccaccaccctgctgctgctgctgcctatgaggccttccggggccctggctttgctgggggcggcggcgcagatgacatgggcgccggccaccaccacggggcccaccacgccgcccaccaccaccacgccgcccaccaccaccaccaccaccaccaccaccacggcggggccggccatggaggaggagctggccaccacgtgcggctggaggagcgcttcagtgatgaccagctggtgtccatgtctgtgcgggagctgaaccggcagctgcggggcttcagcaaggaggaggtgatccggctgaagcagaagaggaggaccctgaagaacagaggctacgcccagagctgccgcttcaagagggtgcagcagaggcacatcctggagagcgagaagtgccagctgcagagccaggtggagcagctgaagctggaggtgggccgcctggccaaggagcgggacctgtacaaggagaagtatgagaagctggccggccggggcggccctggcagcgctgggggcgccggcttcccccgggagcccagccccccccaggccggccctgggggcgccaagggcacagctgacttcttcctgtag

SEQ ID NO: 22477 - DNA, 972 bp, Artificial Sequence
  Description of Artificial Sequence: Synthetic coding sequence
atggctgctgagctgtccatgggccctgagctgcccaccagccccctggccatggagtatgtgaatgactttgacctgctgaagtttgatgtgaagaaggagcccctgggccgggcagagcggcccggccggccctgcacccggctgcagcctgctggctctgtgagcagcacccccctgagcaccccctgcagctctgtgcccagcagccccagcttcagccccacagagcagaagacccacctggaggacctgtactggatggccagcaactaccagcagatgaaccctgaggccctgaacctgaccccagaagatgctgtggaggccctgattggcagccaccctgtgccccagcccctgcagagctttgacagcttccggggggcccaccaccaccaccaccaccaccacccccacccccaccacgcctacccaggggccggcgtggcccatgatgagctgggcccccacgcccacccccaccaccaccaccaccaccaggccagccccccacccagcagcgctgccagccctgcccagcagctgcccaccagccaccctggccctggcccccacgccacagccagcgccacagctgctggaggaaatggatctgtggaggaccgcttcagtgatgaccagctggtgtccatgtctgtgcgggagctgaacagacacctgcggggcttcaccaaggatgaggtgatccggctgaagcagaagaggaggaccctgaagaacagaggctacgcccagagctgccgctacaagagggtgcagcagaagcaccacctggagaatgagaagacccagctgatccagcaggtggagcagctgaagcaggaggtgtcccggctggcccgggagagagatgcctacaaggtgaagtgtgagaagctggccaacagcggcttccgggaggccggcagcaccagtgacagccccagcagccctgagttcttcctgtag

SEQ ID NO: 22478 - DNA, 972 bp, Artificial Sequence; identical to SEQ ID NO: 22477
  Description of Artificial Sequence: Synthetic coding sequence

SEQ ID NO: 22479 - DNA, 1233 bp, Artificial Sequence
  Description of Artificial Sequence: Synthetic coding sequence
atggccaagaggagccgctcagaagatgaagatgatgacctgcagtatgctgaccatgactatgaggtgccccagcagaagggcctgaagaagctgtggaacagagtgaagtggaccagagatgaagatgacaagctgaagaagctggtggagcagcacggcacagatgactggaccctgattgccagccacctgcagaacagaagtgacttccagtgccagcaccgctggcagaaggtgctgaaccctgagctgatcaagggcccctggaccaaggaggaggaccagagggtgattgagctggtgcagaagtatggcaagaagaggaagatgagggtgggccacagccctggcagcgagctgagagatggcagcctgaatgatggcggcaacatggccctgaagcacacccccctgaagaccctgcccttcagccccagccagttcttcaacacctgccctggaaatgagcagctgaacatcgagaaccccagcttcaccagcacccccatctgtggccagaaggccctgatcaccacccccctgcacaaggagaccacccccaaggaccagaaggaaaatgtgggcttccgcacccccaccatcagaagaagcatcctgggcaccacccccaggacccccacccccttcaagaatgccctggccgcccaggagaagaagtatggccccctgaagatcgtgtcccagcccctggccttcctggaggaggacatccgggaggtgctgaaggaggagactggaacagacctcttcctgaaggaggaggatgagcccgcctacaagagctgcaagcaggagaacacagccagcggcaagaaggtgaggaagagcctggtgctggacaactgggagaaggaggagagcggcacccagctgctgacagaggacatcagtgacatgcagagcgagaaccgcttcaccaccagcctgctgatgatccccctgctggagatccatgacaaccgctgcaacctgatccctgagaagcaggacatcaacagcaccaacaagacctacaccctgaccaagaagaagcccaaccccaacaccagcaaggtggtgaagctggagaagaacctgcagagcaactgtgagtgggagaccgtggtgtatggcaagacagaggaccagctgatcatgacagagcaggcccggcgctacctgagcacctacacagccaccagcagcaccagccgggccctgatcctgtag

SEQ ID NO: 22480 - DNA, 2259 bp, Artificial Sequence
  Description of Artificial Sequence: Synthetic coding sequence
atggccaagaggagccgctcagaagatgaagatgatgacctgcagtatgctgaccatgactatgaggtgccccagcagaagggcctgaagaagctgtggaacagagtgaagtggaccagagatgaagatgacaagctgaagaagctggtggagcagcacggcacagatgactggaccctgattgccagccacctgcagaacagaagtgacttccagtgccagcaccgctggcagaaggtgctgaaccctgagctgatcaagggcccctggaccaaggaggaggaccagagggtgattgagctggtgcagaagtatggccccaagcgctggagcctgattgccaagcacctgaagggcagaattggcaagcagtgccgggagcgctggcacaaccacctgaaccctgaggtgaagaagagctcctggacagaggaggaggaccgcatcatctatgaggcccacaagaggctgggcaaccgctgggccgagatcgccaagctgctgcccggccgcacagacaacagcatcaagaaccactggaacagcaccatgaggaggaaggtggagcaggagggctacctgcaggacggcatcaagtctgagaggagcagcagcaagctgcagcacaagccctgtgccgccatggaccacatgcagacccagaaccagttctacatccctgtgcagatccctggctaccagtatgtgtccccagagggcaactgcattgaacatgtgcagcccaccagcgccttcatccagcagcccttcattgatgaggaccctgacaaggagaagaagatcaaggagctggagatgctgctgatgtctgcagaaaatgaggtgcggaggaagaggatccccagccagcccggcagcttcagctcctggagcggcagcttcctgatggatgacaacatgagcaacaccctgaacagcctggatgagcacaccagcgagttctacagcatggatgagaaccagcctgtgtctgcccagcagaacagccccaccaagttcctggccgtggaggccaatgctgtgctgagcagcctgcagaccatccctgagtttgctgagaccctggagctgattgaaagtgaccctgtggcctggagcgatgtgaccagctttgacatcagtgatgctgctgccagccccatcaagagcacccctgtgaagctgatgaggatccagcacaatgaaggagccatggagtgccagttcaacgtgtccctggtgctggagggcaagaagaacacctgcaatggaggcaacagcgaggccgtgcccctgaccagccccaacatcgccaagttcagcaccccaccagccatcctgaggaagaagaggaagatgagggtgggccacagccctggcagcgagctgagagatggcagcctgaatgatggcggcaacatggccctgaagcacacccccctgaagaccctgcccttcagccccagccagttcttcaacacctgccctggaaatgagcagctgaacatcgagaaccccagcttcaccagcacccccatctgtggccagaaggccctgatcaccacccccctgcacaaggagaccacccccaaggaccagaaggaaaatgtgggcttccgcacccccaccatcagaagaagcatcctgggcaccacccccaggacccccacccccttcaagaatgccctggccgcccaggagaagaagtatggccccctgaagatcgtgtcccagcccctggccttcctggaggaggacatccgggaggtgctgaaggaggagactggaacagacctcttcctgaaggaggaggatgagcccgcctacaagagctgcaagcaggagaacacagccagcggcaagaaggtgaggaagagcctggtgctggacaactgggagaaggaggagagcggcacccagctgctgacagaggacatcagtgacatgcagagcgagaaccgcttcaccaccagcctgctgatgatccccctgctggagatccatgacaaccgctgcaacctgatccctgagaagcaggacatcaacagcaccaacaagacctacaccctgaccaagaagaagcccaaccccaacaccagcaaggtggtgaagctggagaagaacctgcagagcaactgtgagtgggagaccgtggtgtatggcaagacagaggaccagctgatcatgacagagcaggcccggcgctacctgagcacctacacagccaccagcagcaccagccgggccctgatcctgtag

SEQ ID NO: 22481 - DNA, 2079 bp, Artificial Sequence
  Description of Artificial Sequence: Synthetic coding sequence
atggccaagaggagccgctcagaagatgaagatgatgacctgcagtatgctgaccatgactatgaggtgccccagcagaagggcctgaagaagctgtggaacagagtgaagtggaccagagatgaagatgacaagctgaagaagctggtggagcagcacggcacagatgactggaccctgattgccagccacctgcagaacagaagtgacttccagtgccagcaccgctggcagaaggtgctgaaccctgagctgatcaagggcccctggaccaaggaggaggaccagagggtgattgagctggtgcagaagtatggccccaagcgctggagcctgattgccaagcacctgaagggcagaattggcaagcagtgccgggagcgctggcacaaccacctgaaccctgaggtgaagaagagctcctggacagaggaggaggaccgcatcatctatgaggcccacaagaggctgggcaaccgctgggccgagatcgccaagctgctgcccggccgcacagacaacagcatcaagaaccactggaacagcaccatgaggaggaaggtggagcaggagggctacctgcaggacggcatcaagtctgagaggagcagcagcaagctgcagcacaagccctgtgccgccatggaccacatgcagacccagaaccagttctacatccctgtgcagatccctggctaccagtatgtgtccccagagggcaactgcattgaacatgtgcagcccaccagcgccttcatccagcagcccttcattgatgaggaccctgacaaggagaagaagatcaaggagctggagatgctgctgatgtctgcagaaaatgaggtgcggaggaagaggatccccagccagcccggcagcttcagctcctggagcggcagcttcctgatggatgacaacatgagcaacaccctgaacagcctggatgagcacaccagcgagttctacagcatggatgagaaccagcctgtgtctgcccagcagaacagccccaccaagttcctggccgtggaggccaatgctgtgctgagcagcctgcagaccatccctgagtttgctgagaccctggagctgattgaaagtgaccctgtggcctggagcgatgtgaccagctttgacatcagtgatgctgctgccagccccatcaagagcacccctgtgaagctgatgaggatccagcacaatgaaggagccatggagtgccagttcaacgtgtccctggtgctggagggcaagaagaacacctgcaatggaggcaacagcgaggccgtgcccctgaccagccccaacatcgccaagttcagcaccccaccagccatcctgaggaagaagaggaagatgagggtgggccacagccctggcagcgagctgagagatggcagcctgaatgatggcggcaacatggccctgaagcacacccccctgaagaccctgcccttcagccccagccagttcttcaacacctgccctggaaatgagcagctgaacatcgagaaccccagcttcaccagcacccccatctgtggccagaaggccctgatcaccacccccctgcacaaggagaccacccccaaggaccagaaggaaaatgtgggcttccgcacccccaccatcagaagaagcatcctgggcaccacccccaggacccccacccccttcaagaatgccctggccgcccaggagaagaagtatggccccctgaagatcgtgtcccagcccctggccttcctggaggaggacatccgggaggtgctgaaggaggagactggaacagacctcttcctgaaggaggaggatgagcccgcctacaagagctgcaagcaggagaacacagccagcggcaagaaggtgaggaagagcctggtgctggacaactgggagaaggaggagagcggcacccagctgctgacagaggacatcagtgacatgcagagcaactgtgagtgggagaccgtggtgtatggcaagacagaggaccagctgatcatgacagagcaggcccggcgctacctgagcacctacacagccaccagcagcaccagccgggccctgatcctgtag

SEQ ID NO: 22482 - DNA, 711 bp, Artificial Sequence
  Description of Artificial Sequence: Synthetic coding sequence
atgtgtgtgtgtgccggctgcagagctgcccccagcagaagaggagctggccccctgcaggtggccggcggctggagcgagggcgctgacatggactatgacagctaccagcactacttctatgactatgactgtggggaggacttctaccgcagcacagcccccagcgaggacatctggaagaagtttgagctggtgcccagcccccccaccagccccccctggggcctgggccctggagctggggaccctgcccctggcatcggccccccagagccctggccaggcggctgcacaggagatgaagctgagagccggggccacagcaagggctggggcaggaactatgccagcatcatcagaagagactgcatgtggagcggcttcagcgcccgggagcggctggagagagctgtgtctgaccggctggcccctggggccccccggggcaacccccccaaggccagcgctgccccagactgcacccccagcctggaggccggcaacccagccccagctgccccctgccccctgggggagcccaagacccaggcctgcagcggcagcgagagccccagcgacagcggcaaggacctgcctgagcccagcaagaggggcccccctcatggctggcccaagctgtgcccctgcctgcggagcggcatcggcagcagccaggccctgggccccagcccccccctgtttggatag

SEQ ID NO: 22483 - DNA, 1095 bp, Artificial Sequence
  Description of Artificial Sequence: Synthetic coding sequence
atggactatgacagctaccagcactacttctatgactatgactgtggggaggacttctaccgcagcacagcccccagcgaggacatctggaagaagtttgagctggtgcccagcccccccaccagccccccctggggcctgggccctggagctggggaccctgcccctggcatcggccccccagagccctggccaggcggctgcacaggagatgaagctgagagccggggccacagcaagggctggggcaggaactatgccagcatcatcagaagagactgcatgtggagcggcttcagcgcccgggagcggctggagagagctgtgtctgaccggctggcccctggggccccccggggcaacccccccaaggccagcgctgccccagactgcacccccagcctggaggccggcaacccagccccagctgccccctgccccctgggggagcccaagacccaggcctgcagcggcagcgagagccccagcgacagtgaaaatgaggagattgatgtggtgacagtggagaagaggcagagcctgggcatcaggaagcctgtgaccatcaccgtgcgggctgaccccctggacccctgcatgaagcacttccacatcagcatccaccagcagcagcacaactatgctgcccgcttccccccagagagctgcagccaggaggaggccagcgagcggggcccccaggaggaggtgctggagagagatgctgctggggagaaggaggatgaggaggatgaggagatcgtgtccccacctcctgtggagagcgaggccgcccagagctgccaccccaagcctgtgtccagtgacacagaagatgtgaccaagaggaagaaccacaacttcctggagaggaagagaagaaatgacctgcggagccgcttcctggccctgcgggaccaggtgcccaccctggccagctgcagcaaggcccccaaggtggtgatcctgagcaaggccctggagtacctgcaggccctggtgggcgctgagaagaggatggccacagagaagaggcagctgcgctgccggcagcagcagctgcagaagagaattgcctacctgaccggctactag

SEQ ID NO: 22484 - DNA, 1185 bp, Artificial Sequence
  Description of Artificial Sequence: Synthetic coding sequence
atgtgtgtgtgtgccggctgcagagctgcccccagcagaagaggagctggccccctgcaggtggccggcggctggagcgagggcgctgacatggactatgacagctaccagcactacttctatgactatgactgtggggaggacttctaccgcagcacagcccccagcgaggacatctggaagaagtttgagctggtgcccagcccccccaccagccccccctggggcctgggccctggagctggggaccctgcccctggcatcggccccccagagccctggccaggcggctgcacaggagatgaagctgagagccggggccacagcaagggctggggcaggaactatgccagcatcatcagaagagactgcatgtggagcggcttcagcgcccgggagcggctggagagagctgtgtctgaccggctggcccctggggccccccggggcaacccccccaaggccagcgctgccccagactgcacccccagcctggaggccggcaacccagccccagctgccccctgccccctgggggagcccaagacccaggcctgcagcggcagcgagagccccagcgacagtgaaaatgaggagattgatgtggtgacagtggagaagaggcagagcctgggcatcaggaagcctgtgaccatcaccgtgcgggctgaccccctggacccctgcatgaagcacttccacatcagcatccaccagcagcagcacaactatgctgcccgcttccccccagagagctgcagccaggaggaggccagcgagcggggcccccaggaggaggtgctggagagagatgctgctggggagaaggaggatgaggaggatgaggagatcgtgtccccacctcctgtggagagcgaggccgcccagagctgccaccccaagcctgtgtccagtgacacagaagatgtgaccaagaggaagaaccacaacttcctggagaggaagagaagaaatgacctgcggagccgcttcctggccctgcgggaccaggtgcccaccctggccagctgcagcaaggcccccaaggtggtgatcctgagcaaggccctggagtacctgcaggccctggtgggcgctgagaagaggatggccacagagaagaggcagctgcgctgccggcagcagcagctgcagaagagaattgcctacctgaccggctactag

SEQ ID NO: 22485 - DNA, 621 bp, Artificial Sequence
  Description of Artificial Sequence: Synthetic coding sequence
atggactatgacagctaccagcactacttctatgactatgactgtggggaggacttctaccgcagcacagcccccagcgaggacatctggaagaagtttgagctggtgcccagcccccccaccagccccccctggggcctgggccctggagctggggaccctgcccctggcatcggccccccagagccctggccaggcggctgcacaggagatgaagctgagagccggggccacagcaagggctggggcaggaactatgccagcatcatcagaagagactgcatgtggagcggcttcagcgcccgggagcggctggagagagctgtgtctgaccggctggcccctggggccccccggggcaacccccccaaggccagcgctgccccagactgcacccccagcctggaggccggcaacccagccccagctgccccctgccccctgggggagcccaagacccaggcctgcagcggcagcgagagccccagcgacagcggcaaggacctgcctgagcccagcaagaggggcccccctcatggctggcccaagctgtgcccctgcctgcggagcggcatcggcagcagccaggccctgggccccagcccccccctgtttggatag

SEQ ID NO: 22486 - DNA, 303 bp, Artificial Sequence
  Description of Artificial Sequence: Synthetic coding sequence
atggactatgacagctaccagcactacttctatgactatgactgtggggaggacttctaccgcagcacagcccccagcgaggacatctggaagaagtttgagctggtgcccagcccccccaccagccccccctggggcctgggccctggagctggggaccctgcccctggcatcggccccccagagccctggccaggcggctgcacaggagatgaagctgagagccggggccacagcaagggctggggcaggaactatgccagcatcatcagaagagactgcatgtggagcggcttctcctag

SEQ ID NO: 22487 - DNA, 642 bp, Artificial Sequence
  Description of Artificial Sequence: Synthetic coding sequence
atgcccaggagagctgagaactgggatgaagctgaggtgggcgctgaggaggccggcgtggaggagtatggcccagaagaagatggaggagaggagagcggggctgaggagagcggccctgaggagagcggccctgaggagctgggcgctgaggaggagatggaggccggccggcccaggcctgtgctgcggtctgtgaacagccgggagcccagccaggtgatcttctgcaacagaagcccccgggtggtgctgcctgtgtggctgaactttgatggagagccccagccctaccccaccctgcccccaggcactggaagacgcatccacagctaccggggccacctgtggctgttcagagatgctggcacccatgatggcctgctggtgaaccagacagagctgtttgtgcccagcctgaatgtggatggccagcccatctttgccaacatcaccctgcctgtgtacaccctgaaggagcgctgcctgcaggtggtgcgcagcctggtgaagccagagaactaccgccgcctggacatcgtgcgcagcctgtatgaggacctggaggaccaccccaacgtgcagaaggacctggagcggctgacccaggagcgcatcgcccaccagaggatgggagactag

SEQ ID NO: 22488 - DNA, 519 bp, Artificial Sequence
  Description of Artificial Sequence: Synthetic coding sequence
atgcccaggagagctgagaactgggatgaagctgaggtgggcgctgaggaggccggcgtggaggagtatggcccagaagaagatggaggagaggagagcggggctgaggagagcggccctgaggagagcggccctgaggagctgggcgctgaggaggagatggaggccggccggcccaggcctgtgctgcggtctgtgaacagccgggagcccagccaggtgatcttctgcaacagaagcccccgggtggtgctgcctgtgtggctgaactttgatggagagccccagccctaccccaccctgcccccaggcactggaagacgcatccacagctacagagtgtacaccctgaaggagcgctgcctgcaggtggtgcgcagcctggtgaagccagagaactacagaaggctggacatcgtgcgcagcctgtatgaggacctggaggaccaccccaacgtgcagaaggacctggagcggctgacccaggagagaattgcccaccagaggatgggagactag

SEQ ID NO: 22489 - DNA, 396 bp, Artificial Sequence
  Description of Artificial Sequence: Synthetic coding sequence
atgcccaggagagctgagaactgggatgaagctgaggtgggcgctgaggaggccggcgtggaggagtatggcccagaagaagattcctaccggggccacctgtggctgttcagagatgctggcacccatgatggcctgctggtgaaccagacagagctgtttgtgcccagcctgaatgtggatggccagcccatctttgccaacatcaccctgcctgtgtacaccctgaaggagcgctgcctgcaggtggtgcgcagcctggtgaagccagagaactaccgccgcctggacatcgtgcgcagcctgtatgaggacctggaggaccaccccaacgtgcagaaggacctggagcggctgacccaggagcgcatcgcccaccagaggatgggagactag

SEQ ID NO: 22490 - DNA, 1281 bp, Artificial Sequence
  Description of Artificial Sequence: Synthetic coding sequence
atggtgcacttctgtggcctgctgaccctgcaccgggagcctgtgcccctgaagagcatctctgtgtctgtgaacatctatgaatttgtggccggcgtgtctgccaccctgaactatgaaaatgaggagaaggtgcccctggaggccttctttgtgttccccatggatgaagattctgctgtgtacagctttgaggccctggtggatggcaagaagatcgtggccgagctgcaggacaagatgaaggcccggaccaactatgagaaggccatcagccagggccaccaggccttcctgctggagggggacagcagcagcagagatgtgttcagctgcaatgtgggcaacctgcagcccggcagcaaggctgctgtgaccctgaagtatgtgcaggagctgcccctggaggctgatggagccctgcgctttgtgctgcctgctgtgctgaacccccgctaccagttcagcggcagcagcaaggacagctgcctgaatgtgaagacccccatcgtgcctgtggaggacctgccctacaccctgtccatggtggccaccatcgacagccagcacggcatcgagaaggtgcagagcaactgccccctgagccccacagagtacctgggggaggacaagaccagcgcccaggtgtccctggccgccggccacaagtttgacagagatgtggagctgctgatctactacaatgaggtgcacaccccatctgtggtgctggagatgggcatgcccaacatgaagccaggccacctgatgggagaccccagcgccatggtgtccttctaccccaacatccctgaggaccagcccagcaacacctgtggggagttcatcttcctgatggacagaagtggctccatgcagagccccatgagcagccaggacaccagccagctgcgcatccaggccgccaaggagaccctcatcctgctgctgaagagcctgcccatcggctgctacttcaacatctacggcttcggcagcagctatgaggcctgcttccctgagagcgtgaagtacacccagcagaccatggaggaggccctgggccgggtgaagctgatgcaggccgacctgggcggcacagagatcctggcccccctgcagaacatctaccggggccccagcatccctggccaccccctgcaggtgtttgagcggccctacaccctgactgtgctgctgctgcacctgagccctgagggcaacctgtgtgtgatccggcccaggcacagccgctggaccatcaccgtgtctgtgggctag

SEQ ID NO: 22491 - DNA, 2361 bp, Artificial Sequence
  Description of Artificial Sequence: Synthetic coding sequence
atggtgcacttctgtggcctgctgaccctgcaccgggagcctgtgcccctgaagagcatctctgtgtctgtgaacatctatgaatttgtggccggcgtgtctgccaccctgaactatgaaaatgaggagaaggtgcccctggaggccttctttgtgttccccatggatgaagattctgctgtgtacagctttgaggccctggtggatggcaagaagatcgtggccgagctgcaggacaagatgaaggcccggaccaactatgagaaggccatcagccagggccaccaggccttcctgctggagggggacagcagcagcagagatgtgttcagctgcaatgtgggcaacctgcagcccggcagcaaggctgctgtgaccctgaagtatgtgcaggagctgcccctggaggctgatggagccctgcgctttgtgctgcctgctgtgctgaacccccgctaccagttcagcggcagcagcaaggacagctgcctgaatgtgaagacccccatcgtgcctgtggaggacctgccctacaccctgtccatggtggccaccatcgacagccagcacggcatcgagaaggtgcagagcaactgccccctgagccccacagagtacctgggggaggacaagaccagcgcccaggtgtccctggccgccggccacaagtttgacagagatgtggagctgctgatctactacaatgaggtgcacaccccatctgtggtgctggagatgggcatgcccaacatgaagccaggccacctgatgggagaccccagcgccatggtgtccttctaccccaacatccctgaggaccagcccagcaacacctgtggggagttcatcttcctgatggacagaagtggctccatgcagagccccatgagcagccaggacaccagccagctgcgcatccaggccgccaaggagaccctcatcctgctgctgaagagcctgcccatcggctgctacttcaacatctacggcttcggcagcagctatgaggcctgcttccctgagagcgtgaagtacacccagcagaccatggaggaggccctgggccgggtgaagctgatgcaggccgacctgggcggcacagagatcctggcccccctgcagaacatctaccggggccccagcatccctggccaccccctgcagctgtttgtgttcacagatggagaggtgacagacaccttcagcgtcatcaaggaggtgcgcatcaaccggcagaagcaccgctgcttctcctttggaattggagagggcaccagcaccagcctcatcaagggcatcgcccgggccagcggcggcaccagcgagttcatcaccgggaaggacaggatgcagagcaaggccctgcggaccctgaagaggagcctgcagcctgtggtggaggatgtgtccctgtcctggcacctgcccccaggcctgagcgccaagatgctgagccctgagcagaccgtcatcttccggggccagaggctcatctcctatgcccagctgaccggccgcatgcctgctgctgagaccactggagaggtgtgcctgaagtacaccctgcagggcaagacctttgaggacaaggtgaccttccccctgcagcccaagccagatgtgaacctgaccatccaccggctggccgccaagagcctgctgcagaccaaggacatgggcctgcgggagaccccagccagtgacaagaaggatgccctgaacctgagcctggagagcggggtcatcagcagcttcaccgccttcatcgccatcaacaaggagctgaacaagcctgtgcagggccccctggcccacagagatgtgccccggcccatcctgctgggcgccagcgcccccctgaagatcaagtgccagagcggcttcaggaaggccctgcacagcgacaggcctccttctgccagccagcccagaggagagctgatgtgctacaaggccaagaccttccagatggatgactacagcctgtgtggcctcatcagccacaaggaccagcacagccctggctttggagagaaccacctggtgcagctgatctaccaccagaatgccaacggctcctgggacctgaatgaagacctggccaagatcctgggcatgagcctggaggagatcatggccgcccagcctgctgagctggtggacagcagcggctgggccaccatcctggccgtcatctggctgcacagcaatggcaaggacctgaagtgtgagtgggagctgctggagaggaaggctgtggcctggatgagggcccacgccggcagcaccatgcccagcgtggtgaaggccgccatcaccttcctgaagagctctgtggaccctgccatctttgccttctag

SEQ ID NO: 22492 - DNA, 1248 bp, Artificial Sequence
  Description of Artificial Sequence: Synthetic coding sequence
atggtgcacttctgtggcctgctgaccctgcaccgggagcctgtgcccctgaagagcatctctgtgtctgtgaacatctatgaatttgtggccggcgtgtctgccaccctgaactatgaaaatgaggagaaggtgcccctggaggccttctttgtgttccccatggatgaagattctgctgtgtacagctttgaggccctggtggatggcaagaagatcgtggccgagctgcaggacaagatgaaggcccggaccaactatgagaaggccatcagccagggccaccaggccttcctgctggagggggacagcagcagcagagatgtgttcagctgcaatgtgggcaacctgcagcccggcagcaaggctgctgtgaccctgaagtatgtgcaggagctgcccctggaggctgatggagccctgcgctttgtgctgcctgctgtgctgaacccccgctaccagttcagcggcagcagcaaggacagctgcctgaatgtgaagacccccatcgtgcctgtggaggacctgccctacaccctgtccatggtggccaccatcgacagccagcacggcatcgagaaggtgcagagcaactgccccctgagccccacagagtacctgggggaggacaagaccagcgcccaggtgtccctggccgccggccacaagtttgacagagatgtggagctgctgatctactacaatgaggtgcacaccccatctgtggtgctggagatgggcatgcccaacatgaagccaggccacctgatgggagaccccagcgccatggtgtccttctaccccaacatccctgaggaccagcccagcaacacctgtggggagttcatcttcctgatggacagaagtggctccatgcagagccccatgagcagccaggacaccagccagctgcgcatccaggccgccaaggagaccctcatcctgctgctgaagagcctgcccatcggctgctacttcaacatctacggcttcggcagcagctatgaggcctgcttccctgagagcgtgaagtacacccagcagaccatggaggaggccctgggccgggtgaagctgatgcaggccgacctgggcggcacagagatcctggcccccctgcagaacatctaccggggccccagcatccctggccaccccctgcagctgtttgtgttcacagatggagaggtgacagacaccttcagcgtcatcaaggaggtgcgcatcaaccggcagaagcacaggtag

SEQ ID NO: 22493 - DNA, 2361 bp, Artificial Sequence; identical to SEQ ID NO: 22491
  Description of Artificial Sequence: Synthetic coding sequence

SEQ ID NO: 22494 - DNA, 1248 bp, Artificial Sequence; identical to SEQ ID NO: 22492
  Description of Artificial Sequence: Synthetic coding sequence

SEQ ID NO: 22495 - DNA, 2301 bp, Artificial Sequence
  Description of Artificial Sequence: Synthetic coding sequence
atggccgccctgagcggcggcggcggcggcggcgctgagcccggccaggccctcttcaacggggacatggagcctgaggccggggccggggccggggccgccgccagcagcgctgctgaccctgccatccctgaggaggtgtggaacatcaagcagatgatcaagctgacccaggagcacatcgaggccctgctggacaagtttggaggagagcacaacccccccagcatctacctggaggcctatgaggagtacaccagcaagctggatgccctgcagcagcgggagcagcagctgctggagagcctgggcaatggaacagacttctctgtgagcagcagcgcctccatggacacagtgaccagcagcagcagcagcagcctgtctgtgctgcccagcagcctgagcgtcttccagaaccccacagatgtggcccggagcaaccccaagagcccccagaagcccatcgtgcgggtcttcctgcccaacaagcagaggacagtggtgcctgcccgctgtggggtgacagtgcgggacagcctgaagaaggccctgatgatgaggggcctcatccctgagtgctgtgctgtgtaccgcatccaggatggagagaagaagcccatcggctgggacacagacatctcctggctgaccggggaggagctgcacgtggaggtgctggagaatgtgcccctgaccacccacaactttgtgaggaagaccttcttcaccctggccttctgtgacttctgcaggaagctgctcttccagggcttccgctgccagacctgtggctacaagttccaccagcgctgcagcacagaggtgcccctgatgtgtgtgaactatgaccagctggacctgctgtttgtgtccaagttctttgagcaccaccccatcccccaggaggaggccagcctggccgagacagccctgaccagcggcagcagccccagcgccccagccagtgacagcatcggcccccagatcctgaccagccccagccccagcaagagcatccccatcccccagcccttccggccagcagatgaggaccacaggaaccagtttggccagagggacaggagcagcagcgcccccaacgtgcacatcaacaccatcgagcctgtgaacattgatgacctgatccgggaccagggcttcagaggagatggcggcagcaccaccggcctgagcgccaccccaccagccagcctgcccggcagcctgaccaacgtgaaggccctgcagaagagccctggcccccagcgggagaggaagagcagcagcagcagtgaagatagaaacaggatgaagaccctgggcagaagagacagcagtgatgactgggagatcccagatggccagatcaccgtgggccagagaattggcagcggcagctttggcaccgtgtacaagggcaagtggcatggagatgtggccgtgaagatgctgaatgtgacagcccccaccccccagcagctgcaggccttcaagaatgaggtgggcgtgctgaggaagaccaggcatgtgaacatcctgctcttcatgggctacagcaccaagccccagctggccatcgtgacccagtggtgtgagggcagcagcctgtaccaccacctgcacatcatcgagaccaagtttgagatgatcaagctgattgacatcgcccggcagacagcccagggcatggactacctgcacgccaagagcatcatccaccgggacctgaagagcaacaacatcttcctgcacgaggacctgactgtgaagatcggggactttggcctggccaccgtgaagagccgctggagcggcagccaccagtttgagcagctgagcggcagcatcctgtggatggcccctgaggtgatccgcatgcaggacaagaacccctacagcttccagagtgatgtgtatgccttcggcatcgtgctgtatgagctgatgacaggccagctgccctacagcaacatcaacaacagagaccagatcatcttcatggtgggccggggctacctgagcccagacctgagcaaggtgcgcagcaactgccccaaggccatgaagaggctgatggctgaatgtctgaagaagaagagagatgagcggcccctcttcccccagatcctggccagcattgagctgctggcccggagcctgcccaagatccacaggtctgccagcgagcccagcctgaacagagctggcttccagacagaggacttcagcctgtatgcctgtgccagccccaagacccccatccaggccggcggctacggggccttccctgtgcactag

SEQ ID NO: 22496 - DNA, 1947 bp, Artificial Sequence
  Description of Artificial Sequence: Synthetic coding sequence
atggagcacatccagggcgcctggaagaccatcagcaatggatttggcttcaaggatgctgtgtttgatggcagcagctgcatcagccccaccatcgtgcagcagtttggctaccagaggcgggccagtgatgatggcaagctgacagaccccagcaagaccagcaacaccatccgggtcttcctgcccaacaagcagaggacagtggtgaatgtgagaaatggcatgagcctgcatgactgcctgatgaaggccctgaaggtgcggggcctgcagcctgagtgctgtgctgtgttccggctgctgcacgagcacaagggcaagaaggcccggctggactggaacacagatgctgccagcctcatcggggaggagctgcaggtggacttcctggaccacgtgcccctgaccacccacaactttgccaggaagaccttcctgaagctggccttctgtgacatctgccagaagttcctgctgaatggcttccgctgccagacctgtggctacaagttccacgagcactgcagcaccaaggtgcccaccatgtgtgtggactggagcaacatccggcagctgctgctcttccccaacagcaccatcggggacagcggcgtgcctgccctgcccagcctgaccatgaggaggatgagggagagcgtgtccaggatgcctgtgagcagccagcaccgctacagcaccccccacgccttcaccttcaacaccagcagccccagcagcgagggcagcctgagccagaggcagaggagcaccagcacccccaacgtgcacatggtgtccaccaccctgcctgtggacagcaggatgattgaagatgccatccgcagccacagcgagagcgccagccccagcgccctgagcagcagccccaacaacctgagccccaccggctggagccagcccaagacccctgtgcctgcccagcgggagcgggcccctgtgtctggcacccaggagaagaacaagatccggccccggggccagagggacagcagctactactgggagattgaggccagcgaggtgatgctgagcaccagaattggcagcggcagctttggcaccgtgtacaagggcaagtggcatggagatgtggccgtgaagatcctgaaggtggtggaccccaccccagagcagttccaggccttcagaaatgaggtggccgtgctgaggaagaccaggcatgtgaacatcctgctcttcatgggctacatgaccaaggacaacctggccatcgtgacccagtggtgtgagggcagcagcctgtacaagcacctgcacgtgcaggagaccaagttccagatgttccagctgattgacatcgcccggcagacagcccagggcatggactacctgcacgccaagaacatcatccaccgggacatgaagagcaacaacatcttcctgcacgagggcctgactgtgaagatcggggactttggcctggccaccgtgaagagccgctggagcggcagccagcaggtggagcagcccaccggctctgtgctgtggatggcccctgaggtgatccgcatgcaggacaacaaccccttctccttccagagtgatgtgtacagctatggcatcgtgctgtatgagctgatgactggagagctgccctacagccacatcaacaacagagaccagatcatcttcatggtgggccggggctacgccagcccagacctgagcaagctgtacaagaactgccccaaggccatgaagaggctggtggccgactgtgtgaagaaggtgaaggaggagcggcccctcttcccccagatcctgagcagcattgagctgctgcagcacagcctgcccaagatcaacagaagtgccagcgagcccagcctgcaccgggccgcccacacagaggacatcaatgcctgcaccctgaccaccagcccccggctgcccgtcttctag

SEQ ID NO: 22497 - DNA, 2007 bp, Artificial Sequence
  Description of Artificial Sequence: Synthetic coding sequence
atggagcacatccagggcgcctggaagaccatcagcaatggatttggcttcaaggatgctgtgtttgatggcagcagctgcatcagccccaccatcgtgcagcagtttggctaccagaggcgggccagtgatgatggcaagctgacagaccccagcaagaccagcaacaccatccgggtcttcctgcccaacaagcagaggacagtggtgaatgtgagaaatggcatgagcctgcatgactgcctgatgaaggccctgaaggtgcggggcctgcagcctgagtgctgtgctgtgttccggctgctgcacgagcacaagggcaagaaggcccggctggactggaacacagatgctgccagcctcatcggggaggagctgcaggtggacttcctggaccacgtgcccctgaccacccacaactttgccaggaagaccttcctgaagctggccttctgtgacatctgccagaagttcctgctgaatggcttccgctgccagacctgtggctacaagttccacgagcactgcagcaccaaggtgcccaccatgtgtgtggactggagcaacatccggcagctgctgctcttccccaacagcaccatcggggacagcggcgtgcctgccctgcccagcctgaccatgaggaggatgagggagagcgtgtccaggatgcctgtgagcagccagcaccgctacagcaccccccacgccttcaccttcaacaccagcagccccagcagcgagggcagcctgagccagaggcagaggagcaccagcacccccaacgtgcacatggtgtccaccaccctgcctgtggacagcaggatgattgagaacaacaacctgagcgccagcccccgggcctggagccgccgcttctgcctgcggggcagagatgccatccgcagccacagcgagagcgccagccccagcgccctgagcagcagccccaacaacctgagccccaccggctggagccagcccaagacccctgtgcctgcccagcgggagcgggcccctgtgtctggcacccaggagaagaacaagatccggccccggggccagagggacagcagctactactgggagattgaggccagcgaggtgatgctgagcaccagaattggcagcggcagctttggcaccgtgtacaagggcaagtggcatggagatgtggccgtgaagatcctgaaggtggtggaccccaccccagagcagttccaggccttcagaaatgaggtggccgtgctgaggaagaccaggcatgtgaacatcctgctcttcatgggctacatgaccaaggacaacctggccatcgtgacccagtggtgtgagggcagcagcctgtacaagcacctgcacgtgcaggagaccaagttccagatgttccagctgattgacatcgcccggcagacagcccagggcatggactacctgcacgccaagaacatcatccaccgggacatgaagagcaacaacatcttcctgcacgagggcctgactgtgaagatcggggactttggcctggccaccgtgaagagccgctggagcggcagccagcaggtggagcagcccaccggctctgtgctgtggatggcccctgaggtgatccgcatgcaggacaacaaccccttctccttccagagtgatgtgtacagctatggcatcgtgctgtatgagctgatgactggagagctgccctacagccacatcaacaacagagaccagatcatcttcatggtgggccggggctacgccagcccagacctgagcaagctgtacaagaactgccccaaggccatgaagaggctggtggccgactgtgtgaagaaggtgaaggaggagcggcccctcttcccccagatcctgagcagcattgagctgctgcagcacagcctgcccaagatcaacagaagtgccagcgagcccagcctgcaccgggccgcccacacagaggacatcaatgcctgcaccctgaccaccagcccccggctgcccgtcttctag

SEQ ID NO: 22498 - DNA, 1302 bp, Artificial Sequence
  Description of Artificial Sequence: Synthetic coding sequence
atgtgtgtggactggagcaacatccggcagctgttcagccagcaccgctacagcacccctcatgccttcaccttcaacaccagcagccccagcagcgagggcagcctgagccagaggcagaggagcaccagcaccccaaatgtgcacatggtgtccaccaccctgcctgtggacagcaggatgattgaagatgccatccgcagccacagcgagagcgccagccccagcgccctgagcagcagccccaacaacctgagccccaccggctggagccagcccaagacccctgtgcctgcccagcgggagcgggcccctgtgtctggcacccaggagaagaacaagatccggccccggggccagagggacagcagctactactgggagattgaggccagcgaggtgatgctgagcacccgcatcggcagcggcagctttggaacagtgtacaagggcaagtggcatggagatgtggccgtgaagatcctgaaggtggtggaccccaccccagagcagttccaggccttcagaaatgaggtggccgtgctgaggaagaccaggcatgtgaacatcctgctcttcatgggctacatgaccaaggacaacctggccatcgtgacccagtggtgtgagggcagcagcctgtacaagcacctgcacgtgcaggagaccaagttccagatgttccagctgattgatattgcccggcagacagcccagggcatggactacctgcacgccaagaacatcatccaccgggacatgaagagcaacaacatcttcctgcacgagggcctgactgtgaagattggagactttggcctggccaccgtgaagagccgctggagcggcagccagcaggtggagcagcccactggatctgtgctgtggatggcccctgaggtgatccgcatgcaggacaacaaccccttctccttccagagtgatgtgtacagctatggaattgtgctgtatgagctgatgaccggggagctgccctacagccacatcaacaacagagaccagatcatcttcatggtgggccggggctacgccagcccagacctgagcaagctgtacaagaactgccccaaggccatgaagaggctggtggccgactgtgtgaagaaggtgaaggaggagcggcccctcttcccccagatcctgagcagcattgagctgctgcagcacagcctgcccaagatcaacagaagtgccagcgagcccagcctgcacagagctgcccacacagaggacatcaatgcctgcaccctgaccaccagcccccggctgcctgtgttctag

SEQ ID NO: 22499 - DNA, 1704 bp, Artificial Sequence
  Description of Artificial Sequence: Synthetic coding sequence
atgatggccaacagccagatcctgctgcggcaggccaccctgtctgtgttcagctgcaggaccagcaaggagcagtgcaagaaggcccggctggactggaacacagatgctgccagcctgattggagaggagctgcaggtggacttcctggaccacgtgcccctgaccacccacaactttgccaggaagaccttcctgaagctggccttctgtgacatctgccagaagttcctgctgaatggcttccgctgccagacctgtggctacaagttccacgagcactgcagcaccaaggtgcccaccatgtgtgtggactggagcaacatccggcagctgctgctcttccccaacagcaccatcggggacagcggcgtgcctgccctgcccagcctgaccatgaggaggatgagggagagcgtgtccaggatgcctgtgagcagccagcaccgctacagcacccctcatgccttcaccttcaacaccagcagccccagcagcgagggcagcctgagccagaggcagaggagcaccagcaccccaaatgtgcacatggtgtccaccaccctgcctgtggacagcaggatgattgaagatgccatccgcagccacagcgagagcgccagccccagcgccctgagcagcagccccaacaacctgagccccaccggctggagccagcccaagacccctgtgcctgcccagcgggagcgggcccctgtgtctggcacccaggagaagaacaagatccggccccggggccagagggacagcagctactactgggagattgaggccagcgaggtgatgctgagcacccgcatcggcagcggcagctttggaacagtgtacaagggcaagtggcatggagatgtggccgtgaagatcctgaaggtggtggaccccaccccagagcagttccaggccttcagaaatgaggtggccgtgctgaggaagaccaggcatgtgaacatcctgctcttcatgggctacatgaccaaggacaacctggccatcgtgacccagtggtgtgagggcagcagcctgtacaagcacctgcacgtgcaggagaccaagttccagatgttccagctgattgatattgcccggcagacagcccagggcatggactacctgcacgccaagaacatcatccaccgggacatgaagagcaacaacatcttcctgcacgagggcctgactgtgaagattggagactttggcctggccaccgtgaagagccgctggagcggcagccagcaggtggagcagcccactggatctgtgctgtggatggcccctgaggtgatccgcatgcaggacaacaaccccttctccttccagagtgatgtgtacagctatggaattgtgctgtatgagctgatgaccggggagctgccctacagccacatcaacaacagagaccagatcatcttcatggtgggccggggctacgccagcccagacctgagcaagctgtacaagaactgccccaaggccatgaagaggctggtggccgactgtgtgaagaaggtgaaggaggagcggcccctcttcccccagatcctgagcagcattgagctgctgcagcacagcctgcccaagatcaacagaagtgccagcgagcccagcctgcacagagctgcccacacagaggacatcaatgcctgcaccctgaccaccagcccccggctgcctgtgttctag

SEQ ID NO: 22500 - DNA, 1611 bp, Artificial Sequence
  Description of Artificial Sequence: Synthetic coding sequence
atgggcagcaacaagagcaagcccaaggatgccagccagaggagaagaagcctggagccagcagaaaatgtgcatggagctgggggcggggccttccctgccagccagacccccagcaagccagccagcgcagatggccaccggggccccagcgctgcctttgccccagctgctgctgagcccaagctgtttggaggcttcaacagcagtgacacagtgaccagcccccagagagctggccccctggccggcggcgtgaccacctttgtggccctgtatgactatgagagcaggacagaaacagacctgtccttcaagaagggggagcggctgcagatcgtgaacaacacagaaggagactggtggctggcccacagcctgagcacaggccagacaggctacatccccagcaactacgtggcccccagcgacagcatccaggccgaggagtggtactttgggaagatcacccggcgggagagcgagcggctgctgctgaatgctgagaacccccggggcaccttcctggtgcgggagagcgagaccaccaagggggcctactgcctgtctgtgtctgactttgacaatgccaagggcctgaatgtgaagcactacaagatcaggaagctggacagcggcggcttctacatcaccagcaggacccagttcaacagcctgcagcagctggtggcctactacagcaagcatgctgatggcctgtgccaccggctgaccaccgtgtgccccaccagcaagccccagacccagggcctggccaaggatgcctgggagatcccccgggagagcctgcggctggaggtgaagctgggccagggctgctttggagaggtgtggatgggcacctggaatggcaccaccagggtggccatcaagaccctgaagccaggcaccatgagccctgaggccttcctgcaggaggcccaggtgatgaagaagctgcggcatgagaagctggtgcagctgtatgctgtggtgtctgaggagcccatctacatcgtgacagagtacatgagcaagggcagcctgctggacttcctgaagggggagaccgggaagtacctgcggctgccccagctggtggacatggccgcccagatcgccagcggcatggcctacgtggagaggatgaactacgtgcaccgggacctgcgggccgccaacatcctggtgggggagaacctggtgtgcaaggtggccgactttggcctggcccggctgattgaagataatgagtacacagcccggcagggcgccaagttccccatcaagtggacagcccctgaggccgccctgtatggccgcttcaccatcaagagtgatgtgtggagctttggcatcctgctgacagagctgaccaccaagggccgggtgccctacccaggcatggtgaaccgggaggtgctggaccaggtggagcggggctacaggatgccctgccccccagaatgtcctgagagcctgcatgacctgatgtgccagtgctggaggaaggagcctgaggagcggcccacctttgagtacctgcaggccttcctggaggactacttcaccagcacagagccccagtaccagcccggggagaacctgtag

SEQ ID NO: 22501 - DNA, 1629 bp, Artificial Sequence
  Description of Artificial Sequence: Synthetic coding sequence
atgggcagcaacaagagcaagcccaaggatgccagccagaggagaagaagcctggagccagcagaaaatgtgcatggagctgggggcggggccttccctgccagccagacccccagcaagccagccagcgcagatggccaccggggccccagcgctgcctttgccccagctgctgctgagcccaagctgtttggaggcttcaacagcagtgacacagtgaccagcccccagagagctggccccctggccggcggcgtgaccacctttgtggccctgtatgactatgagagcaggacagaaacagacctgtccttcaagaagggggagcggctgcagatcgtgaacaacaccaggaaggtggatgtgcgggagggggactggtggctggcccacagcctgagcacaggccagacaggctacatccccagcaactacgtggcccccagcgacagcatccaggccgaggagtggtactttgggaagatcacccggcgggagagcgagcggctgctgctgaatgctgagaacccccggggcaccttcctggtgcgggagagcgagaccaccaagggggcctactgcctgtctgtgtctgactttgacaatgccaagggcctgaatgtgaagcactacaagatcaggaagctggacagcggcggcttctacatcaccagcaggacccagttcaacagcctgcagcagctggtggcctactacagcaagcatgctgatggcctgtgccaccggctgaccaccgtgtgccccaccagcaagccccagacccagggcctggccaaggatgcctgggagatcccccgggagagcctgcggctggaggtgaagctgggccagggctgctttggagaggtgtggatgggcacctggaatggcaccaccagggtggccatcaagaccctgaagccaggcaccatgagccctgaggccttcctgcaggaggcccaggtgatgaagaagctgcggcatgagaagctggtgcagctgtatgctgtggtgtctgaggagcccatctacatcgtgacagagtacatgagcaagggcagcctgctggacttcctgaagggggagaccgggaagtacctgcggctgccccagctggtggacatggccgcccagatcgccagcggcatggcctacgtggagaggatgaactacgtgcaccgggacctgcgggccgccaacatcctggtgggggagaacctggtgtgcaaggtggccgactttggcctggcccggctgattgaagataatgagtacacagcccggcagggcgccaagttccccatcaagtggacagcccctgaggccgccctgtatggccgcttcaccatcaagagtgatgtgtggagctttggcatcctgctgacagagctgaccaccaagggccgggtgccctacccaggcatggtgaaccgggaggtgctggaccaggtggagcggggctacaggatgccctgccccccagaatgtcctgagagcctgcatgacctgatgtgccagtgctggaggaaggagcctgaggagcggcccacctttgagtacctgcaggccttcctggaggactacttcaccagcacagagccccagtaccagcccggggagaacctgtag

SEQ ID NO: 22502 - DNA, 1611 bp, Artificial Sequence; identical to SEQ ID NO: 22500
  Description of Artificial Sequence: Synthetic coding sequence

SEQ ID NO: 22503 - DNA, 1611 bp, Artificial Sequence; identical to SEQ ID NO: 22500
  Description of Artificial Sequence: Synthetic coding sequence

SEQ ID NO: 22504 - DNA, 1611 bp, Artificial Sequence; identical to SEQ ID NO: 22500
  Description of Artificial Sequence: Synthetic coding sequence

SEQ ID NO: 22505 - DNA, 423 bp, Artificial Sequence
  Description of Artificial Sequence: Synthetic coding sequence
atgcccctggtgaagaggaacatcgaccccaggcacctgtgccacacagccctgccccggggcatcaagaatgagctggagtgtgtgaccaacatcagcctggccaacatcatccggcagctgagcagcctgagcaaatatgcagaggacatctttggagagctgttcaatgaggcccacagcttctccttccgggtgaacagcctgcaggagcgggtggaccggctgtctgtgtctgtgacccagctggaccccaaggaggaggagctgagcctgcaggacatcaccatgaggaaggccttccgcagcagcaccatccaggaccagcagctgtttgacaggaagaccctgcccatccccctgcaggagacctatgatgtgtgtgagcagcccccacccctgaacatcctgaccccctactag

SEQ ID NO: 22506 - DNA, 1680 bp, Artificial Sequence
  Description of Artificial Sequence: Synthetic coding sequence
atgcccctggtgaagaggaacatcgaccccaggcacctgtgccacacagccctgccccggggcatcaagaatgagctggagtgtgtgaccaacatcagcctggccaacatcatccggcagctgagcagcctgagcaaatatgcagaggacatctttggagagctgttcaatgaggcccacagcttctccttccgggtgaacagcctgcaggagcgggtggaccggctgtctgtgtctgtgacccagctggaccccaaggaggaggagctgagcctgcaggacatcaccatgaggaaggccttccgcagcagcaccatccaggaccagcagctgtttgacaggaagaccctgcccatccccctgcaggagacctatgatgtgtgtgagcagcccccacccctgaacatcctgaccccctacagagatgatggcaaggagggcctgaagttctacaccaaccccagctacttctttgacctgtggaaggagaagatgctgcaggacacagaggacaagaggaaggagaagaggaagcagaagcagaagaacctggaccggccccatgagcctgagaaggtgccccgggcccctcatgacagaagaagagagtggcagaagctggcccagggccctgagctggctgaagatgatgccaacctgctgcacaagcacatcgaggtggccaatggacctgccagccactttgagacccggccccagacctacgtggaccacatggatggcagctacagcctgagcgccctgcccttcagccagatgtctgagctgctgaccagggctgaggagcgggtgctggtgcggccccatgagcccccacctcctccacccatgcatggagctggagatgccaagcccatccccacctgcatcagcagcgccaccggcctgattgaaaatcggccccagagccctgccactggaagaacacctgtgtttgtgagccccaccccacctcctcctcctccacccctgcccagcgccctgagcaccagcagcctgcgggcctccatgaccagcaccccacctcctcctgtgcccccacctcctcctcctccagccacagccctgcaggccccagctgtgcccccacctccagcccccctgcagatcgcccctggggtgctgcacccagcccccccacccatcgccccacccctggtgcagcccagcccccctgtggcccgggccgcccctgtgtgtgaaacagtgcctgtgcaccccctgccccagggcgaggtgcagggcctgcccccacctcctcctcctccacccctgcccccacctggcatccggcccagcagccctgtgacagtgacagccctggcccaccccccatctggcctgcaccccacccccagcacagcccctggcccccacgtgcccctgatgccacccagcccccccagccaggtgatcccagccagcgagcccaagaggcaccccagcaccctgcccgtcatcagtgatgcccggtctgtgctgctggaggccatcaggaagggcatccagctgaggaaggtggaggagcagcgggagcaggaggccaagcatgaaagaattgaaaatgatgtggccaccatcctgagcagaagaattgctgtggagtacagcgacagtgaagatgacagcgagtttgatgaggtggactggctggagtag

SEQ ID NO: 22507 - DNA, 423 bp, Artificial Sequence; identical to SEQ ID NO: 22505
  Description of Artificial Sequence: Synthetic coding sequence

SEQ ID NO: 22508 - DNA, 1680 bp, Artificial Sequence; identical to SEQ ID NO: 22506
  Description of Artificial Sequence: Synthetic coding sequence

SEQ ID NO: 22509 - DNA, 1680 bp, Artificial Sequence; identical to SEQ ID NO: 22506
  Description of Artificial Sequence: Synthetic coding sequence

SEQ ID NO: 22510 - DNA, 1680 bp, Artificial Sequence; identical to SEQ ID NO: 22506
  Description of Artificial Sequence: Synthetic coding sequence

SEQ ID NO: 22511 - DNA, 1680 bp, Artificial Sequence; identical to SEQ ID NO: 22506
  Description of Artificial Sequence: Synthetic coding sequence

SEQ ID NO: 22512 - DNA, 270 bp, Artificial Sequence
  Description of Artificial Sequence: Synthetic coding sequence
atgcccctggtgaagaggaacatcgaccccaggcacctgtgccacacagccctgccccggggcatcaagaatgagctggagtgtgtgaccaacatcagcctggccaacatcatccggcagctgagcagcctgagcaaatatgcagaggacatctttggagagctgttcaatgaggcccacagcttctccttccgggtgaacagcctgcaggagcgggtggaccggctgtctgtgtctgtgacccagctggaccccaaggaggaggagtag

SEQ ID NO: 22513 - DNA, 543 bp, Artificial Sequence
  Description of Artificial Sequence: Synthetic coding sequence
atgcccctggtgaagaggaacatcgaccccaggcacctgtgccacacagccctgccccggggcatcaagaatgagctggagtgtgtgaccaacatcagcctggccaacatcatccggcagctgagcagcctgagcaaatatgcagaggacatctttggagagctgttcaatgaggcccacagcttctccttccgggtgaacagcctgcaggagcgggtggaccggctgtctgtgtctgtgacccagctggaccccaaggaggaggagctgagcctgcaggacatcaccatgaggaaggccttccgcagcagcaccatccaggaccagcagctgtttgacaggaagaccctgcccatccccctgcaggagacctatgatgtgtgtgagcagcccccacccctgaacatcctgaccccctacagagatgatggcaaggagggcctgaagttctacaccaaccccagctacttctttgacctgtggaaggagaagatgctgcaggacacagaggacaagaggaaggagaagaggaagcagaagtag

SEQ ID NO: 22514 - DNA, 270 bp, Artificial Sequence; identical to SEQ ID NO: 22512
  Description of Artificial Sequence: Synthetic coding sequence

SEQ ID NO: 22515 - DNA, 1497 bp, Artificial Sequence
  Description of Artificial Sequence: Synthetic coding sequence
atgcccctggtgaccaggaacatcgagcccaggcacctgtgccggcagaccctgcccagcgtgcgctctgagctggagtgtgtgaccaacatcaccctggccaacgtcatccggcagctgggcagcctgagcaaatatgcagaggacatctttggagagctgttcacccaggccaacacctttgccagccgggtgagcagcctggccgagcgggtggaccggctgcaggtgaaggtgacccagctggaccccaaggaggaggaggtgtccctgcagggcatcaacaccaggaaggccttccgcagcagcaccatccaggaccagaagctgtttgacaggaacagcctgcctgtgcctgtgctggagacctacaacacctgtgacaccccaccacccctgaacaacctgaccccctacagagatgatggcaaggaggccctgaagttctacacagaccccagctacttctttgacctgtggaaggagaagatgctgcaggacaccaaggacatcatgaaggagaagaggaagcacaggaaggagaagaaggacaaccccaacagaggaaatgtgaaccccaggaagatcaagaccaggaaggaggagtgggagaagatgaagatgggccaggagtttgtggagagcaaggagaagctgggcaccagcggctacccacccaccctggtgtaccagaatggcagcatcggctgtgtggagaatgtggatgccagcagctacccacctccaccccagagcgacagcgccagcagccccagccccagcttcagcgaggacaacctgcccccacctcctgctgagttctcctaccctgtggacaaccagaggggcagcggcctggccggccccaagaggagctctgtggtgagccccagccaccccccaccagccccacccctgggcagccccccaggccccaagccaggctttgcccctcctccagcccctcctcctcctcctccacccatgattggcatccccccacctcctcctcctgtgggcttcggcagccctggcaccccacctccacccagcccccccagcttccccccccacccagactttgctgcccctcctcctcctcctcctcctcctgctgctgactaccccaccctgcccccaccacccctgagccagcccactggaggagcccctcctcctcctcctcctcctcctcctcctggccccccacctccacccttcaccggggctgatggccagcctgccatccccccacccctgagtgacaccaccaagcccaagagcagcctgcctgctgtgtctgatgcccggagtgacctgctgagcgccatccggcagggcttccagctgcggcgggtggaggagcagcgggagcaggagaagagagatgtggtgggcaatgatgtggccaccatcctgagcagaagaattgctgtggagtacagcgacagtgaagatgacagcagcgagtttgatgaagatgactggagcgactag

SEQ ID NO: 22516 - DNA, 846 bp, Artificial Sequence
  Description of Artificial Sequence: Synthetic coding sequence
atgcccctggtgaccaggaacatcgagcccaggcacctgtgccggcagaccctgcccagcgtgcgctctgagctggagtgtgtgaccaacatcaccctggccaacgtcatccggcagctgggcagcctgagcaaatatgcagaggacatctttggagagctgttcacccaggccaacacctttgccagccgggtgagcagcctggccgagcgggtggaccggctgcaggtgaaggtgacccagctggaccccaaggaggaggaggtgtccctgcagggcatcaacaccaggaaggccttccgcagcagcaccatccaggaccagaagctgtttgacaggaacagcctgcctgtgcctgtgctggagacctacaacacctgtgacaccccaccacccctgaacaacctgaccccctacagagatgatggcaaggaggccctgaagttctacacagaccccagctacttctttgacctgtggaaggagaagatgctgcaggacaccaaggacatcatgaaggagaagaggaagcacaggaaggagaagaaggacaaccccaacagaggaaatgtgaaccccaggaagatcaagaccaggaaggaggagtgggagaagatgaagatgggccaggagtttgtggagagcaaggagaagctgggcaccagcggctacccacccaccctggtgtaccagaatggcagcatcggctgtgtggagaatgtggatgccagcagctacccacctccaccccagagcgacagcgccagcagccccagccccagcttcagcgaggacaacctgcccccacctcctgctgagttccgcttctctgctgcccagggctag

SEQ ID NO: 22517 - DNA, 1533 bp, Artificial Sequence
  Description of Artificial Sequence: Synthetic coding sequence
atgcctgtgcccccacctccagcccctcctcctccacccacctttgccctggccaacacagagaagcccaccctgaacaagacagagcaggccggcagaaatgccctgctgagtgacatcagcaagggcaagaagctgaagaagacagtgaccaatgacagaagtgcccccatcctggacaagcccaagggagctggagctgggggcggcggcggcggctttggaggcggcggcggctttggaggcggcggcggcggcggcggcggcggcagctttggaggcggcggccccccaggcctgggcggcctcttccaggccggcatgcccaagctgcggagcacagccaacagagacaatgattctgggggcagccggccccccctgctgcccccaggcggccgcagcaccagcgccaagcccttcagccccccatctggccctggccgcttccctgtgcccagccctggccacaggagcggccccccagagccccagaggaacaggatgcccccacccaggccagatgtgggcagcaagccagacagcatccccccacctgtgcccagcaccccccggcccatccagagcagcccccacaacagaggcagcccccctgtgcctgggggcccccggcagcccagccctggccccaccccaccacccttccctggcaacagaggaacagccctgggcggcggcagcatccggcagagccccctgagcagcagcagccccttcagcaaccggccccccctgccccccacccccagccgggccctggatgacaagcccccacctcctcctcctcctgtgggcaaccggcccagcatccaccgggaggccgtgcccccacctccaccccagaacaacaagccccctgtgcccagcaccccccggcccagcgccagcagccaggcccctcctcctcctcctccacccagccggcccggccccccacccctgccccccagcagcagtggaaatgatgagaccccccggctgccccagaggaacctgagcctgagcagcagcaccccacccctgcccagccctggccgcagcggccccctgcccccaccacccagcgagaggcctcctcctcctgtgcgggaccccccaggccgcagcggccccctgcccccacctcctcctgtgtccagaaatggcagcaccagccgggccctgcctgccaccccccagctgcccagccgctctggagtggacagccccaggagcggcccccggccccccctgcccccagaccggcccagcgctggggcccctcctcctcctccacccagcaccagcatcagaaatggcttccaggacagcccctgtgaagatgagtgggagagccgcttctacttccaccccatcagtgacctgcccccacctgagccctacgtgcagaccaccaagagctaccccagcaagctggccagaaatgaaagccgcagcggcagcaacagaagagagcggggggccccacccctgccccccatcccccggccccccaagcaggccgctgagtag

SEQ ID NO: 22518 - DNA, 1512 bp, Artificial Sequence
  Description of Artificial Sequence: Synthetic coding sequence
atgcctgtgcccccacctccagcccctcctcctccacccacctttgccctggccaacacagagaagcccaccctgaacaagacagagcaggccggcagaaatgccctgctgagtgacatcagcaagggcaagaagctgaagaagacagtgaccaatgacagaagtgcccccatcctggacaagcccaagggagctggagctgggggcggcggcggcggctttggaggcggcggcggctttggaggcggcggcggcggcggcggcggcggcagctttggaggcggcggccccccaggcctgggcggcctcttccaggccggcatgcccaagctgcggagcacagccaacagagacaatgattctgggggcagccggccccccctgctgcccccaggcggccgcagcaccagcgccaagcccttcagccccccatctggccctggccgcttccctgtgcccagccctggccacaggagcggccccccagagccccagaggaacaggatgcccccacccaggccagatgtgggcagcaagccagacagcatccccccacctgtgcccagcaccccccggcccatccagagcagcccccacaacagaggcagcccccctgtgcctgggggcccccggcagcccagccctggccccaccccaccacccttccctggcaacagaggaacagccctgggcggcggcagcatccggcagagccccctgagcagcagcagccccttcagcaaccggccccccctgccccccacccccagccgggccctggatgacaagcccccacctcctcctcctcctgtgggcaaccggcccagcatccaccgggaggccgtgcccccacctccaccccagaacaacaagccccctgtgcccagcaccccccggcccagcgccagcagccaggcccctcctcctcctcctccacccagccggcccggccccccacccctgccccccagcagcagtggaaatgatgagaccccccggctgccccagaggaacctgagcctgagcagcagcaccccacccctgcccagccctggccgcagcggccccctgcccccaccacccagcgagaggcctcctcctcctgtgcgggaccccccaggccgcagcggccccctgcccccacctcctcctgtgtccagaaatggcagcaccagccgggccctgcctgccaccccccagctgcccagccgctctggagtggacagccccaggagcggcccccggccccccctgcccccagaccggcccagcgctggggcccctcctcctcctccacccagcaccagcatcagaaatggcttccaggacagcccctgtgaagatgagtgggagagccgcttctacttccaccccatcagtgacctgcccccacctgagccctacgtgcagaccaccaagagctaccccagcaagctggccagaaatgaaagccgcagcggcagcaacagaagagagcggggggccccacccctgccccccatccccaggtag

SEQ ID NO: 22519 - DNA, 1512 bp, Artificial Sequence; identical to SEQ ID NO: 22518
  Description of Artificial Sequence: Synthetic coding sequence

SEQ ID NO: 22520 - DNA, 1512 bp, Artificial Sequence; identical to SEQ ID NO: 22518
  Description of Artificial Sequence: Synthetic coding sequence

SEQ ID NO: 22521 - DNA, 1080 bp, Artificial Sequence
  Description of Artificial Sequence: Synthetic coding sequence
atgcctgtgcccccacctccagcccctcctcctccacccacctttgccctggccaacacagagaagcccaccctgaacaagacagagcaggccggcagaaatgccctgctgagtgacatcagcaagggcaagaagctgaagaagacagtgaccaatgacagaagtgcccccatcctggacaagcccaagggagctggagctgggggcggcggcggcggctttggaggcggcggcggctttggaggcggcggcggcggcggcggcggcggcagctttggaggcggcggccccccaggcctgggcggcctcttccaggccggcatgcccaagctgcggagcacagccaacagagacaatgattctgggggcagccggccccccctgctgcccccaggcggccgcagcaccagcgccaagcccttcagccccccatctggccctggccgcttccctgtgcccagccctggccacaggagcggccccccagagccccagaggaacaggatgcccccacccaggccagatgtgggcagcaagccagacagcatccccccacctgtgcccagcaccccccggcccatccagagcagcccccacaacagaggcagcccccctgtgcctgggggcccccggcagcccagccctggccccaccccacctcctcctcctcctgtgcgggaccccccaggccgcagcggccccctgcccccacctcctcctgtgtccagaaatggcagcaccagccgggccctgcctgccaccccccagctgcccagccgctctggagtggacagccccaggagcggcccccggccccccctgcccccagaccggcccagcgctggggcccctcctcctcctccacccagcaccagcatcagaaatggcttccaggacagcccctgtgaagatgagtgggagagccgcttctacttccaccccatcagtgacctgcccccacctgagccctacgtgcagaccaccaagagctaccccagcaagctggccagaaatgaaagccgcagcggcagcaacagaagagagcggggggccccacccctgccccccatccccaggtag

SEQ ID NO: 22522 - DNA, 1482 bp, Artificial Sequence
  Description of Artificial Sequence: Synthetic coding sequence
atgcctgtgcccccacctccagcccctcctcctccacccacctttgccctggccaacacagagaagcccaccctgaacaagacagagcaggccggcagaaatgccctgctgagtgacatcagcaagggcaagaagctgaagaagacagtgaccaatgacagaagtgcccccatcctggacaagcccaagggagctggagctgggggcggcggcggcggctttggaggcggcggcggctttggaggcggcggcggcggcggcggcggcggcagctttggaggcggcggccccccaggcctgggcggcctcttccaggccggcatgcccaagctgcggagcacagccaacagagacaatgattctgggggcagccggccccccctgctgcccccaggcggccgcagcaccagcgccaagcccttcagccccccatctggccctggccgcttccctgtgcccagccctggccacaggagcggccccccagagccccagaggaacaggatgcccccacccaggccagatgtgggcagcaagccagacagcatccccccacctgtgcccagcaccccccggcccatccagagcagcccccacaacagaggcagcccccctgtgcctgggggcccccggcagcccagccctggccccaccccaccacccttccctggcaacagaggaacagccctgggcggcggcagcatccggcagagccccctgagcagcagcagccccttcagcaaccggccccccctgccccccacccccagccgggccctggatgacaagcccccacctcctcctcctcctgtgggcaaccggcccagcatccaccgggaggccgtgcccccacctccaccccagaacaacaagccccctgtgcccagcaccccccggcccagcgccagcagccaggcccctcctcctcctcctccacccagccggcccggccccccacccctgccccccagcagcagtggaaatgatgagaccccccggctgccccagaggaacctgagcctgagcagcagcaccccacccctgcccagccctggccgcagcggccccctgcccccaccacccagcgagaggcctcctcctcctgtgcgggaccccccaggccgcagcggccccctgcccccacctcctcctgtgtccagaaatggcagcaccagccgggccctgcctgccaccccccagctgcccagccgctctggagtggacagccccaggagcggcccccggccccccctgcccccagaccggcccagcgctggggcccctcctcctcctccacccagcaccagcatcagaaatggcttccaggacagcccctgtgaagatgagtgggagagccgcttctacttccaccccatcagtgacctgcccccacctgagccctacgtgcagaccaccaagagctaccccagcaagctggccagaaatgaaagccgctctgagtacttctgccagggcttctag

SEQ ID NO: 22523 - DNA, 303 bp, Artificial Sequence
  Description of Artificial Sequence: Synthetic coding sequence
atgcctgtgcccccacctccagcccctcctcctccacccacctttgccctggccaacacagagaagcccaccctgaacaagacagagcaggccggcagaaatgccctgctgagtgacatcagcaagggcaagaagctgaagaagacagtgaccaatgacagaagtgcccccatcctggacaagcccaagggagctggagctgggggcggcggcggcggctttggaggcggcggcggctttggaggcggcggcggcggcggcggcggcggcagctttggaggcggcggccccccaggcctgtag

SEQ ID NO: 22524 - DNA, 1647 bp, Artificial Sequence
  Description of Artificial Sequence: Synthetic coding sequence
atgaagaccctggagacccagcccctggccccagactgctgccccagcgaccaggaccctgccccagcccaccccagcccccacgccagccccatgaacaagaatgctgacagcgagctgatgcctcctcctcctgagcggggggaccccccccggctgagcccagaccctgtggccggcagcgctgtgtcccaggagctgcgggagggggaccctgtgtccctgagcacccccctggagacagaatttggcagccccagcgagctgagccccagaattgaggagcaggagctgtctgagaacaccagcctgcctgctgaggaggccaacggcagcctgtctgaggaggaggccaatggacctgagctgggcagcggcaaggccatggaggacaccagcggggagcctgctgctgaagatgaaggagacacagcctggaactacagcttcagccagctgccccgcttcctgagcggctcctggagcgagttcagcacccagcctgagaacttcctgaagggctgcaagtgggccccagatggcagctgcatcctgaccaacagcgctgacaacatcctgcgcatctacaacctgcccccagagctgtaccacgagggggagcaggtggagtatgcagagatggtgcctgtgctgaggatggtggagggggacaccatctatgactactgctggtacagcctgatgagcagcgcccagcctgacaccagctatgtggccagcagcagccgggagaaccccatccacatctgggatgccttcaccggggagctgcgggccagcttccgggcctacaaccacctggatgagctgacagctgcccacagcctgtgcttctccccagatggcagccagctgttctgtggcttcaacagaacagtgcgggtcttcagcacagcccggcccggccgggactgtgaggtgcgggccacctttgccaagaagcagggccagagcggcatcatcagctgcatcgccttctccccagcccagcccctgtatgcctgtggcagctatggccgcagcctgggcctgtatgcctgggatgatggcagccccctggccctgctgggcggccaccagggcggcatcacccacctgtgcttccacccagatggcaaccgcttcttcagcggggccaggaaggatgctgagctgctgtgctgggacctgcggcagagcggctaccccctgtggagcctgggccgggaggtgaccaccaaccagaggatctactttgacctggaccccaccggccagttcctggtgtctggcagcaccagcggggctgtgtctgtgtgggacacagatggccctggaaatgatggcaagccagagcctgtgctgtccttcctgccccagaaggactgcaccaatggagtgtccctgcaccccagcctgcccctgctggccacagccagcggccagagggtcttccctgagcccacagaaagtggagatgaaggagaggagctgggcctgcccctgctgagcaccaggcatgtgcacctggagtgccgcctgcagctgtggtggtgtggcggggccccagacagcagcatcccagatgaccaccagggcgagaagggccagggcggcacagagggcggcgtgggggagctgatctag

SEQ ID NO: 22525 - DNA, 1647 bp, Artificial Sequence; identical to SEQ ID NO: 22524
  Description of Artificial Sequence: Synthetic coding sequence

SEQ ID NO: 22526 - DNA, 1647 bp, Artificial Sequence; identical to SEQ ID NO: 22524
  Description of Artificial Sequence: Synthetic coding sequence

SEQ ID NO: 22527 - DNA, 567 bp, Artificial Sequence
  Description of Artificial Sequence: Synthetic coding sequence
atgaagaccctggagacccagcccctggccccagactgctgccccagcgaccaggaccctgccccagcccagcctgacaccagctatgtggccagcagcagccgggagaaccccatccacatctgggatgccttcaccggggagctgcgggccagcttccgggcctacaaccacctggatgagctgacagctgcccacagcctgtgcttctccccagatggcagccagctgttctgtggcttcaacagaacagtgcgggtcttcagcacagcccggcccggccgggactgtgaggtgcgggccaccttcggcaagcacctgtgcctgcagggcagaagaagaggcaagggcacagccacctgcaccggggccttctgtgagcccggggccacctgtggcggcagccggcggcccctgtatggccctggcagccgctgcagccctgtgggccgcggggccaaccggctgcgggccggcaggaagcccagccagggccagcctgctggccagaggacagccagcttcctgaacagctaccctgtgtcctgtggggccttcggcctgtag

SEQ ID NO: 22528 - DNA, 1647 bp, Artificial Sequence; identical to SEQ ID NO: 22524
  Description of Artificial Sequence: Synthetic coding sequence

SEQ ID NO: 22529 - DNA, 1299 bp, Artificial Sequence
  Description of Artificial Sequence: Synthetic coding sequence
atggacacagagaagagcggcaagcgggagtttgatgtgcggcagaccccccaggtgaacatcaaccccttcaccccagacagcctgctgctgcacagcagcggccagtgcagaagaaggaagaggacctactggaatgacagctgtggggaggacatggaggccagtgactatgagctggaggatgagaccaggcctgccaagaggatcaccatcacagagagcaacatgaagagccgctacaccacagagttccacgagctggagaagattggcagcggggagtttggcagcgtcttcaagtgtgtgaagaggctggatggctgcatctatgccatcaagaggagcaagaagcccctggccggctctgtggatgagcagaatgccctgcgggaggtgtatgcccatgctgtgctgggccagcacagccacgtggtgcgctacttcagcgcctgggccgaggatgaccacatgctgatccagaatgagtactgcaatggaggcagcctggctgatgccatcagcgagaactaccgcatcatgagctacttcaaggaggccgagctgaaggacctgctgctgcaggtgggccggggcctgcgctacatccacagcatgagcctggtgcacatggacatcaagcccagcaacatcttcatcagcaggaccagcatccccaatgctgccagcgaggagggagatgaagatgactgggccagcaacaaggtgatgttcaagattggagacctgggccacgtgacccgcatcagcagcccccaggtggaggagggggacagccgcttcctggccaatgaggtgctgcaggagaactacacccacctgcccaaggctgacatctttgccctggccctgactgtggtgtgtgccgccggggctgagcccctgcccagaaatggagaccagtggcatgagatccggcagggccgcctgccccgcatcccccaggtgctgagccaggagttcacagagctgctgaaggtgatgatccacccagaccctgagcggcggcccagcgccatggccctggtgaagcacagcgtgctgctgagcgccagcaggaagtctgctgagcagctgcgcatcgagctgaatgctgagaagttcaagaacagcctgctgcagaaggagctgaagaaggcccagatggccaaggctgctgctgaggagcgggccctcttcacagacaggatggccaccaggagcaccacccagagcaacagaaccagccggctgattggcaagaagatgaacagatctgtgtccctgaccatctactag

SEQ ID NO: 22530 - DNA, 1941 bp, Artificial Sequence
  Description of Artificial Sequence: Synthetic coding sequence
atgtccttcctgagccggcagcagcccccacctccaagaagagctggagctgcctgcaccctgcggcagaagctgatcttcagcccctgcagcgactgtgaggaggaggaggaggaggaggaggaggagggcagcggccacagcactggagaagattctgccttccaggagccagacagccccctgcccccagcccggagccccacagagcccggccctgagcggcggcgcagccctggccctgcccctggcagccctggagagctggaggaggacctgctgctgcccggggcctgccctggagcagatgaagctgggggcggcgctgagggggacagctgggaggaggagggcttcggcagcagcagccctgtgaagagccctgctgccccctacttcctgggcagcagcttcagccctgtgcgctgtggcggccctggagatgccagcccccggggctgtggggccaggagagctggggagggcagaagaagccccaggccagaccaccctggcaccccaccccacaagaccttcaggaagctgcggctgtttgacaccccccacacccccaagagcctgctgagcaaggcccggggcatcgacagcagctctgtgaagctgcggggcagcagcctcttcatggacacagagaagagcggcaagcgggagtttgatgtgcggcagaccccccaggtgaacatcaaccccttcaccccagacagcctgctgctgcacagcagcggccagtgcagaagaaggaagaggacctactggaatgacagctgtggggaggacatggaggccagtgactatgagctggaggatgagaccaggcctgccaagaggatcaccatcacagagagcaacatgaagagccgctacaccacagagttccacgagctggagaagattggcagcggggagtttggcagcgtcttcaagtgtgtgaagaggctggatggctgcatctatgccatcaagaggagcaagaagcccctggccggctctgtggatgagcagaatgccctgcgggaggtgtatgcccatgctgtgctgggccagcacagccacgtggtgcgctacttcagcgcctgggccgaggatgaccacatgctgatccagaatgagtactgcaatggaggcagcctggctgatgccatcagcgagaactaccgcatcatgagctacttcaaggaggccgagctgaaggacctgctgctgcaggtgggccggggcctgcgctacatccacagcatgagcctggtgcacatggacatcaagcccagcaacatcttcatcagcaggaccagcatccccaatgctgccagcgaggagggagatgaagatgactgggccagcaacaaggtgatgttcaagattggagacctgggccacgtgacccgcatcagcagcccccaggtggaggagggggacagccgcttcctggccaatgaggtgctgcaggagaactacacccacctgcccaaggctgacatctttgccctggccctgactgtggtgtgtgccgccggggctgagcccctgcccagaaatggagaccagtggcatgagatccggcagggccgcctgccccgcatcccccaggtgctgagccaggagttcacagagctgctgaaggtgatgatccacccagaccctgagcggcggcccagcgccatggccctggtgaagcacagcgtgctgctgagcgccagcaggaagtctgctgagcagctgcgcatcgagctgaatgctgagaagttcaagaacagcctgctgcagaaggagctgaagaaggcccagatggccaaggctgctgctgaggagcgggccctcttcacagacaggatggccaccaggagcaccacccagagcaacagaaccagccggctgattggcaagaagatgaacagatctgtgtccctgaccatctactag

SEQ ID NO: 22531 - DNA, 1554 bp, Artificial Sequence
  Description of Artificial Sequence: Synthetic coding sequence
ctgcaggaccctgccagcacctgtgtgcctgagcccgccagccagcacaccctgcggagcggccctggctgcctgcagcagcctgagcagcagggcgtgcgggaccccggcggcatctgggccaagctgggcgctgctgaggccagcgctgagcggctgcagggccgccgcagcagaggagccagcggcagcgagccccagcagatgggcagtgatgtgcgggacctgaatgccctgctgcctgctgtgcccagcctgggcggcggcggcggctgtgccctgcctgtgtctggagctgcccagtgggcccctgtgctggactttgcccctcctggggccagcgcctacggcagcctgggcggccctgcccctcctccagcccctcctcctcctcctcctcctccaccccacagcttcatcaagcaggagcccagctggggcggcgctgagccccatgaggagcagtgcctgagcgccttcaccgtgcacttcagcggccagttcaccggcacagctggggcctgccgctatggccccttcggccccccaccacccagccaggccagcagcggccaggccaggatgttccccaatgccccctacctgcccagctgcctggagagccagcctgccatccggaaccagggctacagcacagtgacctttgatggcacccccagctatggccacacccccagccaccacgccgcccagttccccaaccacagcttcaagcatgaggaccccatgggccagcagggcagcctgggggagcagcagtacagcgtgcccccacctgtgtatggctgccacacccccacagacagctgcaccggcagccaggccctgctgctgcggaccccctacagcagtgacaacctgtaccagatgaccagccagctggagtgcatgacctggaaccagatgaacctgggcgccaccctgaagggcgtggccgccggcagcagcagctctgtgaagtggacagagggccagagcaaccacagcacaggctatgaaagtgacaaccacaccacccccatcctgtgtggggcccagtaccgcatccacacccatggagtcttccggggcatccaggatgtgagaagagtgcctggggtggcccccaccctggtgcgcagcgccagcgagaccagcgagaagaggcccttcatgtgtgcctacccaggctgcaacaagcgctacttcaagctgagccacctgcagatgcacagcaggaagcacactggagagaagccctaccagtgtgacttcaaggactgtgagcggcgcttcagcagaagtgaccagctgaagaggcaccagaggaggcacactggagtgaagcccttccagtgcaagacctgccagaggaagttcagcagaagtgaccacctgaagacccacaccaggacccacacaggcaagaccagcgagaagcccttcagctgccgctggcccagctgccagaagaagtttgcccggagtgatgagctggtgcgccaccacaacatgcaccagaggaacatgaccaagctgcagctggccctgtag

SEQ ID NO: 22532 - DNA, 954 bp, Artificial Sequence
  Description of Artificial Sequence: Synthetic coding sequence
ctgcaggaccctgccagcacctgtgtgcctgagcccgccagccagcacaccctgcggagcggccctggctgcctgcagcagcctgagcagcagggcgtgcgggaccccggcggcatctgggccaagctgggcgctgctgaggccagcgctgagcggctgcagggccgccgcagcagaggagccagcggcagcgagccccagcagatgggcagtgatgtgcgggacctgaatgccctgctgcctgctgtgcccagcctgggcggcggcggcggctgtgccctgcctgtgtctggagctgcccagtgggcccctgtgctggactttgcccctcctggggccagcgcctacggcagcctgggcggccctgcccctcctccagcccctcctcctcctcctcctcctccaccccacagcttcatcaagcaggagcccagctggggcggcgctgagccccatgaggagcagtgcctgagcgccttcaccgtgcacttcagcggccagttcaccggcacagctggggcctgccgctatggccccttcggccccccaccacccagccaggccagcagcggccaggccaggatgttccccaatgccccctacctgcccagctgcctggagagccagcctgccatccggaaccagggctacagcacagtgacctttgatggcacccccagctatggccacacccccagccaccacgccgcccagttccccaaccacagcttcaagcatgaggaccccatgggccagcagggcagcctgggggagcagcagtacagcgtgcccccacctgtgtatggctgccacacccccacagacagctgcaccggcagccaggccctgctgctgcggaccccctacagcagtgacaacctgtaccagatgaccagccagctggagtgcatgacctggaaccagatgaacctgggcgccaccctgaagggctag

SEQ ID NO: 22533 - DNA, 909 bp, Artificial Sequence
  Description of Artificial Sequence: Synthetic coding sequence
atggagaagggctacagcacagtgacctttgatggcacccccagctatggccacacccccagccaccacgccgcccagttccccaaccacagcttcaagcatgaggaccccatgggccagcagggcagcctgggggagcagcagtacagcgtgcccccacctgtgtatggctgccacacccccacagacagctgcaccggcagccaggccctgctgctgcggaccccctacagcagtgacaacctgtaccagatgaccagccagctggagtgcatgacctggaaccagatgaacctgggcgccaccctgaagggcgtggccgccggcagcagcagctctgtgaagtggacagagggccagagcaaccacagcacaggctatgaaagtgacaaccacaccacccccatcctgtgtggggcccagtaccgcatccacacccatggagtcttccggggcatccaggatgtgagaagagtgcctggggtggcccccaccctggtgcgcagcgccagcgagaccagcgagaagaggcccttcatgtgtgcctacccaggctgcaacaagcgctacttcaagctgagccacctgcagatgcacagcaggaagcacactggagagaagccctaccagtgtgacttcaaggactgtgagcggcgcttcagcagaagtgaccagctgaagaggcaccagaggaggcacactggagtgaagcccttccagtgcaagacctgccagaggaagttcagcagaagtgaccacctgaagacccacaccaggacccacactggagagaagcccttcagctgccgctggcccagctgccagaagaagtttgcccggagtgatgagctggtgcgccaccacaacatgcaccagaggaacatgaccaagctgcagctggccctgtag

SEQ ID NO: 22534 - DNA, 1545 bp, Artificial Sequence
  Description of Artificial Sequence: Synthetic coding sequence
ctgcaggaccctgccagcacctgtgtgcctgagcccgccagccagcacaccctgcggagcggccctggctgcctgcagcagcctgagcagcagggcgtgcgggaccccggcggcatctgggccaagctgggcgctgctgaggccagcgctgagcggctgcagggccgccgcagcagaggagccagcggcagcgagccccagcagatgggcagtgatgtgcgggacctgaatgccctgctgcctgctgtgcccagcctgggcggcggcggcggctgtgccctgcctgtgtctggagctgcccagtgggcccctgtgctggactttgcccctcctggggccagcgcctacggcagcctgggcggccctgcccctcctccagcccctcctcctcctcctcctcctccaccccacagcttcatcaagcaggagcccagctggggcggcgctgagccccatgaggagcagtgcctgagcgccttcaccgtgcacttcagcggccagttcaccggcacagctggggcctgccgctatggccccttcggccccccaccacccagccaggccagcagcggccaggccaggatgttccccaatgccccctacctgcccagctgcctggagagccagcctgccatccggaaccagggctacagcacagtgacctttgatggcacccccagctatggccacacccccagccaccacgccgcccagttccccaaccacagcttcaagcatgaggaccccatgggccagcagggcagcctgggggagcagcagtacagcgtgcccccacctgtgtatggctgccacacccccacagacagctgcaccggcagccaggccctgctgctgcggaccccctacagcagtgacaacctgtaccagatgaccagccagctggagtgcatgacctggaaccagatgaacctgggcgccaccctgaagggcgtggccgccggcagcagcagctctgtgaagtggacagagggccagagcaaccacagcacaggctatgaaagtgacaaccacaccacccccatcctgtgtggggcccagtaccgcatccacacccatggagtcttccggggcatccaggatgtgagaagagtgcctggggtggcccccaccctggtgcgcagcgccagcgagaccagcgagaagaggcccttcatgtgtgcctacccaggctgcaacaagcgctacttcaagctgagccacctgcagatgcacagcaggaagcacactggagagaagccctaccagtgtgacttcaaggactgtgagcggcgcttcagcagaagtgaccagctgaagaggcaccagaggaggcacactggagtgaagcccttccagtgcaagacctgccagaggaagttcagcagaagtgaccacctgaagacccacaccaggacccacactggagagaagcccttcagctgccgctggcccagctgccagaagaagtttgcccggagtgatgagctggtgcgccaccacaacatgcaccagaggaacatgaccaagctgcagctggccctgtag

SEQ ID NO: 22535 - DNA, 1494 bp, Artificial Sequence
  Description of Artificial Sequence: Synthetic coding sequence
ctgcaggaccctgccagcacctgtgtgcctgagcccgccagccagcacaccctgcggagcggccctggctgcctgcagcagcctgagcagcagggcgtgcgggaccccggcggcatctgggccaagctgggcgctgctgaggccagcgctgagcggctgcagggccgccgcagcagaggagccagcggcagcgagccccagcagatgggcagtgatgtgcgggacctgaatgccctgctgcctgctgtgcccagcctgggcggcggcggcggctgtgccctgcctgtgtctggagctgcccagtgggcccctgtgctggactttgcccctcctggggccagcgcctacggcagcctgggcggccctgcccctcctccagcccctcctcctcctcctcctcctccaccccacagcttcatcaagcaggagcccagctggggcggcgctgagccccatgaggagcagtgcctgagcgccttcaccgtgcacttcagcggccagttcaccggcacagctggggcctgccgctatggccccttcggccccccaccacccagccaggccagcagcggccaggccaggatgttccccaatgccccctacctgcccagctgcctggagagccagcctgccatccggaaccagggctacagcacagtgacctttgatggcacccccagctatggccacacccccagccaccacgccgcccagttccccaaccacagcttcaagcatgaggaccccatgggccagcagggcagcctgggggagcagcagtacagcgtgcccccacctgtgtatggctgccacacccccacagacagctgcaccggcagccaggccctgctgctgcggaccccctacagcagtgacaacctgtaccagatgaccagccagctggagtgcatgacctggaaccagatgaacctgggcgccaccctgaagggccacagcacaggctatgaaagtgacaaccacaccacccccatcctgtgtggggcccagtaccgcatccacacccacggcgtcttccggggcatccaggatgtgcggcgggtgcctggggtggcccccaccctggtgcgcagcgccagcgagaccagcgagaagaggcccttcatgtgtgcctacccaggctgcaacaagcgctacttcaagctgagccacctgcagatgcacagcaggaagcacactggagagaagccctaccagtgtgacttcaaggactgtgaaagacgcttcagcagaagtgaccagctgaagaggcaccagaggaggcacactggagtgaagcccttccagtgcaagacctgccagaggaagttcagcagaagtgaccacctgaagacccacaccaggacccacactggagagaagcccttcagctgccgctggcccagctgccagaagaagtttgcccggagtgatgagctggtgcgccaccacaacatgcaccagaggaacatgaccaagctgcagctggccctgtag

SEQ ID NO: 22536 - DNA, 396 bp, Artificial Sequence
  Description of Artificial Sequence: Synthetic coding sequence
atgggccagcagggcagcctgggggagcagcagtacagcgtgcccccacctgtgtatggctgccacacccccacagacagctgcaccggcagccaggccctgctgctgcggaccccctacagcagtgacaacctgtaccagatgaccagccagctggagtgcatgacctggaaccagatgaacctgggcgccaccctgaagggcgtggccgccggcagcagcagctctgtgaagtggacagagggccagagcaaccacagcacaggctatgaaagtgacaaccacaccacccccatcctgtgtggggcccagtaccgcatccacacccacggcgtcttccggggcatccaggatgtgcggcgggtgcctggggtggcccccaccctggtgaggtag

SEQ ID NO: 22537 - DNA, 537 bp, Artificial Sequence
  Description of Artificial Sequence: Synthetic coding sequence
tgactgggcgccaccctgaagggcgtggccgccggcagcagcagctctgtgaagtggacagagggccagagcaaccacagcacaggctatgaaagtgacaaccacaccacccccatcctgtgtggggcccagtaccgcatccacacccacggcgtcttccggggcatccaggatgtgcggcgggtgcctggggtggcccccaccctggtgcgcagcgccagcgagaccagcgagaagaggcccttcatgtgtgcctacccaggctgcaacaagcgctacttcaagctgagccacctgcagatgcacagcaggaagcacactggagtgaagcccttccagtgcaagacctgccagaggaagttcagcagaagtgaccacctgaagacccacaccaggacccacacaggcaagaccagcgagaagcccttcagctgccgctggcccagctgccagaagaagtttgcccggagtgatgagctggtgcgccaccacaacatgcaccagaggaacatgaccaagctgcagctggccctgtag

SEQ ID NO: 22538 - DNA, 867 bp, Artificial Sequence
  Description of Artificial Sequence: Synthetic coding sequence
atggagaagggctacagcacagtgacctttgatggcacccccagctatggccacacccccagccaccacgccgcccagttccccaaccacagcttcaagcatgaggaccccatgggccagcagggcagcctgggggagcagcagtacagcgtgcccccacctgtgtatggctgccacacccccacagacagctgcaccggcagccaggccctgctgctgcggaccccctacagcagtgacaacctgtaccagatgaccagccagctggagtgcatgacctggaaccagatgaacctgggcgccaccctgaagggccacagcacaggctatgaaagtgacaaccacaccacccccatcctgtgtggggcccagtaccgcatccacacccacggcgtcttccggggcatccaggatgtgcggcgggtgcctggggtggcccccaccctggtgcgcagcgccagcgagaccagcgagaagaggcccttcatgtgtgcctacccaggctgcaacaagcgctacttcaagctgagccacctgcagatgcacagcaggaagcacactggagagaagccctaccagtgtgacttcaaggactgtgaaagacgcttcagcagaagtgaccagctgaagaggcaccagaggaggcacactggagtgaagcccttccagtgcaagacctgccagaggaagttcagcagaagtgaccacctgaagacccacaccaggacccacacaggcaagaccagcgagaagcccttcagctgccgctggcccagctgccagaagaagtttgcccggagtgatgagctggtgcgccaccacaacatgcaccagaggaacatgaccaagctgcagctggccctgtag

SEQ ID NO: 22539 - DNA, 1065 bp, Artificial Sequence
  Description of Artificial Sequence: Synthetic coding sequence
atgagggcccggccccaggtgtgtgaggccctgctgtttgccctggccctgcagacaggagtgtgctacggcatcaagtggctggccctgagcaagaccccatctgccctggccctgaaccagacccagcactgcaagcagctggagggcctggtgtctgcccaggtgcagctgtgccgcagcaacctggagctgatgcacacagtggtgcacgccgcccgggaggtgatgaaggcctgcagaagagcctttgctgacatgcgctggaactgcagcagcattgagctggcccccaactacctgctggacctggagcggggcacccgggagagcgcctttgtgtatgccctgtctgctgctgccatcagccacgccatcgcccgggcctgcaccagcggggacctgcccggctgcagctgtggccctgtgcctggagagcccccaggccctggcaaccgctggggcggctgtgccgacaacctgtcctatggcctgctgatgggcgccaagttcagtgatgcccccatgaaggtgaagaagacaggcagccaggccaacaagctgatgaggctgcacaacagcgaggtgggccggcaggccctgcgggccagcctggagatgaagtgcaagtgccacggcgtgtctggcagctgcagcatccgcacctgctggaagggcctgcaggagctgcaggatgtggccgctgacctgaagacccgctacctgagcgccaccaaggtggtgcaccggcccatgggcaccaggaagcacctggtgcccaaggacctggacatccggcctgtgaaggacagcgagctggtgtacctgcagagcagcccagacttctgcatgaagaatgagaaggtgggcagccacggcacccaggaccggcagtgcaacaagaccagcaatggaagtgacagctgtgacctgatgtgctgcggccggggctacaacccctacacagacagagtggtggagcgctgccactgcaagtaccactggtgctgctacgtgacctgccgccgctgtgagaggacagtggagagatatgtgtgcaagtag

SEQ ID NO: 22540 - DNA, 762 bp, Artificial Sequence
  Description of Artificial Sequence: Synthetic coding sequence
atgagggcccggccccaggtgtgtgaggccctgctgtttgccctggccctgcagacaggagtgtgctacggcatcaagtggctggccctgagcaagaccccatctgccctggccctgaaccagacccagcactgcaagcagctggagggcctggtgtctgcccaggtgcagctgtgccgcagcaacctggagctgatgcacacagtggtgcacgccgcccgggaggtgatgaaggcctgcagaagagcctttgctgacatgcgctggaactgcagcagcattgagctggcccccaactacctgctggacctggagcggggcacccgggagagcgcctttgtgtatgccctgtctgctgctgccatcagccacgccatcgcccgggcctgcaccagcggggacctgcccggctgcagctgtggccctgtgcctggagagcccccaggccctggcaaccgctggggcggctgtgccgacaacctgtcctatggcctgctgatgggcgccaagttcagtgatgcccccatgaaggtgaagaagacaggcagccaggccaacaagctgatgaggctgcacaacagcgaggtgggccggcaggccctgcgggccagcctgctggtgaacagccgctgccaggcctgggaggccgcctgtgccctgcccagcctgggcagccaccaggagcagaaggtgtggccaccctggaaggagggccgcaccagcaaggagacagacaagatcaagaacaacctggccgcctag

SEQ ID NO: 22541 - DNA, 18 bp, Artificial Sequence
  Description of Artificial Sequence: Synthetic coding sequence
atgagggcccggccctag

SEQ ID NO: 22542 - DNA, 1143 bp, Artificial Sequence
  Description of Artificial Sequence: Synthetic coding sequence
atgaagaagagcatcggcatcctgagccctggggtggccctgggcatggccggcagcgccatgagcagcaagttcttcctggtggccctggccatcttcttctcctttgcccaggtggtgattgaggccaacagctggtggagcctgggcatgaacaaccctgtgcagatgtctgaggtgtacatcattggagcccagcccctgtgcagccagctggccggcctgagccagggccagaagaagctgtgccacctgtaccaggaccacatgcagtacatcggggagggcgccaagacaggcatcaaggagtgccagtaccagttccgccaccggcgctggaactgcagcacagtggacaacacctctgtgtttggccgggtgatgcagatcggcagccgggagacagccttcacctatgctgtgtctgctgctggggtggtgaatgccatgagccgggcctgccgggagggggagctgagcacctgtggctgcagcagagctgcccggcccaaggacctgccccgggactggctgtggggcggctgtggggacaacatcgactatggctacagatttgccaaggagtttgtggatgcccgggagcgggagcgcatccacgccaagggcagctatgaaagtgcccgcatcctgatgaacctgcacaacaatgaagctggaagaagaacagtgtacaacctggctgatgtggcctgcaagtgccacggcgtgtctggcagctgcagcctgaagacctgctggctgcagctggccgacttcaggaaggtgggagatgccctgaaggagaagtatgacagcgctgctgccatgaggctgaacagccggggcaagctggtgcaggtgaacagccgcttcaacagccccaccacccaggacctggtgtacatcgaccccagcccagactactgtgtgagaaatgaaagcacaggcagcctgggcacccagggccgcctgtgcaacaagaccagcgagggcatggatggctgtgagctgatgtgctgcggccggggctatgaccagttcaagacagtgcagacagagcgctgccactgcaagttccactggtgctgctacgtgaagtgcaagaagtgcacagaaattgtggaccagtttgtgtgcaagtag

SEQ ID NO: 22543 - DNA, 390 bp, Artificial Sequence
  Description of Artificial Sequence: Synthetic coding sequence
atgaagaagagcatcggcatcctgagccctggggtggccctgggcatggccggcagcgccatgagcagcaagttcttcctggtggccctggccatcttcttctcctttgcccaggtggtgattgaggccaacagctggtggagcctgggcatgaacaaccctgtgcagatgagccaggatgtgggcggccacggctggctgcgggcccacgtgctgcggccctggctgcggcctgtgcaggacagagcagatggagccctgcccctgcaggtgcccctggtgctgctgcggcaggtgcaggaggtgcatggagaccggggccctgtgtgtgtgcaggtggtgggcgccacccagcacagcgcccccctgcccggccctgcctacctgtag

SEQ ID NO: 22544 - DNA, 1143 bp, Artificial Sequence; identical to SEQ ID NO: 22542
  Description of Artificial Sequence: Synthetic coding sequence

SEQ ID NO: 22545 - DNA, 645 bp, Artificial Sequence
  Description of Artificial Sequence: Synthetic coding sequence
atggccggcagcgccatgagcagcaagttcttcctggtggccctggccatcttcttctcctttgcccaggtggtgattgaggccaacagctggtggagcctgggcatgaacaaccctgtgcagatgtctgaggtgtacatcatcggggcccagcccctgtgcagccagctggccggcctgagccagggccagaagaagctgtgccacctgtaccaggaccacatgcagtacatcggggagggcgccaagacaggcatcaaggagtgccagtaccagttccgccaccggcgctggaactgcagcacagtggacaacacctctgtgtttggccgggtgatgcagatcggcagccgggagacagccttcacctatgctgtgtctgctgctggggtggtgaatgccatgagccgggcctgccgggagggggagctgagcacctgtggctgcagccgggccgcccggcccaaggacctgccccgggactggctgtggggcggctgtggggacaacattgattatggctacagatttgccaaggagtttgtggatgcccgggagcgggagcgcatccacgccaagggcagctatgagagcgcccgcatcctgatgaacctgcacaacaatgaggccggccggcgggtgtag

SEQ ID NO: 22546 - DNA, 1098 bp, Artificial Sequence
  Description of Artificial Sequence: Synthetic coding sequence
atggccggcagcgccatgagcagcaagttcttcctggtggccctggccatcttcttctcctttgcccaggtggtgattgaggccaacagctggtggagcctgggcatgaacaaccctgtgcagatgtctgaggtgtacatcatcggggcccagcccctgtgcagccagctggccggcctgagccagggccagaagaagctgtgccacctgtaccaggaccacatgcagtacatcggggagggcgccaagacaggcatcaaggagtgccagtaccagttccgccaccggcgctggaactgcagcacagtggacaacacctctgtgtttggccgggtgatgcagatcggcagccgggagacagccttcacctatgctgtgtctgctgctggggtggtgaatgccatgagccgggcctgccgggagggggagctgagcacctgtggctgcagccgggccgcccggcccaaggacctgccccgggactggctgtggggcggctgtggggacaacattgattatggctacagatttgccaaggagtttgtggatgcccgggagcgggagcgcatccacgccaagggcagctatgagagcgcccgcatcctgatgaacctgcacaacaatgaggccggccgcaggacagtgtacaacctggctgatgtggcctgcaagtgccacggcgtgtctggcagctgcagcctgaagacctgctggctgcagctggccgacttcaggaaggtgggagatgccctgaaggagaagtatgattctgctgctgccatgaggctgaacagccggggcaagctggtgcaggtgaacagccgcttcaacagccccaccacccaggacctggtgtacatcgaccccagcccagactactgtgtgagaaatgaaagcacaggcagcctgggcacccagggccgcctgtgcaacaagaccagcgagggcatggatggctgtgagctgatgtgctgcggccggggctatgaccagttcaagacagtgcagacagagcgctgccactgcaagttccactggtgctgctacgtgaagtgcaagaagtgcacagagatcgtggaccagtttgtgtgcaagtag

SEQ ID NO: 22547 - DNA, 876 bp, Artificial Sequence
  Description of Artificial Sequence: Synthetic coding sequence
atgcagtacatcggggagggcgccaagacaggcatcaaggagtgccagtaccagttccgccaccggcgctggaactgcagcacagtggacaacacctctgtgtttggccgggtgatgcagatcggcagccgggagacagccttcacctatgctgtgtctgctgctggggtggtgaatgccatgagccgggcctgccgggagggggagctgagcacctgtggctgcagccgggccgcccggcccaaggacctgccccgggactggctgtggggcggctgtggggacaacattgattatggctacagatttgccaaggagtttgtggatgcccgggagcgggagcgcatccacgccaagggcagctatgagagcgcccgcatcctgatgaacctgcacaacaatgaggccggccgcaggacagtgtacaacctggctgatgtggcctgcaagtgccacggcgtgtctggcagctgcagcctgaagacctgctggctgcagctggccgacttcaggaaggtgggagatgccctgaaggagaagtatgattctgctgctgccatgaggctgaacagccggggcaagctggtgcaggtgaacagccgcttcaacagccccaccacccaggacctggtgtacatcgaccccagcccagactactgtgtgagaaatgaaagcacaggcagcctgggcacccagggccgcctgtgcaacaagaccagcgagggcatggatggctgtgagctgatgtgctgcggccggggctatgaccagttcaagacagtgcagacagagcgctgccactgcaagttccactggtgctgctacgtgaagtgcaagaagtgcacagagatcgtggaccagtttgtgtgcaagtag

SEQ ID NO: 22548 - DNA, 1080 bp, Artificial Sequence
  Description of Artificial Sequence: Synthetic coding sequence
atgcccagcctgctgctgctcttcaccgctgccctgctgagctcctgggcccagctgctgacagatgccaacagctggtggagcctggccctgaaccctgtgcagaggcctgagatgttcatcatcggggcccagcctgtgtgcagccagctgcccggcctgagccctggccagaggaagctgtgccagctgtaccaggagcacatggcctacatcggggagggcgccaagacaggcatcaaggagtgccagcaccagttccggcagaggcgctggaactgcagcacagctgacaatgcctctgtgtttggccgggtgatgcagatcggcagccgggagacagccttcacccatgctgtgtctgctgctggggtggtgaatgccatcagccgggcctgccgggagggggagctgagcacctgtggctgcagcaggacagcccggcccaaggacctgccccgggactggctgtggggcggctgtggggacaacgtggagtatggctacagatttgccaaggagtttgtggatgcccgggagcgggagaagaactttgccaagggcagcgaggagcagggccgggtgctgatgaacctgcagaacaatgaggccggccggcgggctgtgtacaagatggctgatgtggcctgcaagtgccacggcgtgtctggcagctgcagcctgaagacctgctggctgcagctggccgagttcaggaaggtgggggaccggctgaaggagaagtatgattctgctgctgccatgagggtgaccaggaagggccgcctggagctggtgaacagccgcttcacccagcccaccccagaggacctggtgtatgtggaccccagcccagactactgcctgagaaatgaaagcacaggcagcctgggcacccagggccgcctgtgcaacaagaccagcgagggcatggatggctgtgagctgatgtgctgcggccggggctacaaccagttcaagtctgtgcaggtggagcgctgccactgcaagttccactggtgctgctttgtgcgctgcaagaagtgcacagagatcgtggaccagtacatctgcaagtag

SEQ ID NO: 22549 - DNA, 1080 bp, Artificial Sequence; identical to SEQ ID NO: 22548
  Description of Artificial Sequence: Synthetic coding sequence

SEQ ID NO: 22550 - DNA, 1080 bp, Artificial Sequence; identical to SEQ ID NO: 22548
  Description of Artificial Sequence: Synthetic coding sequence

SEQ ID NO: 22551 - DNA, 1398 bp, Artificial Sequence
  Description of Artificial Sequence: Synthetic coding sequence
atgacaggccgggccatggaccccctgcctgctgctgctgtgggcgctgctgctgaggccgaggctgatgaggaggccgaccccccagccagtgacctgcccaccccccaggccatcgagccccaggccatcgtgcagcaggtgcctgcccccagcaggatgcagatgccccagggcaaccccctgctgctgagccacaccctgcaggagctgctggcccgggacacagtgcaggtggagctgatccctgagaagaagggcctcttcctgaagcacgtggagtatgaggtgagcagccagcgcttcaagagctctgtgtaccgccgctacaatgactttgtggtgttccaggagatgctgctgcacaagttcccctacaggatggtgcctgccctgccccccaagaggatgctgggcgctgaccgggagttcatcgaggccaggagaagagccctgaagagatttgtgaacctggtggcccggcaccccctcttctctgaagatgtggtgctgaagctgttcctgtccttcagcggcagtgatgtgcagaacaagctgaaggagagcgcccagtgtgtgggagatgagttcctgaactgcaagctggccacccgggccaaggacttcctgcctgctgacatccaggcccagtttgccatcagccgggagctgatccggaacatctacaacagcttccacaagctgcgggacagagctgagcgcatcgccagccgggccatcgacaatgctgctgacctgctgatctttgggaaggagctgagcgccatcggcagtgacaccacccccctgcccagctgggccgccctgaacagcagcacctggggcagcctgaagcaggccctgaagggcctgtctgtggagtttgccctgctggccgacaaggccgcccagcagggcaagcaggaggagaatgatgtggtggagaagctgaacctcttcctggacctgctgcagagctacaaggacctgtgtgaaagacatgagaagggcgtgctgcacaagcaccagagggccctgcacaagtacagcctgatgaagaggcagatgatgtctgccacagcccagaaccgggagcctgagagcgtggagcagctggagagccgcatcgtggagcaggagaatgccatccagaccatggagctgaggaactacttcagcctgtactgcctgcaccaggagacccagctgattcatgtgtacctgcccctgaccagccacatcctgcgggcctttgtgaacagccagatccagggccacaaggagatgagcaaggtgtggaatgacctgcggcccaagctgagctgcctgtttgctggcccccacagcaccctgaccccaccctgcagccccccagaagatggcctgtgcccccactag

SEQ ID NO: 22552 - DNA, 174 bp, Artificial Sequence
  Description of Artificial Sequence: Synthetic coding sequence
atgagctctgtgcagcagcagcccccaccaccccggcgggtgaccaacgtgggcagcctgctgctgaccccccaggagaatgaaagcctcttcaccttcctgggcaagaagtgtgtgaccatgagcagcgctgtggtgcagctgtatgctgctgacaggaacctgagctgctag

SEQ ID NO: 22553 - DNA, 1140 bp, Artificial Sequence
  Description of Artificial Sequence: Synthetic coding sequence
atggccaggagaagtgccttccctgctgctgccctgtggctgtggagcatcctgctgtgcctgctggccctgcgggcagaggccggccccccccaggaggagagcctgtacctgtggattgatgcccaccaggcccgggtgctgattggatttgaggaggacatcctgattgtgtctgagggcaagatggcccccttcacccatgacttcaggaaggcccagcagaggatgcctgccatccctgtgaacatccacagcatgaacttcacctggcaggccgccggccaggccgagtacttctatgagttcctgagcctgcggagcctggacaagggcatcatggctgaccccaccgtgaatgtgcccctgctgggcaccgtgccccacaaggcctctgtggtgcaggtgggcttcccctgcctgggcaagcaggatggagtggccgcctttgaggtggatgtgattgtgatgaacagcgagggcaacaccatcctgcagaccccccagaatgccatcttcttcaagacctgccagcaggctgaatgtcctgggggctgcagaaatggaggcttctgcaatgaaagacgcatctgtgaatgtccagatggcttccacggcccccactgtgagaaggccctgtgcaccccccgctgcatgaatggaggcctgtgtgtgaccccaggcttctgcatctgccccccaggcttctatggagtgaactgtgacaaggccaactgcagcaccacctgcttcaacggcggcacctgcttctacccaggcaagtgcatctgccccccaggcctggagggggagcagtgtgagatcagcaaatgtccccagccctgcagaaatggaggaaaatgtattggcaagagcaagtgcaagtgcagcaagggctaccagggcgacctgtgcagcaagcctgtgtgtgagcccggctgtggggcccacggcacctgccacgagcccaacaagtgccagtgccaggagggctggcacggccgccactgcaacaagagatatgaggccagcctcatccacgccctgcggcctgctggggcccagctgcggcagcacacccccagcctgaagaaggccgaggagcggcgggaccccccagagagcaactacatctggtag

SEQ ID NO: 22554 - DNA, 120 bp, Artificial Sequence
  Description of Artificial Sequence: Synthetic coding sequence
aagaagaggaaggagaagaagcgggagaagagaagaggcaaggagaggaaggagctgttcaagctggtgagccacgtgctggagaacaggatgggctggcagcacctgaagtggatgtag

SEQ ID NO: 22555 - DNA, 1095 bp, Artificial Sequence
  Description of Artificial Sequence: Synthetic coding sequence
atggcccgggccagcgaggccgtgagccgcatcctggaggagtggcacaaggccaaggtggaggccatgaccctggacctggccctgctgcggtctgtgcagcactttgctgaggccttcaaggccaagaatgtgcccctgcacgtgctggtgtgcaatgctgccacctttgccctgccctggagcctgaccaaggatggcctggagaccaccttccaggtgaaccacctgggccacttctacctggtgcagctgctgaggatgttctgtgccgcccagctgctgcctgtgtccctgtggagcccccagagccccatcgacctgcagatcctgaccaccccctgggagaactggacctctgtggccagcctgcagcagaagaccaccatcggccgctgctggctgatcaccggccccagcagcgccaccagcagcagccccaccagctgcaccgtggcccccacccggggccacgtggagaggtctgcctcctggaagtatgatgtgctgcagcacagcagccagctggtgggcgtgcacacagctgtgtacctgggggaggccttccaccaggtgcacgccaccggcagctgccaccaccgggtgctgtgctgctgccccaggactggaggcagcggcagagatgtgctgcagcagctgctgcccctgcacgccctgaccaggagcagcgagaggagagatggccctgaccctgtgggcagcgagcggctcatccaggagcggctggccagccctgccaagtggagcagcgagaggatgggcacccacaccaggcctgtgtgtgtgcccagcaggaagtgccagggccccctgcccaacgtgccccccacccagatcaggaagagcaagggcaacaagagcagccacaacagagtgaagaacctgaagtaccagtgggaggccggcaacagctggggcaaggtgtccctcttctggggctgggcccggcacaggagcctgtgcttcctggtggtggcctgcctgaaggtgaagacctgcctggtgtgccgcttccgcatcagcctggagaagcaccagcagttctccttcttctactgctacagaattgcctag

SEQ ID NO: 22556 - DNA, 570 bp, Artificial Sequence
  Description of Artificial Sequence: Synthetic coding sequence
atggccgccctgcgctatgccggcctggatgacacagacagtgaagatgagctgcccccaggctgggaggagaggaccaccaaggatggctgggtgtactatgccaaccacacagaggagaagacccagtgggagcaccccaagacaggcaagaggaagagggtggccggggacctgccctacggctgggagcaggagacagatgaaaatggccaggtgttctttgtggaccacatcaacaagaggaccacctacctggacccccggctggccttcaccgtggatgacaaccccaccaagcccaccacccggcagagatatgatggcagcaccacagccatggagatcctgcagggccgggacttcaccgggaaggtggtggtggtgactggagccaacagcggcatcggctttgaaacagccaagagctttgccctgcatggagcccacgtgatcctggcctgcaggaacatggcccgggccagcgaggccgtgagccgcatcctggaggagtggaagaccaagtaccaccccccacctgagaagtgccgcatcaagatcttccactag

SEQ ID NO: 22557 - DNA, 936 bp, Artificial Sequence
  Description of Artificial Sequence: Synthetic coding sequence
atggccgccctgcgctatgccggcctggatgacacagacagtgaagatgagctgcccccaggctgggaggagaggaccaccaaggatggctgggtgtactatgccaaccacacagaggagaagacccagtgggagcaccccaagacaggcaagaggaagagggtggccggggacctgccctacggctgggagcaggagacagatgaaaatggccaggtgttctttgtggaccacatcaacaagaggaccacctacctggacccccggctggccttcaccgtggatgacaaccccaccaagcccaccacccggcagagatatgatggcagcaccacagccatggagatcctgcagggccgggacttcaccgggaaggtggtggtggtgactggagccaacagcggcatcgccaccggcagctgccaccaccgggtgctgtgctgctgccccaggactggaggcagcggcagagatgtgctgcagcagctgctgcccctgcacgccctgaccaggagcagcgagaggagagatggccctgaccctgtgggcgcccagcgggaggccgaccccaggacagcctggcagcctgtgcggctgagcggggcccagagcggctgggcccacaccccagccctgtgtgtgagcccccacgccagcgcccgggccggccccctgcccaacgtgccccccacccagatcaggaagagcaaaggaaacaagagcagccacaacagagtgaagaacctgaagtaccagtgggaggccggcaacagctggggcaaggtgtccctcttctggggctgggcccggcacaggagcctgtgcttcctggtggtggcctgcctgaaggtgaagacctgcctggtgtgccgcttccgcatcagcctggagaagcaccagcagttctccttcttctactgctaccgcatcgcctag

SEQ ID NO: 22558 - DNA, 705 bp, Artificial Sequence
  Description of Artificial Sequence: Synthetic coding sequence
atggccgccctgcgctatgccggcctggatgacacagacagtgaagatgagctgcccccaggctgggaggagaggaccaccaaggatggctgggtgtactatgccaaccacacagaggagaagacccagtgggagcaccccaagacaggcaagaggaagagggtggccggggacctgccctacggctgggagcaggagacagatgaaaatggccaggtgttctttgtggaccacatcaacaagaggaccacctacctggacccccggctggccttcaccgtggatgacaaccccaccaagcccaccacccggcagagatatgatggcagcaccacagccatggagatcctgcagggccgggacttcaccgggaaggtggtggtggtgactggagccaacagcggcatcggctttgaaacagccaagagctttgccctgcatggagcccacgtgatcctggcctgcaggaacatggcccgggccagcgaggccgtgagccgcatcctggaggagtggcagcagggcgccgccaccaccgtgtactgtgccgctgtgcctgagctggagggcctgggcggcatgtacttcaacaactgctgccgctgcatgcccagccctgaggcccagagcgaggagacagcccggaccctgtgggccctgtctgagcggctcatccaggagcggctgggcagccagagcggctag

SEQ ID NO: 22559 - DNA, 1245 bp, Artificial Sequence
  Description of Artificial Sequence: Synthetic coding sequence
atggccgccctgcgctatgccggcctggatgacacagacagtgaagatgagctgcccccaggctgggaggagaggaccaccaaggatggctgggtgtactatgccaaccacacagaggagaagacccagtgggagcaccccaagacaggcaagaggaagagggtggccggggacctgccctacggctgggagcaggagacagatgaaaatggccaggtgttctttgtggaccacatcaacaagaggaccacctacctggacccccggctggccttcaccgtggatgacaaccccaccaagcccaccacccggcagagatatgatggcagcaccacagccatggagatcctgcagggccgggacttcaccgggaaggtggtggtggtgactggagccaacagcggcatcggctttgaaacagccaagagctttgccctgcatggagcccacgtgatcctggcctgcaggaacatggcccgggccagcgaggccgtgagccgcatcctggaggagtggcacaaggccaaggtggaggccatgaccctggacctggccctgctgcggtctgtgcagcactttgctgaggccttcaaggccaagaatgtgcccctgcacgtgctggtgtgcaatgctgccacctttgccctgccctggagcctgaccaaggatggcctggagaccaccttccaggtgaaccacctgggccacttctacctggtgcagctgctgcaggatgtgctgtgccgcagcgccccagcccgggtcatcgtggtgagcagcgagagccaccgcttcacagacatcaatgacagcctgggcaagctggacttcagccggctgagccccaccaagaatgactactgggccatgctggcctacaacagaagcaagctgtgcaacatcctcttcagcaatgagctgcaccggcggctgagcccccggggcgtgaccagcaatgctgtgcaccctggcaacatgatgtacagcaacatccaccgctcctggtgggtgtacaccctgctcttcaccctggcccggcccttcaccaagtccatgcagcagggcgccgccaccaccgtgtactgtgccgctgtgcctgagctggagggcctgggcggcatgtacttcaacaactgctgccgctgcatgcccagccctgaggcccagagcgaggagacagcccggaccctgtgggccctgtctgagcggctcatccaggagcggctgggcagccagagcggctag

SEQ ID NO: 22560 - DNA, 642 bp, Artificial Sequence
  Description of Artificial Sequence: Synthetic coding sequence
atggccgccctgcgctatgccggcctggatgacacagacagtgaagatgagctgcccccaggctgggaggagaggaccaccaaggatggctgggtgtactatgccaaccacacagaggagaagacccagtgggagcaccccaagacaggcaagaggaagagggtggccggggacctgccctacggctgggagcaggagacagatgaaaatggccaggtgttctttgtggaccacatcaacaagaggaccacctacctggacccccggctggccttcaccgtggatgacaaccccaccaagcccaccacccggcagagatatgatggcagcaccacagccatggagatcctgcagggccgggacttcaccgggaaggtggtggtggtgactggagccaacagcggcatcggcaaggccagctgccacgtgggccgcatcctgaagcacaccagggtggaggagctgagcctgctgcccacagccatcaaccgggagctgcccccaccctgcaccgtgctgctgagccagaactggagggtgtgggagggctgcaccagcaccacagctgctgctgcctgcccccaccagaagctgcgggccaagaggcggcccggcccctgtggccgcagcgcccggggctag

SEQ ID NO: 22561 - DNA, 1245 bp, Artificial Sequence; identical to SEQ ID NO: 22559
  Description of Artificial Sequence: Synthetic coding sequence

SEQ ID NO: 22562 - DNA, 111 bp, Artificial Sequence
  Description of Artificial Sequence: Synthetic coding sequence
atggccgccctgcgctatgccggcctggatgacacagacagtgaagatgagctgcccccaggctgggaggagaggaccaccaaggatggctgggtgtactatgccaagtag

SEQ ID NO: 22563 - DNA, 1047 bp, Artificial Sequence
  Description of Artificial Sequence: Synthetic coding sequence
atggcccacagccagaacagcctggagctgcccatcaacatcaatgccacccagatcaccacagcctacggccaccgggccctgcccaagctgaaggaggagctgcagagcgaggacctgcagacccggcagaaggccctgatggccctgtgtgacctgatgcatgaccctgagtgcatctacaaggccatgaacatcggctgcatggagaacctgaaggccctgctgaaggacagcaacagcatggtgcgcatcaagaccacagaggtgctgcacatcacagccagccacagcgtgggccgctatgccttcctggagcatgacatcgtgctggccctgtccttcctgctgaatgaccccagccctgtgtgccggggcaacctgtacaaggcctacatgcagctggtgcaggtgcccaggggggcccaggagatcatcagcaagggcctcatcagcagcctggtgtggaagctgcaggtggaggtggaggaggaggagttccaggagttcatcctggacaccctggtgctgtgcctgcaggaggatgccacagaggccctgggcagcaatgtggtgctggtgctgaagcagaagctgctgagcgccaaccagaacatccgcagcaaggccgcccgggccctgctgaatgtgtccatcagccgggagggcaagaagcaggtgtgccactttgatgtgatccccatcctggtgcacctgctgaaggaccctgtggagcacgtgaagagcaatgctgctggggccctgatgtttgccaccgtcatcacagagggcaagtatgctgccctggaggcccaggccatcggcctgctgctggagctgctgcacagccccatgaccatcgcccggctgaatgccaccaaggccctgaccatgctggccgaggcccctgagggcaggaaggccctgcagacccacgtgcccaccttccgggccatggaggtggagacctatgagaagccccaggtggccgaggccctgcagagagctgccagaattgccatcagcgtcatcgagttcaagccctag

SEQ ID NO: 22564 - DNA, 1131 bp, Artificial Sequence
  Description of Artificial Sequence: Synthetic coding sequence
atggtggtggtggccgccgcccccaacccagcagatggcacccccaaggtgctgctgctgagcggccagcctgccagcgctgctggggccccagctggccaggccctgcccctgatggtgcctgcccagagaggagccagccctgaggccgccagcggcggcctgccccaggccaggaagaggcagaggctgacccacctgagccctgaggagaaggccctgcggaggaagctgaagaacagagtggccgcccagacagcccgggacaggaagaaggccaggatgtctgagctggagcagcaggtggtggacctggaggaggagaaccagaagctgctgctggagaaccagctgctgcgggagaagacccacggcctggtggtggagaaccaggagctgcggcagaggctgggcatggatgccctggtggccgaggaggaggccgaggccaagggaaatgaggtgcggcctgtggccggcagcgctgagagcgctgctggggccggccctgtggtgaccccacctgagcacctgcccatggacagcggcggcatcgacagcagtgacagcgagagtgacatcctgctgggcatcctggacaacctggaccctgtgatgttcttcaagtgccccagccctgagcccgccagcctggaggagctgcctgaggtgtacccagagggccccagcagcctgcctgccagcctgagcctgtctgtgggcaccagcagcgccaagctggaggccatcaatgaactcatccgctttgaccacatctacaccaagcccctggtgctggagatccccagcgagacagagagccaggccaacgtggtggtgaagattgaggaggcccccctgagccccagtgaaaatgaccaccctgagttcatcgtgtctgtgaaggaggagcctgtggaggatgacctggtgcctgagctgggcatcagcaacctgctgagcagcagccactgccccaagcccagcagctgcctgctggatgcctacagcgactgtggctatggaggcagcctgagccccttcagtgacatgagcagcctgctgggcgtgaaccacagctgggaggacacctttgccaatgaactcttcccccagctgatctctgtgtag

SEQ ID NO: 22565 - DNA, 801 bp, Artificial Sequence
  Description of Artificial Sequence: Synthetic coding sequence
atggtggtggtggccgccgcccccaacccagcagatggcacccccaaggtgctgctgctgagcggccagcctgccagcgctgctggggccccagctggccaggccctgcccctgatggtgcctgcccagagaggagccagccctgaggccgccagcggcggcctgccccaggccaggaagaggcagaggctgacccacctgagccctgaggagaaggccctgcggaggaagctgaagaacagagtggccgcccagacagcccgggacaggaagaaggccaggatgtctgagctggagcagcaggtggtggacctggaggaggaggtgaagctgctgaagaaccagaagctgctgctggagaaccagctgctgcgggagaagacccacggcctggtggtggagaaccaggagctgcggcagaggctgggcatggatgccctggtggccgaggaggaggccgaggccaagggaaatgaggtgcggcctgtggccggcagcgctgagagcgctgccctgcggctgcgggcccccctgcagcaggtgcaggcccagctgagccccctgcagaacatcagcccctggatcctggccgtgctgaccctgcagatccagagcctcatcagctgctgggccttctggaccacctggacccagagctgcagcagcaatgccctgccccagagcctgcctgcctggaggagcagccagaggagcacccagaaggaccctgtgccctaccagccccccttcctgtgccagtggggccgccaccagcccagctggaagcccctgatgaactag

SEQ ID NO: 22566 - DNA, 636 bp, Artificial Sequence
  Description of Artificial Sequence: Synthetic coding sequence
atgagggcccctgtgttccaggccctgctgctgtgtggccggcggctggtggtgcagcccctgaacagcgacatgaggaagctgaagaacagagtggccgcccagacagcccgggacaggaagaaggccaggatgtctgagctggagcagcaggtggtggacctggaggaggagaaccagaagctgctgctggagaaccagctgctgcgggagaagacccacggcctggtggtggagaaccaggagctgcggcagaggctgggcatggatgccctggtggccgaggaggaggccgaggccaagggaaatgaggtgcggcctgtggccggcagcgctgagagcgctgccctgcggctgcgggcccccctgcagcaggtgcaggcccagctgagccccctgcagaacatcagcccctggatcctggccgtgctgaccctgcagatccagagcctcatcagctgctgggccttctggaccacctggacccagagctgcagcagcaatgccctgccccagagcctgcctgcctggaggagcagccagaggagcacccagaaggaccctgtgccctaccagccccccttcctgtgccagtggggccgccaccagcccagctggaagcccctgatgaactag

SEQ ID NO: 22567 - DNA, 822 bp, Artificial Sequence
  Description of Artificial Sequence: Synthetic coding sequence
atggctgctgctgatggagccctgcctgaggccgccgccctggagcagcctgctgagctgcctgcctctgtgcgggccagcattgaaaggaagaggcagagggccctgatgctgcggcaggcccggctggccgcccggccctacagcgccacagctgctgctgccaccggcggcatggccaacgtgaaggccgcccccaagatcatcgacacaggaggcggcttcatcctggaggaggaggaggaggaggagcagaagattggcaaggtggtgcaccagcccggccctgtgatggagtttgattatgtgatctgtgaagaatgtgggaaggagttcatggacagctacctgatgaaccactttgacctgcccacctgtgacaactgcagagatgctgatgacaagcacaagctgatcaccaagacagaggccaagcaggagtacctgctgaaggactgtgacctggagaagcgggagccccccctgaagttcatcgtgaagaagaacccccaccacagccagtggggagacatgaagctgtacctgaagctgcagatcgtgaagaggagcctggaggtgtggggcagccaggaggccctggaggaggccaaggaggtgcggcaggagaaccgggagaagatgaagcagaagaagtttgacaagaaggtgaaggagctgcggcgggctgtgcgcagctctgtgtggaagcgggagaccatcgtgcaccagcacgagtatggccctgaggagaacctggaggatgacatgtacaggaagacctgcaccatgtgtggccacgagctgacctatgagaagatgtag

SEQ ID NO: 22568 - DNA, 2823 bp, Artificial Sequence
  Description of Artificial Sequence: Synthetic coding sequence
atggccaggaagagagctgctggaggagagccccggggccgggagctgcggagccagaagagcaaggccaagagcaaggcccggcgggaggaggaggaggaggatgcctttgaagatgagaagccacccaagaagagcctgctgagcaaggtgtcccagggcaagaggaagaggggctgcagccaccctgggggcagcgcagatggccctgccaagaagaaggtggccaaggtgacagtgaagtctgagaacctgaaggtgatcaaggatgaggccctgagtgatggagatgacctgcgggacttccccagcgacctgaagaaggcccaccacctgaagagaggagccaccatgaatgaagacagcaatgaggaggaggaggagagtgaaaatgactgggaggaggtggaggagctgtctgagcctgtgctgggagatgtgcgggagagcacagccttcagccgcagcctgctgcctgtgaagcctgtggagattgaaattgagaccccagagcaggccaagacccgggagaggtctgagaagatcaagctggagtttgagacctacctgcggcgggccatgaagcgcttcaacaagggcgtgcatgaggacacccacaaggtgcacctgctgtgcctgctggccaacggcttctacagaaacaacatctgcagccagcctgacctgcacgccatcggcctgagcatcatcccagcccgcttcaccagggtgctgcccagagatgtggacacctactacctgagcaacctggtgaagtggttcatcggcaccttcaccgtgaatgctgagctgagcgccagcgagcaggacaacctgcagaccaccctggagaggagatttgccatctacagcgccagagatgatgaggagctggtgcacatcttcctgctgatcctgcgggccctgcagctgctgacccggctggtgctgagcctgcagcccatccccctgaagagcgccacagccaagggcaagaagcccagcaaggagcggctgacagctgaccccggcggcagcagcgagaccagcagccaggtgctggagaaccacaccaagcccaagaccagcaagggcaccaagcaggaggagacctttgccaagggcacctgccggcccagcgccaagggcaagagaaataaaggaggcaggaagaagaggagcaagcccagcagcagtgaagaagatgagggccctggggacaagcaggagaaggccacccagaggcggccccacggccgggagcggcgggtggccagccgggtgtcctacaaggaggagagcggcagtgatgaagctggcagcggcagtgactttgagctgagcagtggagaggccagtgaccccagtgatgaggacagcgagcccggcccccccaagcagaggaaggccccagccccccagaggaccaaggccggcagcaagagcgccagcaggacccaccggggcagccacaggaaggaccccagcctgcctgctgccagcagcagcagcagcagcagcaagaggggcaagaagatgtgcagtgatggagagaaggccgagaagaggagcattgctggcatcgaccagtggctggaggtgttctgtgagcaggaggagaagtgggtgtgtgtggactgtgtgcatggagtggtgggccagcccctgacctgctacaagtatgccaccaagcccatgacctacgtggtgggcatcgacagtgatggctgggtgagagatgtgacccagagatatgaccctgtgtggatgacagtgaccaggaaatgtcgggtggatgctgagtggtgggccgagaccctgcggccctaccagagccccttcatggaccgggagaagaaggaggacctggagttccaggccaagcacatggaccagcccctgcccacagccatcggcctgtacaagaaccaccccctgtatgccctgaagaggcacctgctgaagtatgaggccatctacccagagacagctgccatcctgggctactgccgcggggaggccgtgtacagccgggactgtgtgcacaccctgcacagccgggacacctggctgaagaaggcccgggtggtgcggctgggggaggtgccctacaagatggtgaagggcttcagcaacagagccaggaaggcccggctggccgagccccagctgcgggaggagaatgacctgggcctgtttggctactggcagacagaggagtaccagccccctgtggccgtggatggcaaggtgcccagaaatgaatttggaaatgtgtacctgttcctgcccagcatgatgcccatcggctgtgtgcagctgaacctgcccaacctgcaccgggtggccaggaagctggacatcgactgtgtgcaggccatcactggatttgacttccacggcggctacagccaccctgtgacagatggctacatcgtgtgtgaggagttcaaggatgtgctgctgacagcctgggagaatgagcaggccgtcatcgagaggaaggagaaggagaagaaggagaagagggccctgggcaactggaagctgctggccaagggcctgctgatccgggagcggctgaagagaagatatggccccaagtctgaggccgccgccccccacacagatgctgggggcggcctgagcagtgatgaggaggagggcaccagcagccaggccgaggccgcccgcatcctggccgcctcctggccccagaacagagaagatgaggagaagcagaagctgaagggcggccccaagaagaccaagcgggagaagaaggccgccgccagccacctgttcccctttgagcagctgtag

SEQ ID NO: 22569 - DNA, 2712 bp, Artificial Sequence
  Description of Artificial Sequence: Synthetic coding sequence
atggccaggaagagagctgctggaggagagccccggggccgggagctgcggagccagaagagcaaggccaagagcaaggcccggcgggaggaggaggaggaggatgcctttgaagatgagaagccacccaagaagagcctgctgagcaaggtgtcccagggcaagaggaagaggggctgcagccaccctgggggcagcgcagatggccctgccaagaagaaggtggccaaggtgacagtgaagtctgagaacctgaaggtgatcaaggatgaggccctgagtgatggagatgacctgcgggacttccccagcgacctgaagaaggcccaccacctgaagagaggagccaccatgaatgaagacagcaatgaggaggaggaggagagtgaaaatgactgggaggaggccaagacccgggagaggtctgagaagatcaagctggagtttgagacctacctgcggcgggccatgaagcgcttcaacaagggcgtgcatgaggacacccacaaggtgcacctgctgtgcctgctggccaacggcttctacagaaacaacatctgcagccagcctgacctgcacgccatcggcctgagcatcatcccagcccgcttcaccagggtgctgcccagagatgtggacacctactacctgagcaacctggtgaagtggttcatcggcaccttcaccgtgaatgctgagctgagcgccagcgagcaggacaacctgcagaccaccctggagaggagatttgccatctacagcgccagagatgatgaggagctggtgcacatcttcctgctgatcctgcgggccctgcagctgctgacccggctggtgctgagcctgcagcccatccccctgaagagcgccacagccaagggcaagaagcccagcaaggagcggctgacagctgaccccggcggcagcagcgagaccagcagccaggtgctggagaaccacaccaagcccaagaccagcaagggcaccaagcaggaggagacctttgccaagggcacctgccggcccagcgccaagggcaagaggaacaagggcggcaggaagaagaggagcaagcccagcagcagcgaggaggatgagggccctggggacaagcaggagaaggccacccagaggcggccccacggccgggagaggagagtggccagccgggtgtcctacaaggaggagagcggcagtgatgaggccggcagcggcagtgactttgagctgagcagcggggaggccagtgaccccagtgatgaagattctgagcccggcccccccaagcagaggaaggccccagccccccagaggaccaaggccggcagcaagagcgccagcaggacccaccggggcagccacaggaaggaccccagcctgcctgctgccagcagcagcagcagcagcagcaagaggggcaagaagatgtgcagtgatggagagaaggccgagaagaggagcattgctggcatcgaccagtggctggaggtgttctgtgagcaggaggagaagtgggtgtgtgtggactgtgtgcacggcgtggtgggccagcccctgacctgctacaagtatgccaccaagcccatgacctacgtggtgggcatcgacagtgatggctgggtgagagatgtgacccagagatatgaccctgtgtggatgacagtgaccaggaagtgccgggtggatgctgagtggtgggccgagaccctgcggccctaccagagccccttcatggaccgggagaagaaggaggacctggagttccaggccaagcacatggaccagcccctgcccacagccatcggcctgtacaagaaccaccccctgtatgccctgaagaggcacctgctgaagtatgaggccatctacccagagacagctgccatcctgggctactgccgcggggaggccgtgtacagccgggactgtgtgcacaccctgcacagccgggacacctggctgaagaaggcccgggtggtgcggctgggggaggtgccctacaagatggtgaagggcttcagcaacagagccaggaaggcccggctggccgagccccagctgcgggaggagaatgacctgggcctgtttggctactggcagacagaggagtaccagccccctgtggccgtggatggcaaggtgcccagaaatgaatttggaaatgtgtacctgttcctgcccagcatgatgcccatcggctgtgtgcagctgaacctgcccaacctgcaccgggtggccaggaagctggacatcgactgtgtgcaggccatcaccggctttgacttccatggaggctacagccaccctgtgacagatggctacatcgtgtgtgaggagttcaaggatgtgctgctgacagcctgggagaatgagcaggccgtgattgaaaggaaggagaaggagaagaaggagaagagggccctgggcaactggaagctgctggccaagggcctgctgatccgggagcggctgaagagaagatatggccccaagtctgaggccgccgccccccacacagatgctgggggcggcctgagcagtgatgaggaggagggcaccagcagccaggccgaggccgcccgcatcctggccgcctcctggccccagaaccgggaggatgaggagaagcagaagctgaagggcggccccaagaagaccaagcgggagaagaaggctgctgccagccacctgttcccctttgagcagctgtag

SEQ ID NO: 22570 - DNA, 423 bp, Artificial Sequence
  Description of Artificial Sequence: Synthetic coding sequence
atggccaggaagagagctgctggaggagagccccggggccgggagctgcggagccagaagagcaaggccaagagcaaggcccggcgggaggaggaggaggaggatgcctttgaagatgagaagccacccaagaagagcctgctgagcaaggtgtcccagggcaagaggaagaggggctgcagccaccctgggggcagcgcagatggccctgccaagaagaaggtggccaaggtgacagtgaagtctgagaacctgaaggtgatcaaggatgaggccctgagtgatggagatgacctgcgggacttccccagcgacctgaagaaggcccaccacctgaagagaggagccaccatgaatgaagacagcaatgaggaggaggaggagagtgaaaatgactgggaggaggtggaggtgaagaggtag

SEQ ID NO: 22571 - DNA, 507 bp, Artificial Sequence
  Description of Artificial Sequence: Synthetic coding sequence
atggccaggaagagagctgctggaggagagccccggggccgggagctgcggagccagaagagcaaggccaagagcaaggcccggcatgcctttgaagatgagaagccacccaagaagagcctgctgagcaaggtgtcccagggcaagaggaagaggggctgcagccaccctgggggcagcgcagatggccctgccaagaagaaggtggccaaggtgacagtgaagtctgagaacctgaaggtgatcaaggatgaggccctgagtgatggagatgacctgcgggacttccccagcgacctgaagaaggcccaccacctgaagagaggagccaccatgaatgaagacagcaatgaggaggaggaggagagtgaaaatgactgggaggaggtggaggagctgtctgagcctgtgctgggagatgtgcgggagagcacagccttcagccgcagcctgctgcctgtgaagcctgtggagattgaaattgagaccccagagcaggccaagtag

SEQ ID NO: 22572 - DNA, 462 bp, Artificial Sequence
  Description of Artificial Sequence: Synthetic coding sequence
agcagcagcaagaggggcaagaagatgtgcagtgatggagagaaggccgagaagaggagcattgctggcatcgaccagtggctggaggtgttctgtgagcaggaggagaagtgggtgtgtgtggactgtgtgcatggagtggtgggccagcccctgacctgctacaagtatgccaccaagcccatgacctacgtggtgggcatcgacagtgatggctgggtgagagatgtgacccagagatatgaccctgtgtggatgacagtgaccaggaaatgtcgggtggatgctgagtggtgggccgagaccctgcggccctaccagagccccttcatggaccgggagaagaaggaggacctggagggcctgtgtgcccacagcgccttccagggccacgtggccgaggagagcaagagcggggaggcctggaggagcaccctgcaggatggagagcggctcttctag

SEQ ID NO: 22573 - DNA, 177 bp, Artificial Sequence
  Description of Artificial Sequence: Synthetic coding sequence
atgtgcagtgatggagagaaggccgagaagaggagcattgctggcatcgaccagtggctggaggtgttctgtgagcaggaggagaagtgggtgtgtgtggactgccgctgtggcggccctgccagtgacctgctgcaggtgcgccaccaggcccatgacctgtgtggcggccactag

SEQ ID NO: 22574 - DNA, 231 bp, Artificial Sequence
  Description of Artificial Sequence: Synthetic coding sequence
aaggccacccagaggcggccccacggccgggagcggcgggtggccagccgggtgtcctacaaggaggagagcggcagtgatgaagctggcagcggcagtgactttgagctgagcagtggagaggccagtgaccccagtgatgaggacagcgagcccggcccccccaagcagaggaaggccccagccccccagaggaccaaggccggcagcaagagcgccagcaggacatag

SEQ ID NO: 22575 - DNA, 849 bp, Artificial Sequence
  Description of Artificial Sequence: Synthetic coding sequence
atggagggggacttctctgtgtgcaggaactgcaagagacatgtggtgtctgccaacttcaccctgcacgaggcctactgcctgcgcttcctggtgctgtgcccagaatgtgaggagcctgtgcccaaggagaccatggaggagcactgcaagctggagcaccagcaggccaatgaatgccaggagaggcctgtggagtgcaagttctgcaagctggacatgcagctgagcaagctggagctgcacgagagctactgcggcagcaggacagagctgtgccagggctgcggccagttcatcatgcacaggatgctggcccagcacagagatgtgtgccgctctgagcaggcccagctgggcaaaggagagcgcatcagcgcccctgagcgggagatctactgccactactgcaaccagatgatccctgagaacaagtacttccaccacatgggcaagtgctgcccagattctgagttcaagaagcacttccctgtgggcaaccctgagatcctgcccagcagcctgcccagccaggccgctgagaaccagaccagcaccatggagaaggatgtgcggcccaagaccaggagcatcaaccgcttccccctgcacagcgagagcagcagcaagaaggcccccaggagcaagaacaagaccctggaccccctgctgatgtctgagcccaagcccaggaccagcagccccaggggggacaaggccgcctatgacatcctgcggcgctgcagccagtgtggcatcctgctgcccctgcccatcctgaaccagcaccaggagaagtgccgctggctggccagcagcaagggcaagcaggtgaggaacttctcctag

SEQ ID NO: 22576 - DNA, 906 bp, Artificial Sequence
  Description of Artificial Sequence: Synthetic coding sequence
atggagggggacttctctgtgtgcaggaactgcaagagacatgtggtgtctgccaacttcaccctgcacgaggcctactgcctgcgcttcctggtgctgtgcccagaatgtgaggagcctgtgcccaaggagaccatggaggagcactgcaagctggagcaccagcaggtgggctgcaccatgtgccagcagagcatgcagaagagcagcctggagttccacaaggccaatgaatgccaggagaggcctgtggagtgcaagttctgcaagctggacatgcagctgagcaagctggagctgcacgagagctactgcggcagcaggacagagctgtgccagggctgcggccagttcatcatgcacaggatgctggcccagcacagagatgtgtgccgctctgagcaggcccagctgggcaagggggagcgcatcagcgcccctgagcgggagatctactgccactactgcaaccagatgatccctgagaacaagtacttccaccacatgggcaagtgctgcccagacagcgagttcaagaagcacttccctgtgggcaaccctgagatcctgcccagcagcctgcccagccaggccgctgagaaccagaccagcaccatggagaaggatgtgcggcccaagaccaggagcatcaaccgcttccccctgcacagcgagagcagcagcaagaaggcccccaggagcaagaacaagaccctggaccccctgctgatgtctgagcccaagcccaggaccagcagccccaggggggacaaggccgcctatgacatcctgcggcgctgcagccagtgtggcatcctgctgcccctgcccatcctgaaccagcaccaggagaagtgccgctggctggccagcagcaagggcaagcaggtgaggaacttctcctag

SEQ ID NO: 22577 - DNA, 600 bp, Artificial Sequence
  Description of Artificial Sequence: Synthetic coding sequence
atgagcctgcactacggctgctgctgcccagaatgtacctctgtggccatcaaggagatgatgtgggtgatccggccccgggtggcctgtgtggtgaaggatgctggcagcgctggggagcgcatcagcgcccctgagcgggagatctactgccactactgcaaccagatgatccctgagaacaagtacttccaccacatgggcaagtgctgcccagacagcgagttcaagaagcacttccctgtgggcaaccctgagatcctgcccagcagcctgcccagccaggccgctgagaaccagaccagcaccatggagaaggatgtgcggcccaagaccaggagcatcaaccgcttccccctgcacagcgagagcagcagcaagaaggcccccaggagcaagaacaagaccctggaccccctgctgatgtctgagcccaagcccaggaccagcagccccaggggggacaaggccgcctatgacatcctgcggcgctgcagccagtgtggcatcctgctgcccctgcccatcctgaaccagcaccaggagaagtgccgctggctggccagcagcaagggcaagcaggtgaggaacttctcctag

SEQ ID NO: 22578 - DNA, 495 bp, Artificial Sequence
  Description of Artificial Sequence: Synthetic coding sequence
atggagggggacttctctgtgtgcaggaactgcaagagacatgtggtgtctgccaacttcaccctgcacgaggcctactgcctgcgcttcctggtgctgtgcccagaatgtgaggagcctgtgcccaaggagaccatggaggagcactgcaagctggagcaccagcaggtgggctgcaccatgtgccagcagagcatgcagaagagcagcctggagttccacaaggccaatgaatgccaggagaggcctgtggagtgcaagttctgcaagctggacatgcagctgagcaagctggagctgcacgagagctactgcggcagcaggacagagctgtgccagggctgcggccagttcatcatgcacaggatgctggcccagcacagagatgtgtgccgctctgagcaggcccagctgggcaaggagaccagcccagaccccgggaagtgcctgagcatcaccgtggccgccgccctgagcgcccacctgtggccctag

SEQ ID NO: 22579 - DNA, 906 bp, Artificial Sequence
  Description of Artificial Sequence: Synthetic coding sequence
atggagggggacttctctgtgtgcaggaactgcaagagacatgtggtgtctgccaacttcaccctgcacgaggcctactgcctgcgcttcctggtgctgtgcccagaatgtgaggagcctgtgcccaaggagaccatggaggagcactgcaagctggagcaccagcaggtgtctgagatgggcagcggccggggcaagtgcagcatcctgcctgccaggaagaaggccaatgaatgccaggagaggcctgtggagtgcaagttctgcaagctggacatgcagctgagcaagctggagctgcacgagagctactgcggcagcaggacagagctgtgccagggctgcggccagttcatcatgcacaggatgctggcccagcacagagatgtgtgccgctctgagcaggcccagctgggcaagggggagcgcatcagcgcccctgagcgggagatctactgccactactgcaaccagatgatccctgagaacaagtacttccaccacatgggcaagtgctgcccagacagcgagttcaagaagcacttccctgtgggcaaccctgagatcctgcccagcagcctgcccagccaggccgctgagaaccagaccagcaccatggagaaggatgtgcggcccaagaccaggagcatcaaccgcttccccctgcacagcgagagcagcagcaagaaggcccccaggagcaagaacaagaccctggaccccctgctgatgtctgagcccaagcccaggaccagcagccccaggggggacaaggccgcctatgacatcctgcggcgctgcagccagtgtggcatcctgctgcccctgcccatcctgaaccagcaccaggagaagtgccgctggctggccagcagcaagggcaagcaggtgaggaacttctcctag

SEQ ID NO: 22580 - DNA, 1494 bp, Artificial Sequence
  Description of Artificial Sequence: Synthetic coding sequence
atgaccttcaacagctttgagggcagcaagacctgtgtgcctgctgacatcaacaaggaggaggagtttgtggaggagttcaaccggctgaagacctttgccaacttccccagcggcagccctgtgtctgccagcaccctggcccgggccggcttcctgtacacaggagagggggacacagtgcgctgcttcagctgccacgccgctgtggaccgctggcagtatggagacagcgctgtgggccgccacaggaaggtgagccccaactgccgcttcatcaatggcttctacctggagaacagcgccacccagagcaccaacagcggcatccagaatggccagtacaaggtggagaactacctgggcagccgggaccactttgccctggaccggcccagcgagacccatgctgactacctgctgaggacaggccaggtggtggacatcagtgacaccatctaccccaggaacccagccatgtacagcgaggaggcccggctgaagagcttccagaactggccagactatgcccacctgaccccccgggagctggccagcgctggcctgtactacacaggcatcggggaccaggtgcagtgcttctgctgcggcggcaagctgaagaactgggagccctgtgaccgggcctggagcgagcacagaagacacttccccaactgcttctttgtgctgggcaggaacctgaacatccgctctgagagtgatgctgtgtccagtgacaggaacttccccaacagcaccaacctgcccaggaaccccagcatggctgactatgaggcccgcatcttcaccttcggcacctggatctacagcgtgaacaaggagcagctggcccgggccggcttctacgccctgggggagggggacaaggtgaagtgcttccactgcggcggcggcctgacagactggaagcccagcgaggacccctgggagcagcacgccaagtggtacccaggctgcaagtacctgctggagcagaagggccaggagtacatcaacaacatccacctgacccacagcctggaggagtgcctggtgaggaccacagagaagacccccagcctgaccaggagaattgatgacaccatcttccagaaccccatggtgcaggaggccatccgcatgggcttctccttcaaggacatcaagaagatcatggaggagaagatccagatcagcggcagcaactacaagagcctggaggtgctggtggccgacctggtgaatgcccagaaggacagcatgcaggatgagagcagccagaccagcctgcagaaggagatcagcacagaggagcagctgcggcggctgcaggaggagaagctgtgcaagatctgcatggacaggaacatcgccatcgtgtttgtgccctgtggccacctggtgacctgcaagcagtgtgccgaggccgtggacaagtgccccatgtgctacaccgtcatcaccttcaagcagaagatcttcatgtcctag

SEQ ID NO: 22581 - DNA, 1494 bp, Artificial Sequence; identical to SEQ ID NO: 22580
  Description of Artificial Sequence: Synthetic coding sequence

SEQ ID NO: 22582 - DNA, 51 bp, Artificial Sequence
  Description of Artificial Sequence: Synthetic coding sequence
atgaccttcaacagctttgagggcagcaagacctgtgtgcctgctgactag

SEQ ID NO: 22583 - DNA, 471 bp, Artificial Sequence
  Description of Artificial Sequence: Synthetic coding sequence
atgaccttcaacagctttgagggcagcaagacctgtgtgcctgctgacatcaacaaggaggaggagtttgtggaggagttcaaccggctgaagacctttgccaacttccccagcggcagccctgtgtctgccagcaccctggcccgggccggcttcctgtacacaggagagggggacacagtgcgctgcttcagctgccacgccgctgtggaccgctggcagtatggagacagcgctgtgggccgccacaggaaggtgagccccaactgccgcttcatcaatggcttctacctggagaacagcgccacccagagcaccaacagcggcatccagaatggccagtacaaggtggagaactacctgggcagccgggaccactttgccctggaccggcccagcgagacccatgctgactacctgctgaggacaggccaggtggtggacatcagtgacaccatctaccccaggtag

SEQ ID NO: 22584 - DNA, 1494 bp, Artificial Sequence; identical to SEQ ID NO: 22580
  Description of Artificial Sequence: Synthetic coding sequence

SEQ ID NO: 22585 - DNA, 2568 bp, Artificial Sequence
  Description of Artificial Sequence: Synthetic coding sequence
atggtggtgatggcccggctgagcaggcctgagaggccagacctggtgtttgaggaggaggacctgccctatgaggaggagatcatgaggaaccagttctctgtgaagtgctggctgcgctacatcgagttcaagcagggcgcccccaagccccggctgaaccagctgtatgagcgggccctgaagctgctgccctgcagctacaagctgtggtaccgctacctgaaggcccggcgggcccaggtgaagcaccgctgtgtgacagatcctgcctatgaagatgtgaacaactgccacgagcgggcctttgtgttcatgcacaagatgccccggctgtggctggactactgccagttcctgatggaccagggccgggtgacccacaccaggaggacctttgaccgggccctgcgggccctgcccatcacccagcacagccgcatctggcccctgtacctgcgcttcctgcggagccaccccctgcctgagacagctgtgcggggctaccgccgcttcctgaagctgagccctgagagcgctgaggagtacatcgagtacctgaagagcagtgaccggctggatgaggccgcccagaggctggccaccgtggtgaatgatgaaagatttgtgtccaaggccggcaagagcaactaccagctgtggcatgagctgtgtgacctgatcagccagaacccagacaaggtgcagagcctgaatgtggatgccatcatccggggcggcctgacccgcttcacagaccagctgggcaagctgtggtgcagcctggccgactactacatccgcagcggccactttgagaaggccagagatgtgtatgaggaggccatcagaacagtgatgacagtgcgggacttcacccaggtgtttgacagctatgcccagtttgaggagagcatgattgctgccaagatggagacagccagcgagctgggccgggaggaggaggatgatgtggacctggagctgcggctggccaggtttgagcagctgatcagccggcggcccctgctgctgaacagcgtgctgctgcggcagaacccccaccacgtgcatgagtggcacaagagggtggccctgcaccagggccggccccgggagatcatcaacacctacacagaagctgtgcagacagtggaccccttcaaggccaccgggaagccccacaccctgtgggtggcctttgccaagttctatgaggacaatggccagctggatgatgcccgggtcatcctggagaaggccaccaaggtgaacttcaagcaggtggatgacctggcctctgtgtggtgccagtgtggggagctggagctgcggcatgaaaattatgatgaggccctgcggctgctgaggaaggccacagccctgcctgccaggagagctgagtactttgatggcagcgagcctgtgcagaacagagtgtacaagagcctgaaggtgtggagcatgctggccgacctggaggagagcctgggcaccttccagagcaccaaggctgtgtatgaccgcatcctggacctgagaattgccaccccccagatcgtcatcaactatgccatgttcctggaggagcacaagtactttgaggagagcttcaaggcctatgagcggggcatcagcctcttcaagtggcccaacgtgtctgacatctggagcacctacctgaccaagttcatcgcccgctatggaggcaggaagctggagcgggcccgggacctgtttgagcaggccctggatggctgcccccccaagtatgccaagaccctgtacctgctgtatgcccagctggaggaggagtggggcctggcccggcatgccatggctgtgtatgaaagagccaccagggctgtggagcccgcccagcagtatgacatgttcaacatctacatcaagagagctgctgagatctatggagtgacccacacccggggcatctaccagaaggccatcgaggtgctgagtgatgaacatgcccgggagatgtgcctgcgctttgctgacatggagtgcaagctgggggagattgaccgggcccgggccatctacagcttctgcagccagatctgtgaccccaggaccaccggggccttctggcagacctggaaggactttgaggtgcgccacggcaatgaagacaccatcaaggagatgctgcgcatcagaagatctgtgcaggccacctacaacacccaggtgaacttcatggccagccagatgctgaaggtgtctggcagcgccactggaacagtgtctgacctggcccctggccagagcggcatggatgacatgaagctgctggagcagagagctgagcagctggccgctgaggccgagcgggaccagcccctgcgggcccagagcaagatcctgtttgtgcggagtgatgccagccgggaggagctggccgagctggcccagcaggtgaaccctgaggagatccagctgggagaagatgaagatgaagatgagatggacctggagcccaatgaggtgcggctggagcagcagagcgtgcctgctgctgtgtttggcagcctgaaggaggactag

SEQ ID NO: 22586 - DNA, 2559 bp, Artificial Sequence
  Description of Artificial Sequence: Synthetic coding sequence
atggcccggctgagcaggcctgagaggccagacctggtgtttgaggaggaggacctgccctatgaggaggagatcatgaggaaccagttctctgtgaagtgctggctgcgctacatcgagttcaagcagggcgcccccaagccccggctgaaccagctgtatgaaagagccctgaagctgctgccctgcagctacaagctgtggtaccgctacctgaaggcccggcgggcccaggtgaagcaccgctgtgtgacagatcctgcctatgaagatgtgaacaactgccacgagcgggcctttgtgttcatgcacaagatgccccggctgtggctggactactgccagttcctgatggaccagggccgggtgacccacaccaggaggacctttgaccgggccctgcgggccctgcccatcacccagcacagccgcatctggcccctgtacctgcgcttcctgcggagccaccccctgcctgagacagctgtgcggggctaccgccgcttcctgaagctgagccctgagagcgctgaggagtacatcgagtacctgaagagcagtgaccggctggatgaagctgcccagaggctggccaccgtggtgaatgatgaaagatttgtgtccaaggccggcaagagcaactaccagctgtggcatgagctgtgtgacctgatcagccagaacccagacaaggtgcagagcctgaatgtggatgccatcatccggggcggcctgacccgcttcacagaccagctgggcaagctgtggtgcagcctggccgactactacatccgcagcggccactttgagaaggccagagatgtgtatgaggaggccatcagaacagtgatgacagtgcgggacttcacccaggtgtttgacagctatgcccagtttgaggagagcatgattgctgccaagatggagacagccagcgagctgggccgggaggaggaggatgatgtggacctggagctgcggctggccaggtttgagcagctgatcagcagaagacccctgctgctgaacagcgtgctgctgcggcagaacccccaccacgtgcatgagtggcacaagagggtggccctgcaccagggccggccccgggagatcatcaacacctacacagaggccgtgcagacagtggaccccttcaaggccaccgggaagccccacaccctgtgggtggcctttgccaagttctatgaagataatggccagctggatgatgcccgggtcatcctggagaaggccaccaaggtgaacttcaagcaggtggatgacctggcctctgtgtggtgccagtgtggggagctggagctgcggcatgagaactatgatgaggccctgcggctgctgaggaaggccacagccctgcctgcccggcgggcagagtactttgatggcagcgagcctgtgcagaacagagtgtacaagagcctgaaggtgtggagcatgctggccgacctggaggagagcctgggcaccttccagagcaccaaggctgtgtatgaccgcatcctggacctgcgcatcgccaccccccagatcgtcatcaactatgccatgttcctggaggagcacaagtactttgaggagagcttcaaggcctatgaaagaggcatcagcctcttcaagtggcccaacgtgtctgacatctggagcacctacctgaccaagttcatcgcccgctatggaggcaggaagctggagcgggcccgggacctgtttgagcaggccctggatggctgcccccccaagtatgccaagaccctgtacctgctgtatgcccagctggaggaggagtggggcctggcccggcatgccatggctgtgtatgagcgggccaccagggctgtggagcccgcccagcagtatgacatgttcaacatctacatcaagagagctgctgagatctacggcgtgacccacacccggggcatctaccagaaggccatcgaggtgctgagtgatgagcacgcccgggagatgtgcctgcgctttgctgacatggagtgcaagctgggggagattgaccgggcccgggccatctacagcttctgcagccagatctgtgaccccaggaccactggagccttctggcagacctggaaggactttgaggtgagacatggaaatgaagacaccatcaaggagatgctgcgcatccgccgctctgtgcaggccacctacaacacccaggtgaacttcatggccagccagatgctgaaggtgtctggcagcgccaccggcaccgtgtctgacctggcccctggccagagcggcatggatgacatgaagctgctggagcagagagctgagcagctggccgctgaggccgagcgggaccagcccctgcgggcccagagcaagatcctgtttgtgcggagtgatgccagccgggaggagctggccgagctggcccagcaggtgaaccctgaggagatccagctgggggaggatgaagatgaagatgagatggacctggagcccaatgaggtgcggctggagcagcagagcgtgcctgctgctgtgtttggcagcctgaaggaggactag

SEQ ID NO: 22587 - DNA, 1902 bp, Artificial Sequence
  Description of Artificial Sequence: Synthetic coding sequence
atgcctgagatccggctgcggcacgtggtgtcctgcagcagccaggacagcacccactgtgccgagaacctgctgaaggctgacacctacaggaagtggagggctgccaaggccggggagaagaccatctctgtggtgctgcagctggagaaggaggagcagatccacagcgtggacattggaaatgatggcagcgcctttgtggaggtgctggtgggcagcagcgctgggggcgctggggagcaggactatgaggtgctgctggtgaccagcagcttcatgagccccagcgagagccgcagcggcagcaaccccaacagagtgaggatgtttggaccagacaagctggtgcgggctgctgctgagaagcgctgggacagagtgaagatcgtgtgcagccagccctacagcaaggacagccccttcggcctgagctttgtgcgcttccacagccccccagacaaggatgaggccgaggcccccagccagaaggtgacagtgaccaagctgggccagttccgggtgaaggaggaggatgaaagtgccaacagcctgcggcctggggccctcttcttcagccgcatcaacaagaccagccctgtgacagccagtgaccctgctggccccagctatgctgctgccaccctgcaggccagcagcgctgccagcagcgccagccctgtgtcccgggccatcggcagcaccagcaagccccaggagagccccaagggcaagaggaagctggacctgaaccaggaggagaagaagacccccagcaagcccccagcccagctgagccccagcgtgcccaagaggcccaagctgcctgcccccaccaggaccccagccacagcccctgtgcctgcccgggcccagggcgctgtgacaggcaagcccagaggagagggcacagagccccggcggcccagggctggccctgaggagctgggcaagatcctgcagggcgtggtggtggtgctgagcggcttccagaaccccttccgctctgagctgcgggacaaggccctggagctgggcgccaagtacagaccagactggacccgggacagcacccacctgatctgtgcctttgccaacacccccaagtacagccaggtgctgggcctgggcggccgcatcgtgaggaaggagtgggtgctggactgccacaggatgagaagaaggctgcccagccagcgctacctgatggccggccctggcagcagcagcgaggaggatgaggccagccacagcggcggcagcggagatgaggcccccaagctgccccagaagcagccccagaccaagaccaagcccacccaggccgccggccccagcagcccccagaagccacccaccccagaggagaccaaggccgccagccctgtgctgcaggaggacatcgacatcgagggcgtgcagagcgagggccaggacaacggggctgaagattctggggacacagaagatgagctgcggcgggtggccgagcagaaggagcaccggctgcccccaggccaggaggagaatggagaggacccctatgccggcagcacagatgaaaatacagattctgaggagcaccaggagcccccagacctgcctgtgcctgagctgcctgacttcttccagggcaagcacttcttcctgtatggagagttccctggagatgaaagaaggaagctgatccgctacgtgacagccttcaacggggagctggaggacaacatgtctgacagagtgcagtttgtgatcacagcccaggagtgggaccccagctttgaggaggccctgatggacaaccccagcctggcctttgtgcggccccgctggatctacagctgcaatgagaagcagaagctgctgccccaccagctgtatggagtggtgccccaggcctag

SEQ ID NO: 22588 - DNA, 1944 bp, Artificial Sequence
  Description of Artificial Sequence: Synthetic coding sequence
agcaccagcagcttctggccaggagaggcccatgatgtggacatgcctgagatccggctgcggcacgtggtgtcctgcagcagccaggacagcacccactgtgccgagaacctgctgaaggctgacacctacaggaagtggagggctgccaaggccggggagaagaccatctctgtggtgctgcagctggagaaggaggagcagatccacagcgtggacattggaaatgatggcagcgcctttgtggaggtgctggtgggcagcagcgctgggggcgctggggagcaggactatgaggtgctgctggtgaccagcagcttcatgagccccagcgagagccgcagcggcagcaaccccaacagagtgaggatgtttggaccagacaagctggtgcgggctgctgctgagaagcgctgggacagagtgaagatcgtgtgcagccagccctacagcaaggacagccccttcggcctgagctttgtgcgcttccacagccccccagacaaggatgaggccgaggcccccagccagaaggtgacagtgaccaagctgggccagttccgggtgaaggaggaggatgaaagtgccaacagcctgcggcctggggccctcttcttcagccgcatcaacaagaccagccctgtgacagccagtgaccctgctggccccagctatgctgctgccaccctgcaggccagcagcgctgccagcagcgccagccctgtgtcccgggccatcggcagcaccagcaagccccaggagagccccaagggcaagaggaagctggacctgaaccaggaggagaagaagacccccagcaagcccccagcccagctgagccccagcgtgcccaagaggcccaagctgcctgcccccaccaggaccccagccacagcccctgtgcctgcccgggcccagggcgctgtgacaggcaagcccagaggagagggcacagagccccggcggcccagggctggccctgaggagctgggcaagatcctgcagggcgtggtggtggtgctgagcggcttccagaaccccttccgctctgagctgcgggacaaggccctggagctgggcgccaagtacagaccagactggacccgggacagcacccacctgatctgtgcctttgccaacacccccaagtacagccaggtgctgggcctgggcggccgcatcgtgaggaaggagtgggtgctggactgccacaggatgagaagaaggctgcccagccagcgctacctgatggccggccctggcagcagcagcgaggaggatgaggccagccacagcggcggcagcggagatgaggcccccaagctgccccagaagcagccccagaccaagaccaagcccacccaggccgccggccccagcagcccccagaagccacccaccccagaggagaccaaggccgccagccctgtgctgcaggaggacatcgacatcgagggcgtgcagagcgagggccaggacaacggggctgaagattctggggacacagaagatgagctgcggcgggtggccgagcagaaggagcaccggctgcccccaggccaggaggagaatggagaggacccctatgccggcagcacagatgaaaatacagattctgaggagcaccaggagcccccagacctgcctgtgcctgagctgcctgacttcttccagggcaagcacttcttcctgtatggagagttccctggagatgaaagaaggaagctgatccgctacgtgacagccttcaacggggagctggaggacaacatgtctgacagagtgcagtttgtgatcacagcccaggagtgggaccccagctttgaggaggccctgatggacaaccccagcctggcctttgtgcggccccgctggatctacagctgcaatgagaagcagaagctgctgccccaccagctgtatggagtggtgccccaggcctag

SEQ ID NO: 22589 - DNA, 1203 bp, Artificial Sequence
  Description of Artificial Sequence: Synthetic coding sequence
atgcctgagatccggctgcggcacgtggtgtcctgcagcagccaggacagcacccactgtgccgagaacctgctgaaggctgacacctacaggaagtggagggctgccaaggccggggagaagaccatctctgtggtgctgcagctggagaaggaggagcagatccacagcgtggacattggaaatgatggcagcgcctttgtggaggtgctggtgggcagcagcgctgggggcgctggggagcaggactatgaggtgctgctggtgaccagcagcttcatgagccccagcgagagccgcagcggcagcaaccccaacagagtgaggatgtttggaccagacaagctggtgcgggctgctgctgagaagcgctgggacagagtgaagatcgtgtgcagccagccctacagcaaggacagccccttcggcctgagctttgtgcgcttccacagccccccagacaaggatgaggccgaggcccccagccagaaggtgacagtgaccaagctgggccagttccgggtgaaggaggaggatgaaagtgccaacagcctgcggcctggggccctcttcttcagccgcatcaacaagaccagccctgtgacagccagtgaccctgctggccccagctatgctgctgccaccctgcaggccagcagcgctgccagcagcgccagccctgtgtcccgggccatcggcagcaccagcaagccccaggagagccccaagggcaagaggaagctggacctgaaccaggaggagaagaagacccccagcaagcccccagcccagctgagccccagcgtgcccaagaggcccaagctgcctgcccccaccaggaccccagccacagcccctgtgcctgcccgggcccagggcgctgtgacaggcaagcccagaggagagggcacagagccccggcggcccagggctggccctgaggagctgggcaagatcctgcagggcgtggtggtggtgctgagcggcttccagaaccccttccgctctgagctgcgggacaaggccctggagctgggcgccaagtacagaccagactggacccgggacagcacccacctgatctgtgcctttgccaacacccccaagctgccccagaaggtgcccccccagcacaccccagaccagaaccaggcccacagcggctcctggacccagctgaccccagaggcccccaacccctag

SEQ ID NO: 22590 - DNA, 1809 bp, Artificial Sequence
  Description of Artificial Sequence: Synthetic coding sequence
atgcctgagatccggctgcggcacgtggtgtcctgcagcagccaggacagcctggagaaggaggagcagatccacagcgtggacattggaaatgatggcagcgcctttgtggaggtgctggtgggcagcagcgctggaggagctggggagcaggactatgaggtgctgctggtgaccagcagcttcatgagccccagcgagagccgcagcggcagcaaccccaacagagtgaggatgtttggaccagacaagctggtgcgggctgctgctgagaagcgctgggacagagtgaagatcgtgtgcagccagccctacagcaaggacagccccttcggcctgagctttgtgcgcttccacagccccccagacaaggatgaagctgaggcccccagccagaaggtgacagtgaccaagctgggccagttccgggtgaaggaggaggatgagagcgccaacagcctgcggcctggggccctcttcttcagccgcatcaacaagaccagccctgtgacagccagtgaccctgctggccccagctatgctgctgccaccctgcaggccagcagcgctgccagcagcgccagccctgtgtcccgggccatcggcagcaccagcaagccccaggagagccccaagggcaagaggaagctggacctgaaccaggaggagaagaagacccccagcaagcccccagcccagctgagccccagcgtgcccaagaggcccaagctgcctgcccccaccaggaccccagccacagcccctgtgcctgcccgggcccagggcgctgtgacaggcaagcccagaggagagggcacagagccccggcggccccgggccggccctgaggagctgggcaagatcctgcagggcgtggtggtggtgctgagcggcttccagaaccccttccgctctgagctgcgggacaaggccctggagctgggcgccaagtacagaccagactggacccgggacagcacccacctgatctgtgcctttgccaacacccccaagtacagccaggtgctgggcctgggcggcagaattgtgaggaaggagtgggtgctggactgccacaggatgagaagaaggctgcccagccagcgctacctgatggccggccctggcagcagcagtgaagaagatgaggccagccacagcggcggcagcggagatgaggcccccaagctgccccagaagcagccccagaccaagaccaagcccacccaggccgccggccccagcagcccccagaagccacccaccccagaggagaccaaggccgccagccctgtgctgcaggaggacattgatattgaaggagtgcagagcgagggccaggacaatggagctgaggacagcggggacacagaagatgagctgcggcgggtggccgagcagaaggagcaccggctgcccccaggccaggaggagaatggagaggacccctatgccggcagcacagatgagaacacagacagcgaggagcaccaggagcccccagacctgcctgtgcctgagctgcctgacttcttccagggcaagcacttcttcctgtatggagagttccctggagatgagaggaggaagctgatccgctacgtgacagccttcaatggagagctggaggacaacatgtctgacagagtgcagtttgtgatcacagcccaggagtgggaccccagctttgaggaggccctgatggacaaccccagcctggcctttgtgcggccccgctggatctacagctgcaatgagaagcagaagctgctgccccaccagctgtatggagtggtgccccaggcctag

SEQ ID NO: 22591 - DNA, 843 bp, Artificial Sequence
  Description of Artificial Sequence: Synthetic coding sequence
atgtgcagcgccttccacagagctgagagcggcacagagctgctggcccggctggagggccgcagcagcctgaaggagattgagcccaacctgtttgctgatgaggacagccctgtgcacggggacatcctggagttccacggccctgagggcaccgggaagacagagatgctgtaccacctgacagcccgctgcatcctgcccaagtctgagggcggcctggaggtggaggtgctcttcatcgacacagactaccactttgacatgctgcggctggtgaccatcctggagcaccggctgagccagagcagcgaggagatcatcaagtactgcctgggccgcttcttcctggtgtactgcagcagcagcacccacctgctgctgaccctgtacagcctggagagcatgttctgcagccaccccagcctgtgcctgctgatcctggacagcctgagcgccttctactggattgacagagtgaatggaggagagagcgtgaacctgcaggagagcaccctgaggaagtgcagccagtgcctggagaagctggtgaatgactaccgcctggtgctgtttgccaccacccagaccatcatgcagaaggccagcagcagcagcgaggagcccagccacgccagccggcggctgtgtgatgtggacatcgactaccggccctacctgtgcaaggcctggcagcagctggtgaagcacaggatgttcttcagcaagcaggatgacagccagagcagcaaccagttcagcctggtgagccgctgcctgaagagcaacagcctgaagaagcacttcttcatcatcggggagagcggcgtggagttctgctag

SEQ ID NO: 22592 - DNA, 1041 bp, Artificial Sequence
  Description of Artificial Sequence: Synthetic coding sequence
atggacctggacctgctggacctgaacccccgcatcatcgccgccatcaagaaggccaagctgaagtctgtgaaggaggtgctgcacttcagcggccctgacctgaagaggctgaccaacctgagcagccctgaggtgtggcacctgctgaggacagccagcctgcacctgcggggcagcagcatcctgacagccctgcagctgcaccagcagaaggagcgcttccccacccagcaccagaggctgagcctgggctgccctgtgctggatgccctgctgcggggcggcctgcccctggatggcatcacagagctggccggccgcagcagcgctgggaagacccagctggccctgcagctgtgcctggccgtgcagttcccccggcagcacggcggcctggaggccggggctgtgtacatctgcacagaagatgccttcccccacaagaggctgcagcagctgatggcccagcagccccggctgaggacagatgtgcctggagagctgctgcagaagctgcgcttcggcagccagatcttcattgaacatgtggctgatgtggacaccctgctggagtgtgtgaacaagaaggtgcctgtgctgctgagccggggcatggcccggctggtggtgattgacagcgtggccgcccccttccgctgtgaatttgacagccaggccagcgccccccgggcccggcacctgcagagcctgggcgccaccctgcgggagctgagcagcgccttccagagccctgtgctgtgcatcaaccaggtgacagaggccatggaggagcagggcgccgcccacggccccctgggcttctgggatgagcgggtgtccccagccctgggcatcacctgggccaaccagctgctggtgcggctgctggccgaccggctgcgggaggaggaggccgccctgggctgcccagcccggaccctgcgggtgctgagcgccccccacctgccccccagcagctgcagctacaccatctctgctgagggcgtgcggggcaccccaggcacccagagccactag

SEQ ID NO: 22593 - DNA, 1041 bp, Artificial Sequence; identical to SEQ ID NO: 22592
  Description of Artificial Sequence: Synthetic coding sequence

SEQ ID NO: 22594 - DNA, 1041 bp, Artificial Sequence; identical to SEQ ID NO: 22592
  Description of Artificial Sequence: Synthetic coding sequence

SEQ ID NO: 22595 - DNA, 144 bp, Artificial Sequence
  Description of Artificial Sequence: Synthetic coding sequence
atggacctggacctgctggacctgaacccccgcatcatcgccgccatcaagaaggccaagctgaagtctgtgaaggaggtgctgcacttcagcggccctgacctgaagaggctgaccaacctgagcagccctgaggtgtggtag

SEQ ID NO: 22596 - DNA, 138 bp, Artificial Sequence
  Description of Artificial Sequence: Synthetic coding sequence
atggacctggacctgctggacctgaacccccgcatcatcgccgccatcaagaaggccaagctgaagtctgtgaaggaggtgctgcacttcagcggccctgacctgaagaggctgaccaacctgagcagccctgagtag

SEQ ID NO: 22597 - DNA, 1041 bp, Artificial Sequence; identical to SEQ ID NO: 22592
  Description of Artificial Sequence: Synthetic coding sequence

SEQ ID NO: 22598 - DNA, 1041 bp, Artificial Sequence; identical to SEQ ID NO: 22592
  Description of Artificial Sequence: Synthetic coding sequence

SEQ ID NO: 22599 - DNA, 309 bp, Artificial Sequence
  Description of Artificial Sequence: Synthetic coding sequence
atggacctggacctgctggacctgaacccccgcatcatcgccgccatcaagaaggccaagctgaagtctgtgaaggaggtgctgcacttcagcggccctgacctgaagaggctgaccaacctgagcagccctgaggtgtggcacctgctgaggacagccagcctgcacctgcggggcagcagcatcctgacagccctgcagctgcaccagcagaaggagcgcttccccacccagcaccagaggctgagcctgggctgccctgtgctggatgccctgctgcggggcggcctgcccctggatggcatctag

SEQ ID NO: 22600 - DNA, 186 bp, Artificial Sequence
  Description of Artificial Sequence: Synthetic coding sequence
atggacctggacctgctggacctgaacccccgcatcatcgccgccatcaagaaggccaagctgaagtctgtgaaggaggtgctgcacttcagcggccctgacctgaagaggctgaccaacctgagcagccctgaggtgtggcacctgctgaggacagccagcctgcacctgcggggcagcagctag

SEQ ID NO: 22601 - DNA, 339 bp, Artificial Sequence
  Description of Artificial Sequence: Synthetic coding sequence
atggacctggacctgctggacctgaacccccgcatcatcgccgccatcaagaaggccaagctgaagtctgtgaaggaggtgctgcacttcagcggccctgacctgaagaggctgaccaacctgagcagccctgaggtgtggcacctgctgaggacagccagcctgcacctgcggggcagcagcatcctgacagccctgcagctgcaccagcagaaggagcgcttccccacccagcaccagaggctgagcctgggctgccctgtgctggatgccctgctgcggggcggcctgcccctggatggcatcacagagctggccggccgcagcagcgctggatag

SEQ ID NO: 22602 - DNA, 1005 bp, Artificial Sequence
  Description of Artificial Sequence: Synthetic coding sequence
atggagaggaagatcagccgcatccacctggtgtctgagcccagcatcacccacttcctgcaggtgtcctgggagaagaccctggagagcggcttcgtcatcaccctgacagatggccacagcgcctggacaggcaccgtgtctgagagcgagatcagccaggaggctgatgacatggccatggagaagggcaagtatgtgggggagctgaggaaggccctgctgagcggggccggccctgcagatgtgtacaccttcaacttcagcaaggagagctgctacttcttctttgagaagaacctgaaggatgtgtccttccggctgggcagcttcaacctggagaaggtggagaacccagctgaggtgatccgggagctgatctgctactgcctggacaccatcgccgagaaccaggccaagaatgagcacctgcagaaggaaaatgaaaggctgctgcgggactggaatgatgtgcagggccgctttgagaagtgtgtgtctgccaaggaggccctggagacagacctgtacaagcgcttcatcctggtgctgaatgagaagaagaccaagatccgcagcctgcacaacaagctgctgaatgctgcccaggagcgggagaaggacatcaagcaggagggggagacagccatctgcagcgagatgacagctgaccgggaccctgtgtatgatgagagcacagatgaggagagcgagaaccagacagacctgagcggcctggccagcgctgctgtgtccaaggatgacagcatcatcagcagcctggatgtgacagacatcgcccccagcaggaagaggcggcagaggatgcagaggaacctgggcacagagcccaagatggccccccaggagaaccagctgcaggagaaggagaagccagacagcagcctgcctgagaccagcaagaaggagcacatctctgctgagaacatgagcctggagaccctgaggaacagcagccctgaggacctgtttgatgagatctag

SEQ ID NO: 22603 - DNA, 1011 bp, Artificial Sequence
  Description of Artificial Sequence: Synthetic coding sequence
atggagaggaagatcagccgcatccacctggtgtctgagcccagcatcacccacttcctgcaggtgtcctgggagaagaccctggagagcggcttcgtcatcaccctgacagatggccacagcgcctggacaggcaccgtgtctgagagcgagatcagccaggaggctgatgacatggccatggagaagggcaagtatgtgggggagctgaggaaggccctgctgagcggggccggccctgcagatgtgtacaccttcaacttcagcaaggagagctgctacttcttctttgagaagaacctgaaggatgtgtccttccggctgggcagcttcaacctggagaaggtggagaacccagctgaggtgatccgggagctgatctgctactgcctggacaccatcgccgagaaccaggccaagaatgagcacctgcagaaggaaaatgaaaggctgctgcgggactggaatgatgtgcagggccgctttgagaagtgtgtgtctgccaaggaggccctggagacagacctgtacaagcgcttcatcctggtgctgaatgagaagaagaccaagatccgcagcctgcacaacaagctgctgaatgctgcccaggagcgggagaaggacatcaagcaggagggggagacagccatctgcagcgagatgacagctgaccgggaccctgtgtatgatgagagcacagatgaggagagcgagaaccagacagacctgagcggcctggccagcgctgctgtgtccaaggatgacagcatcatcagcagcctggatgtgacagacatcgcccccagcaggaagaggcggcagaggatgcagaggaacctgggcacagagcccaagatggccccccaggagaaccagctgcaggagaaggagaacagcaggccagacagcagcctgcctgagaccagcaagaaggagcacatctctgctgagaacatgagcctggagaccctgaggaacagcagccctgaggacctgtttgatgagatctag

SEQ ID NO: 22604 - DNA, 1005 bp, Artificial Sequence; identical to SEQ ID NO: 22602
  Description of Artificial Sequence: Synthetic coding sequence

SEQ ID NO: 22605 - DNA, 1011 bp, Artificial Sequence; identical to SEQ ID NO: 22603
  Description of Artificial Sequence: Synthetic coding sequence

SEQ ID NO: 22606 - DNA, 186 bp, Artificial Sequence
  Description of Artificial Sequence: Synthetic coding sequence
atgcagaggaacctgggcacagagcccaagatggccccccaggagaaccagctgcaggagaaggagaacagcaggccagacagcagcctgcctgagaccagcaagaaggagcacatctctgctgagaacatgagcctggagaccctgaggaacagcagccctgaggacctgtttgtgtccatctag

SEQ ID NO: 22607 - DNA, 2199 bp, Artificial Sequence
  Description of Artificial Sequence: Synthetic coding sequence
atggtgcgcagcggcaacaaggctgctgtggtgctgtgcatggatgtgggcttcaccatgagcaacagcatccctggcatcgagagcccctttgagcaggccaagaaggtgatcaccatgtttgtgcagaggcaggtgtttgctgagaacaaggatgagatcgccctggtgctgtttggaacagatggaacagacaaccccctgtctggaggagaccagtaccagaacatcaccgtgcaccgccacctgatgctgcctgactttgacctgctggaggacatcgagagcaagatccagcccggcagccagcaggccgacttcctggatgccctgattgtgtccatggatgtgatccagcacgagaccatcggcaagaagtttgagaagaggcacatcgagatcttcacagacctgagcagccgcttcagcaagagccagctggacatcatcatccacagcctgaagaagtgtgacatcagcctgcagttcttcctgcccttcagcctgggcaaggaggatggcagcggggacagaggagatggccccttccggctgggcggccacggccccagcttccccctgaagggcatcacagagcagcagaaggagggcctggagatcgtgaagatggtgatgatcagcctggagggggaggatggcctggatgagatctacagcttcagcgagagcctgaggaagctgtgtgtgttcaagaagattgaaagacacagcatccactggccctgccgcctgaccatcggcagcaacctgagcatcagaattgctgcctacaagagcatcctgcaggagcgggtgaagaagacctggacagtggtggatgccaagaccctgaagaaggaggacatccagaaggagaccgtgtactgcctgaatgatgatgatgaaacagaggtgctgaaggaggacatcatccagggcttccgctatggcagtgacatcgtgcccttcagcaaggtggatgaggagcagatgaagtacaagtctgagggcaagtgcttctctgtgctgggcttctgcaagagcagccaggtgcagaggcgcttcttcatgggcaaccaggtgctgaaggtgtttgctgccagagatgatgaggccgctgctgtggccctgagcagcctcatccacgccctggatgacctggacatggtggccatcgtgcgctatgcctatgacaagagggccaacccccaggtgggcgtggccttcccccacatcaagcacaactatgaatgtctggtgtatgtgcagctgcccttcatggaggacctgcggcagtacatgttcagcagcctgaagaacagcaagaagtatgcccccacagaggcccagctgaatgctgtggatgccctgattgacagcatgagcctggccaagaaggatgagaagacagacaccctggaggacctcttccccaccaccaagatccccaacccccgcttccagaggctcttccagtgcctgctgcaccgggccctgcacccccgggagcccctgccccccatccagcagcacatctggaacatgctgaaccccccagctgaggtgaccaccaagagccagatccccctgagcaagatcaagaccctcttccccctcatcgaggccaagaagaaggaccaggtgacagcccaggagatcttccaggacaaccatgaagatggccccacagccaagaagctgaagacagagcagggcggggcccacttctctgtgagcagcctggccgagggctctgtgacctctgtgggctctgtgaacccagctgagaacttccgggtgctggtgaagcagaagaaggccagctttgaggaggccagcaaccagctgatcaaccacatcgagcagttcctggacaccaatgagaccccctacttcatgaagagcattgactgcatccgggccttccgggaggaggccatcaagttcagcgaggagcagcgcttcaacaacttcctgaaggccctgcaggagaaggtggagatcaagcagctgaaccacttctgggagatcgtggtgcaggacggcatcaccctcatcaccaaggaggaggccagcggcagctctgtgacagctgaggaggccaagaagttcctggcccccaaggacaagcccagcggggacacagctgctgtgtttgaggagggcggagatgtggatgacctgctggacatgatctag

SEQ ID NO: 22608 - DNA, 2199 bp, Artificial Sequence; identical to SEQ ID NO: 22607
  Description of Artificial Sequence: Synthetic coding sequence

SEQ ID NO: 22609 - DNA, 1830 bp, Artificial Sequence
  Description of Artificial Sequence: Synthetic coding sequence
atgagcggctgggagagctactacaagacagaaggagatgaggaggccgaggaggagcaggaggagaacctggaggccagcggggactacaagtacagcggccgggacagcctcatcttcctggtggatgccagcaaggccatgtttgagagccagagtgaagatgagctgaccccatttgacatgagcatccagtgcatccagagcgtgtacatcagcaagatcatcagcagtgaccgggacctgctggccgtggtgttctacggcacagagaaggacaagaacagcgtgaacttcaagaacatctacgtgctgcaggagctggacaaccctggggccaagaggatcctggagctggaccagttcaagggccagcagggccagaagcgcttccaggacatgatgggccacggcagtgactacagcctgtctgaggtgctgtgggtgtgtgccaacctcttcagtgatgtgcagttcaagatgagccacaagaggatcatgctgttcaccaatgaagacaacccccacggcaatgacagcgccaaggccagccgggcccggaccaaggccggggacctgcgggacaccggcatcttcctggacctgatgcacctgaagaagccaggcggctttgacatcagcctcttctacagagacatcatcagcattgctgaagatgaggacctgcgggtgcactttgaggagagcagcaagctggaggacctgctgaggaaggtgcgggccaaggagaccaggaagagggccctgagccggctgaagctgaagctgaacaaggacatcgtcatctctgtgggcatctacaacctggtgcagaaggccctgaagcccccacccatcaagctgtaccgggagaccaatgaacctgtgaagaccaagaccaggaccttcaacaccagcactggaggcctgctgctgcccagcgacaccaagaggagccagatctacggcagccggcagatcatcctggagaaggaggagacagaggagctgaagagatttgatgatcctggcctgatgctgatgggcttcaagcccctggtgctgctgaagaagcaccactacctgcggcccagcctgtttgtgtacccagaggagagcctggtgattggcagcagcaccctcttcagcgccctgctgatcaagtgcctggagaaggaggtggccgccctgtgccgctacaccccaagaagaaacatccccccctactttgtggccctggtgccccaggaggaggagctggatgaccagaagatccaggtgaccccacctggcttccagctggtgttcctgccctttgctgatgacaagaggaagatgcccttcacagagaagatcatggccaccccagagcaggtgggcaagatgaaggccatcgtggagaagctgcgcttcacctacagaagtgacagctttgaaaatcctgtgctgcagcagcacttcaggaacctggaggccctggccctggacctgatggagcctgagcaggccgtggacctgaccctgcccaaggtggaggccatgaacaagaggctgggcagcctggtggatgagttcaaggagctggtgtaccccccagactacaaccctgagggcaaggtgaccaagaggaagcatgacaatgaaggcagcggcagcaagaggcccaaggtggagtacagcgaggaggagctgaagacccacatcagcaagggcaccctgggcaagttcaccgtgcccatgctgaaggaggcctgccgggcctacggcctgaagagcggcctgaagaagcaggagctgctggaggccctgaccaagcacttccaggactag

SEQ ID NO: 22610 - DNA, 1830 bp, Artificial Sequence; identical to SEQ ID NO: 22609
  Description of Artificial Sequence: Synthetic coding sequence

SEQ ID NO: 22611 - DNA, 1674 bp, Artificial Sequence
  Description of Artificial Sequence: Synthetic coding sequence
atgagcggctgggagagctactacaagacagaaggagatgaggaggccgaggaggagcaggaggagaacctggaggccagcggggactacaagtacagcggccgggacagcctcatcttcctggtggatgccagcaaggccatgtttgagagccagagtgaagatgagctgaccccatttgacatgagcatccagtgcatccagagcgtgtacatcagcaagatcatcagcagtgaccgggacctgctggccgtggtgttctacggcacagagaaggacaagaacagcgtgaacttcaagaacatctacgtgctgcaggagctggacaaccctggggccaagaggatcctggagctggaccagttcaagggccagcagggccagaagcgcttccaggacatgatgggccacggcagtgactacagcctgtctgaggtgctgtgggtgtgtgccaacctcttcagtgatgtgcagttcaagatgagccacaagaggatcatgctgttcaccaatgaagacaacccccacggcaatgacagcgccaaggccagccgggcccggaccaaggccggggacctgcgggacaccggcatcttcctggacctgatgcacctgaagaagccaggcggctttgacatcagcctcttctacagagacatcatcagcattgctgaagatgaggacctgcgggtgcactttgaggagagcagcaagctggaggacctgctgaggaaggtgcgggccaaggagaccaggaagagggccctgagccggctgaagctgaagctgaacaaggacatcgtcatctctgtgggcatctacaacctggtgcagaaggccctgaagcccccacccatcaagctgtaccgggagaccaatgaacctgtgaagaccaagaccaggaccttcaacaccagcactggaggcctgctgctgcccagcgacaccaagaggagccagatctacggcagccggcagatcatcctggagaaggaggagacagaggagctgaagagatttgatgatcctggcctgatgctgatgggcttcaagcccctggtgctgctgaagaagcaccactacctgcggcccagcctgtttgtgtacccagaggagagcctggtgattggcagcagcaccctcttcagcgccctgctgatcaagtgcctggagaaggaggtggccgccctgtgccgctacaccccaagaagaaacatccccccctactttgtggccctggtgccccaggaggaggagctggatgaccagaagatccaggtgaccccacctggcttccagctggtgttcctgccctttgctgatgacaagaggaagatgcccttcacagagaagatcatggccaccccagagcaggtgggcaagatgaaggccatcgtggagaagctgcgcttcacctacagaagtgacagctttgaaaatcctgtgctgcagcagcacttcaggaacctggaggccctggccctggacctgatggagcctgagcaggccgtggacctgaccctgcccaaggtggaggccatgaacaagaggctgggcagcctggtggatgagttcaaggagctggtgtaccccccagactacaaccctgagggcaaggtgaccaagaggaagcacgccaagggcccccgctggagcatccagaagaggagctag

SEQ ID NO: 22612 - DNA, 1707 bp, Artificial Sequence
  Description of Artificial Sequence: Synthetic coding sequence
atgagcggctgggagagctactacaagacagaaggagatgaggaggccgaggaggagcaggaggagaacctggaggccagcggggactacaagtacagcggccgggacagcctcatcttcctggtggatgccagcaaggccatgtttgagagccagagtgaagatgagctgaccccatttgacatgagcatccaggagctggacaaccctggggccaagaggatcctggagctggaccagttcaagggccagcagggccagaagcgcttccaggacatgatgggccacggcagtgactacagcctgtctgaggtgctgtgggtgtgtgccaacctcttcagtgatgtgcagttcaagatgagccacaagaggatcatgctgttcaccaatgaagacaacccccatggaaatgattctgccaaggccagccgggcccggaccaaggccggggacctgcgggacaccggcatcttcctggacctgatgcacctgaagaagccaggcggctttgacatcagcctcttctacagagacatcatcagcattgctgaagatgaggacctgcgggtgcactttgaggagagcagcaagctggaggacctgctgaggaaggtgcgggccaaggagaccaggaagagggccctgagccggctgaagctgaagctgaacaaggacatcgtcatctctgtgggcatctacaacctggtgcagaaggccctgaagcccccacccatcaagctgtaccgggagaccaatgaacctgtgaagaccaagaccaggaccttcaacaccagcactggaggcctgctgctgcccagcgacaccaagaggagccagatctacggcagccggcagatcatcctggagaaggaggagacagaggagctgaagagatttgatgaccccggcctgatgctgatgggcttcaagcccctggtgctgctgaagaagcaccactacctgcggcccagcctgtttgtgtacccagaggagagcctggtgattggcagcagcaccctcttcagcgccctgctgatcaagtgcctggagaaggaggtggccgccctgtgccgctacacccccaggaggaacatccccccctactttgtggccctggtgccccaggaggaggagctggatgaccagaagatccaggtgaccccacctggcttccagctggtgttcctgccctttgctgatgacaagaggaagatgcccttcacagagaagatcatggccaccccagagcaggtgggcaagatgaaggccatcgtggagaagctgcgcttcacctacagaagtgacagctttgagaaccctgtgctgcagcagcacttcaggaacctggaggccctggccctggacctgatggagcctgagcaggccgtggacctgaccctgcccaaggtggaggccatgaacaagaggctgggcagcctggtggatgagttcaaggagctggtgtaccccccagactacaaccctgagggcaaggtgaccaagaggaagcatgacaatgaaggcagcggcagcaagaggcccaaggtggagtacagcgaggaggagctgaagacccacatcagcaagggcaccctgggcaagttcaccgtgcccatgctgaaggaggcctgccgggcctacggcctgaagagcggcctgaagaagcaggagctgctggaggccctgaccaagcacttccaggactag

SEQ ID NO: 22613 - DNA, 1680 bp, Artificial Sequence
  Description of Artificial Sequence: Synthetic coding sequence
atgaagaagcagaggaagaacaagaagaggaccctgaagcaggtgtgcatccagagcgtgtacatcagcaagatcatcagcagtgaccgggacctgctggccgtggtgttctacggcacagagaaggacaagaacagcgtgaacttcaagaacatctacgtgctgcaggagctggacaaccctggggccaagaggatcctggagctggaccagttcaagggccagcagggccagaagcgcttccaggacatgatgggccacggcagtgactacagcctgtctgaggtgctgtgggtgtgtgccaacctcttcagtgatgtgcagttcaagatgagccacaagaggatcatgctgttcaccaatgaagacaacccccacggcaatgacagcgccaaggccagccgggcccggaccaaggccggggacctgcgggacaccggcatcttcctggacctgatgcacctgaagaagccaggcggctttgacatcagcctcttctacagagacatcatcagcattgctgaagatgaggacctgcgggtgcactttgaggagagcagcaagctggaggacctgctgaggaaggtgcgggccaaggagaccaggaagagggccctgagccggctgaagctgaagctgaacaaggacatcgtcatctctgtgggcatctacaacctggtgcagaaggccctgaagcccccacccatcaagctgtaccgggagaccaatgaacctgtgaagaccaagaccaggaccttcaacaccagcactggaggcctgctgctgcccagcgacaccaagaggagccagatctacggcagccggcagatcatcctggagaaggaggagacagaggagctgaagagatttgatgatcctggcctgatgctgatgggcttcaagcccctggtgctgctgaagaagcaccactacctgcggcccagcctgtttgtgtacccagaggagagcctggtgattggcagcagcaccctcttcagcgccctgctgatcaagtgcctggagaaggaggtggccgccctgtgccgctacaccccaagaagaaacatccccccctactttgtggccctggtgccccaggaggaggagctggatgaccagaagatccaggtgaccccacctggcttccagctggtgttcctgccctttgctgatgacaagaggaagatgcccttcacagagaagatcatggccaccccagagcaggtgggcaagatgaaggccatcgtggagaagctgcgcttcacctacagaagtgacagctttgaaaatcctgtgctgcagcagcacttcaggaacctggaggccctggccctggacctgatggagcctgagcaggccgtggacctgaccctgcccaaggtggaggccatgaacaagaggctgggcagcctggtggatgagttcaaggagctggtgtaccccccagactacaaccctgagggcaaggtgaccaagaggaagcatgacaatgaaggcagcggcagcaagaggcccaaggtggagtacagcgaggaggagctgaagacccacatcagcaagggcaccctgggcaagttcaccgtgcccatgctgaaggaggcctgccgggcctacggcctgaagagcggcctgaagaagcaggagctgctggaggccctgaccaagcacttccaggactag

SEQ ID NO: 22614 - DNA, 1830 bp, Artificial Sequence; identical to SEQ ID NO: 22609
  Description of Artificial Sequence: Synthetic coding sequence

SEQ ID NO: 22615 - DNA, 1431 bp, Artificial Sequence
  Description of Artificial Sequence: Synthetic coding sequence
atgatgggccacggcagtgactacagcctgtctgaggtgctgtgggtgtgtgccaacctcttcagtgatgtgcagttcaagatgagccacaagaggatcatgctgttcaccaatgaagacaacccccatggaaatgattctgccaaggccagccgggcccggaccaaggccggggacctgcgggacaccggcatcttcctggacctgatgcacctgaagaagccaggcggctttgacatcagcctcttctacagagacatcatcagcattgctgaagatgaggacctgcgggtgcactttgaggagagcagcaagctggaggacctgctgaggaaggtgcgggccaaggagaccaggaagagggccctgagccggctgaagctgaagctgaacaaggacatcgtcatctctgtgggcatctacaacctggtgcagaaggccctgaagcccccacccatcaagctgtaccgggagaccaatgaacctgtgaagaccaagaccaggaccttcaacaccagcactggaggcctgctgctgcccagcgacaccaagaggagccagatctacggcagccggcagatcatcctggagaaggaggagacagaggagctgaagagatttgatgaccccggcctgatgctgatgggcttcaagcccctggtgctgctgaagaagcaccactacctgcggcccagcctgtttgtgtacccagaggagagcctggtgattggcagcagcaccctcttcagcgccctgctgatcaagtgcctggagaaggaggtggccgccctgtgccgctacacccccaggaggaacatccccccctactttgtggccctggtgccccaggaggaggagctggatgaccagaagatccaggtgaccccacctggcttccagctggtgttcctgccctttgctgatgacaagaggaagatgcccttcacagagaagatcatggccaccccagagcaggtgggcaagatgaaggccatcgtggagaagctgcgcttcacctacagaagtgacagctttgagaaccctgtgctgcagcagcacttcaggaacctggaggccctggccctggacctgatggagcctgagcaggccgtggacctgaccctgcccaaggtggaggccatgaacaagaggctgggcagcctggtggatgagttcaaggagctggtgtaccccccagactacaaccctgagggcaaggtgaccaagaggaagcatgacaatgaaggcagcggcagcaagaggcccaaggtggagtacagcgaggaggagctgaagacccacatcagcaagggcaccctgggcaagttcaccgtgcccatgctgaaggaggcctgccgggcctacggcctgaagagcggcctgaagaagcaggagctgctggaggccctgaccaagcacttccaggactag

SEQ ID NO: 22616 - DNA, 741 bp, Artificial Sequence
  Description of Artificial Sequence: Synthetic coding sequence
atggccggggccccagatgagaggagaagaggccctgctgctggggagcagctgcagcagcagcacgtgtcctgccaggtgtttcctgagcggctggcccagggcaacccccagcagggcttcttcagcagcttcttcaccagcaaccagaagtgccagctgcggctgctgaagaccctggagaccaacccctacgtgaagctgctgctggatgccatgaagcacagcggctgtgctgtgaacaaggacagacacttcagctgtgaggactgcaatggaaatgtgtctgggggctttgatgccagcaccagccagatcgtgctgtgccagaacaacatccacaaccaggcccacatgaacagagtggtgacccatgagctgattcatgcctttgaccactgccgggcccacgtggactggttcaccaacatccgccacctggcctgcagcgaggtgcgggccgccaacctgagcggggactgcagcctggtgaatgagatcttccggctgcacttcggcctgaagcagcaccaccagacctgtgtgcgggaccgggccaccctgagcatcctggccgtgaggaacatcagcaaggaggtggccaagaaggctgtggatgaggtgtttgagagctgcttcaatgaccacgagcccttcggccgcatcccccacaacaagacctacgcccgctatgcccaccgggactttgaaaatagagaccgctactacagcaacatctag

SEQ ID NO: 22617 - DNA, 1515 bp, Artificial Sequence
  Description of Artificial Sequence: Synthetic coding sequence
atggaccccggccagcagcccccaccccagcctgccccccagggccagggccagccccccagccagcccccccagggccagggccccccatctggccctggccagcctgccccagctgccacccaggccgccccccaggcccccccagctggccaccagatcgtgcacgtgcggggggacagcgagacagacctggaggccctcttcaatgctgtgatgaaccccaagacagccaacgtgccccagacagtgcccatgaggctgaggaagctgcctgacagcttcttcaagcccccagagcccaagagccacagccggcaggccagcacagatgctggaacagctggggccctgaccccccagcacgtgcgggcccacagcagccctgccagcctgcagctgggcgctgtgtccccaggcaccctgacccccactggagtggtgtctggccctgctgccacccccacagcccagcacctgcggcagagcagctttgagatcccagatgatgtgcccctgcctgctggctgggagatggccaagaccagcagcggccagcgctacttcctgaaccacatcgaccagaccaccacctggcaggaccccaggaaggccatgctgagccagatgaatgtgacagcccccaccagcccccctgtgcagcagaacatgatgaacagcgccagcggccccctgcctgatggctgggagcaggccatgacccaggatggagagatctactacatcaaccacaagaacaagaccacctcctggctggacccccggctggaccccaggtttgccatgaaccagaggatcagccagagcgcccctgtgaagcagcccccacccctggccccccagagcccccagggcggcgtgatgggcggcagcaacagcaaccagcagcagcagatgaggctgcagcagctgcagatggagaaggagcggctgcggctgaagcagcaggagctgctgcggcaggccatgaggaacatcaaccccagcacagccaacagccccaagtgccaggagctggccctgcggagccagctgcccaccctggagcaggacggcggcacccagaaccctgtgagcagccctggcatgagccaggagctgcggaccatgaccaccaacagcagtgaccccttcctgaacagcggcacctaccacagcagagatgagagcacagacagcggcctgtccatgagcagctacagcgtgcccaggaccccagatgacttcctgaacagcgtggatgagatggacacaggagacaccatcaaccagagcaccctgcccagccagcagaaccgcttcccagactacctggaggccatccctggcaccaacgtggacctgggcaccctggagggagatggcatgaacattgaaggagaggagctgatgcccagcctgcaggaggccctgagcagtgacatcctgaatgacatggagagcgtgctggccgccaccaagctggacaaggagagcttcctgacctggctgtag

SEQ ID NO: 22618 - DNA, 1365 bp, Artificial Sequence
  Description of Artificial Sequence: Synthetic coding sequence
atggaccccggccagcagcccccaccccagcctgccccccagggccagggccagccccccagccagcccccccagggccagggccccccatctggccctggccagcctgccccagctgccacccaggccgccccccaggcccccccagctggccaccagatcgtgcacgtgcggggggacagcgagacagacctggaggccctcttcaatgctgtgatgaaccccaagacagccaacgtgccccagacagtgcccatgaggctgaggaagctgcctgacagcttcttcaagcccccagagcccaagagccacagccggcaggccagcacagatgctggaacagctggggccctgaccccccagcacgtgcgggcccacagcagccctgccagcctgcagctgggcgctgtgtccccaggcaccctgacccccactggagtggtgtctggccctgctgccacccccacagcccagcacctgcggcagagcagctttgagatcccagatgatgtgcccctgcctgctggctgggagatggccaagaccagcagcggccagcgctacttcctgaaccacatcgaccagaccaccacctggcaggaccccaggaaggccatgctgagccagatgaatgtgacagcccccaccagcccccctgtgcagcagaacatgatgaacagcgccagcgccatgaaccagaggatcagccagagcgcccctgtgaagcagcccccacccctggccccccagagcccccagggcggcgtgatgggcggcagcaacagcaaccagcagcagcagatgaggctgcagcagctgcagatggagaaggagcggctgcggctgaagcagcaggagctgctgcggcaggtgcggccccaggagctggccctgcggagccagctgcccaccctggagcaggacggcggcacccagaaccctgtgagcagccctggcatgagccaggagctgcggaccatgaccaccaacagcagtgaccccttcctgaacagcggcacctaccacagcagagatgagagcacagacagcggcctgtccatgagcagctacagcgtgcccaggaccccagatgacttcctgaacagcgtggatgagatggacacaggagacaccatcaaccagagcaccctgcccagccagcagaaccgcttcccagactacctggaggccatccctggcaccaacgtggacctgggcaccctggagggagatggcatgaacattgaaggagaggagctgatgcccagcctgcaggaggccctgagcagtgacatcctgaatgacatggagagcgtgctggccgccaccaagctggacaaggagagcttcctgacctggctgtag

SEQ ID NO: 22619 - DNA, 1266 bp, Artificial Sequence
  Description of Artificial Sequence: Synthetic coding sequence
atgaggctgaggaagctgcctgacagcttcttcaagcccccagagcccaagagccacagccggcaggccagcacagatgctggaacagctggggccctgaccccccagcacgtgcgggcccacagcagccctgccagcctgcagctgggcgctgtgtccccaggcaccctgacccccaccggggtggtgtctggccctgctgccacccccacagcccagcacctgcggcagagcagctttgagatcccagatgatgtgcccctgcctgctggctgggagatggccaagaccagcagcggccagcgctacttcctgaaccacatcgaccagaccaccacctggcaggaccccaggaaggccatgctgagccagatgaatgtgacagcccccaccagcccccctgtgcagcagaacatgatgaacagcgccagcggccccctgcctgatggctgggagcaggccatgacccaggatggagagatctactacatcaaccacaagaacaagaccacctcctggctggacccccggctggaccccaggtttgggaaggccatgaaccagaggatcagccagagcgcccctgtgaagcagcccccacccctggccccccagagcccccagggcggcgtgatgggcggcagcaacagcaaccagcagcagcagatgaggctgcagcagctgcagatggagaaggagcggctgcggctgaagcagcaggagctgctgcggcaggccatgaggaacatcaaccccagcacagccaacagccccaagtgccaggagctggccctgcggagccagctgcccaccctggagcaggacggcggcacccagaaccctgtgagcagccctggcatgagccaggagctgcggaccatgaccaccaacagcagtgaccccttcctgaacagcggcacctaccacagcagagatgagagcacagattctggcctgtccatgagcagctacagcgtgcccaggaccccagatgacttcctgaacagcgtggatgagatggacaccggggacaccatcaaccagagcaccctgcccagccagcagaaccgcttcccagactacctggaggccatccctggcaccaacgtggacctgggcaccctggagggagatggcatgaacatcgagggggaggagctgatgcccagcctgcaggaggccctgagcagtgacatcctgaatgacatggagagcgtgctggccgccaccaagctggacaaggagagcttcctgacctggctgtag

SEQ ID NO: 22620 - DNA, 981 bp, Artificial Sequence
  Description of Artificial Sequence: Synthetic coding sequence
atggccaagaccagcagcggccagcgctacttcctgaaccacatcgaccagaccaccacctggcaggaccccaggaaggccatgctgagccagatgaatgtgacagcccccaccagcccccctgtgcagcagaacatgatgaacagcgccagcggccccctgcctgatggctgggagcaggccatgacccaggatggagagatctactacatcaaccacaagaacaagaccacctcctggctggacccccggctggaccccaggtttgccatgaaccagaggatcagccagagcgcccctgtgaagcagcccccacccctggccccccagagcccccagggcggcgtgatgggcggcagcaacagcaaccagcagcagcagatgaggctgcagcagctgcagatggagaaggagcggctgcggctgaagcagcaggagctgctgcggcaggccatgaggaacatcaaccccagcacagccaacagccccaagtgccaggagctggccctgcggagccagctgcccaccctggagcaggacggcggcacccagaaccctgtgagcagccctggcatgagccaggagctgcggaccatgaccaccaacagcagtgaccccttcctgaacagcggcacctaccacagcagagatgagagcacagacagcggcctgtccatgagcagctacagcgtgcccaggaccccagatgacttcctgaacagcgtggatgagatggacacaggagacaccatcaaccagagcaccctgcccagccagcagaaccgcttcccagactacctggaggccatccctggcaccaacgtggacctgggcaccctggagggagatggcatgaacattgaaggagaggagctgatgcccagcctgcaggaggccctgagcagtgacatcctgaatgacatggagagcgtgctggccgccaccaagctggacaaggagagcttcctgacctggctgtag

SEQ ID NO: 22621 - DNA, 1467 bp, Artificial Sequence
  Description of Artificial Sequence: Synthetic coding sequence
atggaccccggccagcagcccccaccccagcctgccccccagggccagggccagccccccagccagcccccccagggccagggccccccatctggccctggccagcctgccccagctgccacccaggccgccccccaggcccccccagctggccaccagatcgtgcacgtgcggggggacagcgagacagacctggaggccctcttcaatgctgtgatgaaccccaagacagccaacgtgccccagacagtgcccatgaggctgaggaagctgcctgacagcttcttcaagcccccagagcccaagagccacagccggcaggccagcacagatgctggaacagctggggccctgaccccccagcacgtgcgggcccacagcagccctgccagcctgcagctgggcgctgtgtccccaggcaccctgacccccactggagtggtgtctggccctgctgccacccccacagcccagcacctgcggcagagcagctttgagatcccagatgatgtgcccctgcctgctggctgggagatggccaagaccagcagcggccagcgctacttcctgaaccacatcgaccagaccaccacctggcaggaccccaggaaggccatgctgagccagatgaatgtgacagcccccaccagcccccctgtgcagcagaacatgatgaacagcgccagcggccccctgcctgatggctgggagcaggccatgacccaggatggagagatctactacatcaaccacaagaacaagaccacctcctggctggacccccggctggaccccaggtttgccatgaaccagaggatcagccagagcgcccctgtgaagcagcccccacccctggccccccagagcccccagggcggcgtgatgggcggcagcaacagcaaccagcagcagcagatgaggctgcagcagctgcagatggagaaggagcggctgcggctgaagcagcaggagctgctgcggcaggagctggccctgcggagccagctgcccaccctggagcaggacggcggcacccagaaccctgtgagcagccctggcatgagccaggagctgcggaccatgaccaccaacagcagtgaccccttcctgaacagcggcacctaccacagcagagatgagagcacagacagcggcctgtccatgagcagctacagcgtgcccaggaccccagatgacttcctgaacagcgtggatgagatggacacaggagacaccatcaaccagagcaccctgcccagccagcagaaccgcttcccagactacctggaggccatccctggcaccaacgtggacctgggcaccctggagggagatggcatgaacattgaaggagaggagctgatgcccagcctgcaggaggccctgagcagtgacatcctgaatgacatggagagcgtgctggccgccaccaagctggacaaggagagcttcctgacctggctgtag

SEQ ID NO: 22622 - DNA, 1479 bp, Artificial Sequence
  Description of Artificial Sequence: Synthetic coding sequence
atggaccccggccagcagcccccaccccagcctgccccccagggccagggccagccccccagccagcccccccagggccagggccccccatctggccctggccagcctgccccagctgccacccaggccgccccccaggcccccccagctggccaccagatcgtgcacgtgcggggggacagcgagacagacctggaggccctcttcaatgctgtgatgaaccccaagacagccaacgtgccccagacagtgcccatgaggctgaggaagctgcctgacagcttcttcaagcccccagagcccaagagccacagccggcaggccagcacagatgctggaacagctggggccctgaccccccagcacgtgcgggcccacagcagccctgccagcctgcagctgggcgctgtgtccccaggcaccctgacccccactggagtggtgtctggccctgctgccacccccacagcccagcacctgcggcagagcagctttgagatcccagatgatgtgcccctgcctgctggctgggagatggccaagaccagcagcggccagcgctacttcctgaaccacatcgaccagaccaccacctggcaggaccccaggaaggccatgctgagccagatgaatgtgacagcccccaccagcccccctgtgcagcagaacatgatgaacagcgccagcggccccctgcctgatggctgggagcaggccatgacccaggatggagagatctactacatcaaccacaagaacaagaccacctcctggctggacccccggctggaccccaggtttgccatgaaccagaggatcagccagagcgcccctgtgaagcagcccccacccctggccccccagagcccccagggcggcgtgatgggcggcagcaacagcaaccagcagcagcagatgaggctgcagcagctgcagatggagaaggagcggctgcggctgaagcagcaggagctgctgcggcaggtgcggccccaggagctggccctgcggagccagctgcccaccctggagcaggacggcggcacccagaaccctgtgagcagccctggcatgagccaggagctgcggaccatgaccaccaacagcagtgaccccttcctgaacagcggcacctaccacagcagagatgagagcacagacagcggcctgtccatgagcagctacagcgtgcccaggaccccagatgacttcctgaacagcgtggatgagatggacacaggagacaccatcaaccagagcaccctgcccagccagcagaaccgcttcccagactacctggaggccatccctggcaccaacgtggacctgggcaccctggagggagatggcatgaacattgaaggagaggagctgatgcccagcctgcaggaggccctgagcagtgacatcctgaatgacatggagagcgtgctggccgccaccaagctggacaaggagagcttcctgacctggctgtag

SEQ ID NO: 22623 - DNA, 1353 bp, Artificial Sequence
  Description of Artificial Sequence: Synthetic coding sequence
atggaccccggccagcagcccccaccccagcctgccccccagggccagggccagccccccagccagcccccccagggccagggccccccatctggccctggccagcctgccccagctgccacccaggccgccccccaggcccccccagctggccaccagatcgtgcacgtgcggggggacagcgagacagacctggaggccctcttcaatgctgtgatgaaccccaagacagccaacgtgccccagacagtgcccatgaggctgaggaagctgcctgacagcttcttcaagcccccagagcccaagagccacagccggcaggccagcacagatgctggaacagctggggccctgaccccccagcacgtgcgggcccacagcagccctgccagcctgcagctgggcgctgtgtccccaggcaccctgacccccactggagtggtgtctggccctgctgccacccccacagcccagcacctgcggcagagcagctttgagatcccagatgatgtgcccctgcctgctggctgggagatggccaagaccagcagcggccagcgctacttcctgaaccacatcgaccagaccaccacctggcaggaccccaggaaggccatgctgagccagatgaatgtgacagcccccaccagcccccctgtgcagcagaacatgatgaacagcgccagcgccatgaaccagaggatcagccagagcgcccctgtgaagcagcccccacccctggccccccagagcccccagggcggcgtgatgggcggcagcaacagcaaccagcagcagcagatgaggctgcagcagctgcagatggagaaggagcggctgcggctgaagcagcaggagctgctgcggcaggagctggccctgcggagccagctgcccaccctggagcaggacggcggcacccagaaccctgtgagcagccctggcatgagccaggagctgcggaccatgaccaccaacagcagtgaccccttcctgaacagcggcacctaccacagcagagatgagagcacagacagcggcctgtccatgagcagctacagcgtgcccaggaccccagatgacttcctgaacagcgtggatgagatggacacaggagacaccatcaaccagagcaccctgcccagccagcagaaccgcttcccagactacctggaggccatccctggcaccaacgtggacctgggcaccctggagggagatggcatgaacattgaaggagaggagctgatgcccagcctgcaggaggccctgagcagtgacatcctgaatgacatggagagcgtgctggccgccaccaagctggacaaggagagcttcctgacctggctgtag

SEQ ID NO: 22624 - DNA, 1860 bp, Artificial Sequence
  Description of Artificial Sequence: Synthetic coding sequence
atggccaatgacattgatgagctgattggcatccccttccccaaccacagcagcgaggtgctgtgcagcctgaatgagcagagacatgatggcctgctgtgtgatgtgctgctggtggtgcaggagcaggagtaccgcacccacaggtctgtgctggccgcctgcagcaagtacttcaagaagctgttcaccgctggcaccctggccagccagccctacgtgtatgaaattgactttgtgcagcctgaggccctggccgccatcctggagtttgcctacaccagcaccctgaccatcacagctggaaatgtgaagcacatcctgaatgctgccaggatgctggagatccagtgcatcgtgaatgtgtgcctggagatcatggagcctggaggagatggaggagaggaggatgacaaggaggatgatgatgatgatgaagatgatgatgatgaggaggatgaggaggaggaggaggaggaggaggaggatgatgatgatgacacagaagattttgctgaccaggagaacctgcctgacccccaggacatcagctgccaccagagccccagcaagacagaccacctgacagagaaggcctacagcgacaccccccgggacttcccagacagcttccaggccggcagccctggccacctgggcgtcatccgggacttcagcattgagagcctgctgagagaaaatctctaccccaaggccaacatcccagaccggcggcccagcctgagcccctttgccccagacttcttcccccacctgtggccaggggactttggagcctttgcccagctgcctgagcagcccatggattctggccccctggacctggtgatcaagaacaggaagatcaaggaggaggagaaggaggagctgcccccacctcctcctccacccttccccaatgacttcttcaaggacatgtttcctgacctgcccggcggccccctgggccccatcaaggccgagaatgactatggagcctacctgaacttcctgagcgccacccacctgggcggcctcttccccccctggcccctggtggaggagaggaagctgaagcccaaggccagccagcagtgccccatctgccacaaggtgatcatgggcgctgggaagctgcccaggcacatgaggacccacactggagagaagccctacatgtgcaccatctgtgaggtgcgcttcacccggcaggacaagctgaagatccacatgaggaagcacactggagagcggccctacctgtgcatccactgcaatgccaagtttgtgcacaactatgacctgaagaaccacatgaggatccacactggagtgcggccctaccagtgtgagttctgctacaagagcttcaccaggagtgaccacctgcaccgccacatcaagaggcagagctgcaggatggcccggccccggcggggcaggaagccagctgcctggagggctgccagcctgctgtttggacctgggggccctgccccagacaaggccgcctttgtgatgcccccagccctgggggaggtgggcggccacctgggcggcgctgctgtgtgcctgcccggccccagccctgccaagcacttcctggccgcccccaagggggccctgagcctgcaggagctggagcggcagtttgaggagacccagatgaagctgtttggccgggcccagctggaggccgagagaaatgctgggggcctgctggcctttgccctggccgagaatgtggccgccgcccggccctacttccccctgcctgacccctgggccgccggcctggccggcctgcccggcctggccggcctgaaccacgtggcctccatgtctgaggccaacaactag

SEQ ID NO: 22625 - DNA, 1860 bp, Artificial Sequence; identical to SEQ ID NO: 22624
  Description of Artificial Sequence: Synthetic coding sequence

SEQ ID NO: 22626 - DNA, 78 bp, Artificial Sequence
  Description of Artificial Sequence: Synthetic coding sequence
atggccaatgacattgatgagctgattggcatccccttccccaaccacagcagcgaggtgctgtgcagcctgaactag

SEQ ID NO: 22627 - DNA, 57 bp, Artificial Sequence
  Description of Artificial Sequence: Synthetic coding sequence
atggccaatgacattgatgagctgattggcatccccttccccaaccacagcagctag

SEQ ID NO: 22628 - DNA, 3375 bp, Artificial Sequence
  Description of Artificial Sequence: Synthetic coding sequence
atggctgatggcccccgctgcaagaggaggaagcaggccaaccccaggagaaataatgtgaccaactacaacacagtggtggagaccaacagcgacagtgatgatgaggacaagctgcacatcgtggaggaggagagcgtgacagatgctgctgactgtgaaggagtgcctgaagatgacctgcccacagaccagacagtgctgcccggccgcagcagcgagcgggagggcaatgccaagaactgctgggaggatgacaggaaggagggccaggagatcctgggccctgaggcccaggctgatgaagctggctgcaccgtgaaggatgatgaatgtgagagtgatgctgaaaatgagcagaaccacgaccccaacgtggaggagttcctgcagcagcaggacacagctgtgatcttccctgaggcccctgaggaggaccagaggcagggcaccccagaggccagcggccatgatgaaaatggcaccccagatgccttcagccagctgctgacctgcccctactgtgaccggggctacaagcgcttcaccagcctgaaggagcacatcaagtacagacatgagaagaatgaagacaacttcagctgcagcctgtgcagctacacctttgcctaccgcacccagctggagcggcacatgaccagccacaagagcggccgggaccagagacatgtgacccagagcggctgcaacaggaagttcaagtgcacagaatgtgggaaggccttcaagtacaagcaccacctgaaggagcacctgcgcatccacagcggggagaagccctatgaatgtcccaactgcaagaagcgcttcagccacagcggcagctacagcagccacatcagcagcaagaagtgcatcagcctcatccctgtgaatggccggcccaggacaggcctgaagaccagccagtgcagcagccccagcctgagcgccagccctggcagccccacccggccccagatccggcagaagattgagaacaagcccctgcaggagcagctgtctgtgaaccagatcaagacagagcctgtggactatgagttcaagcccatcgtggtggccagcggcatcaactgcagcacccccctgcagaatggagtcttcaccggcggcggccccctgcaggccaccagcagcccccagggcatggtgcaggccgtggtgctgcccaccgtgggcctggtgagccccatcagcatcaacctgagtgacatccagaatgtgctgaaggtggccgtggatggaaatgtcatccggcaggtgctggagaacaaccaggccaacctggccagcaaggagcaggagaccatcaatgccagccccatccagcagggcggccacagcgtcatcagcgccatcagcctgcccctggtggaccaggacggcaccaccaagatcatcatcaactacagcctggagcagcccagccagctgcaggtggtgccccagaacctgaagaaggaaaatcctgtggccaccaacagctgcaagtctgagaagctgcctgaggacctgactgtgaagtctgagaaggacaagagctttgagggcggcgtgaatgacagcacctgcctgctgtgtgatgactgccctggggacatcaatgccctgcctgagctgaagcactatgacctgaagcagcccacccagcccccacccctgcctgctgctgaggccgagaagccagagagctctgtgtcctctgccactggagatggcaacctgagccccagccagccccccctgaagaacctgctgagcctgctgaaggcctactatgccctgaatgcccagcccagcgctgaggagctgagcaagattgctgacagcgtgaacctgcccctggatgtggtgaagaagtggtttgagaagatgcaggccggccagatctctgtgcagagcagcgagcccagcagccctgagcccgggaaggtgaacatcccagccaagaacaatgaccagccccagagcgccaatgccaatgagccccaggacagcacagtgaacctgcagagccccctgaagatgaccaacagccctgtgctgcctgtgggcagcaccaccaacggcagccgcagcagcacccccagccccagccccctgaacctgagcagcagcaggaacacccagggctacctgtacacagctgagggcgcccaggaggagccccaggtggagcccctggacctgagcctgcccaagcagcagggcgagctgctggagaggagcaccatcacctctgtgtaccagaacagcgtgtacagcgtgcaggaggagcccctgaacctgagctgtgccaagaaggagccccagaaggacagctgtgtgacagacagcgagcctgtggtgaatgtcatcccccccagcgccaaccccatcaacatcgccatccccaccgtgacagcccagctgcccaccatcgtggccatcgctgaccagaacagcgtgccctgcctgcgggccctggccgccaacaagcagaccatcctgatcccccaggtggcctacacctacagcaccaccgtgtccccagctgtgcaggagccccccctgaaggtgatccagcccaacggcaaccaggatgagcggcaggacaccagcagcgagggcgtgtccaatgtggaggaccagaatgacagcgacagcaccccacccaagaagaagatgaggaagacagaaaatggcatgtatgcctgtgacctgtgtgacaagatcttccagaagagcagcagcctgctgcggcacaagtatgagcacacaggcaagaggcctcatgaatgtggcatctgcaagaaggccttcaagcacaagcaccacctgattgagcacatgaggctgcacagcggggagaagccctaccagtgtgacaagtgtgggaagcgcttcagccacagcggcagctacagccagcacatgaaccaccgctacagctactgcaagcgggaggccgaggagcgggacagcacagagcaggaggaggccggccctgagatcctgagcaatgagcacgtgggcgcccgggccagccccagccagggcgacagtgatgagcgggagagcctgacccgggaggaggatgaggacagcgagaaggaggaggaggaggaggacaaggagatggaggagctgcaggaggagaaggaatgtgagaagccccagggagatgaggaggaggaggaggaggaggaggaggtggaggaggaggaggtggaggaggctgaaaatgaaggagaggaggccaagacagagggcctgatgaaggatgacagagctgagagccaggccagcagcctgggccagaaggtgggggagagcagcgagcaggtgtctgaggagaagaccaatgaggcctag

SEQ ID NO: 22629 - DNA, 3378 bp, Artificial Sequence
  Description of Artificial Sequence: Synthetic coding sequence
atggctgatggcccccgctgcaagaggaggaagcaggccaaccccaggagaaataatgtgaccaactacaacacagtggtggagaccaacagcgacagtgatgatgaggacaagctgcacatcgtggaggaggagagcgtgacagatgctgctgactgtgaaggagtgcctgaagatgacctgcccacagaccagacagtgctgcccggccgcagcagcgagcgggagggcaatgccaagaactgctgggaggatgacaccgggaaggagggccaggagatcctgggccctgaggcccaggctgatgaggccggctgcaccgtgaaggatgatgaatgtgagagtgatgctgaaaatgagcagaaccacgaccccaacgtggaggagttcctgcagcagcaggacacagctgtgatcttccctgaggcccctgaggaggaccagaggcagggcaccccagaggccagcggccatgatgaaaatggcaccccagatgccttcagccagctgctgacctgcccctactgtgaccggggctacaagcgcttcaccagcctgaaggagcacatcaagtacagacatgagaagaatgaagacaacttcagctgcagcctgtgcagctacacctttgcctaccgcacccagctggagcggcacatgaccagccacaagagcggccgggaccagagacatgtgacccagagcggctgcaacaggaagttcaagtgcacagaatgtgggaaggccttcaagtacaagcaccacctgaaggagcacctgcgcatccacagcggggagaagccctatgagtgccccaactgcaagaagcgcttcagccacagcggcagctacagcagccacatcagcagcaagaagtgcatcagcctcatccctgtgaatggccggcccaggacaggcctgaagaccagccagtgcagcagccccagcctgagcgccagccctggcagccccacccggccccagatccggcagaagattgagaacaagcccctgcaggagcagctgtctgtgaaccagatcaagacagagcctgtggactatgagttcaagcccatcgtggtggccagcggcatcaactgcagcacccccctgcagaatggagtcttcaccggcggcggccccctgcaggccaccagcagcccccagggcatggtgcaggccgtggtgctgcccaccgtgggcctggtgagccccatcagcatcaacctgagtgacatccagaatgtgctgaaggtggccgtggatggaaatgtcatccggcaggtgctggagaacaaccaggccaacctggccagcaaggagcaggagaccatcaatgccagccccatccagcagggcggccacagcgtcatcagcgccatcagcctgcccctggtggaccaggacggcaccaccaagatcatcatcaactacagcctggagcagcccagccagctgcaggtggtgccccagaacctgaagaaggagaaccctgtggccaccaacagctgcaagtctgagaagctgcctgaggacctgactgtgaagtctgagaaggacaagagctttgaaggaggagtgaatgacagcacctgcctgctgtgtgatgactgccctggggacatcaatgccctgcctgagctgaagcactatgacctgaagcagcccacccagcccccacccctgcctgctgctgaggccgagaagccagagagctctgtgagcagcgccactggagatggcaacctgagccccagccagccccccctgaagaacctgctgagcctgctgaaggcctactatgccctgaatgcccagcccagcgctgaggagctgagcaagattgctgacagcgtgaacctgcccctggatgtggtgaagaagtggtttgagaagatgcaggccggccagatctctgtgcagagcagcgagcccagcagccctgagcccgggaaggtgaacatcccagccaagaacaatgaccagccccagagcgccaatgccaatgagccccaggacagcacagtgaacctgcagagccccctgaagatgaccaacagccctgtgctgcctgtgggcagcaccaccaacggcagccgcagcagcacccccagccccagccccctgaacctgagcagcagcaggaacacccagggctacctgtacacagctgagggcgcccaggaggagccccaggtggagcccctggacctgagcctgcccaagcagcagggcgagctgctggagaggagcaccatcacctctgtgtaccagaacagcgtgtacagcgtgcaggaggagcccctgaacctgagctgtgccaagaaggagccccagaaggacagctgtgtgacagattctgagcctgtggtgaatgtcatccccccatctgccaaccccatcaacatcgccatccccaccgtgacagcccagctgcccaccatcgtggccatcgctgaccagaacagcgtgccctgcctgcgggccctggccgccaacaagcagaccatcctgatcccccaggtggcctacacctacagcaccaccgtgtccccagctgtgcaggagccccccctgaaggtgatccagcccaatggaaaccaggatgagcggcaggacaccagcagcgagggcgtgtccaatgtggaggaccagaatgacagcgacagcaccccacccaagaagaagatgaggaagacagaaaatggcatgtatgcctgtgacctgtgtgacaagatcttccagaagagcagcagcctgctgcggcacaagtatgagcacacaggcaagaggcctcatgaatgtggcatctgcaagaaggccttcaagcacaagcaccacctgattgagcacatgaggctgcacagcggggagaagccctaccagtgtgacaagtgtgggaagcgcttcagccacagcggcagctacagccagcacatgaaccaccgctacagctactgcaagcgggaggccgaggagcgggacagcacagagcaggaggaggccggccctgagatcctgagcaatgaacatgtgggcgcccgggccagccccagccagggcgacagtgatgagcgggagagcctgacccgggaggaggatgaagattctgagaaggaggaggaggaggaggacaaggagatggaggagctgcaggaggagaaggaatgtgagaagccccagggagatgaggaggaggaggaggaggaggaggaggtggaggaggaggaggtggaggaggccgagaatgaaggagaggaggccaagacagagggcctgatgaaggatgacagagctgagagccaggccagcagcctgggccagaaggtgggggagagcagcgagcaggtgtctgaggagaagaccaatgaggcctag

SEQ ID NO: 22630 - DNA, 870 bp, Artificial Sequence
  Description of Artificial Sequence: Synthetic coding sequence
atggctgatggcccccgctgcaagaggaggaagcaggccaaccccaggagaaataatgtgaccaactacaacacagtggtggagaccaacagcgacagtgatgatgaggacaagctgcacatcgtggaggaggagagcgtgacagatgctgctgactgtgaaggagtgcctgaagatgacctgcccacagaccagacagtgctgcccggccgcagcagcgagcgggagggcaatgccaagaactgctgggaggatgacaccgggaaggagggccaggagatcctgggccctgaggcccaggctgatgaggccggctgcaccgtgaaggatgatgaatgtgagagtgatgctgaaaatgagcagaaccacgaccccaacgtggaggagttcctgcagcagcaggacacagctgtgatcttccctgaggcccctgaggaggaccagaggcagggcaccccagaggccagcggccatgatgaaaatggcaccccagatgccttcagccagctgctgacctgcccctactgtgaccggggctacaagcgcttcaccagcctgaaggagcacatcaagtacagacatgagaagaatgaagacaacttcagctgcagcctgtgcagctacacctttgcctaccgcacccagctggagcggcacatgaccagccacaagagcggccgggaccagagacatgtgacccagagcggctgcaacaggaagttcaagtgcacagaatgtgggaaggccttcaagtacaagcaccacctgaaggagcacctgcgcatccacagcggggagaagccctatgagtgccccaactgcaagaagcgcttcagccacagcggcagctacagcagccacatctcctag

SEQ ID NO: 22631 - DNA, 2721 bp, Artificial Sequence
  Description of Artificial Sequence: Synthetic coding sequence
atgaccagccacaagagcggccgggaccagagacatgtgacccagagcggctgcaacaggaagttcaagtgcacagaatgtgggaaggccttcaagtacaagcaccacctgaaggagcacctgcgcatccacagcggggagaagccctatgaatgtcccaactgcaagaagcgcttcagccacagcggcagctacagcagccacatcagcagcaagaagtgcatcagcctcatccctgtgaatggccggcccaggacaggcctgaagaccagccagtgcagcagccccagcctgagcgccagccctggcagccccacccggccccagatccggcagaagattgagaacaagcccctgcaggagcagctgtctgtgaaccagatcaagacagagcctgtggactatgagttcaagcccatcgtggtggccagcggcatcaactgcagcacccccctgcagaatggagtcttcaccggcggcggccccctgcaggccaccagcagcccccagggcatggtgcaggccgtggtgctgcccaccgtgggcctggtgagccccatcagcatcaacctgagtgacatccagaatgtgctgaaggtggccgtggatggaaatgtcatccggcaggtgctggagaacaaccaggccaacctggccagcaaggagcaggagaccatcaatgccagccccatccagcagggcggccacagcgtcatcagcgccatcagcctgcccctggtggaccaggacggcaccaccaagatcatcatcaactacagcctggagcagcccagccagctgcaggtggtgccccagaacctgaagaaggaaaatcctgtggccaccaacagctgcaagtctgagaagctgcctgaggacctgactgtgaagtctgagaaggacaagagctttgagggcggcgtgaatgacagcacctgcctgctgtgtgatgactgccctggggacatcaatgccctgcctgagctgaagcactatgacctgaagcagcccacccagcccccacccctgcctgctgctgaggccgagaagccagagagctctgtgtcctctgccactggagatggcaacctgagccccagccagccccccctgaagaacctgctgagcctgctgaaggcctactatgccctgaatgcccagcccagcgctgaggagctgagcaagattgctgacagcgtgaacctgcccctggatgtggtgaagaagtggtttgagaagatgcaggccggccagatctctgtgcagagcagcgagcccagcagccctgagcccgggaaggtgaacatcccagccaagaacaatgaccagccccagagcgccaatgccaatgagccccaggacagcacagtgaacctgcagagccccctgaagatgaccaacagccctgtgctgcctgtgggcagcaccaccaacggcagccgcagcagcacccccagccccagccccctgaacctgagcagcagcaggaacacccagggctacctgtacacagctgagggcgcccaggaggagccccaggtggagcccctggacctgagcctgcccaagcagcagggcgagctgctggagaggagcaccatcacctctgtgtaccagaacagcgtgtacagcgtgcaggaggagcccctgaacctgagctgtgccaagaaggagccccagaaggacagctgtgtgacagacagcgagcctgtggtgaatgtcatcccccccagcgccaaccccatcaacatcgccatccccaccgtgacagcccagctgcccaccatcgtggccatcgctgaccagaacagcgtgccctgcctgcgggccctggccgccaacaagcagaccatcctgatcccccaggtggcctacacctacagcaccaccgtgtccccagctgtgcaggagccccccctgaaggtgatccagcccaacggcaaccaggatgagcggcaggacaccagcagcgagggcgtgtccaatgtggaggaccagaatgacagcgacagcaccccacccaagaagaagatgaggaagacagaaaatggcatgtatgcctgtgacctgtgtgacaagatcttccagaagagcagcagcctgctgcggcacaagtatgagcacacaggcaagaggcctcatgaatgtggcatctgcaagaaggccttcaagcacaagcaccacctgattgagcacatgaggctgcacagcggggagaagccctaccagtgtgacaagtgtgggaagcgcttcagccacagcggcagctacagccagcacatgaaccaccgctacagctactgcaagcgggaggccgaggagcgggacagcacagagcaggaggaggccggccctgagatcctgagcaatgagcacgtgggcgcccgggccagccccagccagggcgacagtgatgagcgggagagcctgacccgggaggaggatgaggacagcgagaaggaggaggaggaggaggacaaggagatggaggagctgcaggaggagaaggaatgtgagaagccccagggagatgaggaggaggaggaggaggaggaggaggtggaggaggaggaggtggaggaggctgaaaatgaaggagaggaggccaagacagagggcctgatgaaggatgacagagctgagagccaggccagcagcctgggccagaaggtgggggagagcagcgagcaggtgtctgaggagaagaccaatgaggcctag

SEQ ID NO: 22632 - DNA, 3327 bp, Artificial Sequence
  Description of Artificial Sequence: Synthetic coding sequence
atgaaggtgaccaactacaacacagtggtggagaccaacagcgacagtgatgatgaggacaagctgcacatcgtggaggaggagagcgtgacagatgctgctgactgtgagggcgtgcctgaagatgacctgcccacagaccagacagtgctgcccggccgcagcagcgagcgggagggcaatgccaagaactgctgggaggatgacaccgggaaggagggccaggagatcctgggccctgaggcccaggctgatgaagctggctgcaccgtgaaggatgatgaatgtgagagtgatgctgaaaatgagcagaaccacgaccccaacgtggaggagttcctgcagcagcaggacacagctgtgatcttccctgaggcccctgaggaggaccagaggcagggcaccccagaggccagcggccatgatgaaaatggcaccccagatgccttcagccagctgctgacctgcccctactgtgaccggggctacaagcgcttcaccagcctgaaggagcacatcaagtacagacatgagaagaatgaagacaacttcagctgcagcctgtgcagctacacctttgcctaccgcacccagctggagcggcacatgaccagccacaagagcggccgggaccagagacatgtgacccagagcggctgcaacaggaagttcaagtgcacagaatgtgggaaggccttcaagtacaagcaccacctgaaggagcacctgcgcatccacagcggggagaagccctatgaatgtcccaactgcaagaagcgcttcagccacagcggcagctacagcagccacatcagcagcaagaagtgcatcagcctcatccctgtgaatggccggcccaggacaggcctgaagaccagccagtgcagcagccccagcctgagcgccagccctggcagccccacccggccccagatccggcagaagattgagaacaagcccctgcaggagcagctgtctgtgaaccagatcaagacagagcctgtggactatgagttcaagcccatcgtggtggccagcggcatcaactgcagcacccccctgcagaatggagtcttcaccggcggcggccccctgcaggccaccagcagcccccagggcatggtgcaggccgtggtgctgcccaccgtgggcctggtgagccccatcagcatcaacctgagtgacatccagaatgtgctgaaggtggccgtggatggaaatgtcatccggcaggtgctggagaacaaccaggccaacctggccagcaaggagcaggagaccatcaatgccagccccatccagcagggcggccacagcgtcatcagcgccatcagcctgcccctggtggaccaggacggcaccaccaagatcatcatcaactacagcctggagcagcccagccagctgcaggtggtgccccagaacctgaagaaggaaaatcctgtggccaccaacagctgcaagtctgagaagctgcctgaggacctgactgtgaagtctgagaaggacaagagctttgagggcggcgtgaatgacagcacctgcctgctgtgtgatgactgccctggggacatcaatgccctgcctgagctgaagcactatgacctgaagcagcccacccagcccccacccctgcctgctgctgaggccgagaagccagagagctctgtgtcctctgccactggagatggcaacctgagccccagccagccccccctgaagaacctgctgagcctgctgaaggcctactatgccctgaatgcccagcccagcgctgaggagctgagcaagattgctgacagcgtgaacctgcccctggatgtggtgaagaagtggtttgagaagatgcaggccggccagatctctgtgcagagcagcgagcccagcagccctgagcccgggaaggtgaacatcccagccaagaacaatgaccagccccagagcgccaatgccaatgagccccaggacagcacagtgaacctgcagagccccctgaagatgaccaacagccctgtgctgcctgtgggcagcaccaccaacggcagccgcagcagcacccccagccccagccccctgaacctgagcagcagcaggaacacccagggctacctgtacacagctgagggcgcccaggaggagccccaggtggagcccctggacctgagcctgcccaagcagcagggcgagctgctggagaggagcaccatcacctctgtgtaccagaacagcgtgtacagcgtgcaggaggagcccctgaacctgagctgtgccaagaaggagccccagaaggacagctgtgtgacagacagcgagcctgtggtgaatgtcatcccccccagcgccaaccccatcaacatcgccatccccaccgtgacagcccagctgcccaccatcgtggccatcgctgaccagaacagcgtgccctgcctgcgggccctggccgccaacaagcagaccatcctgatcccccaggtggcctacacctacagcaccaccgtgtccccagctgtgcaggagccccccctgaaggtgatccagcccaacggcaaccaggatgagcggcaggacaccagcagcgagggcgtgtccaatgtggaggaccagaatgacagcgacagcaccccacccaagaagaagatgaggaagacagaaaatggcatgtatgcctgtgacctgtgtgacaagatcttccagaagagcagcagcctgctgcggcacaagtatgagcacacaggcaagaggcctcatgaatgtggcatctgcaagaaggccttcaagcacaagcaccacctgattgagcacatgaggctgcacagcggggagaagccctaccagtgtgacaagtgtgggaagcgcttcagccacagcggcagctacagccagcacatgaaccaccgctacagctactgcaagcgggaggccgaggagcgggacagcacagagcaggaggaggccggccctgagatcctgagcaatgagcacgtgggcgcccgggccagccccagccagggcgacagtgatgagcgggagagcctgacccgggaggaggatgaggacagcgagaaggaggaggaggaggaggacaaggagatggaggagctgcaggaggagaaggaatgtgagaagccccagggagatgaggaggaggaggaggaggaggaggaggtggaggaggaggaggtggaggaggctgaaaatgaaggagaggaggccaagacagagggcctgatgaaggatgacagagctgagagccaggccagcagcctgggccagaaggtgggggagagcagcgagcaggtgtctgaggagaagaccaatgaggcctag

SEQ ID NO: 22633 - DNA, 3180 bp, Artificial Sequence
  Description of Artificial Sequence: Synthetic coding sequence
atggctgatggcccccgctgcaagaggaggaagcaggccaaccccaggagaaataatgtgaccaactacaacacagtggtggagaccaacagcgacagtgatgatgaggacaagctgcacatcgtggaggaggagagcgtgacagatgctgctgactgtgaaggagtgcctgaagatgacctgcccacagaccagacagtgctgcccggccgcagcagcgagcgggagggcaatgccaagaactgctgggaggatgacaggaaggagggccaggagatcctgggccctgaggcccaggctgatgaagctggctgcaccgtgaaggatgatgaatgtgagagtgatgctgaaaatgagcagaaccacgaccccaacgtggaggagttcctgcagcagcaggacacagctgtgatcttccctgaggcccctgaggaggaccagaggcagggcaccccagaggccagcggccatgatgaaaatggcaccccagatgccttcagccagctgctgacctgcccctactgtgaccggggctacaagcgcttcaccagcctgaaggagcacatcaagtacagacatgagaagaatgaagacaacttcagctgcagcctgtgcagctacacctttgcctaccgcacccagctggagcggcacatgaccagccacaagagcggccgggaccagagacatgtgacccagagcggctgcaacaggaagttcaagtgcacagaatgtgggaaggccttcaagtacaagcaccacctgaaggagcacctgcgcatccacagcggggagaagccctatgaatgtcccaactgcaagaagcgcttcagccacagcggcagctacagcagccacatcagcagcaagaagtgcatcagcctcatccctgtgaatggccggcccaggacaggcctgaagaccagccagtgcagcagccccagcctgagcgccagccctggcagccccacccggccccagatccggcagaagattgagaacaagcccctgcaggagcagctgtctgtgaaccagatcaagacagagcctgtggactatgagttcaagcccatcgtggtggccagcggcatcaactgcagcacccccctgcagaatggagtcttcaccggcggcggccccctgcaggccaccagcagcccccagggcatggtgcaggccgtggtgctgcccaccgtgggcctggtgagccccatcagcatcaacctgagtgacatccagaatgtgctgaaggtggccgtggatggaaatgtcatccggcaggtgctggagaacaaccaggccaacctggccagcaaggagcaggagaccatcaatgccagccccatccagcagggcggccacagcgtcatcagcgccatcagcctgcccctggtggaccaggacggcaccaccaagatcatcatcaactacagcctggagcagcccagccagctgcaggtggtgccccagaacctgaagaaggaaaatcctgtggccaccaacagctgcaagtctgagaagctgcctgaggacctgactgtgaagtctgagaaggacaagagctttgagggcggcgtgaatgacagcacctgcctgctgtgtgatgactgccctggggacatcaatgccctgcctgagctgaagcactatgacctgaagcagcccacccagcccccacccctgcctgctgctgaggccgagaagccagagagctctgtgtcctctgccactggagatggcaacctgagccccagccagccccccctgaagaacctgctgagcctgctgaaggcctactatgccctgaatgcccagcccagcgctgaggagctgagcaagattgctgacagcgtgaacctgcccctggatgtggtgaagaagtggtttgagaagatgcaggccggccagatctctgtgcagagcagcgagcccagcagccctgagcccgggaaggtgaacatcccagccaagaacaatgaccagccccagagcgccaatgccaatgagccccaggacagcacagtgaacctgcagagccccctgaagatgaccaacagccctgtgctgcctgtgggcagcaccaccaacggcagccgcagcagcacccccagccccagccccctgaacctgagcagcagcaggaacacccagggctacctgtacacagctgagggcgcccaggaggagccccaggtggagcccctggacctgagcctgcccaagcagcagggcgagctgctggagaggagcaccatcacctctgtgtaccagaacagcgtgtacagcgtgcaggaggagcccctgaacctgagctgtgccaagaaggagccccagaaggacagctgtgtgacagacagcgagcctgtggtgaatgtcatcccccccagcgccaaccccatcaacatcgccatccccaccgtgacagcccagctgcccaccatcgtggccatcgctgaccagaacagcgtgccctgcctgcgggccctggccgccaacaagcagaccatcctgatcccccaggtggcctacacctacagcaccaccgtgtccccagctgtgcaggagccccccctgaaggtgatccagcccaacggcaaccaggatgagcggcaggacaccagcagcgagggcgtgtccaatgtggaggaccagaatgacagcgacagcaccccacccaagaagaagatgaggaagacagaaaatggcatgtatgcctgtgacctgtgtgacaagatcttccagaagagcagcagcctgctgcggcacaagtatgagcacacaggcaagaggcctcatgaatgtggcatctgcaagaaggccttcaagcacaagcaccacctgattgagcacatgaggctgcacagcggggagaagccctaccagtgtgacaagtgtgggaagcgcttcagccacagcggcagctacagccagcacatgaaccaccgctacagctactgcaagcgggaggccgaggagcgggacagcacagagcaggaggaggccggccctgagatcctgagcaatgagcacgtgggcgcccgggccagccccagccagggcgacagtgatgagcgggagagcctgacccgggaggaggatgaggacagcgagaaggaggaggaggaggaggacaaggagatggaggagctgcaggaggagaagcacaagaagaagaagtag

SEQ ID NO: 22634 - DNA, 1932 bp, Artificial Sequence
  Description of Artificial Sequence: Synthetic coding sequence
atggctgatggcccccgctgcaagaggaggaagcaggccaaccccaggagaaataatggcaccccagatgccttcagccagctgctgacctgcccctactgtgaccggggctacaagcgcttcaccagcctgaaggagcacatcaagtacagacatgagaagaatgaagacaacttcagctgcagcctgtgcagctacacctttgcctaccgcacccagctggagcggcacatgaccagccacaagagcggccgggaccagagacatgtgacccagagcggctgcaacaggaagttcaagtgcacagaatgtgggaaggccttcaagtacaagcaccacctgaaggagcacctgcgcatccacagcggggagaagccctatgagtgccccaactgcaagaagcgcttcagccacagcggcagctacagcagccacatcagcagcaagaagtgcatcagcctcatccctgtgaatggccggcccaggacaggcctgaagaccagccagtgcagcagccccagcctgagcgccagccctggcagccccacccggccccagatccggcagaagattgagaacaagcccctgcaggagcagctgtctgtgaaccagatcaagacagagcctgtggactatgagttcaagcccatcgtggtggccagcggcatcaactgcagcacccccctgcagaatggagtcttcaccggcggcggccccctgcaggccaccagcagcccccagggcatggtgcaggccgtggtgctgcccaccgtgggcctggtgagccccatcagcatcaacctgagtgacatccagaatgtgctgaaggtggccgtggatggaaatgtcatccggcaggtgctggagaacaaccaggccaacctggccagcaaggagcaggagaccatcaatgccagccccatccagcagggcggccacagcgtcatcagcgccatcagcctgcccctggtggaccaggacggcaccaccaagatcatcatcaactacagcctggagcagcccagccagctgcaggtggtgccccagaacctgaagaaggagaaccctgtggccaccaacagctgcaagtctgagaagctgcctgaggacctgactgtgaagtctgagaaggacaagagctttgaaggaggagtgaatgacagcacctgcctgctgtgtgatgactgccctggggacatcaatgccctgcctgagctgaagcactatgacctgaagcagcccacccagcccccacccctgcctgctgctgaggccgagaagccagagagctctgtgagcagcgccactggagatggcaacctgagccccagccagccccccctgaagaacctgctgagcctgctgaaggcctactatgccctgaatgcccagcccagcgctgaggagctgagcaagattgctgacagcgtgaacctgcccctggatgtggtgaagaagtggtttgagaagatgcaggccggccagatctctgtgcagagcagcgagcccagcagccctgagcccgggaaggtgaacatcccagccaagaacaatgaccagccccagagcgccaatgccaatgagccccaggacagcacagtgaacctgcagagccccctgaagatgaccaacagccctgtgctgcctgtgggcagcaccaccaacggcagccgcagcagcacccccagccccagccccctgaacctgagcagcagcaggaacacccagggctacctgtacacagctgagggcgcccaggaggagccccaggtggagcccctggacctgagcctgcccaagcagcagggcgaggaggccaagacagagggcctgatgaaggatgacagagctgagagccaggccagcagcctgggccagaaggtgggggagagcagcgagcaggtgtctgaggagaagaccaatgaggcctag

SEQ ID NO: 22635 - DNA, 3174 bp, Artificial Sequence
  Description of Artificial Sequence: Synthetic coding sequence
atggctgatggcccccgctgcaagaggaggaagcaggccaaccccaggagaaataatggcaaggagggccaggagatcctgggccctgaggcccaggctgatgaggccggctgcaccgtgaaggatgatgaatgtgagagtgatgctgaaaatgagcagaaccacgaccccaacgtggaggagttcctgcagcagcaggacacagctgtgatcttccctgaggcccctgaggaggaccagaggcagggcaccccagaggccagcggccatgatgaaaatggcaccccagatgccttcagccagctgctgacctgcccctactgtgaccggggctacaagcgcttcaccagcctgaaggagcacatcaagtacagacatgagaagaatgaagacaacttcagctgcagcctgtgcagctacacctttgcctaccgcacccagctggagcggcacatgaccagccacaagagcggccgggaccagagacatgtgacccagagcggctgcaacaggaagttcaagtgcacagaatgtgggaaggccttcaagtacaagcaccacctgaaggagcacctgcgcatccacagcggggagaagccctatgagtgccccaactgcaagaagcgcttcagccacagcggcagctacagcagccacatcagcagcaagaagtgcatcagcctcatccctgtgaatggccggcccaggacaggcctgaagaccagccagtgcagcagccccagcctgagcgccagccctggcagccccacccggccccagatccggcagaagattgagaacaagcccctgcaggagcagctgtctgtgaaccagatcaagacagagcctgtggactatgagttcaagcccatcgtggtggccagcggcatcaactgcagcacccccctgcagaatggagtcttcaccggcggcggccccctgcaggccaccagcagcccccagggcatggtgcaggccgtggtgctgcccaccgtgggcctggtgagccccatcagcatcaacctgagtgacatccagaatgtgctgaaggtggccgtggatggaaatgtcatccggcaggtgctggagaacaaccaggccaacctggccagcaaggagcaggagaccatcaatgccagccccatccagcagggcggccacagcgtcatcagcgccatcagcctgcccctggtggaccaggacggcaccaccaagatcatcatcaactacagcctggagcagcccagccagctgcaggtggtgccccagaacctgaagaaggagaaccctgtggccaccaacagctgcaagtctgagaagctgcctgaggacctgactgtgaagtctgagaaggacaagagctttgaaggaggagtgaatgacagcacctgcctgctgtgtgatgactgccctggggacatcaatgccctgcctgagctgaagcactatgacctgaagcagcccacccagcccccacccctgcctgctgctgaggccgagaagccagagagctctgtgagcagcgccactggagatggcaacctgagccccagccagccccccctgaagaacctgctgagcctgctgaaggcctactatgccctgaatgcccagcccagcgctgaggagctgagcaagattgctgacagcgtgaacctgcccctggatgtggtgaagaagtggtttgagaagatgcaggccggccagatctctgtgcagagcagcgagcccagcagccctgagcccgggaaggtgaacatcccagccaagaacaatgaccagccccagagcgccaatgccaatgagccccaggacagcacagtgaacctgcagagccccctgaagatgaccaacagccctgtgctgcctgtgggcagcaccaccaacggcagccgcagcagcacccccagccccagccccctgaacctgagcagcagcaggaacacccagggctacctgtacacagctgagggcgcccaggaggagccccaggtggagcccctggacctgagcctgcccaagcagcagggcgagctgctggagaggagcaccatcacctctgtgtaccagaacagcgtgtacagcgtgcaggaggagcccctgaacctgagctgtgccaagaaggagccccagaaggacagctgtgtgacagattctgagcctgtggtgaatgtcatccccccatctgccaaccccatcaacatcgccatccccaccgtgacagcccagctgcccaccatcgtggccatcgctgaccagaacagcgtgccctgcctgcgggccctggccgccaacaagcagaccatcctgatcccccaggtggcctacacctacagcaccaccgtgtccccagctgtgcaggagccccccctgaaggtgatccagcccaatggaaaccaggatgagcggcaggacaccagcagcgagggcgtgtccaatgtggaggaccagaatgacagcgacagcaccccacccaagaagaagatgaggaagacagaaaatggcatgtatgcctgtgacctgtgtgacaagatcttccagaagagcagcagcctgctgcggcacaagtatgagcacacaggcaagaggcctcatgaatgtggcatctgcaagaaggccttcaagcacaagcaccacctgattgagcacatgaggctgcacagcggggagaagccctaccagtgtgacaagtgtgggaagcgcttcagccacagcggcagctacagccagcacatgaaccaccgctacagctactgcaagcgggaggccgaggagcgggacagcacagagcaggaggaggccggccctgagatcctgagcaatgaacatgtgggcgcccgggccagccccagccagggcgacagtgatgagcgggagagcctgacccgggaggaggatgaagattctgagaaggaggaggaggaggaggacaaggagatggaggagctgcaggaggagaaggaatgtgagaagccccagggagatgaggaggaggaggaggaggaggaggaggtggaggaggaggaggtggaggaggccgagaatgaaggagaggaggccaagacagagggcctgatgaaggatgacagagctgagagccaggccagcagcctgggccagaaggtgggggagagcagcgagcaggtgtctgaggagaagaccaatgaggcctag

SEQ ID NO: 22636 - DNA, 3048 bp, Artificial Sequence
  Description of Artificial Sequence: Synthetic coding sequence
atgatgaatgccagccagatgcagaagatgagcaagaccatgatcctgatgctgaagagcttctacaacaacaagaccctgctgtccttcttcctgcggcacctgaagaggacccggggccgggcccaccagaagcctgtggtgatgatgaagatggagcaccagatgcacttccacaactacagccctgtgcacatcgtcatcggctacaagcgcttcaccagcctgaaggagcacatcaagtacagacatgagaagaatgaagacaacttcagctgcagcctgtgcagctacacctttgcctaccgcacccagctggagcggcacatgaccagccacaagagcggccgggaccagagacatgtgacccagagcggctgcaacaggaagttcaagtgcacagaatgtgggaaggccttcaagtacaagcaccacctgaaggagcacctgcgcatccacagcggggagaagccctatgagtgccccaactgcaagaagcgcttcagccacagcggcagctacagcagccacatcagcagcaagaagtgcatcagcctcatccctgtgaatggccggcccaggacaggcctgaagaccagccagtgcagcagccccagcctgagcgccagccctggcagccccacccggccccagatccggcagaagattgagaacaagcccctgcaggagcagctgtctgtgaaccagatcaagacagagcctgtggactatgagttcaagcccatcgtggtggccagcggcatcaactgcagcacccccctgcagaatggagtcttcaccggcggcggccccctgcaggccaccagcagcccccagggcatggtgcaggccgtggtgctgcccaccgtgggcctggtgagccccatcagcatcaacctgagtgacatccagaatgtgctgaaggtggccgtggatggaaatgtcatccggcaggtgctggagaacaaccaggccaacctggccagcaaggagcaggagaccatcaatgccagccccatccagcagggcggccacagcgtcatcagcgccatcagcctgcccctggtggaccaggacggcaccaccaagatcatcatcaactacagcctggagcagcccagccagctgcaggtggtgccccagaacctgaagaaggagaaccctgtggccaccaacagctgcaagtctgagaagctgcctgaggacctgactgtgaagtctgagaaggacaagagctttgaaggaggagtgaatgacagcacctgcctgctgtgtgatgactgccctggggacatcaatgccctgcctgagctgaagcactatgacctgaagcagcccacccagcccccacccctgcctgctgctgaggccgagaagccagagagctctgtgagcagcgccactggagatggcaacctgagccccagccagccccccctgaagaacctgctgagcctgctgaaggcctactatgccctgaatgcccagcccagcgctgaggagctgagcaagattgctgacagcgtgaacctgcccctggatgtggtgaagaagtggtttgagaagatgcaggccggccagatctctgtgcagagcagcgagcccagcagccctgagcccgggaaggtgaacatcccagccaagaacaatgaccagccccagagcgccaatgccaatgagccccaggacagcacagtgaacctgcagagccccctgaagatgaccaacagccctgtgctgcctgtgggcagcaccaccaacggcagccgcagcagcacccccagccccagccccctgaacctgagcagcagcaggaacacccagggctacctgtacacagctgagggcgcccaggaggagccccaggtggagcccctggacctgagcctgcccaagcagcagggcgagctgctggagaggagcaccatcacctctgtgtaccagaacagcgtgtacagcgtgcaggaggagcccctgaacctgagctgtgccaagaaggagccccagaaggacagctgtgtgacagattctgagcctgtggtgaatgtcatccccccatctgccaaccccatcaacatcgccatccccaccgtgacagcccagctgcccaccatcgtggccatcgctgaccagaacagcgtgccctgcctgcgggccctggccgccaacaagcagaccatcctgatcccccaggtggcctacacctacagcaccaccgtgtccccagctgtgcaggagccccccctgaaggtgatccagcccaatggaaaccaggatgagcggcaggacaccagcagcgagggcgtgtccaatgtggaggaccagaatgacagcgacagcaccccacccaagaagaagatgaggaagacagaaaatggcatgtatgcctgtgacctgtgtgacaagatcttccagaagagcagcagcctgctgcggcacaagtatgagcacacaggcaagaggcctcatgaatgtggcatctgcaagaaggccttcaagcacaagcaccacctgattgagcacatgaggctgcacagcggggagaagccctaccagtgtgacaagtgtgggaagcgcttcagccacagcggcagctacagccagcacatgaaccaccgctacagctactgcaagcgggaggccgaggagcgggacagcacagagcaggaggaggccggccctgagatcctgagcaatgaacatgtgggcgcccgggccagccccagccagggcgacagtgatgagcgggagagcctgacccgggaggaggatgaagattctgagaaggaggaggaggaggaggacaaggagatggaggagctgcaggaggagaaggaatgtgagaagccccagggagatgaggaggaggaggaggaggaggaggaggtggaggaggaggaggtggaggaggccgagaatgaaggagaggaggccaagacagagggcctgatgaaggatgacagagctgagagccaggccagcagcctgggccagaaggtgggggagagcagcgagcaggtgtctgaggagaagaccaatgaggcctag

SEQ ID NO: 22637 - DNA, 3360 bp, Artificial Sequence
  Description of Artificial Sequence: Synthetic coding sequence
atggctgatggcccccgctgcaagaggaggaagcaggccaaccccaggagaaataatgtgaccaactacaacacagtggtggagaccaacagcgacagtgatgatgaggacaagctgcacatcgtggaggaggagagcgtgacagatgctgctgactgtgaaggagtgcctgaagatgacctgcccacagaccagacagtgctgcccggccgcagcagcgagcgggagggcaatgccaagaactgctgggaggatgacaggaaggagggccaggagatcctgggccctgaggcccaggctgatgaagctggctgcaccgtgaaggatgatgaatgtgagagtgatgctgaaaatgagcagaaccacgaccccaacgtggaggagttcctgcagcagcaggacacagctgtgatcttccctgaggcccctgaggaggaccagaggcagggcaccccagaggccagcggccatgatgaaaatggcaccccagatgccttcagccagctgctgacctgcccctactgtgaccggggctacaagcgcttcaccagcctgaaggagcacatcaagtacagacatgagaagaatgaagacaacttcagctgcagcctgtgcagctacacctttgcctaccgcacccagctggagcggcacatgaccagccacaagagcggccgggaccagagacatgtgacccagagcggctgcaacaggaagttcaagtgcacagaatgtgggaaggccttcaagtacaagcaccacctgaaggagcacctgcgcatccacagcggggagaagccctatgaatgtcccaactgcaagaagcgcttcagccacagcggcagctacagcagccacatcagcagcaagaagtgcatcagcctcatccctgtgaatggccggcccaggacaggcctgaagaccagccagtgcagcagccccagcctgagcgccagccctggcagccccacccggccccagatccggcagaagattgagaacaagcccctgcaggagcagctgtctgtgaaccagatcaagacagagcctgtggactatgagttcaagcccatcgtggtggccagcggcatcaactgcagcacccccctgcagaatggagtcttcaccggcggcggccccctgcaggccaccagcagcccccagggcatggtgcaggccgtggtgctgcccaccgtgggcctggtgagccccatcagcatcaacctgagtgacatccagaatgtgctgaaggtggccgtggatggaaatgtcatccggcaggtgctggagaacaaccaggccaacctggccagcaaggagcaggagaccatcaatgccagccccatccagcagggcggccacagcgtcatcagcgccatcagcctgcccctggtggaccaggacggcaccaccaagatcatcatcaactacagcctggagcagcccagccagctgcaggtggtgccccagaacctgaagaaggaaaatcctgtggccaccaacagctgcaagtctgagaagctgcctgaggacctgactgtgaagtctgagaaggacaagagctttgagggcggcgtgaatgacagcacctgcctgctgtgtgatgactgccctggggacatcaatgccctgcctgagctgaagcactatgacctgaagcagcccacccagcccccacccctgcctgctgctgaggccgagaagccagagagctctgtgtcctctgccactggagatggcaacctgagccccagccagccccccctgaagaacctgctgagcctgctgaaggcctactatgccctgaatgcccagcccagcgctgaggagctgagcaagattgctgacagcgtgaacctgcccctggatgtggtgaagaagtggtttgagaagatgcaggccggccagatctctgtgcagagcagcgagcccagcagccctgagcccgggaaggtgaacatcccagccaagaacaatgaccagccccagagcgccaatgccaatgagccccaggacagcacagtgaacctgcagagccccctgaagatgaccaacagccctgtgctgcctgtgggcagcaccaccaacggcagccgcagcagcacccccagccccagccccctgaacctgagcagcagcaggaacacccagggctacctgtacacagctgagggcgcccaggaggagccccaggtggagcccctggacctgagcctgcccaagcagcagggcgagctgctggagaggagcagcctgcctgagcagtgcctcttctgccccggccgcaccctggagctggtgctgaagaaggagccccagaaggacagctgtgtgacagattctgagcctgtggtgaatgtcatccccccatctgccaaccccatcaacatcgccatccccaccgtgacagcccagctgcccaccatcgtggccatcgctgaccagaacagcgtgccctgcctgcgggccctggccgccaacaagcagaccatcctgatcccccaggtggcctacacctacagcaccaccgtgtccccagctgtgcaggagccccccctgaaggtgatccagcccaatggaaaccaggatgagcggcaggacaccagcagcgagggcgtgtccaatgtggaggaccagaatgacagcgacagcaccccacccaagaagaagatgaggaagacagaaaatggcatgtatgcctgtgacctgtgtgacaagatcttccagaagagcagcagcctgctgcggcacaagtatgagcacacaggcaagaggcctcatgaatgtggcatctgcaagaaggccttcaagcacaagcaccacctgattgagcacatgaggctgcacagcggggagaagccctaccagtgtgacaagtgtgggaagcgcttcagccacagcggcagctacagccagcacatgaaccaccgctacagctactgcaagcgggaggccgaggagcgggacagcacagagcaggaggaggccggccctgagatcctgagcaatgaacatgtgggcgcccgggccagccccagccagggcgacagtgatgagcgggagagcctgacccgggaggaggatgaagattctgagaaggaggaggaggaggaggacaaggagatggaggagctgcaggaggagaaggaatgtgagaagccccagggagatgaggaggaggaggaggaggaggaggaggtggaggaggaggaggtggaggaggccgagaatgaaggagaggaggccaagacagagggcctgatgaaggatgacagagctgagagccaggccagcagcctgggccagaaggtgggggagagcagcgagcaggtgtctgaggagaagaccaatgaggcctag

SEQ ID NO: 22638 - DNA, 834 bp, Artificial Sequence
  Description of Artificial Sequence: Synthetic coding sequence
atgaaggtgaccaactacaacacagtggtggagaccaacagcgacagtgatgatgaggacaagctgcacatcgtggaggaggagagcgtgacagatgctgctgactgtgagggcgtgcctgaagatgacctgcccacagaccagacagtgctgcccggccgcagcagcgagcgggagggcaatgccaagaactgctgggaggatgacaccgggaaggagggccaggagatcctgggccctgaggcccaggctgatgaagctggctgcaccgtgaaggatgatgaatgtgagagtgatgctgaaaatgagcagaaccacgaccccaacgtggaggagttcctgcagcagcaggacacagctgtgatcttccctgaggcccctgaggaggaccagaggcagggcaccccagaggccagcggccatgatgaaaatggcaccccagatgccttcagccagctgctgacctgcccctactgtgaccggggctacaagcgcttcaccagcctgaaggagcacatcaagtacagacatgagaagaatgaagacaacttcagctgcagcctgtgcagctacacctttgcctaccgcacccagctggagcggcacatgaccagccacaagagcggccgggaccagagacatgtgacccagagcggctgcaacaggaagttcaagtgcacagaatgtgggaaggccttcaagtacaagcaccacctgaaggagcacctgcgcatccacagcggggagaagccctatgaatgtcccaactgcaagaagcgcttcagccacagcggcagctacagcagccacatcagcagcaagaagtgcatctag

SEQ ID NO: 22639 - DNA, 3315 bp, Artificial Sequence
  Description of Artificial Sequence: Synthetic coding sequence
atggctgatggcccccgctgcaagaggaggaagcaggccaaccccaggagaaataatgtgaccaactacaacacagtggtggagaccaacagcgacagtgatgatgaggacaagctgcacatcgtggaggaggagagcgtgacagatgctgctgactgtgaaggagtgcctgaagatgacctgcccacagaccagacagtgctgcccggccgcagcagcgagcgggagggcaatgccaagaactgctgggaggatgacatcaaggatgatgaatgtgagagtgatgctgaaaatgagcagaaccacgaccccaacgtggaggagttcctgcagcagcaggacacagctgtgatcttccctgaggcccctgaggaggaccagaggcagggcaccccagaggccagcggccatgatgaaaatggcaccccagatgccttcagccagctgctgacctgcccctactgtgaccggggctacaagcgcttcaccagcctgaaggagcacatcaagtacagacatgagaagaatgaagacaacttcagctgcagcctgtgcagctacacctttgcctaccgcacccagctggagcggcacatgaccagccacaagagcggccgggaccagagacatgtgacccagagcggctgcaacaggaagttcaagtgcacagaatgtgggaaggccttcaagtacaagcaccacctgaaggagcacctgcgcatccacagcggggagaagccctatgaatgtcccaactgcaagaagcgcttcagccacagcggcagctacagcagccacatcagcagcaagaagtgcatcagcctcatccctgtgaatggccggcccaggacaggcctgaagaccagccagtgcagcagccccagcctgagcgccagccctggcagccccacccggccccagatccggcagaagattgagaacaagcccctgcaggagcagctgtctgtgaaccagatcaagacagagcctgtggactatgagttcaagcccatcgtggtggccagcggcatcaactgcagcacccccctgcagaatggagtcttcaccggcggcggccccctgcaggccaccagcagcccccagggcatggtgcaggccgtggtgctgcccaccgtgggcctggtgagccccatcagcatcaacctgagtgacatccagaatgtgctgaaggtggccgtggatggaaatgtcatccggcaggtgctggagaacaaccaggccaacctggccagcaaggagcaggagaccatcaatgccagccccatccagcagggcggccacagcgtcatcagcgccatcagcctgcccctggtggaccaggacggcaccaccaagatcatcatcaactacagcctggagcagcccagccagctgcaggtggtgccccagaacctgaagaaggaaaatcctgtggccaccaacagctgcaagtctgagaagctgcctgaggacctgactgtgaagtctgagaaggacaagagctttgagggcggcgtgaatgacagcacctgcctgctgtgtgatgactgccctggggacatcaatgccctgcctgagctgaagcactatgacctgaagcagcccacccagcccccacccctgcctgctgctgaggccgagaagccagagagctctgtgtcctctgccactggagatggcaacctgagccccagccagccccccctgaagaacctgctgagcctgctgaaggcctactatgccctgaatgcccagcccagcgctgaggagctgagcaagattgctgacagcgtgaacctgcccctggatgtggtgaagaagtggtttgagaagatgcaggccggccagatctctgtgcagagcagcgagcccagcagccctgagcccgggaaggtgaacatcccagccaagaacaatgaccagccccagagcgccaatgccaatgagccccaggacagcacagtgaacctgcagagccccctgaagatgaccaacagccctgtgctgcctgtgggcagcaccaccaacggcagccgcagcagcacccccagccccagccccctgaacctgagcagcagcaggaacacccagggctacctgtacacagctgagggcgcccaggaggagccccaggtggagcccctggacctgagcctgcccaagcagcagggcgagctgctggagaggagcaccatcacctctgtgtaccagaacagcgtgtacagcgtgcaggaggagcccctgaacctgagctgtgccaagaaggagccccagaaggacagctgtgtgacagacagcgagcctgtggtgaatgtcatcccccccagcgccaaccccatcaacatcgccatccccaccgtgacagcccagctgcccaccatcgtggccatcgctgaccagaacagcgtgccctgcctgcgggccctggccgccaacaagcagaccatcctgatcccccaggtggcctacacctacagcaccaccgtgtccccagctgtgcaggagccccccctgaaggtgatccagcccaacggcaaccaggatgagcggcaggacaccagcagcgagggcgtgtccaatgtggaggaccagaatgacagcgacagcaccccacccaagaagaagatgaggaagacagaaaatggcatgtatgcctgtgacctgtgtgacaagatcttccagaagagcagcagcctgctgcggcacaagtatgagcacacaggcaagaggcctcatgaatgtggcatctgcaagaaggccttcaagcacaagcaccacctgattgagcacatgaggctgcacagcggggagaagccctaccagtgtgacaagtgtgggaagcgcttcagccacagcggcagctacagccagcacatgaaccaccgctacagctactgcaagcgggaggccgaggagcgggacagcacagagcaggaggaggccggccctgagatcctgagcaatgagcacgtgggcgcccgggccagccccagccagggcgacagtgatgagcgggagagcctgacccgggaggaggatgaggacagcgagaaggaggaggaggaggaggacaaggagatggaggagctgcaggaggagaaggaatgtgagaagccccagggagatgaggaggaggaggaggaggaggaggaggtggaggaggaggaggtggaggaggctgaaaatgaaggagaggaggccaagacagagggcctgatgaaggatgacagagctgagagccaggccagcagcctgggccagaaggtgggggagagcagcgagcaggtgtctgaggagaagaccaatgaggcctag

SEQ ID NO: 22640 - DNA, 3645 bp, Artificial Sequence
  Description of Artificial Sequence: Synthetic coding sequence
atgaagcagcccatcatggctgatggcccccgctgcaagaggaggaagcaggccaaccccaggaggaagaatgtggtgaactatgacaacgtggtggacaccggcagcgagacagatgaggaggacaagctgcacatcgccgaggatgatggcatcgccaaccccctggaccaggagaccagccctgcctctgtgcccaaccacgagagcagcccccacgtgtcccaggccctgctgccccgggaggaggaggaggatgagatccgggagggcggcgtggagcacccctggcacaacaatgagatcctgcaggcctctgtggatggccctgaggagatgaaggaggactatgacaccatgggccctgaggccaccatccagacagccatcaacaacggcaccgtgaagaatgccaactgcaccagtgactttgaggagtactttgccaagaggaagctggaggagagagatggccatgctgtgtccattgaggagtacctgcagaggagtgacacagccatcatctacccagaggcccctgaggagctgagccggctgggcaccccagaggccaacggccaggaggagaatgacctgcccccaggcaccccagatgcctttgcccagctgctgacctgcccctactgtgaccggggctacaagaggctgaccagcctgaaggagcacatcaagtacagacatgagaagaatgaggagaacttcagctgccccctgtgcagctacacctttgcctaccgcacccagctggagcggcacatggtgacccacaagccaggcacagaccagcaccagatgctgacccagggcgccggcaacaggaagttcaagtgcacagaatgtgggaaggccttcaagtacaagcaccacctgaaggagcacctgcgcatccacagcggggagaagccctatgaatgtcccaactgcaagaagcgcttcagccacagcggcagctacagcagccacatcagcagcaagaagtgcatcggcctcatctctgtgaatggaaggatgaggaacaacatcaagacaggcagcagccccaacagcgtgagcagcagccccaccaacagcgccatcacccagctgaggaacaagctggagaatggcaagcccctgtccatgtctgagcagacaggcctgctgaagatcaagacagagcccctggacttcaatgactacaaggtgctgatggccacccacggcttcagcggcaccagccccttcatgaatggaggcctgggcgccaccagccccctgggcgtgcaccccagcgcccagagccccatgcagcacctgggcgtgggcatggaggcccccctgctgggcttccccaccatgaacagcaacctgtctgaggtgcagaaggtgctgcagatcgtggacaacacagtgtcccggcagaagatggactgcaaggccgaggagatcagcaagctgaagggctaccacatgaaggacccctgcagccagcctgaggagcagggcgtgaccagccccaacatcccccctgtgggcctgcctgtggtgagccacaatggagccaccaagagcatcatcgactacaccctggagaaggtgaatgaggccaaggcctgcctgcagagcctgaccacagacagccggcggcagatcagcaacatcaagaaggagaagctgcggaccctgattgacctggtgacagatgacaagatgattgagaaccacaacatcagcacccccttcagctgccagttctgcaaggagagcttccctggccccatccccctgcaccagcacgagcgctacctgtgcaagatgaatgaggagatcaaggctgtgctgcagccccatgagaacatcgtgcccaacaaggccggcgtgtttgtggacaacaaggccctgctgctgagctctgtgctgtctgagaagggcatgaccagccccatcaacccctacaaggaccacatgtctgtgctgaaggcctactatgccatgaacatggagcccaacagtgatgagctgctgaagatcagcattgctgtgggcctgccccaggagtttgtgaaggagtggtttgagcagaggaaggtgtaccagtacagcaacagccgcagccccagcctggagaggagcagcaagcccctggcccccaacagcaacccccccaccaaggacagcctgctgcccaggagccctgtgaagcccatggacagcatcaccagccccagcattgctgagctgcacaacagcgtgaccaactgtgacccccccctgcggctgaccaagcccagccacttcaccaacatcaagcctgtggagaagctggaccacagccgcagcaacacccccagccccctgaacctgagcagcaccagcagcaagaacagccacagcagcagctacacccccaacagcttcagcagcgaggagctgcaggccgagcccctggacctgagcctgcccaagcagatgaaggagcccaagagcatcatcgccaccaagaacaagaccaaggccagcagcatcagcctggaccacaacagcgtgagcagcagcagcgagaacagtgatgagcccctgaacctgaccttcatcaagaaggagttcagcaacagcaacaacctggacaacaagagcaccaaccctgtgttctccatgaaccccttcagcgccaagcccctgtacacagccctgcccccccagagcgccttccccccagccaccttcatgcctcctgtgcagaccagcatccctggcctgcggccctacccaggcctggaccagatgtccttcctgccccacatggcctacacctaccccactggagctgccacctttgctgacatgcagcagaggaggaagtaccagaggaagcagggcttccagggcgagctgctggatggagcccaggactacatgagcggcctggatgacatgacagacagcgacagctgcctgagcaggaagaagatcaagaagacagagagcggcatgtatgcctgtgacctgtgtgacaagaccttccagaagagcagcagcctgctgcggcacaagtatgagcacacaggcaagaggccccaccagtgccagatctgcaagaaggccttcaagcacaagcaccacctgattgagcacagccggctgcacagcggggagaagccctaccagtgtgacaagtgtgggaagcgcttcagccacagcggcagctacagccagcacatgaaccaccgctacagctactgcaagcgggaggccgaggagcgggaggccgctgagcgggaggcccgggagaagggccacctggagcccacagagctgctgatgaacagagcctacctgcagagcatcaccccccagggctacagcgacagcgaggagcgggagagcatgcccagagatggagagagcgagaaggagcacgagaaggagggagaagatggctacggcaagctgggccggcaggatggagatgaggagtttgaggaggaggaggaggagagcgagaacaagtccatggacacagatcctgagaccatcagagatgaggaggagactggagaccacagcatggatgacagcagtgaagatggcaagatggagaccaagagtgaccacgaggaggacaacatggaggatggcatgtag

SEQ ID NO: 22641 - DNA, 1275 bp, Artificial Sequence
  Description of Artificial Sequence: Synthetic coding sequence
atggctgatggcccccgctgcaagaggaggaagcaggccaaccccaggaggaagaatgtggtgaactatgacaacgtggtggacaccggcagcgagacagatgaggaggacaagctgcacatcgcagaagatgatggcatcgccaaccccctggaccaggagaccagccctgcctctgtgcccaaccacgagagcagcccccacgtgtcccaggccctgctgccccgggaggaggaggaggatgagatccgggagggcggcgtggagcacccctggcacaacaatgagatcctgcaggcctctgtggatggccctgaggagatgaaggaggactatgacaccatgggccctgaggccaccatccagacagccatcaacaatggaacagtgaagaatgccaactgcaccagtgactttgaggagtactttgccaagaggaagctggaggagagagatggccatgctgtgtccattgaggagtacctgcagaggagtgacacagccatcatctacccagaggcccctgaggagctgagccggctgggcaccccagaggccaacggccaggaggagaatgacctgcccccaggcaccccagatgcctttgcccagctgctgacctgcccctactgtgaccggggctacaagaggctgaccagcctgaaggagcacatcaagtacagacatgagaagaatgaggagaacttcagctgccccctgtgcagctacacctttgcctaccgcacccagctggagcggcacatggtgacccacaagccaggcacagaccagcaccagatgctgacccagggcgccggcaacaggaagttcaagtgcacagaatgtgggaaggccttcaagtacaagcaccacctgaaggagcacctgcgcatccacagcggggagaagccctatgagtgccccaactgcaagaagcgcttcagccacagcggcagctacagcagccacatcagcagcaagaagtgcatcggcctcatctctgtgaatggccgcatgaggaacaacatcaagacaggcagcagccccaacagcgtgagcagcagccccaccaacagcgccatcacccagctgaggaacaagctggagaatggcaagcccctgtccatgtctgagcagacaggcctgctgaagagcggccgggcccagtggctgacccccctcatcccagccctgctggaggccgaggtgggccgcagccggggccagaagattgagaccctgctggccaacatggtggagccccggctgtactag

SEQ ID NO: 22642 - DNA, 1320 bp, Artificial Sequence
  Description of Artificial Sequence: Synthetic coding sequence
atgaagcagcccatcatggctgatggcccccgctgcaagaggaggaagcaggccaaccccaggaggaagaatgtggtgaactatgacaacgtggtggacaccggcagcgagacagatgaggaggacaagctgcacatcgccgaggatgatggcatcgccaaccccctggaccaggagaccagccctgcctctgtgcccaaccacgagagcagcccccacgtgtcccaggccctgctgccccgggaggaggaggaggatgagatccgggagggcggcgtggagcacccctggcacaacaatgagatcctgcaggcctctgtggatggccctgaggagatgaaggaggactatgacaccatgggccctgaggccaccatccagacagccatcaacaacggcaccgtgaagaatgccaactgcaccagtgactttgaggagtactttgccaagaggaagctggaggagagagatggccatgctgtgtccattgaggagtacctgcagaggagtgacacagccatcatctacccagaggcccctgaggagctgagccggctgggcaccccagaggccaacggccaggaggagaatgacctgcccccaggcaccccagatgcctttgcccagctgctgacctgcccctactgtgaccggggctacaagaggctgaccagcctgaaggagcacatcaagtacagacatgagaagaatgaggagaacttcagctgccccctgtgcagctacacctttgcctaccgcacccagctggagcggcacatggtgacccacaagccaggcacagaccagcaccagatgctgacccagggcgccggcaacaggaagttcaagtgcacagaatgtgggaaggccttcaagtacaagcaccacctgaaggagcacctgcgcatccacagcggggagaagccctatgaatgtcccaactgcaagaagcgcttcagccacagcggcagctacagcagccacatcagcagcaagaagtgcatcggcctcatctctgtgaatggaaggatgaggaacaacatcaagacaggcagcagccccaacagcgtgagcagcagccccaccaacagcgccatcacccagctgaggaacaagctggagaatggcaagcccctgtccatgtctgagcagacaggcctgctgaagatcaagacagagcccctggacttcaatgactacaaggtgctgatggccacccacggcttcagcggcaccagccccttcatgaatggaggcctgggcgccaccagccccctgggcgtgcaccccagcgcccagagccccatgcagcacctgtag

SEQ ID NO: 22643 - DNA, 408 bp, Artificial Sequence
  Description of Artificial Sequence: Synthetic coding sequence
atgaagcagcccatcatggctgatggcccccgctgcaagaggaggaagcaggccaaccccaggaggaagaatgtggtgaactatgacaacgtggtggacaccggcagcgagacagatgaggaggacaagctgcacatcgccgaggatgatggcatcgccaaccccctggaccaggagaccagccctgcctctgtgcccaaccacgagagcagcccccacgtgtcccaggccctgctgccccgggaggaggaggaggatgagatccgggagggcggcgtggagcacccctggcacaacaatgagatcctgcaggcctctgtggatggccctgaggagatgaaggaggactatgacaccatgggccctgaggccaccatccagacagccatcaacaacggcaccggctag

SEQ ID NO: 22644 - DNA, 3645 bp, Artificial Sequence; identical to SEQ ID NO: 22640
  Description of Artificial Sequence: Synthetic coding sequence

SEQ ID NO: 22645 - DNA, 2109 bp, Artificial Sequence
  Description of Artificial Sequence: Synthetic coding sequence
atgaagcagcccatcatggctgatggcccccgctgcaagaggaggaagcaggccaaccccaggaggaagaatgtggtgaactatgacaacgtggtggacaccggcagcgagacagatgaggaggacaagctgcacatcgccgaggatgatggcatcgccaaccccctggaccaggagaccagccctgcctctgtgcccaaccacgagagcagcccccacgtgtcccaggccctgctgccccgggaggaggaggaggatgagatccgggagggcggcgtggagcacccctggcacaacaatgagatcctgcaggcctctgtggatggccctgaggagatgaaggaggactatgacaccatgggccctgaggccaccatccagacagccatcaacaacggcaccgtgaagaatgccaactgcaccagtgactttgaggagtactttgccaagaggaagctggaggagagagatggccatgctgtgtccattgaggagtacctgcagaggagtgacacagccatcatctacccagaggcccctgaggagctgagccggctgggcaccccagaggccaacggccaggaggagaatgacctgcccccaggcaccccagatgcctttgcccagctgctgacctgcccctactgtgaccggggctacaagaggctgaccagcctgaaggagcacatcaagtacagacatgagaagaatgaggagaacttcagctgccccctgtgcagctacacctttgcctaccgcacccagctggagcggcacatggtgacccacaagccaggcacagaccagcaccagatgctgacccagggcgccggcaacaggaagttcaagtgcacagaatgtgggaaggccttcaagtacaagcaccacctgaaggagcacctgcgcatccacagcggggagaagccctatgaatgtcccaactgcaagaagcgcttcagccacagcggcagctacagcagccacatcagcagcaagaagtgcatcggcctcatctctgtgaatggaaggatgaggaacaacatcaagacaggcagcagccccaacagcgtgagcagcagccccaccaacagcgccatcacccagctgaggaacaagctggagaatggcaagcccctgtccatgtctgagcagacaggcctgctgaagatcaagacagagcccctggacttcaatgactacaaggtgctgatggccacccacggcttcagcggcaccagccccttcatgaatggaggcctgggcgccaccagccccctgggcgtgcaccccagcgcccagagccccatgcagcacctgggcgtgggcatggaggcccccctgctgggcttccccaccatgaacagcaacctgtctgaggtgcagaaggtgctgcagatcgtggacaacacagtgtcccggcagaagatggactgcaaggccgaggagatcagcaagctgaagggctaccacatgaaggacccctgcagccagcctgaggagcagggcgtgaccagccccaacatcccccctgtgggcctgcctgtggtgagccacaatggagccaccaagagcatcatcgactacaccctggagaaggtgaatgaggccaaggcctgcctgcagagcctgaccacagacagccggcggcagatcagcaacatcaagaaggagaagctgcggaccctgattgacctggtgacagatgacaagatgattgagaaccacaacatcagcacccccttcagctgccagttctgcaaggagagcttccctggccccatccccctgcaccagcacgagcgctacctgtgcaagatgaatgaggagatcaaggctgtgctgcagccccatgagaacatcgtgcccaacaaggccggcgtgtttgtggacaacaaggccctgctgctgagctctgtgctgtctgagaagggcatgaccagccccatcaacccctacaaggaccacatgtctgtgctgaaggcctactatgccatgaacatggagcccaacagtgatgagctgctgaagatcagcattgctgtgggcctgccccaggagtttgtgaaggagtggtttgagcagaggaaggtgtaccagtacagcaactag

SEQ ID NO: 22646 - DNA, 276 bp, Artificial Sequence
  Description of Artificial Sequence: Synthetic coding sequence
atgaagcagcccatcatggctgatggcccccgctgcaagaggaggaagcaggccaaccccaggaggaagaatgtggtgaactatgacaacgtggtggacaccggcagcgagacagatgaggaggacaagctgcacatcgccgaggatgatggcatcgccaaccccctggaccaggagaccagccctgcctctgtgcccaaccacgagagcagcccccacgtgtcccaggccctgctgccccgggaggaggaggaggatgagatccgggagggctag

SEQ ID NO: 22647 - DNA, 192 bp, Artificial Sequence
  Description of Artificial Sequence: Synthetic coding sequence
atgaagcagcccatcatggctgatggcccccgctgcaagaggaggaagcaggccaaccccaggaggaagaatgtggtgaactatgacaacgtggtggacaccggcagcgagacagatgaggaggacaagctgcacatcgccgaggatgatggcatcgccaaccccctggaccaggagaccagccctgcctag

SEQ ID NO: 22648 - DNA, 3573 bp, Artificial Sequence
  Description of Artificial Sequence: Synthetic coding sequence
atgaagcagcccatcatggctgatggcccccgctgcaagaggaggaagcaggccaaccccaggaggaagaatgtggtgaactatgacaacgtggtggacaccggcagcgagacagatgaggaggacaagctgcacatcgccgaggatgatggcatcgccaaccccctggaccaggagaccagccctgcctctgtgcccaaccacgagagcagcccccacgtgtcccaggccctgctgccccgggaggaggaggaggatgagatccgggagggcggcgtggagcacccctggcacaacaatgagatcctgcaggcctctgtggatggccctgtgaagaatgccaactgcaccagtgactttgaggagtactttgccaagaggaagctggaggagagagatggccatgctgtgtccattgaggagtacctgcagaggagtgacacagccatcatctacccagaggcccctgaggagctgagccggctgggcaccccagaggccaacggccaggaggagaatgacctgcccccaggcaccccagatgcctttgcccagctgctgacctgcccctactgtgaccggggctacaagaggctgaccagcctgaaggagcacatcaagtacagacatgagaagaatgaggagaacttcagctgccccctgtgcagctacacctttgcctaccgcacccagctggagcggcacatggtgacccacaagccaggcacagaccagcaccagatgctgacccagggcgccggcaacaggaagttcaagtgcacagaatgtgggaaggccttcaagtacaagcaccacctgaaggagcacctgcgcatccacagcggggagaagccctatgaatgtcccaactgcaagaagcgcttcagccacagcggcagctacagcagccacatcagcagcaagaagtgcatcggcctcatctctgtgaatggaaggatgaggaacaacatcaagacaggcagcagccccaacagcgtgagcagcagccccaccaacagcgccatcacccagctgaggaacaagctggagaatggcaagcccctgtccatgtctgagcagacaggcctgctgaagatcaagacagagcccctggacttcaatgactacaaggtgctgatggccacccacggcttcagcggcaccagccccttcatgaatggaggcctgggcgccaccagccccctgggcgtgcaccccagcgcccagagccccatgcagcacctgggcgtgggcatggaggcccccctgctgggcttccccaccatgaacagcaacctgtctgaggtgcagaaggtgctgcagatcgtggacaacacagtgtcccggcagaagatggactgcaaggccgaggagatcagcaagctgaagggctaccacatgaaggacccctgcagccagcctgaggagcagggcgtgaccagccccaacatcccccctgtgggcctgcctgtggtgagccacaatggagccaccaagagcatcatcgactacaccctggagaaggtgaatgaggccaaggcctgcctgcagagcctgaccacagacagccggcggcagatcagcaacatcaagaaggagaagctgcggaccctgattgacctggtgacagatgacaagatgattgagaaccacaacatcagcacccccttcagctgccagttctgcaaggagagcttccctggccccatccccctgcaccagcacgagcgctacctgtgcaagatgaatgaggagatcaaggctgtgctgcagccccatgagaacatcgtgcccaacaaggccggcgtgtttgtggacaacaaggccctgctgctgagctctgtgctgtctgagaagggcatgaccagccccatcaacccctacaaggaccacatgtctgtgctgaaggcctactatgccatgaacatggagcccaacagtgatgagctgctgaagatcagcattgctgtgggcctgccccaggagtttgtgaaggagtggtttgagcagaggaaggtgtaccagtacagcaacagccgcagccccagcctggagaggagcagcaagcccctggcccccaacagcaacccccccaccaaggacagcctgctgcccaggagccctgtgaagcccatggacagcatcaccagccccagcattgctgagctgcacaacagcgtgaccaactgtgacccccccctgcggctgaccaagcccagccacttcaccaacatcaagcctgtggagaagctggaccacagccgcagcaacacccccagccccctgaacctgagcagcaccagcagcaagaacagccacagcagcagctacacccccaacagcttcagcagcgaggagctgcaggccgagcccctggacctgagcctgcccaagcagatgaaggagcccaagagcatcatcgccaccaagaacaagaccaaggccagcagcatcagcctggaccacaacagcgtgagcagcagcagcgagaacagtgatgagcccctgaacctgaccttcatcaagaaggagttcagcaacagcaacaacctggacaacaagagcaccaaccctgtgttctccatgaaccccttcagcgccaagcccctgtacacagccctgcccccccagagcgccttccccccagccaccttcatgcctcctgtgcagaccagcatccctggcctgcggccctacccaggcctggaccagatgtccttcctgccccacatggcctacacctaccccactggagctgccacctttgctgacatgcagcagaggaggaagtaccagaggaagcagggcttccagggcgagctgctggatggagcccaggactacatgagcggcctggatgacatgacagacagcgacagctgcctgagcaggaagaagatcaagaagacagagagcggcatgtatgcctgtgacctgtgtgacaagaccttccagaagagcagcagcctgctgcggcacaagtatgagcacacaggcaagaggccccaccagtgccagatctgcaagaaggccttcaagcacaagcaccacctgattgagcacagccggctgcacagcggggagaagccctaccagtgtgacaagtgtgggaagcgcttcagccacagcggcagctacagccagcacatgaaccaccgctacagctactgcaagcgggaggccgaggagcgggaggccgctgagcgggaggcccgggagaagggccacctggagcccacagagctgctgatgaacagagcctacctgcagagcatcaccccccagggctacagcgacagcgaggagcgggagagcatgcccagagatggagagagcgagaaggagcacgagaaggagggagaagatggctacggcaagctgggccggcaggatggagatgaggagtttgaggaggaggaggaggagagcgagaacaagtccatggacacagatcctgagaccatcagagatgaggaggagactggagaccacagcatggatgacagcagtgaagatggcaagatggagaccaagagtgaccacgaggaggacaacatggaggatggcatgtag

SEQ ID NO: 22649 - DNA, 3645 bp, Artificial Sequence; identical to SEQ ID NO: 22640
  Description of Artificial Sequence: Synthetic coding sequence

SEQ ID NO: 22650 - DNA, 1893 bp, Artificial Sequence
  Description of Artificial Sequence: Synthetic coding sequence
atgagcatcagcgccctgggcggccgcaccaagggcaagcccctgcccccaggagaggaggagaggaacaacgtgctgaagcagatgaaggtgaggaccaccctgaagggggacaagtcctggatcaccaagcaggatgagagcgagggccgcaccatcgagctgcccagcggccgcagccgggccaccagcttcagcagcgctggggaggtgcccaagccccggccccccagcacccgggcccccaccggctacatcatccggggcgtcttcaccaagcccatcgacagcagcagccagccccagcagcagttccccaaggccaacggcacccccaagtctgctgccagcctggtgaggacagccaatgccggccccccccggcccagcagcagcggctacaagatgaccacagaggactacaagaagctggccccctacaacatccgccgcagcagcaccagcggggacacagaggaggaggaggaggaggaggtggtgcccttcagcagtgatgagcagaagagaagaagtgaggccgccagcggcgtgctgcggaggacagccccccgggagcacagctatgtgctgtctgctgccaagaagagcacaggccccacccaggagacccaggcccccttcatcgccaagagggtggaggtggtggaggaggatggccccagcgagaagagccaggaccccccagccctggcccggagcaccccaggcagcaacagaagcagccctggcaacaaggacaaggaggccccctgcagccgggagctgcagagggacctggccggggaggaggccttccgggcccccaacacagatgctgcccggagcagcgcccagctgagtgatggaaatgtgggcagcggggccaccggcagcaggcctgagggcctggccgctgtggacatcggcagcgagcggggcagcagcagcgccacctctgtgtctgctgtgcctgctgacaggaagagcaacagcacagctgcccaggaggatgccaaggctgaccccaagggggccctggccgactatgagggcaaggatgtggccaccagggtgggggaggcctggcaggagaggcctggggccccccggggcggccagggcgaccctgctgtgcctgcccagcagcctgctgaccccagcaccccagagcggcagagcagccccagcggcagcgagcagctggtgagaagagagagctgtggcagctctgtgctgacagactttgagggcaaggatgtggccaccaaggtgggggaggcctggcaggacaggcctggggccccccggggcggccagggcgaccctgctgtgcccacccagcagcctgctgaccccagcaccccagagcagcagaacagccccagcggcagcgagcagtttgtgagaagagagagctgcaccagccgggtgcgcagccccagcagctgcatggtgacagtgacagtgacagccaccagcgagcagccccacatctacatcccagccccagccagcgagctggacagcagcagcaccaccaagggcatcctgtttgtgaaggagtatgtgaatgccagcgaggtgagcagcggcaagcctgtgtctgcccgctacagcaatgtgagcagcattgaagattcttttgccatggagaagaagccaccctgtggcagcaccccctacagcgagaggaccaccggcggcatctgcacctactgcaaccgggagatccgggactgccccaagatcaccctggagcacctgggcatctgctgccacgagtactgcttcaagtgtggcatctgcagcaagcccatgggagacctgctggaccagatcttcatccaccgggacaccatccactgtgggaagtgctatgagaagctgttctag

SEQ ID NO: 22651 - DNA, 1407 bp, Artificial Sequence
  Description of Artificial Sequence: Synthetic coding sequence
atgaccacagaggactacaagaagctggccccctacaacatcagaagaagcagcaccagcggggacacagaggaggaggaggaggaggaggtggtgcccttcagcagtgatgagcagaagaggagcagccccacccaggagacccaggcccccttcatcgccaagagggtggaggtggtggaggaggatggccccagcgagaagagccaggaccccccagccctggcccggagcaccccaggcagcaacagaagcagccctggcaacaaggacaaggaggccccctgcagccgggagctgcagagggacctggccggggaggaggccttccgggcccccaacacagatgctgcccggagcagcgcccagctgagtgatggaaatgtgggcagcggggccaccggcagcaggcctgagggcctggccgctgtggacatcggcagcgagcggggcagcagcagcgccacctctgtgtctgctgtgcctgctgacaggaagagcaacagcacagctgcccaggaggatgccaaggctgaccccaagggggccctggccgactatgagggcaaggatgtggccaccagggtgggggaggcctggcaggagaggcctggggccccccggggcggccagggcgaccctgctgtgcctgcccagcagcctgctgaccccagcaccccagagcggcagagcagccccagcggcagcgagcagctggtgagaagagagagctgtggcagctctgtgctgacagactttgagggcaaggatgtggccaccaaggtgggggaggcctggcaggacaggcctggggccccccggggcggccagggcgaccctgctgtgcccacccagcagcctgctgaccccagcaccccagagcagcagaacagccccagcggcagcgagcagtttgtgagaagagagagctgcaccagccgggtgcgcagccccagcagctgcatggtgacagtgacagtgacagccaccagcgagcagccccacatctacatcccagccccagccagcgagctggacagcagcagcaccaccaagggcatcctgtttgtgaaggagtatgtgaatgccagcgaggtgagcagcggcaagcctgtgtctgcccgctacagcaatgtgagcagcattgaagattcttttgccatggagaagaagccaccctgtggcagcaccccctacagcgagaggaccaccggcggcatctgcacctactgcaaccgggagatccgggactgccccaagatcaccctggagcacctgggcatctgctgccacgagtactgcttcaagtgtggcatctgcagcaagcccatgggagacctgctggaccagatcttcatccaccgggacaccatccactgtgggaagtgctatgagaagctgttctag

SEQ ID NO: 22652 - DNA, 1374 bp, Artificial Sequence
  Description of Artificial Sequence: Synthetic coding sequence
atgaccacagaggactacaagaagctggccccctacaacatcagaagaagcagcaccagcggggacacagaggaggaggaggaggaggaggtggtgcccttcagcagtgatgagcagaagagaagaagtgaagctgccagcggcgtgctgcggaggacagccccccgggagcacagctatgtgctgtctgctgccaagaagagcacaggcagccccacccaggagacccaggcccccttcatcgccaagagggtggaggtggtggaggaggatggccccagcgagaagagccaggaccccccagccctggcccggagcaccccaggcagcaacagcagcagaggagaggagatcgtgcggctgcagatcctgaccccccgggccggcctgcggctggtggccccagatgtggagggcatgagcagcagcgccacctctgtgtctgctgtgcctgctgacaggaagagcaacagcacagctgcccaggaggatgccaaggctgaccccaagggggccctggccgactatgagggcaaggatgtggccaccagggtgggggaggcctggcaggagaggcctggggccccccggggcggccagggcgaccctgctgtgcctgcccagcagcctgctgaccccagcaccccagagcggcagagcagccccagcggcagcgagcagctggtgcggcgggagagctgtggcagctctgtgctgacagactttgagggcaaggatgtggccaccaaggtgggggaggcctggcaggacaggcctggggccccccggggcggccagggcgaccctgctgtgcccacccagcagcctgctgaccccagcaccccagagcagcagaacagccccagcggcagcgagcagtttgtgcggcgggagagctgcaccagccgggtgcgcagccccagcagctgcatggtgacagtgacagtgacagccaccagcgagcagccccacatctacatcccagccccagccagcgagctggacagcagcagcaccaccaagggcatcctgtttgtgaaggagtatgtgaatgccagcgaggtgtcctctgggaagcctgtgtctgcccgctacagcaatgtgagcagcattgaggacagctttgccatggagaagaagccaccctgtggcagcaccccctacagcgagaggaccactggaggcatctgcacctactgcaaccgggagatccgggactgccccaagatcaccctggagcacctgggcatctgctgccacgagtactgcttcaagtgtggcatctgcagcaagcccatgggagacctgctggaccagatcttcatccaccgggacaccatccactgtgggaaatgttatgagaagctgttctag

SEQ ID NO: 22653 - DNA, 2070 bp, Artificial Sequence
  Description of Artificial Sequence: Synthetic coding sequence
atgagcatcagcgccctgggcggccgcaccaagggcaagcccctgcccccaggagaggaggagaggaacaacgtgctgaagcagatgaaggtgaggaccaccctgaagggggacaagtcctggatcaccaagcaggatgagagcgagggccgcaccatcgagctgcccagcggccgcagccgggccaccagcttcagcagcgctggggaggtgcccaagccccggccccccagcacccgggcccccaccggctacatcatccggggcgtcttcaccaagcccatcgacagcagcagccagccccagcagcagttccccaaggccaacggcacccccaagtctgctgccagcctggtgaggacagccaatgccggccccccccggcccagcagcagcggctacaagatgaccacagaggactacaagaagctggccccctacaacatccgccgcagcagcaccagcggggacacagaggaggaggaggaggaggaggtggtgcccttcagcagtgatgagcagaagagaagaagtgaggccgccagcggcgtgctgcggaggacagccccccgggagcacagctatgtgctgtctgctgccaagaagagcacaggccccacccaggagacccaggcccccttcatcgccaagagggtggaggtggtggaggaggatggccccagcgagaagagccaggaccccccagccctggcccggagcaccccaggcagcaacagcgcagatggcggccgcaccaaggccagccgggccatctggattgaatgtctgcccagcatgcccagccctgctggcagccaggagctgagcagcagaggagaggagatcgtgcggctgcagatcctgaccccccgggccggcctgcggctggtggccccagatgtggagggcatgaggagcagccctggcaacaaggacaaggaggccccctgcagccgggagctgcagagggacctggccggggaggaggccttccgggcccccaacacagatgctgcccggagcagcgcccagctgagtgatggaaatgtgggcagcggggccaccggcagcaggcctgagggcctggccgctgtggacatcggcagcgagcggggcagcagcagcgccacctctgtgtctgctgtgcctgctgacaggaagagcaacagcacagctgcccaggaggatgccaaggctgaccccaagggggccctggccgactatgagggcaaggatgtggccaccagggtgggggaggcctggcaggagaggcctggggccccccggggcggccagggcgaccctgctgtgcctgcccagcagcctgctgaccccagcaccccagagcggcagagcagccccagcggcagcgagcagctggtgcggcgggagagctgtggcagctctgtgctgacagactttgagggcaaggatgtggccaccaaggtgggggaggcctggcaggacaggcctggggccccccggggcggccagggcgaccctgctgtgcccacccagcagcctgctgaccccagcaccccagagcagcagaacagccccagcggcagcgagcagtttgtgcggcgggagagctgcaccagccgggtgcgcagccccagcagctgcatggtgacagtgacagtgacagccaccagcgagcagccccacatctacatcccagccccagccagcgagctggacagcagcagcaccaccaagggcatcctgtttgtgaaggagtatgtgaatgccagcgaggtgtcctctgggaagcctgtgtctgcccgctacagcaatgtgagcagcattgaggacagctttgccatggagaagaagccaccctgtggcagcaccccctacagcgagaggaccactggaggcatctgcacctactgcaaccgggagatccgggactgccccaagatcaccctggagcacctgggcatctgctgccacgagtactgcttcaagtgtggcatctgcagcaagcccatgggagacctgctggaccagatcttcatccaccgggacaccatccactgtgggaaatgttatgagaagctgttctag

SEQ ID NO: 22654 - DNA, 1359 bp, Artificial Sequence
  Description of Artificial Sequence: Synthetic coding sequence
atgcagaggcaggccccctacaacatccgccgcagcagcaccagcggggacacagaggaggaggaggaggaggaggtggtgcccttcagcagtgatgagcagaagagaagaagtgaggccgccagcggcgtgctgcggaggacagccccccgggagcacagctatgtgctgtctgctgccaagaagagcacaggcagccccacccaggagacccaggcccccttcatcgccaagagggtggaggtggtggaggaggatggccccagcgagaagagccaggaccccccagccctggcccggagcaccccaggcagcaacagcagcagaggagaggagatcgtgcggctgcagatcctgacccccagggctggcctgcggctggtggccccagatgtggagggcatgagcagcagcgccacctctgtgtctgctgtgcctgctgacaggaagagcaacagcacagctgcccaggaggatgccaaggctgaccccaagggggccctggccgactatgagggcaaggatgtggccaccagggtgggggaggcctggcaggagaggcctggggccccccggggcggccagggcgaccctgctgtgcctgcccagcagcctgctgaccccagcaccccagagcggcagagcagccccagcggcagcgagcagctggtgagaagagagagctgtggcagctctgtgctgacagactttgagggcaaggatgtggccaccaaggtgggggaggcctggcaggacaggcctggggccccccggggcggccagggcgaccctgctgtgcccacccagcagcctgctgaccccagcaccccagagcagcagaacagccccagcggcagcgagcagtttgtgagaagagagagctgcaccagccgggtgcgcagccccagcagctgcatggtgacagtgacagtgacagccaccagcgagcagccccacatctacatcccagccccagccagcgagctggacagcagcagcaccaccaagggcatcctgtttgtgaaggagtatgtgaatgccagcgaggtgagcagcggcaagcctgtgtctgcccgctacagcaatgtgagcagcattgaagattcttttgccatggagaagaagccaccctgtggcagcaccccctacagcgagaggaccaccggcggcatctgcacctactgcaaccgggagatccgggactgccccaagatcaccctggagcacctgggcatctgctgccacgagtactgcttcaagtgtggcatctgcagcaagcccatgggagacctgctggaccagatcttcatccaccgggacaccatccactgtgggaagtgctatgagaagctgttctag

SEQ ID NO: 22655 - DNA, 1428 bp, Artificial Sequence
  Description of Artificial Sequence: Synthetic coding sequence
tgaagaagcagcaccagcggggacacagaggaggaggaggaggaggaggtggtgcccttcagcagtgatgagcagaagaggagcctgcggaggacagccccccgggagcacagctatgtgctgtctgctgccaagaagagcacaggcagccccacccaggagacccaggcccccttcatcgccaagagggtggaggtggtggaggaggatggccccagcgagaagagccaggaccccccagccctggcccggagcaccccaggcagcaacagaagcagccctggcaacaaggacaaggaggccccctgcagccgggagctgcagagggacctggccggggaggaggccttccgggcccccaacacagatgctgcccggagcagcgcccagctgagtgatggaaatgtgggcagcggggccaccggcagcaggcctgagggcctggccgctgtggacatcggcagcgagcggggcagcagcagcgccacctctgtgtctgctgtgcctgctgacaggaagagcaacagcacagctgcccaggaggatgccaaggctgaccccaagggggccctggccgactatgagggcaaggatgtggccaccagggtgggggaggcctggcaggagaggcctggggccccccggggcggccagggcgaccctgctgtgcctgcccagcagcctgctgaccccagcaccccagagcggcagagcagccccagcggcagcgagcagctggtgcggcgggagagctgtggcagctctgtgctgacagactttgagggcaaggatgtggccaccaaggtgggggaggcctggcaggacaggcctggggccccccggggcggccagggcgaccctgctgtgcccacccagcagcctgctgaccccagcaccccagagcagcagaacagccccagcggcagcgagcagtttgtgcggcgggagagctgcaccagccgggtgcgcagccccagcagctgcatggtgacagtgacagtgacagccaccagcgagcagccccacatctacatcccagccccagccagcgagctggacagcagcagcaccaccaagggcatcctgtttgtgaaggagtatgtgaatgccagcgaggtgtcctctgggaagcctgtgtctgcccgctacagcaatgtgagcagcattgaggacagctttgccatggagaagaagccaccctgtggcagcaccccctacagcgagaggaccactggaggcatctgcacctactgcaaccgggagatccgggactgccccaagatcaccctggagcacctgggcatctgctgccacgagtactgcttcaagtgtggcatctgcagcaagcccatgggagacctgctggaccagatcttcatccaccgggacaccatccactgtgggaaatgttatgagaagctgttctag

SEQ ID NO: 22656 - DNA, 1146 bp, Artificial Sequence
  Description of Artificial Sequence: Synthetic coding sequence
atgaccacagaggactacaagaagctggccccctacaacatcagaagaagcagcaccagcggggacacagaggaggaggaggaggaggaggtggtgcccttcagcagtgatgagcagaagagaagaagtgaagctgccagcggcgtgctgcggaggacagccccccgggagcacagctatgtgctgtctgctgccaagaagagcacaggcagccccacccaggagacccaggcccccttcatcgccaagagggtggaggtggtggaggaggatggccccagcgagaagagccaggaccccccagccctggcccggagcaccccaggcagcaacagcgcagatggcggccgcaccaaggccagccgggccatctggattgaatgtctgcccagcatgcccagccctgctggcagccaggagctgagcagcagaggagaggagatcgtgcggctgcagatcctgaccccccgggccggcctgcggctggtggccccagatgtggagggcatgaggagcagccctggcaacaaggacaaggaggccccctgcagccgggagctgcagagggacctggccggggaggaggccttccgggcccccaacacagatgctgcccggagcagcgcccagctgagtgatggaaatgtgggcagcggggccaccggcagcaggcctgagggcctggccgctgtggacatcggcagcgagcggggcagcagcagcgccacctctgtgtctgctgtgcctgctgacaggaagagcaacagcacagctgcccaggaggatgccaaggctgaccccaagggggccctggccgactatgagggcaaggatgtggccaccagggtgggggaggcctggcaggagaggcctggggccccccggggcggccagggcgaccctgctgtgcctgcccagcagcctgctgaccccagcaccccagagcggcagagcagccccagcggcagcgagcagctggtgcggcgggagagctgtggcagctctgtgctgacagactttgagggcaaggatgtggccaccaaggtgggggaggcctggcaggacaggcctggccccagctgcacccacagcgccacctgccgcagccagtaccccaggacagctgagcagccccagaggatctag

SEQ ID NO: 22657 - DNA, 636 bp, Artificial Sequence
  Description of Artificial Sequence: Synthetic coding sequence
gaggaggccttccgggcccccaacacagatgctgcccggagcagcgcccagctgagtgatggaaatgtgggcagcggggccaccggcagcaggcctgagggcctggccgctgtggacatcggcagcgagcggggccgcctgtgtgccgccgccagctttgccagcttcctggaggaccaggacggccacagcgccaacagccagagctgcaagcccaggcctgctgccatcagcagcagcgccacctctgtgtctgctgtgcctgctgacaggaagagcaacagcacagctgcccaggaggatgccaaggctgaccccaagggggccctggccgactatgagggcaaggatgtggccaccagggtgggggaggcctggcaggagaggcctggggccccccggggcggccagggcgaccctgctgtgcctgcccagcagcctgctgaccccagcaccccagagcggcagagcagccccagcggcagcgagcagctggtgagaagagagagctgtggcagctctgtgctgacagactttgagggcaaggatgtggccaccaaggtgggggaggcctggcaggacaggcctggggccccccggggcggccagggcgaccctgctgtgcccacccagtag

SEQ ID NO: 22658 - DNA, 666 bp, Artificial Sequence
  Description of Artificial Sequence: Synthetic coding sequence
tgactgcggaggacagccccccgggagcacagctatgtgctgtctgctgccaagaagagcacaggcagccccacccaggagacccaggcccccttcatcgccaagagggtggaggtggtggaggaggatggccccagcgagaagagccaggaccccccagccctggcccggagcaccccaggcagcaacagcgcagatggcggccgcaccaaggccagccgggccatctggattgaatgtctgcccagcatgcccagccctgctggcagccaggagctgagcagcagaggagaggagatcgtgcggctgcagatcctgaccccccgggccggcctgcggctggtggccccagatgtggagggcatgaggagcagccctggcaacaaggacaaggaggccccctgcagccgggagctgcagagggacctggccggggaggaggccttccgggcccccaacacagatgctgcccggagcagcgcccagctgagtgatggaaatgtgggcagcggggccaccggcagcaggcctgagggcctggccgctgtggacatcggcagcgagcggggcagcagcagcgccacctctgtgtctgctgtgcctgctgacaggaagagcaacagcacagctgcccaggaggatgccaaggctgaccccaagggctag

SEQ ID NO: 22659 - DNA, 414 bp, Artificial Sequence
  Description of Artificial Sequence: Synthetic coding sequence
tgagtgctgcccaggaggcaccgccaccggctgagcagaagaggctggcgctggtggaagaggacaggcctgctgcggcgggcccggacccacctgctgtggcaggaccccctgctggcccagacagtgaggatggaggccggccccaagaggctgggccagtttggcagcagcgcctgccaggtgtgcctggcccccctgggcgcccggagcagcggcctgccccaggccaccaagacccggcggcccccagcccctgagagcagccggggcacctggctggtgcggcggctgagcggcccccccacccagatgctgcaggcccctgtgcccctgcagagcctgctgagcctgctgattggccgggccacagcccagcagcccaggaggatgcagaggcagacccagaggtag

SEQ ID NO: 22660 - DNA, 2073 bp, Artificial Sequence
  Description of Artificial Sequence: Synthetic coding sequence
atgagcatcagcgccctgggcggccgcaccaagggcaagcccctgcccccaggagaggaggagaggaacaacgtgctgaagcagatgaaggtgaggaccaccctgaagggggacaagtcctggatcaccaagcaggatgagagcgagggccgcaccatcgagctgcccagcggccgcagccgggccaccagcttcagcagcgctggggaggtgcccaagccccggccccccagcacccgggcccccaccggctacatcatccggggcgtcttcaccaagcccatcgacagcagcagccagccccagcagcagttccccaaggccaacggcacccccaagtctgctgccagcctggtgaggacagccaatgccggccccccccggcccagcagcagcggctacaagatgaccacagaggactacaagaagctggccccctacaacatccgccgcagcagcaccagcggggacacagaggaggaggaggaggaggaggtggtgcccttcagcagtgatgagcagaagagaagaagtgaggccgccagcggcgtgctgcggaggacagccccccgggagcacagctatgtgctgtctgctgccaagaagagcacaggcagccccacccaggagacccaggcccccttcatcgccaagagggtggaggtggtggaggaggatggccccagcgagaagagccaggaccccccagccctggcccggagcaccccaggcagcaacagcgcagatggcggccgcaccaaggccagccgggccatctggattgagtgcctgcccagcatgcccagccctgctggcagccaggagctgagcagcagaggagaggagatcgtgcggctgcagatcctgacccccagggctggcctgcggctggtggccccagatgtggagggcatgaggagcagccctggcaacaaggacaaggaggccccctgcagccgggagctgcagagggacctggccggggaggaggccttccgggcccccaacacagatgctgcccggagcagcgcccagctgagtgatggaaatgtgggcagcggggccaccggcagcaggcctgagggcctggccgctgtggacatcggcagcgagcggggcagcagcagcgccacctctgtgtctgctgtgcctgctgacaggaagagcaacagcacagctgcccaggaggatgccaaggctgaccccaagggggccctggccgactatgagggcaaggatgtggccaccagggtgggggaggcctggcaggagaggcctggggccccccggggcggccagggcgaccctgctgtgcctgcccagcagcctgctgaccccagcaccccagagcggcagagcagccccagcggcagcgagcagctggtgagaagagagagctgtggcagctctgtgctgacagactttgagggcaaggatgtggccaccaaggtgggggaggcctggcaggacaggcctggggccccccggggcggccagggcgaccctgctgtgcccacccagcagcctgctgaccccagcaccccagagcagcagaacagccccagcggcagcgagcagtttgtgagaagagagagctgcaccagccgggtgcgcagccccagcagctgcatggtgacagtgacagtgacagccaccagcgagcagccccacatctacatcccagccccagccagcgagctggacagcagcagcaccaccaagggcatcctgtttgtgaaggagtatgtgaatgccagcgaggtgagcagcggcaagcctgtgtctgcccgctacagcaatgtgagcagcattgaagattcttttgccatggagaagaagccaccctgtggcagcaccccctacagcgagaggaccaccggcggcatctgcacctactgcaaccgggagatccgggactgccccaagatcaccctggagcacctgggcatctgctgccacgagtactgcttcaagtgtggcatctgcagcaagcccatgggagacctgctggaccagatcttcatccaccgggacaccatccactgtgggaagtgctatgagaagctgttctag

SEQ ID NO: 22661 - DNA, 993 bp, Artificial Sequence
  Description of Artificial Sequence: Synthetic coding sequence
tgaagtgagatggccgccagagatgagctgggcctgggcggggacagcctggaggccatgcctgtgcctgctgcccggggccggccccgcatcaccaatggacctgaggagctggccgcccccagccctgctgccctggccgactatgagggcaaggatgtggccaccagggtgggggaggcctggcaggagaggcctggggccccccggggcggccagggcgaccctgctgtgcctgcccagcagcctgctgaccccagcaccccagagcggcagagcagccccagcggcagcgagcagctggtgagaagagagagctgtggcagctctgtgctgacagactttgagggcaaggatgtggccaccaaggtgggggaggcctggcaggacaggcctggggccccccggggcggccagggcgaccctgctgtgcccacccagcagcctgctgaccccagcaccccagagcagcagaacagccccagcggcagcgagcagtttgtgagaagagagagctgcaccagccgggtgcgcagccccagcagctgcatggtgacagtgacagtgacagccaccagcgagcagccccacatctacatcccagccccagccagcgagctggacagcagcagcaccaccaagggcatcctgtttgtgaaggagtatgtgaatgccagcgaggtgagcagcggcaagcctgtgtctgcccgctacagcaatgtgagcagcattgaagattcttttgccatggagaagaagccaccctgtggcagcaccccctacagcgagaggaccaccggcggcatctgcacctactgcaaccgggagatccgggactgccccaagatcaccctggagcacctgggcatctgctgccacgagtactgcttcaagtgtggcatctgcagcaagcccatgggagacctgctggaccagatcttcatccaccgggacaccatccactgtgggaagtgctatgagaagctgttctag

SEQ ID NO: 22662 - DNA, 1575 bp, Artificial Sequence
  Description of Artificial Sequence: Synthetic coding sequence
atgaccacagaggactacaagaagctggccccctacaacatcagaagaagcagcaccagcggggacacagaggaggaggaggaggaggaggtggtgcccttcagcagtgatgagcagaagagaagaagtgaagctgccagcggcgtgctgcggaggacagccccccgggagcacagctatgtgctgtctgctgccaagaagagcacaggccccacccaggagacccaggcccccttcatcgccaagagggtggaggtggtggaggaggatggccccagcgagaagagccaggaccccccagccctggcccggagcaccccaggcagcaacagcagcagaggagaggagatcgtgcggctgcagatcctgacccccagggctggcctgcggctggtggccccagatgtggagggcatgaggagcagccctggcaacaaggacaaggaggccccctgcagccgggagctgcagagggacctggccggggaggaggccttccgggcccccaacacagatgctgcccggagcagcgcccagctgagtgatggaaatgtgggcagcggggccaccggcagcaggcctgagggcctggccgctgtggacatcggcagcgagcggggcagcagcagcgccacctctgtgtctgctgtgcctgctgacaggaagagcaacagcacagctgcccaggaggatgccaaggctgaccccaagggggccctggccgactatgagggcaaggatgtggccaccagggtgggggaggcctggcaggagaggcctggggccccccggggcggccagggcgaccctgctgtgcctgcccagcagcctgctgaccccagcaccccagagcggcagagcagccccagcggcagcgagcagctggtgagaagagagagctgtggcagctctgtgctgacagactttgagggcaaggatgtggccaccaaggtgggggaggcctggcaggacaggcctggggccccccggggcggccagggcgaccctgctgtgcccacccagcagcctgctgaccccagcaccccagagcagcagaacagccccagcggcagcgagcagtttgtgagaagagagagctgcaccagccgggtgcgcagccccagcagctgcatggtgacagtgacagtgacagccaccagcgagcagccccacatctacatcccagccccagccagcgagctggacagcagcagcaccaccaagggcatcctgtttgtgaaggagtatgtgaatgccagcgaggtgagcagcggcaagcctgtgtctgcccgctacagcaatgtgagcagcattgaagattcttttgccatggagaagaagccaccctgtggcagcaccccctacagcgagaggaccaccggcggcatctgcacctactgcaaccgggagatccgggactgccccaagatcaccctggagcacctgggcatctgctgccacgagtactgcttcaagtgtggcatctgcagcaagcccatgggagacctgctggaccagatcttcatccaccgggacaccatccactgtgggaagtgctatgagaagctgttctag

SEQ ID NO: 22663 - DNA, 2166 bp, Artificial Sequence
  Description of Artificial Sequence: Synthetic coding sequence
atgagcatcagcgccctgggcggccgcaccaagggcaagcccctgcccccaggagaggaggagaggaacaacgtgctgaagcagatgaaggtgaggaccaccctgaagggggacaagtcctggatcaccaagcaggatgagagcgagggccgcaccatcgagctgcccagcggccgcagccgggccaccagcttcagcagcgctggggaggtgcccaagccccggccccccagcacccgggcccccaccggctacatcatccggggcgtcttcaccaagcccatcgacagcagcagccagccccagcagcagttccccaaggccaacggcacccccaagtctgctgccagcctggtgaggacagccaatgccggccccccccggcccagcagcagcggctacaagatgaccacagaggactacaagaagctggccccctacaacatccgccgcagcagcaccagcggggacacagaggaggaggaggaggaggaggtggtgcccttcagcagtgatgagcagaagagaagaagtgaggccgccagcggcgtgctgcggaggacagccccccgggagcacagctatgtgctgtctgctgccaagaagagcacaggccccacccaggagacccaggcccccttcatcgccaagagggtggaggtggtggaggaggatggccccagcgagaagagccaggaccccccagccctggcccggagcaccccaggcagcaacagcgcagatggcggccgcaccaaggccagccgggccatctggattgaatgtctgcccagcatgcccagccctgctggcagccaggagctgagcagcagaggagaggagatcgtgcggctgcagatcctgaccccccgggccggcctgcggctggtggccccagatgtggagggcatgaggagcagccctggcaacaaggacaaggaggccccctgcagccgggagctgcagagggacctggccggggaggaggccttccgggcccccaacacagatgctgcccggagcagcgcccagctgagtgatggaaatgtgggcagcggggccaccggcagcaggcctgagggcctggccgctgtggacatcggcagcgagcggggccgcctgtgtgccgccgccagctttgccagcttcctggaggaccaggacggccacagcgccaacagccagagctgcaagcccaggcctgctgccatcagcagcagcgccacctctgtgtctgctgtgcctgctgacaggaagagcaacagcacagctgcccaggaggatgccaaggctgaccccaagggggccctggccgactatgagggcaaggatgtggccaccagggtgggggaggcctggcaggagaggcctggggccccccggggcggccagggcgaccctgctgtgcctgcccagcagcctgctgaccccagcaccccagagcggcagagcagccccagcggcagcgagcagctggtgcggcgggagagctgtggcagctctgtgctgacagactttgagggcaaggatgtggccaccaaggtgggggaggcctggcaggacaggcctggggccccccggggcggccagggcgaccctgctgtgcccacccagcagcctgctgaccccagcaccccagagcagcagaacagccccagcggcagcgagcagtttgtgcggcgggagagctgcaccagccgggtgcgcagccccagcagctgcatggtgacagtgacagtgacagccaccagcgagcagccccacatctacatcccagccccagccagcgagctggacagcagcagcaccaccaagggcatcctgtttgtgaaggagtatgtgaatgccagcgaggtgtcctctgggaagcctgtgtctgcccgctacagcaatgtgagcagcattgaggacagctttgccatggagaagaagccaccctgtggcagcaccccctacagcgagaggaccactggaggcatctgcacctactgcaaccgggagatccgggactgccccaagatcaccctggagcacctgggcatctgctgccacgagtactgcttcaagtgtggcatctgcagcaagcccatgggagacctgctggaccagatcttcatccaccgggacaccatccactgtgggaaatgttatgagaagctgttctag

SEQ ID NO: 22664 - DNA, 2079 bp, Artificial Sequence
  Description of Artificial Sequence: Synthetic coding sequence
atgagcatcagcgccctgggcggccgcaccaagggcaagcccctgcccccaggagaggaggagaggaacaacgtgctgaagcagatgaaggtgaggaccaccctgaagggggacaagtcctggatcaccaagcaggatgagagcgagggccgcaccatcgagctgcccagcggccgcagccgggccaccagcttcagcagcgctggggaggtgcccaagccccggccccccagcacccgggcccccaccggctacatcatccggggcgtcttcaccaagcccatcgacagcagcagccagccccagcagcagttccccaaggccaacggcacccccaagtctgctgccagcctggtgaggacagccaatgccggccccccccggcccagcagcagcggctacaagatgaccacagaggactacaagaagctggccccctacaacatccgccgcagcagcaccagcggggacacagaggaggaggaggaggaggaggtggtgcccttcagcagtgatgagcagaagagaagaagtgaggccgccagcggcgtgctgcggaggacagccccccgggagcacagctatgtgctgtctgctgccaagaagagcacaggccccacccaggagacccaggcccccttcatcgccaagagggtggaggtggtggaggaggatggccccagcgagaagagccaggaccccccagccctggcccggagcaccccaggcagcaacagcgcagatggcggccgcaccaaggccagccgggccatctggattgaatgtctgcccagcatgcccagccctgctggcagccaggagctgcggagcagccctggcaacaaggacaaggaggccccctgcagccgggagctgcagagggacctggccggggaggaggccttccgggcccccaacacagatgctgcccggagcagcgcccagctgagtgatggaaatgtgggcagcggggccaccggcagcaggcctgagggcctggccgctgtggacatcggcagcgagcggggccgcctgtgtgccgccgccagctttgccagcttcctggaggaccaggacggccacagcgccaacagccagagctgcaagcccaggcctgctgccatcagcagcagcgccacctctgtgtctgctgtgcctgctgacaggaagagcaacagcacagctgcccaggaggatgccaaggctgaccccaagggggccctggccgactatgagggcaaggatgtggccaccagggtgggggaggcctggcaggagaggcctggggccccccggggcggccagggcgaccctgctgtgcctgcccagcagcctgctgaccccagcaccccagagcggcagagcagccccagcggcagcgagcagctggtgagaagagagagctgtggcagctctgtgctgacagactttgagggcaaggatgtggccaccaaggtgggggaggcctggcaggacaggcctggggccccccggggcggccagggcgaccctgctgtgcccacccagcagcctgctgaccccagcaccccagagcagcagaacagccccagcggcagcgagcagtttgtgagaagagagagctgcaccagccgggtgcgcagccccagcagctgcatggtgacagtgacagtgacagccaccagcgagcagccccacatctacatcccagccccagccagcgagctggacagcagcagcaccaccaagggcatcctgtttgtgaaggagtatgtgaatgccagcgaggtgagcagcggcaagcctgtgtctgcccgctacagcaatgtgagcagcattgaagattcttttgccatggagaagaagccaccctgtggcagcaccccctacagcgagaggaccaccggcggcatctgcacctactgcaaccgggagatccgggactgccccaagatcaccctggagcacctgggcatctgctgccacgagtactgcttcaagtgtggcatctgcagcaagcccatgggagacctgctggaccagatcttcatccaccgggacaccatccactgtgggaagtgctatgagaagctgttctag

SEQ ID NO: 22665 - DNA, 1899 bp, Artificial Sequence
  Description of Artificial Sequence: Synthetic coding sequence
atgcagcgggaggagggcttcaacaccaagatggctgatggcccagatgaatatgacacagaggccggctgtgtgcccctgctgcaccctgaggagatcaagccccagagccactacaaccacggctatggagagcccctgggcaggaagacccacattgatgactacagcacctgggacatcgtgaaggccacccagtatggcatctatgagcgctgccgggagctggtggaggccggctatgatgtgcggcagcctgacaaggaaaatgtgaccctgctgcactgggccgccatcaacaacagaattgacctggtgaagtactacatcagcaagggggccatcgtggaccagctgggcggggacctgaacagcacccccctgcactgggccacccggcagggccacctgtccatggtggtgcagctgatgaagtacggggctgaccccagcctgattgatggagagggctgcagctgcatccacctggccgcccagtttggccacaccagcatcgtggcctacctgattgccaagggccaggatgtggacatgatggaccagaatggcatgacccccctgatgtgggccgcctaccgcacccacagcgtggaccccacccggctgctgctgaccttcaacgtgtctgtgaacctgggggacaagtaccacaagaacacagccctgcactgggccgtgctggccggcaacaccaccgtcatcagcctgctgctggaggccggggccaacgtggatgcccagaacatcaagggggagagcgccctggacctggccaagcagaggaagaatgtgtggatgatcaaccacctgcaggaggcccggcaggccaagggctatgacaaccccagcttcctgaggaagctgaaggctgacaaggagttccggcagaaggtgatgctgggcacccccttcctggtgatctggctggtgggcttcatcgctgacctgaacatcgacagctggctgatcaagggcctgatgtatggaggagtgtgggccaccgtgcagttcctgagcaagagcttctttgaccacagcatgcacagcgccctgcccctgggcatctacctggccaccaagttctggatgtatgtgacctggttcttctggttctggaatgacctgaacttcctgttcatccacctgcccttcctggccaacagcgtggccctcttctacaactttgggaagtcctggaagagtgaccccggcatcatcaaggccacagaggagcagaagaagaagaccatcgtggagctggccgagaccggcagcctggacctgagcatcttctgcagcacctgcctgatcaggaagcctgtgcgcagcaagcactgcggcgtgtgcaaccgctgcatcgccaagtttgaccaccactgcccctgggtgggcaactgtgtgggcgccggcaaccaccgctacttcatgggctacctgttcttcctgctcttcatgatctgctggatgatctacggctgcatctcctactggggcctgcactgtgagaccacctacaccaaggatggcttctggacctacatcacccagatcgccacctgcagcccctggatgttctggatgttcctgaacagcgtcttccacttcatgtgggtggccgtgctgctgatgtgccagatgtaccagatcagctgcctgggcatcaccaccaatgaaagaatgaatgcccggcgctacaagcacttcaaggtgaccaccaccagcattgagagccccttcaaccacggctgtgtgaggaacatcatcgacttctttgagttccgctgctgcggcctcttccggcctgtgattgtggactggacccggcagtacaccattgaatatgaccagatcagcggcagcggctaccagctggtgtag

SEQ ID NO: 22666 - DNA, 651 bp, Artificial Sequence
  Description of Artificial Sequence: Synthetic coding sequence
atgagcaccatccccaagagagctgtgtgccccttcagcacccagagatatggcatctatgagcgctgccgggagctggtggaggccggctatgatgtgcggcagcctgacaaggaaaatgtgaccctgctgcactgggccgccatcaacaacagaattgacctggtgaagtactacatcagcaagggggccatcgtggaccagctgggcggggacctgaacagcacccccctgcactgggccacccggcagggccacctgtccatggtggtgcagctgatgaagtacggggctgaccccagcctgattgatggagagggctgcagctgcatccacctggccgcccagtttggccacaccagcatcgtggcctacctgattgccaagggccaggatgtggacatgatggaccagaatggcatgacccccctgatgtgggccgcctaccgcacccacagcgtggaccccacccggctgctgctgaccttcaacgtgtctgtgaacctgggggacaagtaccacaagaacacagccctgcactgggccgtgctggccggcaacaccaccgtcatcagcctgctgctggaggccggggccaacgtggatgcccagaacatcaaggccatcctgcgctgccacatggccctgtag

SEQ ID NO: 22667 - DNA, 1899 bp, Artificial Sequence; identical to SEQ ID NO: 22665
  Description of Artificial Sequence: Synthetic coding sequence

SEQ ID NO: 22668 - DNA, 2667 bp, Artificial Sequence
  Description of Artificial Sequence: Synthetic coding sequence
atgctgagccggctgttccggatgcacggcctgttcgtggccagccacccgtgggaagttattgtgggaacagtcacgcttacaatctgtatgatgagcatgaacatgtttaccggcaataataagatctgcgggtggaattacgagtgccccaaatttgaagaggacgtgctgtccagtgatatcattatcctgacgattacaaggtgtatcgctattctatatatttatttccaattccagaacctcagacagcttggcagcaaatatatcctgggaatcgccggcttattcaccatattttcatcattcgtgttttcaactgtagtaatccacttcctagacaaagaactcaccggacttaatgaggccctgcccttcttcctgctgctgatcgacctgtcccgagcaagcactcttgctaaattcgcactttcatccaactcacaggacgaagtacgggaaaacatcgcgagaggcatggccatcctggggcctacatttactctggatgccctggtggagtgcctggtaattggcgtggggacgatgtcgggggttaggcagctggagatcatgtgttgttttgggtgtatgtcagtgctggccaactactttgtgttcatgaccttctttcccgcctgtgtttcattagtcctcgagttatccagagagtcacgcgaaggaaggcccatctggcagctgagtcacttcgctcgggttttggaagaggaagagaacaaacctaaccctgtcacacagcgtgtgaagatgatcatgagccttggcttggtactggtccacgcccactctcgatggatcgccgacccaagtccacagaacagcacagccgacacttccaaggtgtcattgggactagacgaaaatgtcagtaaacgtatagaaccatctgtctctctctggcagttttacctcagtaagatgatttcaatggatattgagcaagtgattacccttagcctcgcgttgctgctcgcggtgaagtacatcttttttgagcagacagagactgagtccacccttagcctgaaaaaccctattactagtcctgtggtgacccagaaaaaggtgccagacaattgctgtcgcagagaacccatgctcgtgcgaaacaaccagaagtgcgacagtgtggaagaagagaccgggatcaaccgtgagagaaaggttgaggtgattaaaccacttgtggccgaaaccgacactccgaatcgagctactttcgtggtgggcaactcctcattactggatacctcttccgtcctagtgacacaggaacccgagatcgagctccccagggaacctcgcccaaatgaagaatgccttcagatccttgggaatgcggagaaaggtgctaagtttctgtcagacgctgaaataatccagcttgtgaatgccaagcacatccccgcatacaagctagaaacgctgatggagacccatgaaagaggagtgtccatccgcagacaactgctcagtaaaaagctctctgaaccctcatccctgcaatatcttccctacagggactataattactccttggtcatgggcgcttgctgtgagaatgtgattggctacatgcctatccccgtgggagttgccggtccattgtgccttgacgagaaggaattccaagtgcccatggccaccactgaagggtgccttgttgcttccactaatcgcgggtgtcgcgcaattggtcttgggggcggtgcttcttctcgggtcctcgccgatggtatgacccgcggtccagtcgttcggcttccaagggcttgtgacagcgcggaggtgaaggcatggctggaaacgagtgaagggttcgccgtcataaaagaggccttcgactccaccagccggttcgctagactacagaaactgcacacaagcatcgccggacggaacctttacattaggttccagtcccggtcaggggacgcgatggggatgaacatgatttcaaaaggaacagagaaagctctgtctaagctccacgaatactttccagaaatgcagattctggcagtgagtggcaattactgcaccgataaaaaacccgctgccattaattggattgagggtcgcggaaagtccgtggtgtgcgaggctgtgatccctgccaaggttgtcagagaggtccttaaaaccaccactgaggcaatgatcgaagtgaatatcaacaagaacttggttggaagcgcaatggccggatccatcggtggctacaacgcccacgccgccaacattgtgacggccatctatatcgcctgcggtcaggacgcagcccagaacgtcgggtccagcaattgcattacactgatggaggcaagtgggcccactaatgaagatctctatattagctgtaccatgccatctattgagatcgggaccgttggtggggggacaaacctgcttcctcagcaagcctgcctccagatgctgggggtgcaaggggcctgcaaggacaatccaggggagaacgctaggcagctggcacgtattgtgtgcgggaccgttatggccggagaactgagcctgatggcagcgctagccgcgggccacctagtgaaaagccacatgattcataacagaagcaaaatcaacctgcaagaccttcaaggggcttgtaccaagaaaacggcctag

SEQ ID NO: 22669 - DNA, 2508 bp, Artificial Sequence
  Description of Artificial Sequence: Synthetic coding sequence
atgctgagccggctgttccggatgcacggcctgttcgtggccagccacccttgggaggtcatcgtggggaccgtaaccctcacaatttgcatgatgtcaatgaacatgtttaccggcaacaataaaatttgcggctggaattatgaatgtcctaaattcgaagaagacgtcctttcctcagatattatcatcttaactatcacacggtgtatcgccatactgtacatctactttcagtttcagaatttaaggcagctcggatccaaatacatcctcggaattgccggcctctttacaatatttagcagcttcgtgttcagcaccgtggtaattcatttcctggataaggaactaacaggcctgaatgaggccttgcccttctttctgcttttaatagatctaagtcgagccagtaccctggctaaattcgcactgtcatcaaatagtcaggacgaagtgagggagaatattgccagaggtatggctattctggggccaactttcacactcgacgccctggtggaatgcttagtaattggagttggcaccatgagtggtgtaaggcagcttgagatcatgtgttgcttcggttgtatgtctgtcttagcaaattattttgttttcatgacatttttccctgcctgtgtgtcactcgttctcgaactgagcagagagtcacgcgagggcaggcccatctggcagctatcccacttcgccagagtcttggaggaggaagaaaataaaccaaatcccgtgacacaacgcgtaaaaatgataatgagtctcgggctcgtgctggtccacgcccacagtagatggatcgcggatccaagccctcaaaactctaccgccgatacatccaaggtctctctcggcctcgatgagaacgtgagcaagagaatcgaaccatccgtttccctatggcagttctatctgtctaagatgatttcaatggacatcgagcaggtaataactctgagccttgccctcctgctggctgtcaaatacatcttcttcgagcagacggaaactgagtccacacttagcctcaagaaccccatcacctcgccagtcgtgacccagaagaaagtacctgataactgctgcagaagagagccaatgctggtcagaaacaatcaaaaatgtgactccgtggaagaggaaactgggattaaccgggaaagaaaagtcgaggtgatcaaaccgctcgtcgccgaaactgacacccctaatagagcaacttttgtggtcggcaacagttctcttctggatacctctagcgttcttgtcactcaggagcccgagatagaattacccagggagccgcggcctaatgaggaatgcctgcaaatattgggcaatgccgagaaaggggccaaatttcttagtgacgcggaaattattcagttagtgaacgcgaagcatattccagcctataagcttgaaaccctgatggagacccatgagcggggtgtttctattcgccgccagcttctgagcaaaaaattgagcgaacccagcagcctgcagtatcttccttatagagattataactacagcttgttgggcgggggagcgtcaagtagagtactggcggatggcatgacaagaggacccgtcgtcaggcttccccgcgcatgtgattcagcagaggtcaaagcatggctagagacgtccgagggatttgccgtgatcaaggaggcctttgactcaacctcccgctttgctagactccagaaactgcacaccagtatcgccggtcgcaatctgtatataagattccagtctcggtctggggacgctatggggatgaatatgatttctaagggcacagagaaagccctctcgaagttacacgaatacttcccagaaatgcagattctggccgtctccgggaactattgtacagataagaaacccgcagccataaactggatcgaaggccgtggaaagtcagtagtctgcgaggcagtgattccggccaaggtcgtacgtgaagtgttgaagaccactactgaggcaatgattgaagtgaacataaataagaatctggtcggtagcgctatggcgggctcaatcggcgggtataacgcgcatgccgccaacatcgtgactgcaatctacatagcctgcggccaggatgcggcacaaaacgtgggttcatcgaactgcataaccttgatggaagccagcggacccaccaacgaggatctatatatctcatgtaccatgccctccattgagattggcactgtcggaggcgggaccaatctgcttccacagcaagcatgcctgcagatgctcggggtccagggagcatgcaaggataacccaggggagaatgccaggcaactcgctagaatcgtctgtggcacagtaatggcaggcgagttgagtctaatggcggccctcgctgcaggccacctcgtgaaatcccacatgatacacaacagatctaaaatcaatctccaagatctccagggtgcttgtacaaagaaaaccgcctag

SEQ ID NO: 22670 - DNA, 798 bp, Artificial Sequence
  Description of Artificial Sequence: Synthetic coding sequence
atgctgagccggctgttccggatgcacggcctgttcgtggccagccatccgtgggaggtgatcgtcggtaccgtcacactcaccatctgcatgatgagcatgaatatgtttacagagggcaccgagaaagccctgagtaaactccacgaatattttccagagatgcagatcttggctgtgtcaggaaattactgtactgataaaaaacctgcggctattaactggatcgagggccggggtaagtcagttgtctgcgaagcggtgatccccgccaaagtagttcgggaagtactgaaaactacaaccgaggctatgatagaggttaacatcaacaagaacctggtgggatccgcaatggccggcagcattggaggttataacgcacatgccgcaaatatcgtaactgctatttatattgcgtgtggtcaggatgcagcgcaaaacgtgggatcttctaattgcatcacattgatggaagctagcgggccgactaatgaggatctctatatttcctgtacgatgcccagcatcgaaataggtacagtgggaggtggcactaatctgctccctcaacaggcatgtttgcaaatgctgggggtgcagggggcgtgtaaggataaccccggagagaacgctaggcagcttgctaggatagtgtgtgggaccgtgatggccggagaattgagtctgatggccgccctcgcggctgggcacttggtaaagagtcatatgatacacaaccgctcaaagatcaacctgcaagaccttcagggtgcctgcacaaaaaagacagcatag

SEQ ID NO: 22671 - DNA, 57 bp, Artificial Sequence
  Description of Artificial Sequence: Synthetic coding sequence
atgctgagccggctgttccggatgcacggcctgttcgtggccagccacccttggtag

SEQ ID NO: 22672 - DNA, 336 bp, Artificial Sequence
  Description of Artificial Sequence: Synthetic coding sequence
atgctgagccggctgttccggatgcacggcctgttcgtggccagccatccgtgggaagtgatcgtggggacagtaaccctcacaatctgtatgatgtcaatgaatatgttcaccgggaacaataagatatgcggctggaattatgagtgtccaaagtttgaggaggatgtgctcagttcagatatcatcatcttgacaatcacccgctgcatcgctattctgtatatatatttccaattccagaacctccgccagttaggttccaaatacatcctggggatcgcaggactgttcacaattttttcctcattcgtgttctctacagtcgttatatag

SEQ ID NO: 22673 - DNA, 2667 bp, Artificial Sequence
  Description of Artificial Sequence: Synthetic coding sequence
atgctgagccggctgttccggatgcacggcctgttcgtggccagccatccgtgggaggtgattgtcggtacagtcactctcacaatatgcatgatgtctatgaatatgttcaccggaaataacaaaatctgcggctggaattacgagtgtccaaagttcgaggaggatgtattgagcagcgatattattatcctcacaatcactcgatgcatcgcaattttatacatttattttcagttccagaatttgcggcagttgggatccaagtacattctgggtatcgcgggcctgtttacgattttttcctctttcgtgttctcaactgtggtgattcatttcctggataaggaactgactggcctgaacgaggccttaccattttttttgctactcatcgacctgtctagggcgagcaccttggcaaaatttgccctctcaagtaatagccaggacgaagttagagagaatatcgcaaggggtatggccattctgggtcccacattcacactggatgcactcgttgagtgtctggtcataggagttggtaccatgagcggagtccggcagcttgagataatgtgttgttttggatgtatgtcggttctagcaaactacttcgtgtttatgacttttttcccagcctgcgtcagcttggttctggagttgtctcgggagtccagggaaggccgtccaatttggcagctgtcacattttgctagggttctcgaagaagaagagaacaaacccaaccctgttacacagcgggttaaaatgattatgtccctgggccttgtgcttgtccatgcacatagccgctggatcgctgacccttccccccagaacagtactgctgacaccagtaaggtttcgctggggctggacgaaaacgtgtcaaagcgaatcgagccatctgtcagcctttggcaattttatcttagtaagatgatctcaatggatatcgaacaagtgattactctgtcattggccctcctcttagccgttaaatacattttctttgaacaaacagaaacagagtcaaccctctcactgaagaaccctattaccagtccagtggtcactcaaaagaaagtccctgacaactgctgcaggcgcgagcctatgcttgttcgcaataatcagaaatgcgacagtgtagaagaagagacaggtattaaccgagagcggaaagtcgaggtgatcaaacccctcgtcgctgagactgatacccctaacagagctaccttcgtggtgggaaactcttcgctcctcgacacctcctccgtgctagtcacacaggagcctgagatcgaactcccccgtgagccaaggccgaatgaagaatgcttgcagattctaggcaacgccgaaaaaggcgccaagtttctcagtgacgctgagatcatccagctggtaaatgccaagcacatcccggcctacaaactggaaacactaatggaaacccacgagcggggagtatccatacgtcggcagctcctaagtaaaaaattatcagagcctagtagcctgcaatacctcccttacagagactataactactctttggtgatgggtgcatgctgtgaaaatgttattggctacatgccaatccccgtgggtgtcgcgggacctctgtgtttggatgagaaggagttccaggttccgatggcgacgacagagggttgcttggtagctagtaccaataggggctgtcgtgctattggtttggggggcggtgcctcttctcgcgtgctggcagatggcatgactagaggcccagtggtccggctccctcgggcctgtgacagtgccgaagttaaagcctggctggaaacctccgagggcttcgcagtaatcaaggaggccttcgactcaactagcaggtttgcacgccttcaaaagttgcacacaagcatcgctggtcggaacctctatatcaggtttcagtccagaagtggtgacgcaatggggatgaatatgataagcaaaggcacagagaaggccctgtctaaactgcacgagtacttcccagagatgcagatcctcgcggtgtctggcaactactgcactgacaaaaagccagcggcaatcaattggatcgaaggccgcggaaaatcagtggtctgcgaggctgtgattccagctaaggtcgtgagggaggtgctgaagactacaacagaggctatgatcgaagtaaatattaataaaaacctagttggcagtgcaatggccggaagtatcgggggttacaacgcgcacgctgcaaacattgttacggcgatttatattgcatgcgggcaggacgctgcacaaaacgtaggtagttcgaactgcatcactcttatggaggccagtggacccacaaacgaggacctgtacatcagttgtaccatgccttccatagagataggcacagtgggcggaggcacaaacttgcttccgcagcaggcctgtttacaaatgcttggggtacaaggggcctgtaaagataacccaggagaaaacgcgcgacagttggctcggattgtgtgcggcactgtcatggccggggaattatctctaatggctgcgctggcagccggccacttggttaagtcccatatgatccacaataggagcaagattaacctgcaagacctgcaaggagcctgcactaagaagactgcatag

SEQ ID NO: 22674 - DNA, 2460 bp, Artificial Sequence
  Description of Artificial Sequence: Synthetic coding sequence
atgcacagccaccccgtgtacctgctgcccgtgcccgagttcaccagcacttggattaaaatctatttcggttactgttggccattccataacttcttaaagttttgtatccagtactcctgtcactctttgctgagacagagaatcgacagacttgaggaagccttaccttttttcctccttctgattgatttgtcacgcgcttccaccctggccaagttcgctttgagctcaaactcccaggatgaggtgcgagaaaatatagctagaggtatggcaatcctggggcccaccttcaccctggatgcactggtagagtgcctggtaatcggcgttggaacaatgtcgggcgtgcggcagctcgaaattatgtgttgtttcggttgcatgtctgtcctggcaaattactttgtgttcatgactttttttccagcatgcgttagtctcgtgctcgaactgtctcgagaatccagggagggtcgccccatctggcagctcagccatttcgctcgggtgttagaggaagaggaaaacaagcctaacccggtcacacaacgggtgaagatgataatgagcctcggtctggtgctagtgcatgcccactctagatggattgccgacccctctccacagaactccactgcagacacatctaaagtgtctcttgggcttgatgaaaacgttagcaagcgaattgagccatctgtaagcttatggcaattctacctgagcaagatgattagcatggacatcgaacaggttattacgctcagcctggccctcttactcgcagtgaagtacattttcttcgagcagaccgagaccgagtccactctttccctcaagaatccgattacatctcccgtggttacacaaaagaaggtgccagataactgctgcaggagagagccaatgctagttcgtaacaaccagaagtgcgacagtgtggaagaagaaactggaatcaatcgagagcgaaaggtggaggtcataaagcccctggtggctgagactgacactccaaatagggctaccttcgtggtcggtaactcgagccttctcgacacgtcctctgtgctggtgacgcaggagcccgaaatcgagctccctagagagcccaggcccaacgaggagtgtctacagatcctgggcaacgccgaaaagggagcgaaatttttgtctgacgccgaaatcatccagttggtgaatgccaaacacatccctgcctataaactggaaaccctgatggagacacacgagagaggagtgtcgattcggcggcagctgctatccaaaaaactctcggagccatcctccctgcagtatcttccataccgcgattacaactattcattggtcatgggggcatgttgtgagaacgtcattgggtacatgcctatccctgttggcgtggcggggcctctgtgccttgatgaaaaagagttccaggttcccatggccacaaccgagggctgcctggtagctagcaccaatagggggtgtcgggcaattggtctgggaggcggcgcttccagccgagttcttgctgacggaatgacacgaggccctgtcgtccgtcttcccagggcttgtgactctgcggaagtgaaagcttggctcgaaacttcggagggattcgctgttatcaaggaggctttcgactccacaagtcgcttcgcaaggctgcaaaagcttcatacatctatagctggcagaaacctgtacatcagatttcaaagccggagtggggatgccatgggaatgaatatgatatctaagggaacagaaaaggctctgagcaaacttcacgagtactttccagagatgcaaatcctggccgtttctggcaactactgtaccgataaaaagccagcagcaataaactggattgagggccggggaaaatctgtagtttgtgaggccgtaatccctgcaaaagtggttcgggaggtactgaagactacaactgaagctatgatcgaagtcaatatcaataaaaacctggtggggagcgcgatggcaggaagtatcggcgggtataacgcgcacgcagctaatattgtcactgctatttatatcgcttgtgggcaagacgctgcccagaacgttggttccagcaactgtataactcttatggaagcatctggtccgactaacgaagacctctacatatcgtgcacaatgccatccattgaaattggcactgtagggggtggaactaatcttctcccgcagcaggcctgtctgcagatgctgggggttcaaggcgcgtgcaaagacaatcccggcgaaaacgctagacagctcgccagaatcgtctgtggcactgtgatggcgggagagctgagcctaatggccgctctggctgctggccatttggtgaaatcccacatgatacataataggtctaaaatcaatctccaagatttacagggagcctgtaccaaaaagaccgcttag

SEQ ID NO: 22675 - DNA, 1671 bp, Artificial Sequence
  Description of Artificial Sequence: Synthetic coding sequence
atggcccggaccaccagccagctgtacgacgccgtgcccatccagtcttcggttgtgctgtgctcatgcccttctccaagtatggtgcggacccagaccgagtcttccacaccacccggaattcccggtgggtctagacaaggccccgcaatggatgggaccgcggctgaacccaggcctggagccgggtctttacagcacgcccagccccctccccaaccacgtaaaaagcggccagaggattttaagttcggcaaaatactgggagagggtagtttcagcacagtggtcttagcacgagagctggcaacttccagagaatacgctattaagatcctagagaagcggcatattattaaagagaataaagtgccatacgttacccgcgaaagagatgtgatgagccgtctggatcaccccttctttgttaagctgtacttcaccttccaggatgatgagaaactgtacttcggactgtcgtacgctaaaaatggtgaactgctgaagtatataaggaagattggcagtttcgacgaaacttgcactagattttataccgccgaaatcgtttcagccctggagtaccttcatgggaaaggcatcattcacagggatctgaagcccgaaaacatcctgctaaacgaagatatgcacatccagattacggatttcggcaccgctaaggtgctgtcgcctgaatccaaacaggcacgggctaactcatttgtgggtacagcccaatatgtcagccccgaactgctgaccgagaagagcgcttgtaagtctagcgatctgtgggccctgggttgcattatttatcagctggtggcaggactacctccatttcgcgcaggaaatgagtatctgatcttccagaagattattaagctcgagtatgacttccctgaaaagttttttcctaaggcccgggatttagttgaaaagctccttgtgctcgacgccaccaaaaggctggggtgtgaggagatggaagggtatgggccgctgaaggctcacccattctttgagagcgtgacctgggagaatcttcaccagcagacaccgcccaagctgaccgcctatctgcccgccatgtctgaagacgatgaagactgttacggcaattatgataacctgctatcacagtttgggtgcatgcaagtgtcatcatcttctagcagccacagcttatctgcctccgacactgggctgcctcagagatctggatccaacatcgagcagtacattcacgacctggattcaaacagtttcgaactcgacctgcagttcagcgaggacgaaaagcgccttctcctcgaaaagcaggcagggggcaacccttggcatcaattcgttgagaataacctcattctgaagatgggccccgtggacaaaagaaaaggtttgttcgcacgccgcagacagctgctgctcactgagggccctcacttatactatgtggaccctgtcaataaagtcctgaagggcgaaattccctggagtcaggaactaagacccgaggcaaaaaatttcaaaacattttttgtgcacactccaaatcgcacttactacttgatggacccatcgggaaatgcacacaaatggtgtagaaaaatccaagaagtctggaggcaaagataccagtcccatcccgacgcagccgttcaatag

SEQ ID NO: 22676 - DNA, 1599 bp, Artificial Sequence
  Description of Artificial Sequence: Synthetic coding sequence
atggcccggaccaccagccagctgtacgacgccgtgcccatccagtcctctgttgtcctgtgctcctgtccaagcccgagcatggtcaggactcagactgaaagtagcactccacctggtatccctggcggtagcaggcagggtcccgccatggatgggacggcggctgaacctcgcccaggtgctggctcactgcaacacgcccagccccctcctcagccacgcaagaaacgccctgaagacttcaagtttggcaaaatcctcggggagggaagctttagcacagtggtgttagcacgcgaattagcaacgagccgggagtacgccataaaaatcttagagaagaggcatattattaaggagaataaggttccttacgtgactcgggagcgagatgtcatgtcccgtctggatcacccatttttcgtgaaactctacttcaccttccaagatgacgagaagctatacttcggactgagttacgcaaagaacggcgagctgttgaaatacatccggaagatcggctcattcgacgagacatgtacccgcttctataccgccgagattgttagcgctctggagtaccttcacggcaaagggataatccaccgagacctgaaacctgagaatatcttactcaatgaggacatgcacatccaaatcaccgacttcggcactgccaaagtgctctcgcccgaaagcaagcagggcgtttccgacctgtgggcactcggctgcattatttaccagctggtggctggcctgcccccgttccgtgccggaaatgaatatctgatcttccagaaaattataaaattggagtatgatttccctgaaaagttttttccaaaagctagggatctggtcgagaagctacttgtactggatgctactaagcggcttggttgcgaagaaatggaaggatacggcccactaaaggctcacccatttttcgagtccgtgacatgggaaaacctccatcaacagaccccccccaagctcactgcatatctgccagcaatgagcgaggacgatgaggattgctacggaaactacgataacctcctgtcccagtttggctgtatgcaggtgagttccagcagttcctctcattctttgagcgctagcgacactggcctcccacagagatccggctcaaatatcgagcagtacatccatgatctggatagcaatagctttgaactcgatctacagttctcagaggacgaaaaaaggctgcttctggagaaacaagctggcggtaatccctggcaccaatttgtggaaaacaacctcatcctcaagatggggcctgtggacaagcgcaaaggtctctttgctaggaggcgacagctgctccttaccgaagggcctcatctgtattacgttgatcctgtgaacaaggttttgaagggggaaattccttggagtcaggagttgcgacctgaagctaagaacttcaagaccttctttgtgcatacccccaacaggacatattaccttatggatccctcaggaaatgcccacaagtggtgtcggaagattcaggaggtgtggcgccaaaggtatcaatcgcatcccgacgctgcagtacaatag

SEQ ID NO: 22677 - DNA, 1479 bp, Artificial Sequence
  Description of Artificial Sequence: Synthetic coding sequence
cgggcccaggacgagggcggccactgctggggcagcgccagcggccgtcggacactgagaaggaggcgcgcggcgcagcgatgcggcggcggcgcacgggctgacgcaggccctatggcacgcactactagtcagctctacgacgccgtgccaatacagtcttcagtggttctgtgttcctgtcccagccccagtatggtgagaacacagacggagtctagcacgcccccagggattcctgggggctcacggcaagggcccgctatggacggaacagctgctgaaccccggcctggcgctggttctctgcagcacgcccagcctccccctcagcctaggaaaaaacggcctgaagacttcaagttcggcaagatcttaggggagggatctttctccaccgtcgtgctagccagagaactagccacgagtagagagtacgccatcaagatactcgagaaacgccacattattaaggaaaataaggtgccttatgtgacacgcgaacgcgacgtgatgagcagattggaccaccccttttttgttaaactctatttcacattccaagacgatgagaagctgtacttcggcctatcttacgccaagaacggcgagttgctgaaatacattagaaagataggttctttcgacgaaacttgtactcggttttacacagccgagatcgtatctgccctggaatacctacatggtaagggaataattcacagagatttgaaacctgaaaatatattgctcaatgaagatatgcacatccagatcaccgactttggcacggctaaagtgctatcccctgagtcaaagcaggcccgagccaatagcttcgtcggcacagcccagtatgtttcccctgagctgttgactgagaagtctgcctgcaagagttccgatctctgggccttagggtgcatcatctaccaattggtggccggcttgccccctttccgcgcaggaaacgaatacttgatctttcagaagataatcaaactggagtacgactttcctgaaaagttctttcctaaagcacgggaccttgttgagaagttgctggtacttgacgcaacaaaacggctgggttgtgaggaaatggaagggtatggaccactgaaagcccatccttttttcgagagtgtgacatgggaaaaccttcatcagcagactcctccaaagttgactgcttacctgcccgccatgagcgaggacgacgaagactgttacgggaactatgacaatctgctgagccaatttggatgtatgcaagtgtcatccagttcttcttctcattcactgtccgcaagtgacaccggactgccacagcggtctggtagcaatatcgaacagtatatccacgacctcgacagcaattccttcgaactggatctgcagttttccgaggacgaaaagagactgttactggaaaagcaagccggcggcaatccatgcttgacgggtcggataatttag

SEQ ID NO: 22678 - DNA, 1290 bp, Artificial Sequence
  Description of Artificial Sequence: Synthetic coding sequence
atggcccggaccaccagccagctgtacgacgccgtgcccatccagtcgagcgtagttctatgctcttgtccatcgccctcaatggtgcggacccaaactgaatcatcgactccacctgggattccgggtggttccagacagggccccgcaatggatggcacggccgctgaaccccgccctggagcgggctcgctccagcatgcacagccccctcctcaacccaggaaaaaacgcccggaagactttaagttcggaaagatcttaggagaaggcagtttctcaaccgtagtactcgcgagggaactggcaacttctcgcgagtacgccactcgcgcaaattccttcgtgggaaccgctcagtatgtcagtcccgagctcttgacagagaaatctgcctgtaaatcctcagacctctgggccctgggctgcatcatttatcagctcgttgctggcctgccaccattccgggccggaaacgagtatctcatttttcagaaaataataaaactggagtatgactttcccgagaagttcttcccaaaggcccgcgacctggtcgaaaagctgttggttctcgatgcaaccaaaagattgggctgcgaggagatggaggggtacgggcctctgaaggcccatcctttctttgaatccgttacatgggaaaatctgcatcagcaaacaccccccaagttaacagcatatctccctgcgatgtctgaggacgatgaagattgctatggcaactacgacaacttgctgtcccagttcggttgtatgcaggtcagctcctcctcatctagccatagcctctccgcaagcgacaccggcctgcctcagcggtcaggttcaaatatagagcagtacatacacgacctggattctaactcttttgaactcgatctacagttctcggaagatgaaaagaggctgctcctggaaaaacaggctggtgggaacccatggcatcagtttgttgagaacaaccttattctcaagatgggacccgtggataagcgcaaagggctgtttgcccggcgacgacagctactgctgacggaggggccccatctgtattatgttgacccagtgaacaaagtgctgaaaggagaaatcccatggagccaggagctaagaccagaggccaagaattttaaaacattctttgtgcacacaccgaataggacatattaccttatggacccctccggaaatgcgcacaagtggtgtcggaagatacaggaggtctggcgtcagcggtaccaaagccaccctgatgcagccgttcagtag

SEQ ID NO: 22679 - DNA, 5121 bp, Artificial Sequence
  Description of Artificial Sequence: Synthetic coding sequence
atgggcgtgcccaagttctaccggtggatcagcgagcggtacccctgcttatctgaagtggtgaaagagcatcagatccctgagttcgataatttgtaccttgatatgaacggaattatacatcagtgttctcatcctaacgatgacgacgtccattttcggatcagcgatgataagatcttcactgacatcttccactacttggaggtactctttaggatcattaagccaagaaaggtgtttttcatggcagtagatggcgttgccccgagagcaaaaatgaaccagcaaaggggccggcgcttccgttccgcaaaggaagcagaagacaagattaaaaaggctattgagaagggagagacacttcctaccgaagcacgttttgactccaactgtataacccctggaaccgagttcatggcacggttgcatgagcatctgaaatatttcgtcaatatgaagattagcaccgacaagtcctggcagggagtcacaatctatttctcaggacacgagacgccaggtgagggggaacacaaaatcatggagttcattaggtctgagaaggccaaacctgaccacgatcctaatactcgacattgtttgtatggccttgatgctgatctgattatgcttggcctcaccagccatgaggctcacttctctctgcttcgtgaggaggtccgcttcgggggtaagaaaactcagcgcgtgtgcgctcccgaggaaactacgttccacctcctccatttgagcttgatgagagagtatattgattacgaattctcagtccttaaagagaagataacattcaagtacgacatcgagcgtattatagacgattggattcttatggggtttctggtgggaaatgacttcatcccacatctccctcacctgcatatcaaccacgatgcccttccactgctttatgggacatatgttaccattttgcctgaactcggcggatacattaatgagtcgggccacttgaatctcccaagatttgaaaagtacctggtaaagttgagtgatttcgacagagagcacttcagcgaggtgttcgtggacctgaagtggtttgagtctaaggtaggtaacaaatatctgaatgaagccgcaggcgtggcagccgaggaggcccgcaactataaggagaagaaaaaacttaaagggcaggagaatagtctttgctggaccgcgctggataagaacgaaggggagatgatcacttccaaggataatctggaagatgagacagaggatgatgatctgttcgaaacagaattcaggcagtacaagagaacatactacatgactaagatgggtgtggacgtggtaagcgatgatttcctggctgatcaggcagcttgctatgtacaggctatacaatggatccttcattattactaccacggcgttcagagttggtcctggtactacccttatcattacgccccttttttatccgatatacataatatttctacgctgaaaatccattttgagcttggcaagcccttcaaaccattcgagcagctcttggctgtgttacccgccgcatcgaagaacctgctcccggcctgctaccagcacctgatgaccaatgaagactctcccatcatcgaatattaccccccagattttaaaaccgatctcaatggtaaacagcaagaatgggaagccgtggtgctcataccgttcatagacgagaaacgcctcctggaggcgatggaaacatgtaaccacagtctcaagaaggaagaacgaaagcggaatcagcattcagaatgtctgatgtgctggtacgaccgcgacacggaattcatctacccatccccctggccagaaaagttccctgccatcgagaggtgctgtactcggtacaagattatttctctcgatgcctggcgcgtggatatcaacaaaaacaaaatcacacggattgatcaaaaagctttatatttttgtggattcccaacactgaaacatattcggcacaaattttttctaaaaaaatccggcgtccaggttttccagcagtcatcccggggtgaaaacatgatgttagaaattcttgtagatgccgaaagcgacgagttaactgttgagaatgtggcctcaagcgtcctggggaaatctgtctttgtgaactggccacacttggaggaagcccgggtcgtagcggtgagcgacggcgaaacgaaattctacctcgaggaaccacccggtacccaaaagctgtactccggaaggaccgcccccccaagtaaagtcgtgcacttgggcgataaagaacagtctaattgggccaaggaggtgcagggcatcagcgaacactatctgaggcggaaaggcattatcatcaacgagacatctgccgtagtctatgctcagctcctgaccggtagaaagtaccagattaaccagaatggagaggtcaggctcgagaagcaatggagcaagcaggtcgtccctttcgtgtaccagaccattgtcaaggacatccgagccttcgacagccgcttttccaacatcaagacgcttgacgatctcttcccattaaggtccatggtttttatgctgggcaccccatactatggctgtaccggagaagtgcaggactctggggacgtcatcaccgaggggagaatccgcgtgatcttctcaatcccctgcgagccgaatctcgacgccctgatacaaaaccaacacaaatattccatcaaatataacccagggtacgtcctggcgtctaggctaggcgtgtcaggctacttggtgtctaggttcactgggagcattttcatcgggcgaggttcccgtaggaatccccacggtgatcacaaggcaaacgtcggcctgaatttgaaatttaacaagaagaacgaggaggtacctggctacacgaagaaggttgggtctgagtggatgtactcctcagcagctgaacaactgttggcagagtatcttgagcgcgccccagaattattctcctatatagctaaaaactcccaggaagacgtgttttacgaggatgacatttggccaggcgagaacgagaatggggccgagaaggtccaggagattatcacctggctgaaaggacatcccgtgagcacgctgagccgaagctcctgtgacttgcagattctcgatgcagctatcgtcgagaaaattgaggaggaagtggagaagtgtaagcagcggaagaacaataaaaaagtgagagtcaccgtgaagcctcatctcctttacagaccactcgaacagcaacacggcgtgatccccgatagggatgctgaattctgcctcttcgatcgtgtagtgaatgttagggagaactttagtgtgccagtgggccttcgcggaaccattatagggatcaagggagccaaccgcgaggccgatgtgctgtttgaggtgttgtttgacgaagagtttccgggaggtttaacgattcgttgtagcccaggccgtgggtaccgcctccccacaagtgctttggtaaatctctcacacggcagtcgttctgagacagggaaccaaaaattgacagccatcgtgaagcctcagcctgctgtgcaccagcatagcagctcatccagcgtctcttcaggacacctgggagccctgaaccactccccacagtccttattcgtccccacgcaggtgccaacaaaagacgatgatgagttttgcaatatttggcagtccctgcagggatcaggaaagatgcagtactttcagcctacgatacaggagaagggggctgtactgccacaggagatctcacaggtgaaccagcaccataagtccggcttcaacgacaactcagtcaagtaccagcagcggaaacacgatcctcataggaagttcaaggaggaatgcaagagccctaaagctgagtgttggtctcagaagatgtccaataagcagcccaattcaggcatcgagaatttcctggcaagtctgaatatcagcaaggaaaatgaagttcaatcctctcaccatggagagccccccagcgaagagcacctgtctccccagagcttcgccatgggaacgaggatgttaaaagaaattctgaagatcgacggcagtaatacagtcgaccataaaaatgagatcaaacagatcgccaacgagattccggtgtcttctaatcggcgtgacgaatacgggctgccctctcagccgaaacagaataaaaaattggcttcctacatgaataagccacattcagccaacgaataccacaacgtccaaagcatggataatatgtgctggcctgcaccatcccaaattccacccgtaagcacaccagtgacagagctctcaaggatctgcagcctggtcggaatgccgcagcccgatttctcctttctgagaatgccgcagacgatgacagtgtgccaggtgaagctctccaacggactccttgtgcatggaccccagtgccattctgaaaatgaagcaaaggagaaagccgcccttttcgcgctgcagcaactgggctctttaggtatgaattttccactgccgagtcaggtgttcgctaactacccctcagccgtgcccccaggaacaatcccccccgctttccccccacccaccggttgggaccattacggctccaactacgccctgggtgccgccaacatcatgccctcaagcagccatttattcgggtccatgccctggggcccaagtgtgccagtaccaggcaagccctttcatcatacattgtattccggaacaatgcccatggccggaggtatccccggcggagttcacaaccagttcatccctttacaggtcaccaaaaagagagtagcgaataaaaagaatttcgaaaacaaggaagcgcagtcatcccaggcaacgccggtgcagacttcccagcccgacagctctaacattgtcaaggtgtcaccgcgggagagctccagcgcgtctctgaagtccagtcctatcgcccaaccagcaagcagtttccaggttgaaaccgcctcacagggccattctatctctcaccacaaatcaacccccatctcaagtagccgaagaaaatcacgcaaactcgccgtcaatttcggcgtgtcgaagccttcagagtag

SEQ ID NO: 22680 - DNA, 5085 bp, Artificial Sequence
  Description of Artificial Sequence: Synthetic coding sequence
atgggcgtgcccaagttctaccggtggatcagcgagcggtacccctgcttgagcgaggttgttaaggagcatcagatccccgagtttgacaacctgtacttggacatgaatgggattatccaccagtgcagccaccccaacgacgacgacgtgcattttcgaatcagcgacgataagattttcactgatatcttccactatctggaagttttgtttcgcatcataaagccgagaaaagtcttctttatggccgtggatggcgtggcacctagagctaagatgaatcaacaacgtggtcggcgctttagatctgcaaaggaagctgaagacaaaatcaaaaaggccattgagaaaggtgaaacattgcccacggaggctaggtttgatagcaattgtataacccccgggaccgagttcatggcgcgcttacacgagcacctgaagtacttcgtgaacatgaagataagtactgacaaaagctggcaaggcgtgaccatttatttttctggtcatgagacacctggagagggcgagcacaaaatcatggagtttatccggtcagagaaagcaaaacccgaccatgaccctaataccagacattgcttgtacggtctggatgcagacctcatcatgctaggcttaacatcccacgaggcccatttcagccttctgagagaagaagtgagatttggcggaaagaaaacccaaagagtctgcgccccagaagaaaccactttccacttactacacctaagccttatgcgggaatacattgactacgaattttccgtgttgaaggagaagatcaccttcaagtacgatatagaacgcatcatcgatgattggattctcatgggctttctggtcgggaatgatttcattccgcacctgccccatttgcatatcaatcacgatgctttaccactcctctacggcacttatgtgaccattctgcctgagctgggaggctacatcaatgaaagtggacacctgaatctcccacgtttcgagaagtaccttgtgaagctgagtgacttcgacagagaacatttctctgaggtgttcgtggatttaaagtggtttgaaagtaaagtcggtaataaatacctgaatgaggcggctggagtagcggctgaggaggccagaaactacaaggagaaaaagaaattgaaagggcaggagaactccttgtgctggaccgcgctggacaaaaatgagggcgagatgattacctctaaagataaccttgaggatgagaccgaggacgatgacctttttgaaaccgagtttcggcagtataagagaacgtactacatgaccaaaatgggggtagacgtggtaagcgacgactttttagctgatcaggccgcctgctacgtgcaggcaatccagtggatcttgcactattattatcacggtgtccaatcatggagttggtattacccttatcactacgcacctttcctgtctgatatccacaacatcagcactctcaagatccacttcgagctcggtaagcccttcaaaccttttgagcagctactggccgtgctacctgccgccagcaaaaatttgctcccagcctgctaccagcatctgatgaccaatgaggacagccccatcatcgaatactatccccccgactttaaaacagacctgaatggaaaacagcaggagtgggaggccgtagtgctcattccgttcatcgacgagaagcgcctgctagaggctatggaaacgtgtaatcattccctaaaaaaggaagaaagaaaaaggaatcagcatagcgagtgtctaatgtgttggtatgatcgcgacacagaatttatctaccccagcccttggccggagaagtttccagccatcgaacgctgttgcaccaggtataagatcatctcactagacgcgtggagagtggatattaacaagaataaaatcaccagaatcgaccagaaagcgctgtacttttgcggtttccctacccttaagcacattcgccataaatttttcttaaagaagtccggcgtgcaggtgtttcagcagtcatctaggggtgagaacatgatgctggagattctcgtcgatgctgagtctgacgaactgacagtggagaatgtagccagtagcgtgttgggaaagtccgtatttgtgaattggccccacctcgaggaagctcgagtcgtcgccgtgtccgatggagaaactaagttttatctcgaggagcctccgggcacacagaagctgtactccggaagaactgccccaccctcaaaggtggtgcacctcggagataaagagcagtccaactgggcaaaggaggtccagggaatttctgagcactacctgcgccgaaaaggtatcatcattaatgagactagtgcagtcgtgtacgcccagctgctgaccggcagaaaataccaaatcaaccaaaacggcgaagttcggctcgaaaagcagtggagcaaacaggtggtcccgttcgtctaccagacgattgttaaagatatccgggcgtttgattcgcgattcagtaacatcaagacacttgacgatctgttcccactgcgcagcatggtatttatgctgggcactccttattacgggtgtacaggcgaagtgcaagacagtggggacgtgattaccgagggacgtataagagtgatcttcagcattccttgcgagcccaacctggacgccctcatccagaaccagcacaaatattccatcaagtataatcctggatacgtgcttgcaagccgcctgggggtgtccgggtaccttgtttccagattcactggaagcatttttattgggaggggtagtcgacgaaatcctcacggagatcataaagccaatgtagggctgaaccttaaattcaataagaagaatgaggaagtgccgggatatactaagaaggtgggcagcgaatggatgtattcctcagccgctgagcagctgctggctgaatacctcgaacgtgctcctgagctttttagctatattgcaaagaacagccaggaggatgtgttttacgaagacgacatttggcccggcgagaacgagaatggggccgagaaagtgcaagagattatcacctggctgaaagggcatccagtctctaccttgagtcggtcaagttgtgatctgcaaattcttgacgccgcgattgtggaaaaaatcgaggaggaggttgagaagtgcaagcagagaaagaacaacaagaaagtgagggtgaccgtgaaaccacacttgctgtatcgtcccttagaacagcagcatggggttatccctgacagagatgcggaattctgcctctttgatagggtcgtcaatgtgcgggaaaacttcagtgtcccagttggcctgcggggaacgataatcgggataaagggagcaaaccgagaggccgacgtgctgttcgaggtgttatttgatgaggagtttcctggtggactaaccatccgctgctcccccggaaggggatatcggttacccacctccgcgttagtgaatttgtcccacgggtccaggtcagaaactggcaaccaaaagctgaccgccatcgttaaaccgcaacctgctgtgcaccaacatagttcctcttctagtgtgtccagtggacacctgggagcactgaatcactcccctcagtctctctttgttcccacacaggtacccactaaagatgatgacgaattctgcaatatctggcagtcactgcaggggtctgggaaaatgcagtacttccaaccaacaatacaagagaaaggtgccgtgctgccacaagagatttcgcaagtcaatcagcaccacaaatccgggtttaacgataatagcgtgaagtatcagcaacggaaacatgaccctcatcgcaaatttaaggaggaatgcaagagtcccaaggccgagtgctggtcccagaagatgtccaataaacagcccaacagcggaattgagaactttctcgccagtctgaatatttcgaaggagaacgaggttcaatcaagtcaccatggcgagccgccctcagaagagcacctgagtccccaatcatttgccatgaaagggacaaggatgctgaaagaaattctaaaaattgatggaagtaataccgtggatcacaaaaatgaaataaagcagattgccaatgagattcccgtctcatcaaatagacgggacgagtacggtctcccgtcacagcctaagcagaataaaaagttggcttcctacatgaacaagccacactcggctaacgagtaccataatgtacagtctatggataacatgtgctggcctgccccctcccaaatcccccctgtgtccacacctgttacagagctgagtagaatatgcagccttgtcggtatgccccagcctgacttctcattcctccgtatgccccagacaatgacggtctgccaggtgaagctatccaacggcctgcttgtccacggtccacagtgtcactccgaaaacgaggccaaagaaaaagctgccctttttgcccttcagcagcttggaagtttgggaatgaatttccccctgccatcccaggtgttcgcgaactacccatccgctgttccccctggcaccatcccacctgcttttcctccccccaccgctaacatcatgccatcctctagccacctattcgggtccatgccctggggcccgtcagtaccagtgcctgggaaaccttttcaccacaccttatattccggaaccatgcccatggccgggggtattcccgggggggtccacaatcagtttatccccttacaggtgaccaagaagcgggtcgccaacaaaaagaactttgaaaacaaggaggctcagagttcacaggcgacaccggtgcagacgagccaacccgactccagtaatatcgtaaaggtatccccccgagagtcgtcctcagcctctctgaagtcttcacctattgcacagcctgctagcagcttccaagtggaaaccgcctcacagggacattcaatcagtcaccacaagtccacacccatatcttctagcaggcggaaatcacgtaagctggccgtgaactttggcgtgtcaaagccatcagagtag

SEQ ID NO: 22681 - DNA, 1380 bp, Artificial Sequence
  Description of Artificial Sequence: Synthetic coding sequence
atgggcgtgcccaagttctaccggtggatcagcgagcggtacccctgcctgagcgaggtggtcaaggaacaccaaatcccagaatttgataatctgtacttggacatgaacggtataatccatcagtgctcccatccaaatgatgacgatgtgcacttccgcattagtgatgataagatcttcacagacatcttccactacttggaggtgttattcaggatcataaaaccgcgcaaagtgttttttatggccgtcgacggagtggctccccgggccaagatgaatcagcagcggggccgtagattcagaagtgccaaggaggccgaagataagattaagaaagccattgaaaaaggcgaaacactgccaaccgaagctagattcgacagtaattgtatcactcccggtacagagttcatggcacggttacacgaacatttgaagtacttcgtgaatatgaaaatctcaactgacaagtcatggcagggggtgacaatttacttctctggccacgagacacccggggagggggagcataagatcatggaattcattcgttctgaaaaagctaagccagatcatgatcctaatacaagacattgtctgtacggcctggatgccgacctgatcatgttgggattaacatcccacgaggcgcacttttcactcttgcgggaagaagttaggtttggaggaaaaaaaacacagcgggtgtgtgctcctgaggagacaacattccacctactgcatctctctctgatgcgtgaatacattgattacgaattctctgtcttgaaggagaaaataacctttaagtacgacattgaacgtatcattgatgattggatcttgatgggattcctggtgggaaacgatttcatccctcacttgcctcaccttcacattaaccatgatgccctgccactgctgtacggcacgtatgttaccatcctgcccgagttgggtgggtacatcaacgaatccggccaccttaatctgccgaggtttgaaaaatacctcgtaaaactcagtgacttcgaccgagagcacttcagcgaagtgtttgttgacctgaaatggtttgaatctaaggtaggcaacaagtatttaaatgaagcggccggggtagccgccgaggaggctcgcaactacaaggaaaagaagaaactgaaaggccaagaaaattccctctgttggacggcgctagataagaatgagggtgaaatgatcacaagcaaagacaacctcgaggatgagactgaggatgacgatctgtttgaaacagagtttaggcaatataagcgcacatattacatgaccaagatgggcgtggatgtggtctccgaatacgtcttcgcaaatgccttcatccttaagtag

SEQ ID NO: 22682 - DNA, 750 bp, Artificial Sequence
  Description of Artificial Sequence: Synthetic coding sequence
atgctgggcctgaccagccacgaggcccacttcagcctgctgcgggaggaggttcgctttggggggaaaaagacccagcgtgtctgcgctccagaggagacgaccttccaccttttacatctctctctgatgcgggagtacatcgattatgaattttcggtgctcaaagaaaaaattaccttcaagtatgacatcgaacgcatcattgacgactggatactgatggggttcctcgtggggaacgattttatcccccacctgcctcatctgcacatcaaccacgatgccctgccactgctgtatggcacctacgtgactattcttccagagttgggcggttacatcaatgaaagcggacacctgaatctgcctcgtttcgagaagtatttggtgaaactgtcggattttgaccgcgaacacttcagcgaagtctttgtggacctgaagtggttcgaatctaaagttggtaataagtatttgaacgaagctgccggcgtcgcagcggaggaggctcgtaactacaaagagaagaaaaagttgaaagggcaagaaaactccctctgttggaccgctctcgataagaatgagggagaaatgattacatctaaagacaacctggaggacgagacggaagacgatgacctttttgaaaccgagttccgccagtataagcggacgtactacatgacaaagatgggcgtggatgtggtctcggaatacgttttcgcgaatgcctttattctgaagtag

SEQ ID NO: 22683 - DNA, 3483 bp, Artificial Sequence
  Description of Artificial Sequence: Synthetic coding sequence
tgaaccaacgaggacagccccatcatcgagtactacccccccgactttaaaacagacctaaacggtaaacagcaagaatgggaggcagtggtgctgattcccttcattgacgagcgcctgctagaagctatggaaacctgcaaccacagcctgaagaaagaagaaagaaagcgaaatcagcatagtgagtgcctcatgtgttggtacgaccgtgatacagaatttatttatccttcaccctggccagagaaatttcctgccatagagagatgttgtacgaggtataagattataagcctggatgcatggcgtgtagacattaacaagaacaagattacaaggatagaccagaaggctttgtatttctgcggattccctacgctgaaacatatccggcataaattctttctaaaaaagtctggggtccaggtcttccagcagtcaagtcgcggcgaaaatatgatgctggagattttagttgatgcagagtctgacgagttaactgtagaaaatgtggcttccagcgtactcggtaagtcagtatttgtgaactggccccatctggaagaggccagagtggtggcggtgtctgatggtgaaactaagttctacctggaagaacctccaggcacccagaaactctattctggccgcaccgctccgccaagcaaggtagttcacttgggcgacaaagagcaaagtaattgggcaaaagaagtgcagggcataagcgaacactacctgagaagaaaaggaattataattaacgagacttctgccgtcgtctacgcccagcttcttacaggaagaaagtaccagataaatcagaacggggaagtccgacttgaaaagcaatggtctaaacaggtggttccttttgtataccaaactattgtaaaagatatccgcgcattcgacagccggttctccaacattaaaactctggacgatctgttcccactgcggtctatggtcttcatgctcgggactccctactacggatgcactggagaagtacaagattccggagacgtaatcacagagggccgaatccgagtcattttttctatcccctgcgagcctaatctggacgccttaattcaaaaccagcacaagtatagtatcaagtataatccggggtatgtgctggcatcaagactgggtgtgtctggatacttggtctcccggttcactggctctattttcattggccgaggctctcggaggaacccgcatggagaccacaaggcgaacgttggactgaatctgaagtttaacaagaagaatgaagaagtacccggttataccaagaaagtgggcagcgagtggatgtattcctcagccgccgagcagttgttagctgagtacctggaacgcgcgcccgaacttttctcttacatcgctaaaaattctcaggaagatgtcttctacgaagatgacatttggcccggcgagaacgaaaatggtgcagaaaaggtgcaggagatcatcacctggctgaagggacaccccgtctcgactctcagtcggtcttcatgtgatcttcaaattctggacgcagccattgtcgaaaagatagaggaagaggtggagaagtgtaagcagagaaaaaataacaagaaggtccgggtcaccgtaaaaccacatcttctgtacagaccccttgaacaacaacatggcgtcataccggatagagacgctgagttctgtttgttcgatagagttgtaaacgtccgggagaatttttcggttcccgttggactgaggggaacgatcatcggcatcaaaggcgcgaatcgcgaggctgacgtcctgtttgaagtgctcttcgacgaagagttcccgggcgggctgaccatccgttgcagcccgggccgaggttatcgacttccgaccagcgcactcgtcaatctgtcccacgggtctagaagtgaaacagggaaccagaaactcacagccattgtcaaacctcagccggcagtacaccagcatagttcaagttcatctgtgtccagcggtcacctgggtgccttgaatcacagcccacaaagtttgttcgtgcccacccaagtacctactaaggacgatgacgagttctgcaatatatggcagtctctgcaagggtccggcaagatgcaatatttccagccaacaatccaggagaaaggagctgtgctgccacaggaaatatcacaagtcaatcaacaccacaagagtgggtttaatgataacagtgtgaagtatcaacaacggaaacacgacccacacaggaaatttaaggaagaatgcaagtccccaaaagcagaatgttggtcacagaagatgagcaataagcagcctaattccggaatcgagaacttccttgccagcttaaacatcagcaaggaaaatgaagtgcaatcgtctcaccacggggagcctccttcagaggaacacctgagcccccaatccttcgcaatgaaaggaactcgcatgctgaaggaaatcctcaaaatcgacggctcaaatacagtggaccacaagaacgaaatcaaacagatcgccaatgagatccctgtgtccagtaacagacgcgatgagtatggactgcctagccaaccaaagcagaacaaaaaactggcctcttatatgaacaaaccccactcggctaacgagtatcacaatgtacaatctatggacaatatgtgctggcccgctccgagccagatccctccagtttctacacctgtgactgaactaagtagaatctgctctctggttggtatgcctcagccagacttttcctttttgcggatgccccagaccatgactgtctgtcaagtgaagcttagcaacgggcttctcgtccacgggcctcagtgccacagtgagaatgaagcaaaagagaaggcggccctatttgctctgcagcaattaggttccttgggcatgaattttccgctcccttcacaggtcttcgccaactacccctctgccgtgccgccaggaactataccaccagcctttcctcccccaaccgctaatatcatgccaagttcctcccacttgtttgggtcaatgccatggggaccctccgtccctgtgccaggtaaacccttccaccacacactttatagtgggactatgcccatggccggtgggatcccaggaggcgtacataaccaatttattccgctgcaggtcactaagaagagggtggccaacaagaaaaattttgagaacaaggaggcacaaagcagccaggcaacacccgttcagaccagccagccagacagcagtaacattgtgaaagtgtctccgcgtgaatctagctccgcaagccttaaaagctctcccattgcccaacctgcatcaagctttcaggtggaaactgcctcccaggggcacagcatcagccatcataaatccaccccaatcagctcctctagacgcaaatctcgtaagctggccgtcaacttcggagtatccaagccatccgaatag

SEQ ID NO: 22684 - DNA, 1233 bp, Artificial Sequence
  Description of Artificial Sequence: Synthetic coding sequence
atgcccgcccgggccctgctgccccggcggatgggccaccggaccctcgcatccactccagctctctgggcttccataccttgtcccagatccgagctgcgcctagatttagtgcttccttccggtcaatcctttcgatggagggagcagagtcctgcccattggtctggcgtcctggcagaccaggtgtggaccctgacgcagaccgaggagcagctccattgcactgtttataggggggacaaatctcaagcatctcgccctactcctgacgagctggaggctgtgaggaagtattttcagttagacgtgaccttagcacagctatatcaccattggggaagcgtggactcccattttcaggaagtagcccagaagttccaaggagtccgcctgctcaggcaagacccaattgagtgcctattctcctttatctgtagtagtaacaacaatattgctaggattaccggaatggtagagcggctttgccaagcctttggtccacgccttattcaattggacgacgtgacctatcatggctttccctcgttgcaagcactcgcgggacccgaggtcgaagcgcacctccgcaaactgggcttgggttaccgagccaggtacgtgtctgcctccgcaagagccatcctcgaagagcaaggtgggttagcttggctacagcaattacgggagagttcttatgaggaagctcataaagccctctgcattttgccaggagtgggaacaaaagtggccgattgcatctgtctgatggcgctggacaaacctcaggcagttcctgtcgacgttcacatgtggcacatcgcacagagagactacagctggcaccccaccacttcccaagcaaagggcccctcccctcaaacaaacaaagagcttggaaattttttccgttctttgtgggggccatatgcaggctgggcgcaggctacaccgccctcatacagatgttgctctgtgcctacctgcgccaatcccgccatgctgcgttcccaccagcagtccgcagagcgcgtcccaaaagggcggaaagctaggtggggcaccctggacaaagagataccccaggccccctctcctcctttccccacttcactcagtccttctccgccaagcttgatgctcggcagaggtctgcccgttacaaccagtaaggcacgacatccgcaaatcaaacaatcagtgtgtactaccaggtggggcgggggatactag

SEQ ID NO: 22685 - DNA, 1071 bp, Artificial Sequence
  Description of Artificial Sequence: Synthetic coding sequence
atgcccgcccgggccctgctgccccggcggatgggccaccggaccctggccagtacaccagctctctgggcctcgattccctgcccgcggtcggagttgcgcctggatctggtgttacccagcgggcagagtttcaggtggcgtgagcagagtcctgcgcattggtcaggtgtgctcgccgatcaggtgtggaccctgactcagaccgaagagcaactgcactgcaccgtatacagaggcgacaagtcacaggccagtaggccaactcccgacgagctggaagctgtccgaaagtactttcagttggatgtcacgctcgcacagttgtatcatcactggggctcagtcgactctcactttcaagaggtcgcacaaaaattccagggggtgaggcttcttcgtcaggacccaatcgagtgcttatttagctttatctgctcgagtaataataacatcgcacggataacgggtatggtcgagcggttgtgccaagcttttggacctcgactgatccagcttgacgacgtcacatatcacggattcccctctctacaggcccttgcgggtccagaggtagaggcacacctgaggaaactcgggttgggttatagggctcggtacgtgtcagctagcgcccgagccatcctcgaggagcaaggcggactggcctggctccagcagttaagggaatcctcatatgaggaagcccacaaggcattatgcatactgccaggtgtgggaaccaaggtagcagattgcatctgtctgatggctcttgataaaccacaagccgtgccagttgacgtgcatatgtggcacattgcccagagagactacagctggcacccaacaactagccaggcaaaaggtccatcccctcagaccaataaggaactgggcaactttttccgcagcctatgggggccttatgctgggtgggctcaagccctgtgtcaggtgatcactaccttcatgaccttcctgggtccccaccgcctggatcagatgcctcccgaggagctgcagacctcgtcctcccgcctgggcggaccgccatggcagtgtatatag

SEQ ID NO: 22686 - DNA, 1275 bp, Artificial Sequence
  Description of Artificial Sequence: Synthetic coding sequence
atgcccgcccgggccctgctgccccggcggatgggccaccggaccctggcctcaactcctgccctctgggcctccatcccttgtccacggtccgaactgagactggacttggtgctaccatccggacagtcgttccgctggcgtgagcagtccccggcccactggagcggggtccttgcagatcaggtttggaccctgacacagacagaggaacaactgcattgcactgtctaccgcggagataaaagtcaggcctctagaccaacacccgacgagctcgaggccgtgagaaaatattttcaactggacgtgactctagctcagctttaccatcactggggctctgtagactctcacttccaggaagtggcccaaaaatttcagggggtcaggctactgcgccaagacccaattgagtgcttattttctttcatctgctccagcaacaacaacattgccagaatcactggcatggtggagcgcctgtgccaggcatttggcccacgtctcattcaacttgatgatgttacgtaccacggttttccgagtcttcaggccttagccggacctgaagtggaggcccatcttagaaagctggggcttggttaccgcgcaagatacgtgtcagcctcagcgagagctattctggaggagcagggcggactggcgtggctgcaacagctgagggaaagctcctacgaagaagctcacaaagccctatgcattctcccgggcgtgggtacaaaagtcgccgattgtatctgccttatggcattggacaaaccccaggcagtgcccgtggacgtgcacatgtggcacatcgctcagagggactattcctggcaccccactaccagccaggcgaagggcccgagcccacaaaccaataaggaattggggaatttcttcaggagcttgtggggcccttatgccgggtgggcacaggctggccttctggggaatgcgtttgacggacaccaactgctcagacctctgattttctgccaggaccatttgagagaaggccccccaatcgggcgaggggactcacagggggaggagttggagccccagctgccttccagtttatccagcattccatatggcttctgcgaccattgttggactaaggacgtggatgaccctcctctagtgactcacccttcacctggctctcgcgacggacatatgactcaggcatggcccgtgaaggttgtctcccctctcgccaccgtcatcggacacgtgatgcaggcaagtctcttagcattgtag

SEQ ID NO: 22687 - DNA, 975 bp, Artificial Sequence
  Description of Artificial Sequence: Synthetic coding sequence
atgcccgcccgggccctgctgccccggcggatgggccaccggaccctcgcctctaccccggctttatgggcatccatcccctgtcctaggtccgaactgaggttggatcttgtgctcccatctggtcagtcctttaggtggcgggagcagtctcccgcccactggtctggcgtactggctgaccaggtgtggactttaacacagaccgaggagcagttgcattgtaccgtttaccggggtgacaaaagtcaggctagccgccctaccccagacgagctggaggcagtccgtaagtactttcagctcgacgtgacactggctcagctttatcaccactggggcagtgtggactctcacttccaagaggttgctcagaagtttcagggggtcaggctccttaggcaggatcctattgaatgtcttttttctttcatttgctctagtaataacaacattgctcgcattacaggaatggttgagagactgtgccaggcattcggccctcggttgatccaacttgatgatgtcacctatcacggatttccctctctgcaggccttagctggacctgaagtggaagcccacctgcggaagctcggattaggataccgcgcaagatatgtcagcgcttcagccagggccattctggaggaacaaggtggattagcctggctacaacaactgagggagtcttcttacgaagaggcgcacaaagcactgtgtatcctgcccggggtaggcactaaggtggctgattgcatctgccttatggctcttgataagccacaggccgtgccagtggacgtccacatgtggcacattgctcagagggattactcttggcaccccactacatcccaggctaagggtccatctccccagacaaacaaggagctcggaaacttcttccgttcactgtgggggccttacgctggatgggcacaggctgtctctgtgccccgctgtccaccttag

SEQ ID NO: 22688 - DNA, 594 bp, Artificial Sequence
  Description of Artificial Sequence: Synthetic coding sequence
atggtggagcggctgtgccaggccttcggcccccggctgatccagctagacgatgttacataccacgggttcccctctctccaggctctggctggccccgaggtcgaagcccatttacgcaaactgggactaggatatagagccaggtacgtatccgcttctgcaagagccatcctggaagagcagggagggctggcctggttacaacagctgcgcgaatccagctatgaggaggctcacaaggccctgtgtattctccccggagtgggaaccaaagagactttttcaggcgcttgtggggacttgatgctggcggggcccaagcgatgctgcagtgtgcctacgtgcgcaaatcccgccatgttaagatcccaccagcaatccgcagagagggtcccaaaaggacgcaaagcacgctggggcactctggataaggagataccacaggcgccttctcccccatttccaacatctcttagcccatctccgccctccctgatgcttggacggggattacctgtcactacatctaaggcgagacacccccagatcaaacagagcgtgtgcaccacccgatggggaggagggtactag

SEQ ID NO: 22689 - DNA, 1038 bp, Artificial Sequence
  Description of Artificial Sequence: Synthetic coding sequence
atgcccgcccgggccctgctgccccggcggatgggccaccggaccctggcatctactcctgctctgtgggcatctatcccctgtccgagaagtgaactgcgactagacctagtgcttcccagtggccagtcattccgttggcgggagcagtccccagcccattggagtggagtcttggcagatcaggtgtggacgctgactcaaaccgaggaacagctgcattgcacggtgtatcggggtgataagtcgcaggcaagcagaccaactcccgatgagctggaagctgtacgaaaatactttcaattggatgtcacactcgcccagctctaccatcattggggtagtgtggattctcattttcaggaagttgcccagaaattccagggggtgagacttcttagacaggacccaatagagtgcctgttttcgtttatctgttccagtaataacaacatcgcgcggattactggcatggtggagagactgtgtcaggctttcggtccaaggcttattcaattagatgacgtgacctatcatggctttcccagcctccaagcgctcgctggacctgaggtggaggcacatctgagaaagctgggtctaggttaccgggcacgatacgtaagtgcttccgcacgagcaattttagaggagcaaggcggactggcctggctgcagcagcttagagaatcctcatacgaagaggcgcacaaggcactatgcattttgccaggagtcggcacaaaggtggcagattgcatttgtctgatggccttggacaagcctcaggcagtccccgtggatgtccatatgtggcatattgcgcagagggattattcatggcaccccacaaccagccaggcaaaggggccgtcaccacagactaataaggaactgggtaatttcttccgcagtctctggggtccatacgcaggttgggcccaggcagtgctgttttcggctgacctgaggcagtcacgtcatgctcaagagcctcctgccaagcgccggaaagggtctaaggggccggaaggttag

SEQ ID NO: 22690 - DNA, 1074 bp, Artificial Sequence
  Description of Artificial Sequence: Synthetic coding sequence
atgcccgcccgggccctgctgccccggcggatgggccaccggaccctggcatctacgcctgctctctgggcctctattccctgtcctcgatccgaactccgccttgaccttgtgctgccatctggacaatcgtttcgatggagagaacagagccccgcacactggagcggggtgctggctgatcaggtttggaccctgactcagacggaagagcagctgcactgtactgtctaccgtggcgataaatctcaggcaagcagacccacaccagacgaactagaagccgttcgcaagtatttccagctggacgtcacactcgctcaattataccaccactggggcagcgtggactctcactttcaggaggtggcacaaaagttccagggtgtacgactattgaggcaggaccctatcgagtgcctgtttagtttcatatgctcctcaaacaacaacattgctcggatcactggcatggttgaacggctgtgccaggcttttgggcctagactaattcagctggatgacgtaacctaccatggcttcccctcattgcaagctctggccggccccgaagtggaggctcatctgcgcaagctggggttgggttacagggccaggtacgtctcggcatcggctcgggcgattcttgaagagcagggcggcctggcctggctgcagcagctacgggaaagctcgtatgaggaggcgcacaaggcattatgcattttgcccggggttggtaccaaaggtctgctcggtaacgcctttgacggacatcaactactccgccccctgatattctgtcaagaccacctgagagagggcccaccaattggcagaggcgactcccaaggcgaggagcttgagccccagctgcccagttccttgtcctcgatcccttatggattttgcgatcattgttggacgaaggacgtagacgatccccccctggttactcacccctctcctggcagcagggatggccacatgacccaggcatggcctgtcaaggttgtcagtccgttggctactgtcataggccatgttatgcaggcgtccctcctggcactgtag

SEQ ID NO: 22691 - DNA, 588 bp, Artificial Sequence
  Description of Artificial Sequence: Synthetic coding sequence
atgcccgcccgggccctgctgccccggcggatgggccaccggacccttgcttcaacgcccgccctctgggcatccattccctgtccacggtcggagcttcggcttgacttggttctgccatcaggccagtcatttcggtggagggaacaatcacccgcccattggagtggagtgctggcagaccaagtgtggacgcttacacagacagaggagcagctgcattgcactgtttaccgcggagataagtcccaggctagtaggcctacacccgacgaactggaagctgtccgaaagtacttccagctcgatgtaaccctggcccaactgtaccaccattgggggagcgtcgatagccactttcaagaagtggctcagaagtttcagggcgttcgactgctccggcaagacccaattgaatgcctgttctccttcatatgttcttccaacaacaacattgcccgtatcacggggatggtggagcgcctctgccaggcattcggaccccggctcattcaactggatgatgtgacctatcacggctttccttctctgcaggctctcgccgggccaccctggcagtgtatctag

SEQ ID NO: 22692 - DNA, 969 bp, Artificial Sequence
  Description of Artificial Sequence: Synthetic coding sequence
atgcccgcccgggccctgctgccccggcggatgggccaccggaccctggcctcaaccccagcgttatgggcctctataccctgtccacgctctgaacttcgcctggatctcgtgctcccttctggtcagagctttagatggcgtgagcaatcaccagctcattggtccggcgtactggcagaccaggtgtggacccttacacagacggaagagcagctccactgcacagtctatcgaggggataagtcccaggcatcccggcccacaccagatgaactggaagctgtccggaaatactttcagctggacgttacactcgctcaattgtatcatcattggggctctgtggacagccacttccaggaggtagcacagaaattccagggagtgagactccttcgtcaggatcctattgaatgccttttttcatttatctgctcttccaacaacaacatcgccagaatcactggcatggtagaacgactttgccaggcctttggcccgcgattaattcagttagacgacgtgacatatcatggtttcccatccttgcaggccctcgctgggcccgaggtggaggcccacctgagaaagcttggacttggctatagagcccggtacgtgagcgcttcagccagggcgatcctggaggagcagggcggcctggcctggctccagcaactgagggagagctcatatgaggaggcacataaagcactgtgcattctgcctggggtcgggacaaaggttgcagattgcatatgtttgatggctctggataagccccaagctgtgccggtggatgtccatatgtggcatatcgcgcagcgcgattacagttggcaccccactacttcccaagccaaggggccttcccctcaaacaaacaaagaactaggaaatttcttccgctccctgtggggtccttatgccggatgggcgcaagctgccgggagcgacgccagttag

SEQ ID NO: 22693 - DNA, 6807 bp, Artificial Sequence
  Description of Artificial Sequence: Synthetic coding sequence
atgagcggcctgcacctggtgaagcagggccgggaccggaagaagattgactcacaacgcgattttactgttgcttctcccgctgagttcgtcacgagatttggcggaaacaaagtcatcgaaaaggtcttgatcgcaaataatggcatcgcagccgtaaagtgtatgcgatccatccgtagatggtcatacgagatgttccgaaatgagagggcaattaggttcgtcgtaatggtcacccccgaggatctgaaagctaatgcagaatacataaaaatggcagaccattatgtaccagtgcctggcgggccaaacaataacaactacgcgaacgtggagcttatattagatatcgccaagcgcataccagtgcaagctgtctgggccggctggggccacgcttcagagaatcccaaactacccgagctgctacttaagaacggcatcgctttcatgggtccaccctctcaggcgatgtgggctctcggcgacaagatcgcatccagcattgtggcccagaccgcgggcatccctactctgccgtggagcggtagtggcctccgggtggattggcaggagaatgacttctcaaagagaattctgaacgtgccccaggagctatatgagaaagggtacgtgaaggacgttgacgacggactccaggcagcagaagaggtgggctacccagtaatgataaaggccagcgaaggagggggcggcaagggtattagaaaagtaaacaacgctgatgacttccccaatctgtttaggcaggtacaggcggaggttcccgggagccccatatttgtcatgcgactggccaagcagagccggcatctggaggttcagatcctagccgatcaatacggaaatgctatctccttgttcggccgcgattgtagcgttcagcgaaggcaccagaaaataattgaggaggccccagctactatcgccaccccagcggtctttgagcacatggagcaatgcgccgttaaactggccaagatggtgggatatgtctcagcaggcactgttgaatacctgtacagccaggacggcagcttctacttcttggagctgaacccgcgactgcaggtcgagcacccttgcactgagatggtggcggatgtgaacctacccgcggcacagctgcaaatcgcaatggggattccactgtatcggatcaaagacatcagaatgatgtacggagtcagcccctggggcgattcccccatcgatttcgaagattccgcacatgtgccatgcccaagggggcatgtcattgctgcacgcataactagcgaaaatccagacgagggtttcaagcctagtagcggcaccgtccaggagttgaattttaggtctaataaaaacgtgtggggctatttctccgtggccgctgccggaggcctgcatgagttcgcggattcccaattcggccactgtttcagctggggagagaatagagaagaagcgatcagcaatatggtagtcgctcttaaggaactgagtatacggggggatttcaggacaacggtcgaatacttgatcaagctgctggagaccgagagtttccagatgaacaggatagacaccggttggctggatcgcctaatcgccgaaaaggtccaggccgaaaggccagacacgatgcttggcgttgtgtgcggtgcactgcacgtggctgacgtatccttgagaaactctgtctctaactttcttcattctctggaacgcggccaagtgctgcccgcccatacattgctcaataccgtggacgtcgaattgatttatgagggcgtgaagtatgttcttaaggtgacccgccagagtccaaatagctacgtcgtgattatgaacggttcctgtgtcgaagtcgatgtgcaccgcctgtcagacgggggcttgcttctcagttacgacggcagctcctatacgacatacatgaaagaggaagtggatcgatacaggatcaccattggaaataaaacatgcgtgttcgaaaaggaaaacgatccttctgttatgagatcacccagcgccggtaagctgattcagtacatagtggaggacggaggccacgttttcgctgggcagtgctacgcagagatcgaagtcatgaagatggtgatgacgctgactgccgtcgagtccggatgcatccactacgtgaaaaggccgggagcagccctggatcccggatgcgtgctcgctaaaatgcaactggataacccttccaaagtgcagcaggctgagcttcatacgggctccctgccacgcatacagagcactgccctacggggcgaaaaattacaccgggtcttccactatgttttagacaacctggtgaatgttatgaatggatactgcctaccagatccatttttcagctccaaagtaaaggactgggtggaacggctcatgaaaacattaagagacccctctttgcccctactcgagttgcaagacataatgacttcagtgagcgggcgcattcctccgaatgttgagaagagcataaaaaaggaaatggctcagtacgcctccaatatcacctccgtgctgtgccagtttcccagccaacagatcgccaacattctcgattcccatgccgctacgttaaatcgcaaaagtgagagagaagtgttttttatgaatacccagagtatcgtccagttggtccagcggtaccggagcggtatccgcggccatatgaaggcagtggtaatggacttactgcgacaatacctcagggtggaaacccagtttcaaaacggccactacgataaatgtgtgtttgcactaagggaggaaaacaagtctgatatgaatacagttcttaattacatctttagccacgcccaagtgactaagaagaatctgctggttaccatgttaatcgaccagttgtgcgggagggatcctaccctgactgacgagttacttaacatcctgactgagctcactcagctctctaaaactaccaacgcgaaagttgcactcagagcaaggcaggtgcttattgcttcgcatctcccaagttatgagctcagacacaaccaggttgagtctattttcctgtccgccattgacatgtatggacaccaattctgcatagagaatcttcaaaaattgattttgtcagagacatcaatcttcgacgtgttgcccaatttcttctatcattccaaccaagtggtcagaatggcagctctggaagtctacgtgcggagggcttatatagcatacgaattgaacagtgtccaacaccgtcagctgaaagataacacatgcgtcgtggagtttcagttcatgctgcccactagtcatcccaacaggggtaacatacctaccctcaataggatgtcctttagttcgaacctgaaccactatggcatgacccacgtggctagcgtgtctgacgtacttctggacaactcttttacccctccatgtcaaagaatgggggggatggtgtctttccgcacctttgaagacttcgtcaggatctttgacgaagtcatgggctgcttttccgatagtcctcctcagtctccgacatttcccgaagccgggcacacaagcctttacgacgaagacaaagtgcctagggatgagcctatccacattttgaatgtcgccattaagactgactgcgacatcgaagatgaccgccttgctgctatgtttcgcgagttcacccagcagaataaagctactctggtcgaccacggtattaggaggctcacgttccttgtggcccagaaagatttcagaaaacaggttaactacgaggtggacaggcggttccatagggagtttcctaagttttttactttccgcgcgagggataaatttgaggaggatcggatctatcgtcaccttgagcccgcgctcgccttccagctggaacttaatcgtatgcggaattttgacctgactgcaataccatgtgccaaccacaagatgcatctgtatctgggcgcggctaaagtcgaagtggggacagaggttaccgattaccggttcttcgtcagggccataattaggcattctgatctggtcacaaaggaggcctccttcgagtatctgcagaatgagggcgagcgactacttctggaggccatggatgaactcgaagtcgcctttaataataccaacgtgcgcactgactgtaatcacatcttcttaaactttgttcccaccgttattatggatccgtctaagatcgaagaatctgtgaggtcaatggttatgcgttacgggtctcggctttggaaattaagagtgttgcaggcggagctgaagattaacattcgtctgacacctacaggtaaggctattccgattcgcctgttcctgacaaatgaatctgggtattacctggacatttctctgtacaaagaggttacagactcccgcactgcacagatcatgttccaagcttacggagacaagcaggggccgttacatgggatgctgattaatactccttacgtgaccaaggacctgctccagagcaagcggttccaggcacaatctctcggcacgacctatatctacgatattcctgaaatgtttagacagtcactgatcaaactgtgggagtctatgagtacgcaggctttcctcccgtcccctccacttccgagcgacatgctgacctatactgagctcgttctggacgaccagggccaactggtacatatgaatagactccctggtggaaacgaaatcgggatggtggcctggaagatgacgttcaagagcccagagtatcctgagggccgtgacatcatcgttatcggcaatgacatcacttaccggattggtagcttcgggccacaggaggacctcctatttttgagagcctctgagctggcaagggcagaaggcattcctagaatctacgtctcagcaaactcaggcgcacgaatcgggcttgcggaggagataagacacatgtttcatgtggcgtgggtggatcctgaagacccctataaaggatatcgttatctgtatctgactccacaggactacaaaagggtttcagccctgaacagtgtgcattgcgagcacgttgaagatgaaggagagagtcgatacaagattacagacattattggaaaagaggaaggaatcggtccggagaacctgcgcggctctggaatgattgcgggcgagtctagtcttgcctataatgaaatcatcacgatttccctcgtgacctgccgcgctatcggtatcggagcataccttgttaggctgggccagcgcactatccaagtggagaacagccatctcatcttgactggcgccggtgccttaaacaaggtcctgggaagagaggtgtatacctccaacaaccagctcgggggcattcagattatgcacaacaatggagtcacccactgtaccgtctgtgacgactttgagggagtctttaccgtcctgcactggctgagctacatgccaaagtctgttcactctagcgtgcccctcctcaactctaaagacccaatagatcgcattattgagtttgtaccaacgaagacgccatatgatcctcggtggatgttggcaggtagaccgcacccaactcagaaaggtcagtggctgagcggctttttcgactacgggagtttcagtgaaattatgcagccttgggcccagactgtcgtggtcgggcgagcgaggctcggcggaatccctgttggagttgtggccgtggagactagaacagtggaactatcaatccctgccgaccctgcgaacctggactccgaggcgaagatcatccaacaggccggtcaggtgtggtttcccgacagtgcctttaagacgtaccaagcaattaaagatttcaatcgcgaagggctccctttaatggtttttgctaactggcgcggcttttcaggagggatgaaagatatgtatgatcaggttctgaaattcggcgcgtacatagttgatggcctgagggagtgctgtcagccagtactggtttacatacccccccaggccgagctgaggggcggctcttgggttgtgattgacagctctatcaaccctagacatatggaaatgtacgcagatagggaatcaagaggttccgtgctggagccggagggcactgtggagatcaagttccgcaggaaggatttagttaagaccatgcgcagggttgatccagtgtacattcatctcgccgaacgtttgggaaccccagagttgtccaccgccgagagaaaggagctggagaacaagttgaaggagcgcgaagagttcctgatccccatataccaccaagttgccgtgcagttcgcagatcttcatgatacacccggccgtatgcaggaaaagggtgtcatctctgatatcctcgactggaaaaccagtaggacgttcttctattggcggcttaggagacttctgcttgaagatcttgtcaagaaaaaaattcacaatgctaatccggaactgactgatggtcaaattcaggccatgctccggcggtggtttgtcgaggtggagggaactgttaaggcatacgtctgggataataacaaagaccttgctgagtggctcgagaagcaactgacggaagaagacggtgtgcattctgtcattgaagagaatattaagtgcatctcacgcgattatgtgttgaaacagatacgatctctggtacaggcaaatccggaagtggccatggacagtatcattcacatgacacagcatatttcgcccactcaaagggccgaggtaattcggatcttgtctactatggacagcccgtctacctag

SEQ ID NO: 22694 - DNA, 7152 bp, Artificial Sequence
  Description of Artificial Sequence: Synthetic coding sequence
atgtggtggagcaccctgatgagcatcctgcgggcccggagcttctggaaatggataagcacccaaacggtccggattattagggccgttcgggcacactttgggggaatcatggatgaaccatctcccttagctcagcctctggagctgaatcagcattctaggttcattattggcagcgtgagtgaagataactcagaagatgagatctcaaacctggtaaaactggaccttttggaggagaaagaggggagtctatcccctgcttccgtgggatctgacacactcagtgatttgggtatatcatctctgcaggacggcctcgcactgcatatccgttcttcaatgtccggtctgcatctggtgaaacagggccgggatagaaagaaaattgacagccaaagggacttcaccgtggcttcacccgctgaatttgttacccggtttggggggaacaaagtgattgagaaggtcctgatcgcaaacaatggcatcgccgctgtgaagtgcatgcgatcaatcaggagatggagttatgaaatgtttcgtaacgagcgggctatccgcttcgtggtcatggttacacctgaggacttaaaagccaatgccgagtacattaagatggcggaccattacgtgcccgtaccgggaggtccaaataataataattacgcaaacgtagaacttatcctggacattgcgaagcgcataccagtccaggcagtgtgggctggatggggacacgcatcagagaatcctaaactgccagaattgttactaaaaaatggaatcgccttcatgggtccaccgtcacaagccatgtgggctctcggagacaagattgctagttctattgtggcccagaccgcaggcatacccaccctgccctggtctggcagtggactccgggtcgattggcaggaaaacgatttttcaaagcgaatattaaatgttcctcaggagctgtacgagaaggggtacgtgaaagatgttgacgacggactgcaggccgccgaagaggtcgggtaccccgttatgataaaagccagtgagggcggcggaggaaaaggaatcaggaaggttaacaacgctgatgattttcctaatttgtttcgtcaggtgcaggcagaggttccgggaagtccaatatttgtgatgcggctggctaagcagtccaggcatctcgaggtacagatcctggcagatcagtacggcaacgctatcagtctctttggaagggactgctcagtgcagcggagacaccagaagattatagaggaggctcctgctaccatagctacacctgccgtgtttgagcacatggagcaatgtgccgtcaagctggctaaaatggttggatacgtctcggctggaaccgtggaatacctgtactctcaggacggctccttttacttcctggagctgaacccacggcttcaagtcgagcacccatgcacggagatggttgcggacgttaatctacctgccgcccagctgcagatagctatgggtatccccctgtatcggattaaggatataagaatgatgtacggcgtttctccttggggagactccccaattgatttcgaggactctgcccacgtgccctgtccgcgaggacacgtgatcgccgcacgaatcacatcggagaatccagatgaaggtttcaaaccttcctcaggcacagtgcaggagcttaatttccggtcgaataagaacgtgtggggctatttctccgtcgcagccgccggcgggctgcatgagttcgcagattcccagttcggtcattgctttagctggggggagaaccgcgaggaggcaatatccaatatggtagtggctctgaaagagttgtccatccgtggggacttccggacaaccgttgagtatcttataaagcttctagagacagagtcttttcagatgaatcgaatagacaccggttggctcgacaggctgatcgctgaaaaggtgcaggcagagcggcccgacacaatgctgggagttgtttgtggcgccttacacgtggccgatgtctccctgcgaaacagtgtgagcaacttcctgcactcccttgaaagaggtcaagtgctcccggctcacacactgctgaataccgttgacgtcgaactcatctacgagggagttaaatacgttcttaaagttactagacagtcccccaactcatacgtggtgattatgaatgggagctgtgtcgaggtggacgtgcacagactttcggacggggggctgctactctcctacgatggctccagctatacgacttacatgaaggaggaagttgatcgctaccgcattactataggaaacaagacttgcgtctttgaaaaagaaaatgatccatctgtgatgcgaagcccttctgcaggaaagttgatccagtacatcgtagaagatgggggacacgtattcgcaggacaatgctacgccgagattgaagttatgaagatggtgatgacgcttacagcagtcgagagcgggtgcatccactacgtcaagcgccccggcgctgctcttgatcccggctgcgtgcttgccaagatgcaactcgataatccttcaaaggtgcaacaagcagagttacataccgggtcactaccgaggattcagagcacagctctgaggggagagaaattacaccgagtattccattatgtccttgacaatctcgtgaacgtcatgaacggctactgcctccccgatccatttttttcctctaaggtcaaggactgggtggagcggttgatgaagaccctgagggatcccagtctccctctgttagaattgcaagatatcatgaccagtgtcagtggcaggattcccccaaacgtagagaaaagcatcaagaaggaaatggcacagtatgctagcaacatcacttccgttctctgtcagtttccctcccaacagatagctaacattctggattcccatgctgcaaccctaaataggaagtcggagcgggaagtgttcttcatgaatactcagtcaatcgtacagctagtgcagaggtaccgatccgggattagaggccatatgaaagcggtcgtgatggatctgctcaggcagtatctgagagtcgagactcagttccagaacggacactacgacaagtgcgtgttcgcattacgggaggagaacaaaagcgacatgaacactgtcctaaattacatcttttctcacgcacaggttacaaaaaaaaatttgcttgtgaccatgttaatcgaccagctttgtggacgcgacccgactctcaccgacgaactgctgaacattttgacggagctcactcagctcagcaagactacgaacgctaaggttgctctgcgagctcggcaggtcctaatagcctcccatcttcctagctacgaacttaggcacaaccaggtcgagtctatcttcttgagcgcgatcgacatgtatggccaccagttttgcattgagaacctccagaagctgattctcagtgagacaagtattttcgacgtgttgcctaactttttctaccactccaatcaggtggtgcgaatggcggcattagaggtatatgtccgtagggcttatattgcatatgaacttaatagtgtgcaacaccgccagctgaaggataatacatgtgttgtggaattccagttcatgctgcctacctcccatcccaatcgcggcaacattcccacattaaacaggatgagcttttcaagcaatctgaatcactacgggatgacccacgttgcgtccgtaagtgacgttttgctcgacaatagcttcaccccaccttgtcagcgtatgggcggtatggtgtccttccggaccttcgaggactttgtccgtatcttcgatgaagttatgggctgcttttcagactcccctcctcagtctccaacatttccagaagctggccatacgtcattgtacgacgaagacaaggtcccacgggacgagccaattcacatcttaaacgttgcaattaagaccgattgcgatatagaggatgatcgactcgccgcaatgttccgagagtttacgcaacagaataaagctacactcgtggaccatgggatacggaggcttacatttctggtggcacagaaggactttaggaaacaggtgaactacgaggtcgatcgacggtttcacagagagtttccaaaatttttcacgtttcgagcacgagacaagttcgaggaggacaggatttatcggcacctggagcccgcactggcttttcaactagaactgaatcgcatgcggaattttgaccttacggctatcccctgtgctaaccacaagatgcacctctatctgggcgctgcaaaggttgaagtgggaactgaagttaccgattacagatttttcgtcagggctataattcggcatagcgatctcgtgaccaaggaagccagcttcgaatacttgcagaatgaaggggagcggttactgctcgaggcaatggacgaactggaggtggccttcaataatacaaacgtgcgcactgactgtaatcatatcttcctgaacttcgtccccaccgtaatcatggatcctagcaagattgaagaaagcgtcaggtcaatggtgatgagatatggttcaaggttatggaagcttagagtcctccaggccgaactgaagatcaatattagactgacacccacgggcaaggccatccctattaggctgttcctgaccaatgagagcgggtactacttagatatcagtctgtacaaagaggtcacggatagcagaactgctcagatcatgtttcaggcatacggggacaagcaggggcctcttcatgggatgctcatcaacaccccatacgttaccaaggacctcttgcagagcaagagattccaggcacagtcacttggtaccacctacatctacgacatccccgaaatgtttaggcaatcattaatcaaactgtgggaatctatgtcaacgcaggctttcctgccatctcccccccttccctcggatatgctcacctatactgaacttgttctcgacgaccagggccagttagtgcatatgaatcgactgcctgggggcaacgagatcgggatggtggcatggaaaatgacatttaaatcccccgaatatcccgaaggccgagatattattgtcattggcaacgacataacataccgtatcggatcattcggccctcaggaggacttgctttttctacgggccagtgagcttgccagggcagagggaatacctagaatctacgtaagtgcgaacagcggggctaggattggcttagcagaggaaattagacacatgttccatgtggcgtgggtggatcccgaagatccgtacaaagggtatcggtatctatacctaaccccacaggattataagcgggtttctgcattgaacagtgtccactgcgagcacgttgaggacgaaggggaaagccgctataaaataaccgatatcatcggtaaagaggagggaattggccctgagaacctgagaggatccggcatgattgccggcgagtctagccttgcctacaatgagattattacaatctctctggtcacgtgcagagcaattggaataggggcttacctggtccgccttggacagcggacaattcaggtagaaaatagtcacctcatcctgacgggcgccggggctcttaacaaagttttggggagagaagtgtataccagcaataatcagctgggtgggatccagattatgcacaataatggagtgacgcactgcaccgtgtgtgatgactttgagggggtcttcacggtcctgcattggctttcctacatgccaaaatccgtccactcttctgtgcctctccttaacagcaaagatcctatcgaccgtatcattgagtttgtgccaacaaagactccttatgaccctcgatggatgctggccgggagaccccaccctacgcagaaaggtcagtggttgtccgggttctttgattatgggagcttttctgagattatgcaaccctgggcgcagacggtcgtggtcggtagggcccgactgggcggtattcctgtgggcgtggtcgccgtggaaacccgaactgtagaattaagcatacctgctgacccagccaacctcgacagtgaggcaaagataatccagcaggccggtcaggtctggttccccgacagcgctttcaagacctatcaggccattaaggattttaaccgagaagggctgccactgatggtgttcgcaaattggcgtggctttagtggtggaatgaaagatatgtatgaccaggtacttaagtttggagcttacatagtggacggcttgagggagtgctgtcagccggtgctcgtctacattcctcctcaggccgagttacgcggcggaagctgggtggtaatcgatagtagcataaacccaaggcacatggagatgtatgctgatagagagagcagagggtccgtcctcgagcctgaaggtacagttgagattaagttcagaaggaaagacctggtgaagactatgcggcgagttgaccctgtctacatccatctggccgaacgcttggggacccccgaactgagcaccgccgaacgaaaagagctggagaacaaactgaaggagagggaagagtttttaattcctatataccaccaggtggcggtacagttcgctgacttacatgataccccagggcgaatgcaggagaaaggtgtcattagcgacattcttgattggaaaacgtctagaacctttttctactggcggctgagacggcttctcttagaggatctcgttaaaaagaagattcataacgccaatcccgagctgacagatgggcagatccaggccatgctgcgaagatggttcgtcgaagtggaagggactgtgaaagcgtatgtctgggataataacaaagacctggcagagtggctcgaaaagcagcttaccgaggaagacggagtgcatagtgtaattgaggagaatatcaaatgtattagcagggactacgtccttaaacaaattcgaagcctggtgcaggcaaacccagaggtcgccatggacagcatcattcatatgacccagcatatttctccaacccagcgagcggaggttattaggatcctatcaactatggactctccgtctacctag

SEQ ID NO: 22695 - DNA, 6867 bp, Artificial Sequence
  Description of Artificial Sequence: Synthetic coding sequence
atggagggcagccccgaggagaacaaggagatgcggtactacatgttgcaacgaagctctatgagtggactacacctggtaaaacaaggccgcgatagaaaaaaaatcgactcccagagagatttcactgttgcttcgcccgcagaattcgtcactcggttcggaggcaacaaagttatcgagaaagtgctgatcgcaaataatggaatcgcagctgtgaaatgtatgaggagtattcgccgctggtcatatgaaatgtttcggaatgagagagccattcgcttcgtggtaatggtgacacctgaggacctcaaggcaaacgcagagtacatcaagatggcggaccactatgtacctgtgcctggtgggccaaataataacaattacgctaacgtggagctgatattggacatcgccaagcgcataccagtccaggctgtctgggctgggtggggccatgcttccgagaatccaaagctccctgagctccttctgaaaaacggcatcgcattcatgggcccaccatcacaggcaatgtgggccctgggagacaaaatcgctagctcgattgtagcgcagaccgccggtattccaacgctgccctggagtggatctggtttacgggtagattggcaggagaatgatttttccaagaggatcctgaatgtcccacaagaactgtacgaaaaagggtatgtaaaggacgttgatgatgggctgcaagcagctgaggaggtaggctacccggtcatgattaaagcctcagagggtggtggcggcaaggggattcgcaaggtcaacaatgcagacgactttcccaatctttttaggcaggtgcaggccgaggtacccggatcacctattttcgtgatgcgcctggcaaaacagtcccgccatcttgaagtgcaaatcttggccgaccagtacggtaatgcgataagcctgttcggccgggattgctccgttcagagacggcaccagaaaatcatcgaagaagcccccgctaccatcgcaacacccgctgtgttcgaacatatggagcagtgtgccgttaagcttgccaaaatggtaggctacgtgtctgccggcactgtcgaatatctttattctcaagatggcagcttttatttcctggagctcaaccctagactgcaggttgagcacccttgcacagagatggtggccgatgttaatttgcctgctgcccaacttcaaatcgccatgggcattcctctatatcggatcaaagacatccgcatgatgtatggcgtctccccatggggggactctccaattgatttcgaggactctgcgcacgtgccctgccccagagggcacgtgattgcagcaaggatcactagcgagaatcccgacgaagggttcaagcctagcagtggaacagtgcaggaactgaattttaggtcaaacaagaatgtttggggatatttctctgtggccgctgccggtggccttcacgagttcgcggattcacagtttggtcactgtttctcctggggcgaaaaccgtgaggaagcaattagcaacatggtagttgccctgaaggagctgagtattcgcggggactttaggactacagtggaatatttaattaagctgctggaaactgagtcttttcaaatgaaccggatagacaccgggtggcttgatcgccttatcgcagagaaggtgcaggccgaacggccggacacgatgcttggggtggtttgcggcgctttgcatgtcgccgacgtaagcctgagaaactctgtgtccaacttcctgcatagtctggagcgtggccaagtgctgcccgcccacaccttacttaatacagttgacgtcgagcttatctacgaaggggtgaagtacgttcttaaggtgacacgccagtctccaaattcctatgtcgtgatcatgaacggcagttgcgtggaagttgatgtacacaggcttagcgatggcggattgctcctttcctatgatggcagctcctatacgacatacatgaaagaagaagtggaccggtatcgtataaccattgggaataagacatgtgtgttcgaaaaagagaacgaccctagtgtgatgagatctccctcagcaggcaaactgatccagtatattgttgaagatggaggacatgtgttcgccggacagtgctatgctgagattgaggttatgaaaatggtgatgactctcaccgccgtggagtccggctgtatacactatgtgaagaggccaggagctgctcttgatcccggctgcgttctggcaaagatgcagctggataatccatccaaagttcagcaggcagagctccataccgggtccctgccccgcatacagagtacagccctccgcggtgagaaactgcatcgagtctttcattacgtgctggataatctggtcaatgtgatgaacggatattgcctgcccgatccattcttctcctccaaagtgaaggattgggtcgagcgcctcatgaagactctgagagaccccagcctgcccctgttggagctgcaagatatcatgacttctgtgtccggaagaatcccaccaaacgttgagaagtccattaagaaagaaatggcccagtacgcaagcaacatcacttccgtgttgtgtcagtttccgagccagcagatcgccaacattctggactctcatgcagccacactcaatcggaaaagtgagagggaggtgtttttcatgaatacccagtctatcgttcagctagttcagcgatatagaagcggaattagaggccatatgaaagctgtggtgatggatctcctccggcagtacctaagagtggaaacacagttccagaatggacactacgacaagtgcgtctttgccttgagagaggaaaacaaatccgacatgaacaccgttcttaattacatctttagtcatgcacaggtcactaaaaagaacctcctagtcaccatgctcatcgatcagctgtgtggtagggacccgacactgactgatgagctgttaaacatactcactgaactgacccaactgtctaagaccaccaatgccaaggtcgctttgcgcgcaaggcaggtgcttatcgcctcccacctgccaagttatgagctgaggcacaaccaggtggagagcatttttctctccgctatcgatatgtacggtcaccaattctgtattgaaaacctgcagaagctaatcctgagtgaaacatccatttttgatgttctgcccaatttcttttaccatagcaaccaagttgtgcgtatggccgctctcgaggtgtacgtgaggagagcatacatcgcatatgaattgaacagtgtccagcatagacagttgaaggataacacatgcgtcgttgaatttcaattcatgctgccaaccagtcatcctaaccgtgggaacatccccacactcaaccgcatgagcttctcgagtaatctgaaccattatggaatgacacacgtggcgtcagttagcgatgttctccttgataactcttttacacctccttgccagcgcatgggaggtatggtgagctttaggactttcgaagacttcgtgaggatctttgatgaggtcatgggatgcttttccgattcgccaccccagagtccaactttccccgaggcaggtcacacatccctgtatgacgaggataaagtccctagggacgagccaatccatattctgaatgtcgcaatcaaaaccgattgtgatattgaggatgacagactcgccgctatgttccgagagtttacgcaacagaacaaagccactctggtggaccacggcatccggcgcctgacctttttggtggcacagaaggactttcgtaaacaagttaattatgaagtggaccggcggttccaccgcgagttccctaagtttttcaccttccgggctcgtgataagttcgaagaggatcggatctatcggcacctggagcctgcactggccttccagctggagttaaatcggatgagaaattttgatctcaccgctataccatgcgctaatcacaaaatgcatctgtacctaggggccgcaaaagtggaggttgggactgaggtcaccgactacagattcttcgtacgagccatcatacgccattccgacctcgtcaccaaggaagcaagctttgagtatctgcagaatgagggtgaaaggctgcttctggaggccatggacgaacttgaggtggcattcaacaatacgaatgttcgaacagactgtaatcacatttttctgaattttgtgccgaccgtcattatggacccatcaaagattgaagagagtgttcgctctatggtgatgcgctacggcagccgtctgtggaaacttcgcgtcttgcaggcagaactaaagattaacattagactcacacctaccggaaaggctatccccattaggctgttcttgacaaacgaatcagggtactacctggacatttccctgtacaaagaagttacagattctaggaccgcgcagatcatgtttcaggcatatggcgataagcagggcccgctccatgggatgttgattaacacaccctatgtaaccaaggacctccttcaatccaagaggttccaagcccagtccctgggaaccacctacatctacgacatacccgagatgtttcgacagtcactgatcaaactgtgggaatcaatgtctacacaggccttcctgccgtccccgcccctcccctcggacatgctgacttacacggagctggtgctggacgaccagggccagctcgtgcacatgaatcgcctgccaggcggtaacgaaatcggcatggttgcttggaaaatgacatttaagtctccagagtacccagaggggcgtgatatcatcgtgatcggcaatgacattacttatcggataggctcgttcggtcctcaagaggatttgctctttctgagagcgtccgaactggccagagccgaggggattccacgcatatacgtgtctgccaatagtggagcaaggatcgggcttgcagaggagattagacacatgttccacgtcgcgtgggtggatcctgaagacccatacaagggataccggtacctttacttgacccctcaagattacaagcgtgtctcagcgcttaatagcgtacattgtgaacacgtcgaggacgagggcgagtcgcgttacaagatcaccgacatcattgggaaggaagaaggcataggccccgagaacctccgcgggagcgggatgatcgccggcgaatccagcctagcgtataacgagatcatcaccataagtctggtcacctgtcgagctataggaatcggagcgtatttggttcgcctaggacagcggaccatccaggtggaaaactctcacctgattctgactggggcgggggctctcaacaaggttctcggacgggaagtgtatactagtaataatcagctcggcggtatccagatcatgcacaataacggtgttacacactgcaccgtatgcgatgattttgagggggttttcaccgtcctgcactggctgagctacatgccaaagtctgtgcatagtagtgtgcccctgctaaattctaaggatccaatcgaccgcatcatcgaattcgtccccaccaaaaccccctacgacccccgatggatgcttgcagggagacctcacccaacccagaaggggcaatggctctccggcttcttcgattacggatcattcagcgaaatcatgcagccctgggcccagactgtagttgtgggaagagcacggctgggtggtatccccgtcggagttgtcgccgtagaaaccaggacagttgaactgtccatcccagctgacccagccaacctggacagtgaggctaaaatcatccagcaggcgggacaggtttggttccctgattctgcttttaagacctaccaggcaattaaggacttcaaccgggaggggctgccgctgatggtgttcgccaactggagggggttcagtgggggcatgaaggacatgtacgaccaggtgctcaagttcggagcctacatcgtcgatggtctgcgggaatgctgccagcctgtcctggtgtacattcccccccaggccgaactgaggggtggatcatgggtggtgattgactcttcgataaacccgcggcatatggaaatgtacgccgatcgggagtcaaggggcagcgtcctggaacccgaaggcacagtcgagataaagttccgacggaaggatttggtcaaaactatgcgccgcgtagatccagtctatattcacctcgccgagcggctcggaaccccagagctctccactgctgaaagaaaagaactggagaacaagcttaaggagcgcgaagagtttctcatcccaatctaccaccaggtcgctgtgcagttcgccgatcttcacgatacacccggacgcatgcaggaaaagggggtgatctctgatatactcgactggaaaacaagcaggacatttttttattggcggctgcgacgtctgctgctcgaggaccttgtgaagaagaagattcacaacgcaaacccggagcttacagatgggcagatccaagcgatgctgcggcggtggttcgtcgaagttgaagggactgtgaaagcttacgtctgggataataataaagacctagcggaatggctggagaagcagttaacggaggaagatggtgtccactctgttattgaggagaacattaaatgcatcagcagggactacgtgctgaaacaaataaggagcttggtgcaggccaatccagaagtggcgatggacagtatcatccacatgactcagcacatttctcccacgcagagggccgaggttatccggatcttgtcgactatggatagcccttctacatag

SEQ ID NO: 22696 - DNA, 1419 bp, Artificial Sequence
  Description of Artificial Sequence: Synthetic coding sequence
atgcacaacaacggcgtgacccactgcaccgtgtgcgacgacttcgagggcgtattcacagtgctccactggcttagctatatgcccaagagcgtacacagttccgtgcctctgcttaacagtaaagatccaatcgaccgcataattgagtttgtgccaactaaaacaccatacgatccccggtggatgctggccggtaggccccatcctacacagaaggggcaatggctttctggattctttgactacggatctttcagcgagatcatgcagccctgggctcaaacggttgtggtcgggcgggctaggctgggcgggatcccggtgggcgtcgtagcggtggaaaccaggaccgtggagctatcgatcccagctgacccggcaaatctcgactcggaggccaagattattcaacaggcgggacaggtttggttccccgattcagcattcaagacttaccaagccatcaaagactttaaccgggagggcttgccactcatggtattcgccaattggaggggctttagcgggggcatgaaagacatgtacgaccaggtactgaaatttggggcatacattgtggacgggcttcgagagtgctgtcagccagtgctcgtgtatatccctccccaggccgagctacgcggagggtcatgggtcgtcatagattcatctattaacccaaggcacatggagatgtacgccgacagagagtcccgaggatctgtgttagagcctgaggggacagtggagatcaagttccggagaaaagaccttgtgaaaacaatgcgcagagttgatccagtgtatatccacttggcagaaagactggggacccctgagctgagcactgccgaacgcaaggagctggagaataaacttaaggaacgagaagaattcttgattcccatctatcatcaagtagctgttcaattcgccgacctgcacgacactcccggccggatgcaagagaaaggcgtgattagtgacattctggactggaagaccagcagaaccttcttttactggaggttgcgccggttgctcctggaggacctggtgaaaaagaaaattcacaacgccaatcctgagctaacggacggacagatccaggctatgctgcggcggtggtttgtggaagtggaagggaccgttaaagcatatgtctgggacaacaacaaggacctagccgagtggcttgaaaagcagctgacagaagaggatggcgtgcactcagtgatagaggagaatatcaaatgcattagtagggattacgtcctcaaacagatccgctcattggtacaggcaaatcctgaggtggccatggactctatcatacatatgacacaacatatttcccccactcaaagggcagaagtgattcgtatattgagcacaatggactcccctagcacctag

SEQ ID NO: 22697 - DNA, 129 bp, Artificial Sequence
  Description of Artificial Sequence: Synthetic coding sequence
atgagcggcctgcacctggtgaagcagggccgggaccggaagaagattgacagtcagcgggattttaccgtggcttccccggctgaatttgtgactagattcggagggaacaaggtgatagagaagtag

SEQ ID NO: 22698 - DNA, 7041 bp, Artificial Sequence
  Description of Artificial Sequence: Synthetic coding sequence
atggacgagcccagccccctggcccagcccctggagctgaaccagcactcgcgctttatcatcgggtccgttagcgaggataactccgaagacgagatttctaacctcgtgaaacttgatttgctcgaagagaaagagggatccctgagccctgctagtgtgggctctgataccttgtcagacttgggcatctccagcctccaggatgggttggccctgcacatccgcagtagtatgtccggactccacctggtcaaacagggcagagatcgaaaaaaaatcgattcccagcgggattttacagttgcttcgccagctgagtttgtcacgcgattcggtggcaataaggttatcgagaaggtgctgattgccaataacggcatcgccgccgtgaagtgcatgcggtccatccgacgatggtcatacgagatgttcaggaacgagcgggcaatccggtttgttgttatggtgacgcccgaagacctgaaagctaatgcagagtatatcaagatggctgaccactacgtcccagtgccaggtggacccaacaacaataactacgccaacgttgagctaattctagatattgcgaaacgcatccccgtacaggccgtgtgggctggttgggggcacgcaagcgagaaccccaagctccctgagctcttgctgaaaaatggaatcgcctttatgggtcctccttcacaagccatgtgggcgctgggcgacaagattgcatcttccatcgttgcgcagacggctggcatccctaccctcccatggtccgggagcggtctaagagtggattggcaagaaaatgatttcagcaaaagaattctgaacgtgccccaggaactgtacgagaagggctacgtcaaggatgttgatgacggtctccaggctgcagaggaggtgggctaccccgtgatgattaaagcaagtgagggcggcgggggcaagggtatcaggaaggtgaataacgcagatgactttcccaacctgttcaggcaggtacaggccgaggtgccggggagcccaatctttgtgatgagactggcaaagcagagcagacatctggaggttcaaattctggcggaccagtacggcaacgccatttcactctttggtcgcgactgctccgtgcaaagacggcaccagaaaatcattgaagaggcgcctgcaacaattgccacacccgctgtgttcgagcacatggaacagtgcgcggttaagctggccaagatggtcggctacgtgtctgctggaactgtggagtacctttacagtcaagacggctccttttacttcctggaactgaacccaaggctccaggtagagcacccttgtaccgaaatggtggctgacgttaatctgcctgcagcacaactgcaaatcgctatgggtatccctctataccgaattaaggacataaggatgatgtacggggtgtccccctggggtgattctcccatcgacttcgaggattctgcacacgttccctgccccagagggcacgtgattgccgcaaggattacatccgagaaccctgatgagggcttcaaaccatcgagtggcaccgtccaggagttaaatttccgtagcaataagaatgtctgggggtatttcagcgtcgctgccgcggggggtctacatgagttcgctgattcacagttcggacactgtttcagctggggagagaaccgggaagaagctatctcaaatatggtcgtagctctgaaggaactgagcatccgtggcgactttcgtaccacggtggagtaccttatcaagctgctggagaccgaaagtttccaaatgaaccgcattgatacaggctggcttgaccgcctgatcgcagaaaaagtgcaggccgaacgccccgacacaatgctgggggtagtgtgcggcgctctccatgtggcagacgtgtctcttagaaattcagtgtctaacttcctgcactccttggagcggggtcaagtgctcccggcccacaccctgttaaacaccgtcgatgtggaactgatctacgagggcgtgaaatacgtcctgaaagtcacaaggcaaagccccaacagttacgtagttataatgaacggttcctgcgtggaggtagacgtgcaccggctctctgatggtggtcttttactgagctatgatggatcatcctatactacgtacatgaaagaggaggtcgatcggtaccgtattacgatcggaaacaagacctgtgtattcgagaaggaaaatgatccttcggtcatgcgcagcccatccgccggaaagttaatacagtatatcgttgaggacggaggccacgtgttcgcaggccagtgttacgccgagatcgaagtaatgaagatggtgatgacactcaccgctgttgaatctggatgcattcactatgtaaagcgccccggagccgccctggatccagggtgtgtcttggccaaaatgcagctcgacaacccttccaaagtgcagcaagcggagctgcacacaggctctttgccccggatccagagcaccgccctaagaggcgagaaactgcaccgcgtattccactacgtactcgacaacctagtgaacgtcatgaacgggtactgcctgccagacccttttttttcctccaaggtgaaagactgggtagagaggctgatgaaaaccctgagagacccgtctctgcctcttctggagcttcaggacataatgacgtcagtttcagggcgcattcccccgaatgtggagaaatccattaagaaggagatggctcagtacgcgtcaaatatcaccagcgtgctgtgccaattcccatcccagcagatcgccaacatacttgacagccatgctgcaacactcaatcgtaagagtgaaagggaagttttctttatgaatacgcagtccatcgtccagttggtgcagcgttatcgtagcgggatcaggggacacatgaaagccgtggttatggatctgctgaggcagtacctgcgcgttgagacacaatttcaaaatgggcactatgacaagtgcgtgttcgcccttcgcgaggagaacaaaagcgatatgaataccgtgctgaattatatctttagccatgcccaggtaacaaagaagaacttgctggtaacaatgctgattgaccagctttgtggccgcgatcccacgctcaccgatgagctgctgaacatcctgaccgagctgactcagttatctaagacaaccaacgcgaaagtggcactccgggctcgacaggtcctgattgccagccacctgccttcctacgagttgcgccacaatcaagtggaatcaatcttcctgagtgcaatcgacatgtatgggcaccagttttgcatagagaacctgcaaaagttaatcttgagtgaaacgtcgatattcgacgtgctgccaaactttttttaccacagtaatcaggtggtgcgaatggcagccttagaagtttacgttcgtcgtgcctatattgcctacgagcttaatagcgtccaacacagacagctcaaggacaacacctgtgtggtcgaatttcagtttatgctgccgacctcccacccgaacagaggcaacattcctactctgaacaggatgtccttctcatcaaatctgaaccactacggcatgacacacgtcgcgtccgtgagtgatgtcctactcgataatagtttcacaccgccctgccagcgaatgggagggatggtgtcttttagaaccttcgaggactttgttcggatcttcgacgaggttatgggttgtttctccgatagccccccccagtcccctacgttcccggaagcaggacataccagcctctacgatgaagacaaagttccaagagatgagcctattcacatcctgaacgtcgcaattaagacggactgcgatatcgaagatgataggctcgcggctatgtttcgtgagtttacacaacagaacaaggccacactggttgatcacgggattcgaagactgacctttctagtagcacagaaagattttcgaaaacaggtgaactacgaggtcgaccgccgttttcaccgggaattccctaagttcttcacgtttcgcgccagagataaatttgaggaggaccggatttaccgtcatttagagcccgcactcgcatttcagttagagttgaacagaatgcgaaattttgatttaacagcaataccgtgcgccaatcacaaaatgcatttatacctcggagcagctaaagtagaagtggggaccgaggtcactgattatcgctttttcgtacgggctatcataagacacagcgacctggtcaccaaggaggccagcttcgagtacttgcaaaacgaaggggaacgcctgctcctggaggcaatggacgagcttgaggtcgcattcaataacaccaacgtccgcacagactgtaaccatattttcctcaatttcgtgcctactgttattatggatccatctaagattgaggagtctgtgcggtctatggtcatgaggtatggatcacgcctctggaagctaagggtcttgcaggctgaattgaaaattaacattagactgaccccaacagggaaagccatcccaattcggctgttcctaacaaacgaatcaggatattacctcgatatcagcttgtacaaggaagtcaccgatagccgtacagcgcagattatgttccaagcgtatggagataagcagggccctctgcatggcatgctgatcaatacaccctatgttaccaaagacctgcttcagtctaaaaggttccaggcacaatccttgggaaccacctacatctatgacattcccgagatgttccgtcagtctctcataaagttatgggagagcatgtctacacaggcattcctgcctagcccccctttgccatccgacatgctcacctatacagagctcgtgctcgacgaccaaggccagctggtgcacatgaaccgtctcccagggggcaatgaaattggtatggtcgcgtggaagatgaccttcaagtcaccggaatatcccgaggggcgggacattatcgtcatcgggaacgacatcacctatagaatcgggagtttcggaccccaggaagacctgttgtttttacgcgcttcagagttagctagggcagaggggatcccccggatctatgtgtccgccaatagtggtgcaagaatcggcctggctgaggagataagacatatgtttcacgttgcgtgggtggatcctgaagatccctataagggttatcgctacctatatctaaccccgcaggactataaaagagtgagtgctctcaactctgttcactgcgagcatgtggaagacgaaggcgaaagcaggtataagatcaccgatatcatcggcaaggaggaaggtattggccccgagaaccttagaggtagcgggatgatcgcgggggaatctagtttggcctataatgagatcatcacaatctcccttgttacttgtcgtgccatcggaattggagcgtatctggtccgtctcggccagaggaccattcaggttgagaactctcacctgattctgaccggtgctggagcccttaacaaggttctgggtagggaggtgtacacatcaaacaaccagctaggagggatacagatcatgcataataatggcgtgacacattgtacagtctgcgatgattttgagggcgtgtttaccgtgctgcattggctgtcttacatgccaaaatcagttcacagtagcgttcccctcctgaattccaaggaccccatcgataggatcattgagtttgtgcctacaaagactccttacgacccacggtggatgctcgcaggccgcccccacccaactcagaagggacagtggctgtcgggtttttttgattatgggagcttttccgagatcatgcagccatgggcccaaacagtggtggtggggcgggcacgcctgggaggaatacccgtcggggtcgtggctgtggagacaagaacggtcgaactcagtatacccgcagacccggcaaaccttgattccgaagctaaaattattcaacaggccgggcaggtctggttcccagacagcgcctttaaaacctaccaggccattaaggatttcaatagagaagggttgcctctgatggtgtttgccaattggcggggattttccggcggtatgaaggacatgtacgaccaggtgttgaaatttggggcatatatagtggacggtctgagagagtgttgtcaacccgtccttgtctatatcccgcctcaggctgagctacgtggcggatcttgggtcgttatcgacagctccatcaatcctaggcacatggaaatgtatgctgatcgcgagagcagaggctccgtattggagcccgaagggaccgtcgaaatcaagtttaggcgcaaagatctagtcaagactatgcgccgggtggacccggtctatattcatttggccgagagactgggcacgcctgagttatcaactgctgaacgtaaagaactggagaataagctgaaggaaagagaggaatttctgattccaatctatcaccaggtggcagttcagtttgctgatctgcacgatacacctgggaggatgcaggaaaaaggagtgatctcggatatcctggattggaagacttccagaacatttttctattggcgacttcgccgcctgcttctcgaagatctcgtgaagaaaaagatacataatgcgaatcccgagctaacagatggacaaatccaggcaatgctgagaaggtggttcgtggaggtggaggggacagtgaaggcttatgtgtgggacaacaacaaggacctggctgaatggctcgagaagcagctaaccgaagaagatggggtgcattcagttatcgaggagaacattaagtgtattagtagagattatgtcttaaagcagattcgcagtttagtacaggcaaacccagaggtagccatggattccatcatccatatgacccaacatatttctcctacccagcgggccgaagttattcgtatactgtcaacaatggactcgcctagcacgtag

SEQ ID NO: 22699 - DNA, 129 bp, Artificial Sequence
  Description of Artificial Sequence: Synthetic coding sequence
atgagcggcctgcacctggtgaagcagggccgggaccggaagaagatcgatagtcaacgggacttcacagtagcaagcccagccgagtttgtcactagatttggtggaaacaaagtgattgaaaaatag

SEQ ID NO: 22700 - DNA, 234 bp, Artificial Sequence
  Description of Artificial Sequence: Synthetic coding sequence
atggacgagcccagccccctggcccagcccctggagctgaaccagcactcacggtttattatcgggtccgtgtctgaggacaactccgaggatgagatctctaacctggtcaaactcgatctgcttgaggaaaaggaggggagtctcagtcccgcctcagtgggctccgatactctgtctgatctgggcatctcttcccttcaggatggactagctctgcacattcgtctgtag

SEQ ID NO: 22701 - DNA, 3138 bp, Artificial Sequence
  Description of Artificial Sequence: Synthetic coding sequence
atgggctgcttcagcgacagccccccccagagccccaccttccccgaggcgggccacacttctctgtacgatgaagacaaggttcctagggacgaacccattcacattttgaatgttgctataaaaacagattgtgacatagaggatgaccgcctcgctgctatgttcagagagtttacccagcagaacaaagcaaccctggtcgatcatggcattcgaagactgacctttctggtcgcccaaaaagattttagaaagcaggttaactacgaagtggacaggaggttccatagggagttccctaagttctttacatttcgcgcccgggataaatttgaggaagaccgaatatatcgacatcttgaacctgctttggcctttcagttggagctgaacagaatgcggaatttcgatctaaccgccataccttgcgctaatcataagatgcacctatacctcggcgccgctaaggttgaagtgggcaccgaggttacagattaccgcttcttcgtgcgggccatcatcagacacagcgatctcgttacgaaggaggcttcattcgagtacctgcagaatgaaggcgagcggctacttctcgaagccatggatgagctggaagtagcctttaacaacactaacgtccggactgactgcaaccacattttcttaaacttcgtaccaacagtgattatggacccttctaaaattgaggaatctgtgcgttcaatggtgatgcgctatggctcgaggctttggaagctgagggtgttgcaagctgaactgaagattaacatccgccttactccaactggcaaggctatccctatccgactcttcttgactaacgaatcaggctattaccttgacatttccctgtacaaggaagtgaccgacagccgcacagcccagatcatgtttcaggcttacggggataagcagggcccgctccatggtatgctgatcaatacaccctatgtcaccaaggatctgttacagtccaagaggttccaggcacaaagcttgggaactacctatatatacgacatcccagaaatgttcaggcagatcggaatggtggcctggaaaatgacctttaaaagcccagaataccctgaagggagagacattatagtcatcggcaatgatatcacataccggataggctcatttggaccacaggaggacctcctgttcctgcgcgcgtctgaattggcccgggctgagggaataccccgcatctacgtctctgctaactcaggggcccgcattggcctggcggaggaaataagacatatgttccacgtggcttgggtcgaccctgaagatccctataagggataccggtacctttatctgactccacaggactacaaaagagtgtccgccttaaatagcgtgcattgtgagcacgtggaagatgagggcgagtctagatataagataacggacatcatcggaaaggaggagggcataggacctgagaatttgcgtggttcaggcatgattgccggagaaagctcacttgcttataatgagataatcacgatctcgcttgtgacttgcagagccatcgggattggagcctacctcgtaagacttggtcaacgtacaatacaggttgaaaactctcatcttatcctcactggtgcaggagcacttaacaaggtcctcggaagggaggtttacaccagtaataaccagttgggtggaattcagattatgcacaataatggcgtgacccactgcactgtctgtgacgacttcgagggggtctttaccgtcctacactggctgtcttacatgcctaaatccgttcacagcagcgtgcctctgctgaactctaaagaccctatagaccgcattatcgagtttgtacctactaagaccccctatgatccacggtggatgcttgctggccgccctcaccctacacagaaaggccagtggctgtcaggatttttcgactacgggagcttcagcgaaatcatgcagccgtgggctcagacagtcgttgttggccgcgcgaggctgggaggcatccccgtgggcgtggtggctgttgaaacaagaactgtcgaattgtcgatcccggcagatccagccaatcttgactcggaagcgaagattatccaacaggctggccaagtttggttccctgactccgctttcaagacatatcaagccataaaagactttaaccgggagggtttgcccctcatggtgtttgctaattggaggggattttcaggtggcatgaaagacatgtacgatcaggttttgaaattcggagcatatattgtggatggactacgggaatgctgtcagccagtcttggtgtatattcctcctcaggccgaactgaggggcgggtcctgggtcgtgatcgattcctcaataaacccccgccatatggaaatgtatgccgacagagaatcacgtggcagcgtcctcgagcccgagggcacagtggagattaaattcaggcgcaaggatctggtcaaaacgatgcgaagagttgaccccgtatatatacatctggctgaacggctgggcacgcccgagctgtccaccgctgaacggaaggagttggaaaacaaattgaaggaaagggaagagtttttgataccaatttatcaccaggttgccgtgcagttcgctgatttacacgacacaccagggcgaatgcaggagaagggggttatcagtgatatccttgactggaagacaagtagaacattcttttattggcggctgcggcggctcctcttggaggatttggtgaagaagaaaatccacaacgcgaatcccgaactgaccgacggccagatccaagcaatgctgagacgctggtttgtggaggtggaaggcaccgttaaggcttacgtctgggataacaataaggacctggcagagtggctggagaagcagttgacagaggaagacggtgtgcattctgtgatcgaagagaacataaagtgtatctcccgcgattatgtgttaaaacaaatccggagcctcgtccaagctaatccagaagtggccatggacagcataatccatatgacccagcacatcagcccaacgcagagagctgaggtgatcaggattctgagtacaatggactcacccagtacatag

SEQ ID NO: 22702 - DNA, 363 bp, Artificial Sequence
  Description of Artificial Sequence: Synthetic coding sequence
atggacgagcccagccccctggcccagcccctggagctgaaccagcattcccggttcataatcggcagcgtctctgaggacaacagcgaggacgagatctctaacctagtaaagctcgacctgctggaggaaaaagaaggttctctctcacccgcgagtgttgggtccgatacactctccgacctggggattagctcattacaagatggtttggcgctccatattcggagctccatgtcgggtctgcatttagttaaacaggggcgcgaccggaagaaaattgatagccaacgcgactttaccgtagctagcccagctgaattcgtgactcgcttcgggggaaataaggtgatcgagaaatag

SEQ ID NO: 22703 - DNA, 7113 bp, Artificial Sequence
  Description of Artificial Sequence: Synthetic coding sequence
agcttctggaagtggatcagcacccagaccgtgcggatcatccgggccgtgcgcgctcattttggaggcatcatggacgaacctagtccgttggctcagcctttggaactgaaccagcactcccgctttatcattggctcagtgtctgaggacaattccgaagatgaaatctctaatctcgtgaagctagatcttctggaggagaaagaaggcagcctgagcccggcaagcgtgggcagcgatacgctgagcgacctgggaatcagcagtctgcaagatggtctcgccctgcatatacgctcatctatgagcgggctgcaccttgttaagcaaggccgcgaccgcaagaagatcgattctcagagagactttaccgtggccagccccgccgaatttgttacaaggtttgggggaaataaggtgatcgaaaaggtcctcatcgctaacaacggcatcgctgccgtcaaatgcatgagatcgatccgtcggtggtcttacgagatgttccgaaatgagagggctatccggtttgtcgttatggtgacacctgaagatttaaaagctaacgccgagtacatcaaaatggcagatcattatgtgccggtgccaggtggcccaaataataataactacgccaatgtggagctgatccttgatattgcaaagcgcataccagtccaagccgtatgggccggatggggacacgcctccgagaatcctaaactccccgagctcctgctgaagaacggtatcgcatttatggggcctccttctcaggctatgtgggcgctcggggataaaatagctagttctatcgtcgcgcagactgcagggattcccaccctgccctggtccggatctggccttagagtggattggcaagaaaatgatttctccaagcggattctgaacgtgccacaagaattatacgagaaaggctatgttaaggacgtcgacgacggtcttcaggccgccgaggaggtaggctatcccgtgatgattaaggcatccgaaggtggaggtggaaagggcatacgaaaggtgaacaatgccgatgattttccaaacttgttccgtcaggtgcaggccgaggttcccggatcacccatctttgtgatgcggctagcgaaacaaagccggcacctggaagtgcaaatcttggccgatcaatatggtaacgcgatctcgctctttggaagagactgctccgtccagagacgacatcagaaaatcatcgaggaggcaccagccacaatcgctacgccagcagtttttgagcacatggaacagtgtgccgtgaagctggccaagatggtcggatatgtatccgctggaaccgtcgaatacctgtactcccaggatggcagcttctactttctcgaactcaatcctcggctgcaagtcgagcacccttgtacggaaatggttgccgacgtcaatctccccgcagcccagctgcagatagccatgggaattccattgtatagaattaaggacatacggatgatgtatggggtgtccccatggggagactcccctatcgacttcgaggacagcgcccacgtgccttgtcctcgtggccacgtgattgctgcacgcattacaagtgaaaaccctgacgaaggctttaaaccttctagcgggacagtccaggaacttaatttcaggtcgaataaaaatgtatggggatatttctcggtggcggcggcagggggcctacacgagtttgcagactcccagtttggacactgttttagttggggggagaaccgcgaggaagctatctccaatatggtggtcgccttgaaagagttgtctatcaggggcgacttcaggactacggttgagtatcttatcaaactgctcgagaccgagagtttccagatgaaccgcatcgacactggctggctggatcggcttatagccgaaaaggtgcaggcagagaggcccgatacgatgcttggggttgtgtgtggagcattgcacgtagcagacgtgtctttacgtaatagcgtttcgaacttcctccatagcctggagcggggccaagtactacccgcccatacccttctcaacacagttgatgttgaactgatctacgagggcgtgaagtacgtgcttaaggtgactaggcagtcaccaaatagttatgttgtcattatgaacggctcttgtgtggaagtagatgttcacagactcagcgatggcggtctcctcctatcctatgacggatcaagctatacaacatacatgaaagaagaggtcgaccggtatagaattacaatcgggaataagacctgtgtttttgagaaggaaaacgatccatcagtcatgcgatcccccagcgcgggcaagcttatccagtacatcgttgaggatggaggacacgtgttcgccggacagtgttacgctgagatcgaagtcatgaaaatggttatgacattaaccgccgtagagtccggctgtatacactacgtaaaaagacctggagccgccctcgatcctggctgtgttctggccaagatgcaactggataaccctagcaaggtgcagcaggcagaactgcacacgggatccttgccaagaatccagtccacggcccttaggggggaaaagctgcacagggtattccattacgtgttggataacctcgttaatgtgatgaacggctactgcctacccgacccctttttttcaagcaaggtcaaggattgggtggaaaggctgatgaagactctacgagatcctagtttacccctcctggaacttcaagacataatgacttccgttagcggccggattccacccaatgtggaaaaatctatcaagaaggaaatggcccaatatgcttccaatatcacatccgtcctttgccagttcccgtctcaacagatagccaacatactcgacagccacgcagccactttgaatagaaagagtgaacgtgaggtattctttatgaacacgcagtctatagtacagctggtccagcgatatagatctggtattcgcgggcatatgaaggcagtggtaatggacttgctaagacagtatctgcgggtagagacccagttccagaatgggcactatgacaaatgcgtgttcgccctgcgtgaagagaacaaatccgatatgaacacagtgctgaattacatcttctcgcacgctcaggtgacaaagaagaacctgctcgtgacaatgctgattgatcagctttgtggaagagaccccactctaaccgacgaactgctgaatatcctaacggaactgacacaactgagtaaaactactaatgcgaaggtcgctctcagggctagacaggtgttgatagctagccacctccccagctacgagttaagacataatcaggttgagtcgatttttttatctgctattgatatgtatggacaccaattctgcattgaaaaccttcagaaactcatcttgagcgaaacttctatatttgatgtgctgcctaatttcttttaccattctaatcaagtcgtgagaatggctgcgttggaagtgtacgtaaggagagcttacattgcctacgaactgaacagcgtgcagcataggcagttgaaggacaacacttgtgtggtagaattccagtttatgctccctactagccatcccaatcgaggtaatattccaaccctgaatagaatgtccttcagttccaatctaaatcattacggaatgactcacgtcgcttcagtttccgacgtgctattggacaactcctttacacctccgtgtcagcgtatgggtggcatggtgagctttaggaccttcgaggattttgtgcggatctttgatgaggtgatgggatgttttagtgattcaccaccccagagtcccaccttcccagaggccggacacacgagcctgtatgacgaagacaaggtgcctcgtgacgagcccatccatattctgaacgtcgcaatcaagaccgactgcgatattgaggatgatcggcttgcagctatgttccgagaatttacgcagcagaacaaggcaacgctggtggaccacggcatcaggcgcctgactttcctagtggcccagaaagattttagaaagcaggtcaactacgaggtcgaccgcaggttccaccgggagttcccaaaatttttcacatttcgggcacgtgataaatttgaggaggaccggatttaccggcacctggagcccgcactagccttccagctcgaactcaacaggatgaggaacttcgatcttactgcgatcccttgcgccaaccataagatgcatttgtatctcggggctgctaaggtggaggtgggaaccgaagtgaccgactaccgcttttttgtgagagcgataatcaggcacagcgacctggtaactaaggaggccagcttcgaataccttcagaatgagggtgaaaggctcttattggaagcaatggacgagctggaggttgccttcaacaataccaatgtgcggacggattgcaaccacatatttctgaactttgtcccaactgttatcatggatccaagcaagatcgaggaaagcgtcaggagcatggttatgagatatggaagccggctgtggaaacttagggtgctccaggcagaattgaaaattaacatcaggctgacccctacaggtaaagctattccgatccggctgttcctcaccaacgagagcggctactatctggacatttctctctacaaggaagtcactgacagccggactgcgcagataatgtttcaggcttatggggataaacagggccccctgcatgggatgctgatcaatactccctacgtcaccaaggatctgctgcagtccaagcgctttcaagcacagtctctgggaacgacttatatttacgatattcccgaaatgttcaggcagagcttgatcaagctgtgggagtcaatgagtacacaggcttttctgccctccccaccattaccctccgacatgttgacctacacagagctggtactggatgaccaaggccagctggtgcatatgaatagactcccggggggcaatgaaattggaatggtggcctggaagatgacctttaagtccccagaataccccgagggccgtgatataatagtgattggcaatgacatcacctataggattggctcctttgggccacaggaggacctgctgtttctccgtgcgagtgaacttgcgcgcgccgagggcattcctcgcatatacgtcagtgccaattctggcgctaggatagggctcgctgaggaaattaggcacatgtttcatgtcgcctgggtggacccagaggacccttataaagggtaccggtacttgtatcttacccctcaagactacaagagggtcagtgctttgaatagtgtgcactgtgaacacgtggaagacgagggagagtcaagatataagatcaccgacattatcgggaaagaggaaggaattggtccggaaaatctgagaggatccggaatgattgcaggagagagttccttagcctacaacgagatcattacaataagcctagttacgtgccgggcaattggaatcggtgcttatttagtgcgcttagggcagagaactattcaggttgaaaactcgcacctgattcttacaggtgccggggctctgaacaaagtccttggtcgtgaggtctacacttccaataaccagctgggtggaatccagatcatgcacaataatggggtcactcactgcaccgtgtgcgatgatttcgagggggtgtttaccgtgctacactggctgtcgtatatgcctaagtcagtacactctagtgttccactcctcaatagtaaggatccaatcgatagaataatcgaattcgtcccaaccaagacaccctatgacccccgctggatgctcgctgggcggccccatcctacacaaaagggccagtggctctctgggttttttgactacggatctttctccgaaatcatgcagccctgggctcagacagttgtagtgggccgcgctaggctgggtggaattcccgtcggggttgtcgctgttgagacgcgtaccgtggaattgtccatccctgccgaccctgcaaatctggatagcgaagccaaaattatccaacaggccggccaggtgtggttccccgattctgcttttaagacctaccaagccatcaaggactttaatcgagagggtttacccctcatggtctttgctaattggagagggttttctggtggcatgaaggacatgtacgaccaggttcttaagttcggggcatacatcgttgacggtcttagagaatgctgccagcccgtactagtgtacatccctccacaggccgaactgcgcgggggtagttgggtggtgattgactccagcatcaacccgaggcatatggaaatgtacgcagaccgcgaatcccgggggagtgtactcgaaccagaaggcactgtggaaatcaagttccggagaaaagacctggtgaaaacaatgaggagggttgaccctgtctatatacacttggccgaacgactgggcacacctgagttgagcacggccgagagaaaggagttggagaataagcttaaagaaagggaggagtttttgattcctatctaccatcaggtcgctgttcagttcgcggaccttcacgataccccaggccgtatgcaggaaaagggtgttatctctgatatactcgactggaaaaccagtcgtacgttcttctactggagacttcgacggcttctgctggaagacctggttaagaaaaaaattcacaatgcgaaccccgagttgactgatggacaaattcaggccatgctgcgtaggtggtttgtggaggtcgaggggacagttaaggcctacgtctgggataataacaaagatctcgctgaatggctcgagaagcagttaacggaggaagacggcgtgcactccgtgatcgaagaaaatataaaatgcatctctagggattacgttcttaaacaaatccggagtctggttcaggctaatcctgaggttgctatggatagtataatccacatgacccagcacatcagcccaactcaaagggccgaagtcattcggatcctgtcaaccatggatagtcccagtacttag

SEQ ID NO: 22704 - DNA, 777 bp, Artificial Sequence
  Description of Artificial Sequence: Synthetic coding sequence
atgagcggcctgcacctggtgaagcagggccgggaccggaagaagattgactctcagcgcgactttaccgtggcctcccctgcggaattcgtgactagattcgggggtaacaaggtgatagagaaagtgctcatagctaacaacggtattgccgccgttaaatgcatgagaagtataagaaggtggtcttatgaaatgttccgaaacgaaagagccattcgcttcgtggtgatggtaacaccagaggatctgaaagccaacgccgaatatatcaaaatggcagatcactatgttcctgtgccaggcggaccgaataacaacaactatgctaacgtagagctgatcctcgacatagcaaagcgaatacctgtgcaagcagtgtgggccgggtggggtcacgctagcgaaaaccctaaactgccagaacttcttttaaaaaatggcatcgccttcatgggacccccttctcaggcaatgtgggccttgggagacaaaatcgcctctagcatcgtcgcccagaccgccgggatccccacactaccatggagcggttctggtctgcgggtggactggcaagagaacgattttagcaagagaatccttaacgtgcctcaagaactgtacgaaaagggctatgtcaaggatgtcgacgacggcctccaggctgccgaagaggtcggttacccggtgatgattaaagcttctgaaggtggaggtggtaaaggcattcgcaaagtgaataacgcagacgatttccccaacctgtttaggcaatag

SEQ ID NO: 22705 - DNA, 144 bp, Artificial Sequence
  Description of Artificial Sequence: Synthetic coding sequence
atggacgagcccagccccctggcccagcccctggagctgaaccagcattcaaggtttattattggaagcgtgtccgaagataactctgaggatgaaatttctaacctagtgaagctggacctgcttgaagagaaggagggttag

SEQ ID NO: 22706 - DNA, 2679 bp, Artificial Sequence
  Description of Artificial Sequence: Synthetic coding sequence
atggaccactacgacagccagcagaccaacgactacatgcagcccgaagaggattgggaccgggacctgctgctagatcctgcttgggagaagcaacaaagaaaaacatttacagcatggtgcaacagccaccttcggaaggccggcacacagatcgaaaacatcgaggaagacttccgagatggactcaaactgatgctgcttcttgaggtcatctcaggcgagagactggccaagcctgagcgagggaaaatgcgagtccataagattagtaatgtcaacaaagcactggacttcatcgcatctaagggagtgaagctggtctctatcggggctgaagagatcgtcgacggtaacgtgaaaatgaccctgggcatgatatggaccataattctcagatttgccatccaggacattagcgtggaagaaactagcgccaaagagggtcttctcttgtggtgccagcgcaaaacagctccctacaagaacgtaaacatccagaacttccacatttcttggaaggacggactcggattctgtgctctcattcacagacataggcccgaactgatcgattatgggaaactgcgcaaggatgaccccctcaccaatctgaataccgccttcgatgtcgctgagaagtacctcgatattccaaaaatgctcgacgccgaggatatcgtgggaacagctcgccccgatgagaaagccataatgacgtacgtaagctctttctaccacgccttcagtggcgcacagaaggctgaaacagccgccaatagaatatgcaaagtcttagcagtcaaccaggaaaacgagcagcttatggaggattatgagaagctggcgtccgacctgctggagtggattcggcgcacaatcccctggctggaaaatagagtgcctgagaacactatgcacgctatgcaacaaaaacttgaagacttcagggattatagacgactgcataagccgcccaaggtgcaggagaaatgtcagcttgagattaattttaacacattacagacaaagctcaggttgtccaatcgccctgcgtttatgccttccgagggcagaatggtttctgatattaacaatgcctgggggtgcctggaacaggtggaaaagggatatgaagagtggctgttgaacgagattcggaggctggagcgacttgatcacctcgcagagaagttccgccagaaggcatccatccatgaggcctggactgatggaaaggaagcgatgttgcgccagaaagattatgaaacagctacacttagcgaaatcaaggcgctacttaaaaaacacgaagccttcgaatccgacttagccgcacaccaggatcgcgttgagcagatcgctgccatcgcgcaggagctgaacgaattggactattatgattcccccagcgtaaatgcacgctgtcagaaaatctgcgatcaatgggacaacctgggtgcgttgacccagaaacgccgcgaggcgttggaaaggaccgagaaactgttggagactatagatcagttgtatcttgagtatgctaaacgcgccgcaccattcaacaattggatggagggtgcgatggaagatctgcaggacactttcatcgtgcacaccatagaggagatccagggattaactacagcacacgagcagttcaaagctacgctgccggacgctgacaaggaaagattggcaatcctgggaatccacaatgaggtgtctaaaatagtccagacttaccacgtcaatatggctgggactaacccttatacaacaataacacctcaggaaatcaacggcaagtgggaccacgtgcgacagctcgttccaagaagggaccaagccctgacagaagagcatgccagacagcaacacaacgagcgattacgcaagcaatttggcgcccaagctaatgtgatcggcccctggatccagacgaagatggaggagattggtcggatatccatcgagatgcatggtactctggaggatcagctgtctcacttacgacagtatgaaaaatccattgtcaactataaacccaaaatcgatcagctggagggtgaccatcagctcatccaggaggccctgatcttcgacaacaagcatactaattacactatggagcacattagggtaggctgggagcagctgttaacaaccatcgcacgaaccatcaatgaggtagagaatcagatcctgacacgcgatgccaagggaatttcacaggaacaaatgaacgagttcagagcttccttcaaccatttcgaccgggaccacagcggcacactcggtccagaggagttcaaagcctgtttaatttcgctcggctatgacataggcaacgatccacagggggaggcagaatttgcaagaataatgtcgatcgttgatcctaatcggttaggggtggttacttttcaggcctttattgattttatgagcagagagacagccgacacggacacagcggaccaggtgatggcgtcttttaaaatcctggctggtgataaaaactacattaccatggatgaactccggcgcgagttgcccccagatcaggcagagtactgcatcgccaggatggccccctacactggacctgattcagtgccaggcgcacttgactacatgagctttagcacagccctttatggggagagtgacctatag

SEQ ID NO: 22707 - DNA, 2745 bp, Artificial Sequence
  Description of Artificial Sequence: Synthetic coding sequence
atggaccactacgacagccagcagaccaacgactacatgcagcccgaggaggactgggatcgtgacctgctgttggatcctgcctgggaaaagcagcagcgaaaaacttttaccgcctggtgcaatagtcacttacggaaggctggcacacaaatcgagaatatagaggaggattttcgggatggattgaagttaatgctactcctagaagtaatctcaggcgagaggcttgccaagcctgagcgaggtaaaatgagagtccataaaattagtaatgtaaataaagccctggactttattgcctcgaagggggttaaactggtgagtatcggcgccgaggagatagtggatggcaacgtgaaaatgacactgggcatgatttggacaatcattctacggttcgcaatccaggacataagcgtcgaggaaaccagcgctaaggaaggcctcctgctttggtgccaacgcaaaacagccccgtacaaaaacgtgaatatacaaaattttcatattagctggaaagatggcctcgggttctgcgccctcattcatagacacagaccagagctgatcgattacggcaagctccggaaggacgaccctctgaccaatctgaatacagcctttgatgtggcagagaagtacctggacatccccaaaatgctcgatgctgaagacatagtgggcaccgcccgcccagatgaaaaagccattatgacctatgtgtcatctttttaccacgcattcagcggtgctcaaaaggccgaaactgcggctaatcgaatatgtaaagttctggctgtcaatcaggaaaacgagcagctgatggaggattatgagaagctggcctctgacctgctggagtggataaggcgaactataccctggttggagaaccgagttccagaaaacactatgcacgccatgcagcaaaaactggaagattttcgtgactatagaagactgcacaagcctcccaaggtgcaggagaagtgccagctagagatcaatttcaatacactgcagacaaagctgagactgagcaatagaccggcctttatgcctagcgaaggccgaatggtctcagacataaataacgcatggggttgcctggagcaggtagaaaagggctatgaagaatggctgttgaatgaaattcggcggcttgagcgactagatcatctcgctgagaagttccgacaaaaggcgtcaatccatgaagcgtggacagatggcaaggaggcaatgctgcggcagaaggattacgaaactgcaaccctatccgaaatcaaagccctcctaaagaagcatgaggctttcgagtctgacctggcggctcaccaggaccgcgtggagcaaattgcagcaatcgcacaggagctgaatgaacttgactattacgattctccgtcagtgaacgccagatgtcagaagatatgcgatcagtgggacaatctgggtgcgctgacccagaagcgtagggaggctttggaacgaacagaaaaactgctggagactattgaccagctttacctggaatatgcaaaacgggcagcccctttcaacaactggatggaaggagccatggaagacttacaggatactttcatagtccacaccattgaggagatccaggggctcactaccgcacacgagcagttcaaggccacattgcccgacgcagataaagagcggctggccatactgggtatccacaacgaagtgtccaagattgtgcagacctaccacgtgaatatggcaggaactaacccatacacaactattacacctcaggagatcaatgggaagtgggaccacgtgcgccaactggtgccacgacgcgatcaagctctcacagaagagcacgccaggcaacagcacaatgaaaggctcaggaagcaatttggggcacaggccaatgtaatcggcccctggattcagaccaaaatggaggaaattggtagaatttcaatcgagatgcacggcactctggaggatcaactgtcccatctgaggcagtacgaaaagagcatcgttaactacaaacccaagatcgatcagctcgaaggagaccaccagctgattcaggaggcactcatcttcgataataagcacacgaattatacgatggagcatataagggtggggtgggaacagttgctgacaactatcgcacgtacaattaatgaagtcgaaaaccaaatcctcacaagggacgcaaaaggtatttcgcaggagcaaatgaacgaattccgagctagcttcaaccactttgatagagatcattccggtacactggggcccgaagaatttaaagcatgtcttatcagtctcgggtatgacataggtaacgatcctcagaaaaaaacgggtatgatggacaccgacgactttcgggcatgtctgatatccatgggctacaacatgggagaggcggaatttgctaggattatgagcatcgtcgatccaaaccgtcttggcgtggtgacatttcaggccttcatagatttcatgagcagagagactgcggatactgacactgcagatcaggttatggctagttttaagatcctcgccggagataagaactatatcaccatggatgagctgagaagggagctccctcctgaccaagccgagtattgtattgcacggatggcaccatatacgggaccggattcggtcccaggggctttggattatatgtccttcagcacagctctttacggcgagtccgatttatag

SEQ ID NO: 22708 - DNA, 2664 bp, Artificial Sequence
  Description of Artificial Sequence: Synthetic coding sequence
atggaccactacgacagccagcagaccaacgactacatgcagcccgaggaagattgggatcgggacttactattagaccctgcttgggagaaacagcaaagaaaaactttcacagcctggtgcaacagccacctgcggaaagccggaacacaaattgagaacatagaggaagacttccgcgacggactcaagctaatgcttctgctggaagtgatctccggcgagcgtttggccaaacccgagagaggtaagatgagggttcacaaaatttctaatgtgaacaaagccctggatttcatcgcgtctaagggcgtgaaactcgtgtcaattggggctgaagagatagtggacggtaatgtcaagatgaccctcggaatgatttggactataatcttacggttcgcgatccaggatatttccgtagaagaaacttctgcgaaggaagggctgcttctttggtgccagcgaaaaacggccccctacaagaatgtgaatatccagaactttcatatatcctggaaagatggacttggcttctgtgccctcatccatcgtcacaggccggagcttattgattatggcaagctgagaaaagacgaccctctaactaaccttaacactgcttttgacgtagctgagaagtatctggatatccctaagatgttggatgctgaagacatagtcgggaccgccaggcctgacgagaaagccattatgacgtacgtgagctctttttaccacgctttcagcggagcacagaaagcagagaccgcagcaaataggatctgcaaagtgctcgcggtcaatcaggaaaacgagcagctcatggaggattacgagaaactagcttcagatctgttagagtggatccgcagaacaatcccttggctggagaatagagtccccgagaatacaatgcatgcgatgcagcaaaagttagaggactttcgggactacagaagactacacaaacctccaaaggtccaggaaaaatgccagttagagatcaacttcaatacccttcaaacgaagctgagactcagtaataggcccgcattcatgccttccgaaggccggatggtgagcgacattaataacgcctggggttgtttggagcaagttgaaaaaggatatgaagagtggctcctgaatgaaattcgccgactggaacggctcgaccatctggcggagaaattccggcagaaggcatcaattcacgaagcatggacagacggaaaggaggcaatgttacggcagaaggattatgagacagcgaccctctccgagatcaaggccctcttgaaaaagcatgaggctttcgaatctgatttggccgcacatcaggatcgggtggaacagattgctgcgattgcccaggaactgaacgaactggactactacgattctccgtcggtaaacgccagatgtcagaaaatctgtgatcagtgggacaatctgggggccctcacacagaagaggagagaagccctggaaaggactgaaaagctgctggaaacaatcgatcagctatatctggagtacgccaagcgggctgcaccattcaacaactggatggagggcgccatggaagacctccaggatacatttattgtgcacaccatagaggagattcaagggctgaccacagcccatgaacagttcaaagccaccctccctgatgctgataaagagagactggccatcctcggaattcataatgaggtctctaagatcgtgcagacgtaccatgtgaatatggcaggcacaaacccttatacaacaattacaccccaagaaataaatggaaaatgggaccatgtgcgccagctggtgcctaggagggatcaagccctgacagaggagcatgctcgccagcagcataacgaaaggttgcggaagcaatttggggctcaagccaatgttatcggtccgtggatccagacgaaaatggaggagattgggagaatctctattgagatgcatggcacattagaggatcagctgagtcacctgaggcagtatgagaaatctatagtcaattacaagccgaaaatagatcaattagaaggggatcaccaattgattcaggaggctctgattttcgataacaagcacactaactatacaatggagcacattcgtgtgggctgggaacagctgctgactacgatcgccagaactataaatgaggtagagaatcagattctgacccgagacgccaaagggatcagccaggagcaaatgaatgaatttcgagccagcttcaaccacttcgaccgaaaaaagacaggcatgatggatacagatgacttccgagcttgcctgataagtatggggtacaatatgggagaggcggaatttgctagaatcatgagtattgtcgatcccaacagactgggggtcgtgactttccaagcgttcatcgactttatgtcccgcgaaactgcagacaccgacacagctgatcaagttatggccagtttcaaaatactggcaggcgataaaaactatatcactatggacgaattaaggagggaactgcccccagaccaagccgaatactgtattgctcgtatggctccatatacaggtccagactccgttcctggtgcactggattacatgagtttttccaccgcactttatggcgagagtgacttgtag

SEQ ID NO: 22709 - DNA, 2736 bp, Artificial Sequence
  Description of Artificial Sequence: Synthetic coding sequence
atggtggactaccacgccgccaaccagagctaccagtacggccccagcagtgcgggcaatggcgctggggggggcggatcaatgggcgactatatggcacaggaggatgactgggacagggaccttctgctcgaccctgcctgggagaagcagcaaagaaagacttttaccgcttggtgcaactctcatctccgaaaggccggtacgcagattgagaacatcgacgaggactttcgggacggattgaagcttatgctcctactggaagtgataagcggcgaaagactgccaaagccagagcgagggaagatgagggttcataagatcaacaacgtcaataaagccctggactttatcgcctctaaaggggttaagttggtgagtataggagcagaagagatcgttgacggcaatgccaaaatgaccctaggaatgatctggaccataatactcagatttgccattcaggatatcagcgtcgaggaaacgtccgctaaggagggcctcttactgtggtgtcaaagaaagaccgccccttacaagaatgttaacgtacagaatttccatatcagttggaaagatggactcgcattcaatgccctaattcacaggcatagacctgaattgattgagtacgacaaacttaggaaggatgatcctgtgacaaacctaaacaacgccttcgaggtagctgagaaatatctggatatccctaaaatgcttgatgcagaagacatagtgaataccgcccgaccggatgaaaaagcaataatgacctacgtgtcctcattctaccacgccttttctggcgcgcagaaggccgaaaccgcagccaacaggatctgcaaagtgcttgctgtaaatcaggaaaatgagcacctcatggaggattacgagaagctggctagcgatctcctcgaatggatcagacgcacgatcccatggttggaagaccgtgtccctcaaaaaactattcaggaaatgcagcagaagttagaggactttagagactacaggcgtgtgcacaagcctccaaaagtccaggaaaagtgccagttagaaatcaatttcaacaccttgcagactaagctgagattaagcaatcggccagcctttatgccttctgagggcaagatggttagcgacattaacaatggctggcaacacctggagcaggcggaaaagggctatgaagagtggctgctaaacgagatacgcaggcttgagcgcctggatcatttggcagaaaagttccgccagaaagcctctatacacgaggcctggaccgacggcaaggaggccatgctgaagcatcgggactacgaaacagcgaccctgtcggatattaaggctctaatcagaaaacacgaggcttttgagagcgacctcgcggcccaccaggaccgagtcgaacagatcgcggccattgcccaggagttaaatgagcttgactactacgactctcacaacgtcaacacacgctgccagaaaatctgtgatcaatgggacgctctgggatcccttactcactcgcggcgagaggctctggaaaagaccgaaaagcagctcgaggcaatagaccagctccacctggagtacgccaaacgtgcagcaccatttaacaactggatggagagcgctatggaggatttacaggatatgttcatcgtgcatacaattgaagagatcgaagggctgatctctgcacacgatcaattcaagtcaaccctgcccgatgccgacagagagagagaagccatccttgcaatccacaaggaagcccagcgtatcgccgaatctaaccacattaaattatctggcagcaacccctataccactgtgacccctcaaattatcaacagtaagtgggagaaggttcagcagctggttccaaagcgcgaccatgccctcctcgaggaacagtcaaaacagcagagtaacgaacatttgcgacgtcaatttgccagccaagccaacgtcgtcggcccatggatccagacaaagatggaagagatcgggagaatttccattgagatgaatggtactctcgaggaccaactgagccacctgaagcagtacgagcggtccattgtggattacaagccaaatcttgacctcctggaacaacagcatcagcttatccaggaagccctgatctttgataacaaacataccaattataccatggaacatattcgggtgggctgggaacagttgctgaccactatcgcacgtaccattaatgaagtagagaatcagatacttacccgggatgccaagggcatatctcaggaacagatgcaggagtttcgggcaagctttaaccacttcgataaggaccatggaggcgcccttgggcccgaggagtttaaggcgtgtctgatcagcctgggttacgacgtggagaacgataggcagggagaggccgagtttaaccgaataatgtctttggtggatcctaatcacagcggcctcgtgacattccaggcattcatcgactttatgtctagggagacaacagacaccgacaccgcagatcaagtgatcgcaagcttcaaggtgctggccggggacaagaattttattactgctgaagagctacggcgggaactcccacctgaccaggccgagtactgcatcgcacggatggccccatatcaaggacctgacgcagtgcctggcgcattggattataaaagcttttcgaccgccctttacggggagtctgatctgtag

SEQ ID NO: 22710 - DNA, 2079 bp, Artificial Sequence
  Description of Artificial Sequence: Synthetic coding sequence
atggtggactaccacgccgccaaccagagctaccagtacggcccctctagcgccggtaatggagctgggggcgggggatccatgggggattatatggcacaggaagacgactgggatcgtgatcttcttctggacccagcatgggaaaagcagcagagaaaagccgagaccgcagccaacaggatttgcaaggtgttggcagtgaatcaggaaaatgagcacctcatggaagactatgagaaactggcctcagacttactcgagtggatcagaagaactatcccttggttggaggaccgcgtgcctcagaagacaatacaggaaatgcagcagaagctcgaggattttagggactatcgtcgcgtacacaagccacccaaggtgcaggagaaatgtcagctggagatcaacttcaataccctacagaccaagctcaggctctcaaaccgccccgccttcatgccctcggaaggaaaaatggttagcgatataaacaatggttggcagcacttggaacaggcagagaaggggtacgaagagtggctgttgaatgagatcagaaggctggaacggctcgaccacctggctgagaagttccggcagaaagcctccatccacgaggcctggactgacggcaaagaggccatgctaaaacacagagattacgaaaccgcaactctcagcgacataaaggccttgattcggaagcacgaggccttcgagtccgaccttgcagcgcatcaggaccgggtggagcaaatcgcggccattgcgcaggagctcaatgaactagactactacgatagtcataatgtaaacacgcgctgccagaagatttgtgatcagtgggatgccctcgggagcttaacgcatagcagaagggaggccctggaaaagacggaaaaacagctagaagccattgaccaactccacctcgaatacgcaaaacgcgccgcaccatttaataactggatggagtccgcaatggaggatctgcaagatatgtttattgttcatacaatcgaggaaattgaaggccttattagcgcccacgaccagttcaaatccacattgccagatgctgatcgcgagcgcgaagctatccttgccatccacaaggaagcccagcggatcgctgagtccaatcacatcaagttgagtggctccaatccttatacaaccgtaacccctcaaattattaactcaaaatgggagaaggtccaacaactggtgccgaaacgtgaccatgctttattagaggaacaaagtaagcagcagagtaacgagcatcttcggaggcaatttgctagccaggccaacgtggtgggcccatggattcagacaaagatggaggagattggccgcatcagcattgagatgaatgggacacttgaggaccagctgtcacacctgaaacaatatgaacgatcaattgtggactacaaacccaacctggacttgctggagcagcagcaccagctcatccaggaggcccttatcttcgataacaagcatacaaactacacaatggaacacattcgggttggttgggagcagctactgaccaccattgctcggactatcaacgaagtagaaaaccagatactgactagggatgccaagggcattagccaggagcagatgcaggaattccgggctagtttcaatcactttgacaaagatcacgggggagcattagggcccgaagaatttaaggcctgtcttatttctctgggatacgacgtggaaaatgacaggcagggggaggcggagttcaaccgcattatgagccttgtggatccgaaccacagcgggttggttaccttccaagctttcatcgattttatgtcgcgagaaacaaccgatactgacaccgctgatcaggtcatcgccagcttcaaggtactggcaggcgataaaaatttcataaccgcagaggagctgagacgcgagctgcctcccgaccaagccgagtattgtatagctcgtatggctccttaccagggccccgacgctgtacccggagcactcgactataaaagcttcagcacagccctgtacggcgaaagcgacctttag

SEQ ID NO: 22711 - DNA, 1566 bp, Artificial Sequence
  Description of Artificial Sequence: Synthetic coding sequence
atggtggactaccacgccgccaaccagagctaccagtacggccccagcagtgccggaaacggggcaggaggaggggggtccatgggggactacatggctcaagaagacgactgggatagagatctgctgctggatccagcctgggagaaacagcaacggaagacgttcactgcctggtgtaattcacatctgcgaaaggctgggactcagatcgagaatattgacgaggatttccgagacggtctgaagttgatgctcctgttagaggtgcacgagttggattattacgattctcacaatgttaacacacgttgtcaaaaaatctgcgaccaatgggatgcactggggtctttgacacattcccgcagggaagctctcgaaaaaaccgagaaacagttggaggctatcgatcagctgcacctggagtatgctaaaagagctgctccatttaacaactggatggaaagcgccatggaagacttgcaagacatgtttatcgttcataccatcgaggagatcgaaggtctaatcagtgcccatgaccagttcaagtccactctgcccgatgccgatcgtgagcgtgaggccatcctggccatccacaaggaggcgcagcggatcgccgagtcaaatcacatcaagctctccgggtccaatccgtataccactgtaacaccacagattatcaattctaaatgggagaaggtacagcagttggtaccgaaaagggaccacgccctgctggaagagcagtcgaagcagcagagcaacgagcacttaaggcgccagtttgcctcgcaggccaatgtagtggggccctggattcaaaccaagatggaggagattggtcggatttctatcgaaatgaacggcaccctggaggaccaactgtcccatctaaagcagtacgagcgttctattgtggattacaagccgaacctagatttactggagcaacagcaccagctgattcaggaggcccttatctttgacaataaacataccaactacacgatggagcatattcgggttggctgggagcagctactgactactatcgccaggacaattaacgaagtcgagaaccaaatcctgacgcgagatgcgaaaggaatctcccaggaacagatgcaagaatttcgcgctagctttaaccattttgataaagaccatggaggcgctctcggacccgaggaattcaaagcatgtctgatctctctgggttatgacgtggaaaatgacagacagggagaggcagaatttaatagaatcatgagtctggtggacccgaaccatagcggtctggtgacatttcaggcctttatagactttatgagccgagaaacaactgacacggataccgctgaccaggtcatcgctagctttaaagttctggctggggataagaacttcataaccgctgaggaactgcgcagagagctcccgcccgaccaggctgaatattgcattgcccgaatggccccatatcagggcccagacgcagttcccggggcccttgactataagagcttttctaccgcactatacggagaatcagacctatag

SEQ ID NO: 22712 - DNA, 1689 bp, Artificial Sequence
  Description of Artificial Sequence: Synthetic coding sequence
atggtggactaccacgccgccaaccagagctaccagtacggccccagctcagccggtaacggggcaggcggcgggggctccatgggggattacatggcccaggaagacgactgggatcgggacctgctcctggatcccgcatgggagaaacagcagagaaagacttttacggcctggtgcaactcgcacctgcggaaagcgggaacgcagatcgagaacattgatgaagactttcgggacggtttgaagcttatgctcttgcttgaggtgattagcggggaaagactccctaagccagagcgggggaagatgagggtgcacaagataaacaacgtgaacaaggctctggactttatagcaagtaagggcgtcaaactggtgagtattggggctgaggagattgtggatggaaacgccaagatgactctgggcatgatctggacaataattctgcgcttcgcaatccaggatattagtgttgaagagacttccgctaaggaagggctgctgctatggtgccagcggaaaacagccccctacaagaatgtcaacgtgcagaatttccacatctcgtggaaggacgggctggcatttaatgccttaatccatagacaccggcccgagcttattgagtacgacaaactgcggaaggatgatcccgttacaaacctgaacaacgcgttcgaggtggctgaaaagtacctggacatacctaaaatgctggatgctgaagacattgtcaacacggcacgccctgacgagaaggcaataatgacgtatgtatcaagcttctaccatgcatttagcggcgcacaaaaggccgagacagctgctaatcggatctgtaaagttctggctgtcaaccaagaaaacgagcacctcatggaggactacgagaaattagcctctgatctgctggagtggatcagaagaacaataccctggctggaggaccgggtgccccagaaaacaatacaggaaatgcaacagaaactggaagatttccgtgactataggagggttcataagccacctaaggtgcaggagaagtgccaactagagattaactttaacactctgcagaccaaattaaggttaagcaacaggccagccttcatgccatcggagggcaagatggtctctgatatcaataatggctggcaacacttggagcaggccgaaaaaggttatgaggaatggttgctgaacgaaataaggcggctggaacggctagatcacctggctgagaagttccgccaaaaggccagcattcacgaagcctggacagacgggaaggaagctatgctgaagcatcgggactatgagaccgccacattatctgacattaaggccctaattcggaagcacgaggcatttgagagcgacctcgctgctcaccaagatcgcgtagagcaaattgcagccatagcccaggaactgaatgagctggactactacgattcccacaatgtcaatactcccgatggactgcaggaaggtcctggccaaccccatagtccaatcccacccctatgtatatacgcgaagcacagtcttcagagcagcggtgtaggtggatgggccggcagaggatggggacggctttcacctttatcactgtgcggacttgcccgacgattccctagaccaggctggggggatctcggccccgcattgcttgtttggtag

SEQ ID NO: 22713 - DNA, 1518 bp, Artificial Sequence
  Description of Artificial Sequence: Synthetic coding sequence
atgaagttcaagctgcacgtgaacagcgcccggcagtacaaggacctctggaacatgtctgacgataagcccttcttatgcacggccccaggatgtggtcaacgatttacaaacgaggatcacctagcagtccacaagcataagcatgagatgacactgaagtttggtcctgctcgtaatgacagcgtgattgtggccgatcagacacccaccccaactcgatttctgaaaaactgcgaagaggttgggcttttcaacgaactggcatctccattcgaaaacgaattcaagaaagctagcgaagacgatatcaagaagatgcctttggacttaagccctctcgccaccccaattattcgtagtaagatcgaggaaccctcagtcgtcgaaacaacgcaccaagactcacccttgcctcacccggaatcaacgactagcgacgagaaagaggtgccactggcccagactgcccagcccacctcagcgattgttcgccccgccagcctgcaagttccaaacgtattattgacttcctccgatagcagcgtaattatccaacaggctgtgccctcccccacttcatcaacagtgataactcaggccccctctagcaaccgccctattgtgcccgtgccgggcccatttcctttgttgctgcacttacccaacggccagaccatgccagtggctatacctgcctctatcacgtcatctaatgtgcacgtgcccgctgctgtcccgcttgtccgcccagtgacaatggtgcccagcgtccccgggatacctggccctagttccccacagccagtccaatccgaagcaaaaatgagacttaaagctgccctgacccagcagcacccccctgttactaacggagatactgtgaaaggacatggaagcggcttagttcgcacacagagcgaggagagccggcctcagagcctgcagcaacctgcaaccagcactaccgagacgcccgctagccccgcccatacaaccccccagacacagtctacatcaggacgacggaggcgagcggctaatgaagacccagacgagaaacgccggaaattcctggagagaaaccgcgccgccgcatcgcgctgccgccaaaagaggaaggtttgggtccagagcctagaaaagaaagctgaggacctctcaagtctgaacggccagctccagagcgaggtgaccctgttgagaaacgaggtggctcagctgaaacagctgctgctcgctcataaggactgccccgttaccgccatgcagaaaaagagcggctaccatactgccgacaaagatgacagctccgaagacatcagtgtccccagctcaccccatactgaggccatccagcacagcagcgtgtctaccagtaatggcgtaagctcaacatccaaggcagaggcagtagccacttctgtcctcacacagatggctgaccagagcaccgagcccgccttgagtcaaattgttatggctccatcctctcagtctcaacctagtggtagctag

SEQ ID NO: 22714 - DNA, 1344 bp, Artificial Sequence
  Description of Artificial Sequence: Synthetic coding sequence
atgtactgcgcctggatgtggcccgaccagacccccacccccacccggttcctgaaaaactgcgaggaagttgggctgttcaatgagctcgccagcccgttcgaaaatgaattcaagaaagcctccgaggatgatatcaagaaaatgcccctagatctgtcacctcttgctacccctatcatcagaagcaaaattgaggaaccttcagttgtggagactacacaccaagattccccactgccacacccagaatctactacatctgatgaaaaagaggttccactggcccagaccgcccaaccgacttcagctatcgttcggcccgcttccttacaggtccctaatgtcctccttacatccagtgacagttctgtgatcatacaacaggccgtgccctctccaaccagcagcacagtgatcacacaagccccttcttccaatagacccatagttccagtccctgggcccttccctttgctactgcatcttccgaatgggcaaaccatgcctgtagcgatccccgcctcgatcacctcatcgaacgtgcatgtgcctgcagccgtccccctagtgcggcccgttacgatggtgccatctgtgccgggcatccctggacctagtagcccacaaccagtgcagtccgaggcaaagatgcgactgaaggcagcgctgacacaacagcatcctcccgtgaccaacggggacacagtgaaagggcatggatccggcttggtgcgcacacagtccgaggaaagccggccgcagtcactgcaacaacctgctacctctacaacggagacaccggcttcccccgcacacaccacaccccagacacagagtaccagcggcaggcgccgaagagccgccaatgaagatcccgacgagaagcggaggaagtttttagagcgcaaccgtgccgctgcttctcggtgcaggcagaaaaggaaggtctgggtgcagagtctggagaagaaagccgaagacctttcgagtctcaacggccagctccagagcgaagtgaccctcctcaggaacgaagtggctcagctgaaacagctcttgctcgcgcataaagactgccccgtaacagccatgcagaaaaaaagcggctatcacactgcagataaagatgatagctcagaggatataagcgtgccctcatccccccacacggaagccattcagcacagctctgtttctacttctaatggcgtgagttctaccagcaaagccgaggccgtggcaacatccgtgctaacacagatggcggaccaatccacggaacccgctctttctcagatcgtcatggccccctccagtcagtcacagcccagtggtagctag

SEQ ID NO: 22715 - DNA, 381 bp, Artificial Sequence
  Description of Artificial Sequence: Synthetic coding sequence
atgagcgacgacaagcccttcctgtgcaccgcccccggctgcggccagtccgaggttacgctgctccgcaacgaagtggcacagctgaaacagttactcctggcccacaaggactgtcctgtaactgctatgcaaaagaaatcgggatatcacaccgcagacaaagacgactccagcgaggacataagcgttccgtcgagcccccatacggaagcgattcagcactcctctgtgtccacgtcaaatggcgtgtcctcgacatcaaaggctgaagctgtagccacatccgtactcacgcaaatggccgaccaaagtacagagccagcattgagtcagatagtaatggccccttccagtcagagtcagccgtccgggtcatag

SEQ ID NO: 22716 - DNA, 1518 bp, Artificial Sequence
  Description of Artificial Sequence: Synthetic coding sequence
atgaagttcaagctgcacgtgaacagcgcccggcagtacaaggacctctggaatatgagtgacgataaaccctttctttgcacagctcctggctgtggacagcggtttaccaatgaagatcaccttgccgtgcataagcacaaacacgaaatgaccctcaaattcgggcccgccaggaatgactctgttattgtcgccgaccagaccccaacaccaacacggttccttaaaaactgtgaagaggtgggtctattcaacgaactggcaagccccttcgaaaacgaattcaaaaaggcttctgaagacgatatcaagaaaatgcccctcgatttatcaccactggccacccctatcatccgcagcaagatcgaggagccttccgtggtggagacaacacaccaagacagtccattgccccaccctgagtctacaactagcgacgagaaagaggtgccattagcacagactgcgcagcctactagcgctatcgtgagacccgccagcctgcaggtacccaacgtattgttaaccagttcggacagctctgtgattatccaacaggccgtgccaagcccaacctcgtccactgtaatcactcaggcacccagctctaacaggccaatcgtccccgtgcccggtccctttccactactgctgcatctgcccaacggtcagaccatgcccgttgcgattcctgccagtattacctccagtaatgtgcatgtgcccgccgcggttccactcgtgcgacctgtcaccatggtaccgagcgtgcctggaatacccggcccatctagcccccagcccgtacagtcagaggctaagatgcgacttaaggctgcgcttacgcaacagcacccacccgttacgaatggtgatactgtcaaaggacacggttctggtctggtgagaacacaatcagaagaatcgcgtccacagtccctgcagcagcccgctacctctacaaccgaaacccctgcttccccagcacataccacaccacaaacacagagtaccagcggtcgtcgcagaagggccgcaaacgaagaccccgacgagaaacgccggaagttccttgaacgtaacagggccgccgcgagtcgctgtagacaaaaaaggaaagtgtgggtccagtctctagagaagaaagccgaagacctgagtagcctcaacgggcagttgcagagcgaggttacgcttctccggaatgaagttgcacagctcaagcagttgcttctggcccataaagactgtcctgtgacggctatgcagaagaagagcggctaccacaccgcagacaaggatgacagtagcgaagacattagtgtccccagctctccgcacaccgaggcaatacaacattccagcgtatcgactagcaacggagtgagtagcacatccaaggccgaggcagtagcaacaagcgtgctgacacaaatggcagatcagtcgacagagcccgccctgtcacagatcgttatggcacccagctcccagtctcagcccagcgggagctag

SEQ ID NO: 22717 - DNA, 1344 bp, Artificial Sequence
  Description of Artificial Sequence: Synthetic coding sequence
atgtactgcgcctggatgtggcccgaccagacccccacccccacccgatttttgaaaaactgtgaggaggtgggattgttcaacgagctggcatccccgttcgagaacgaatttaaaaaagccagtgaagacgatattaaaaagatgccactcgacctgagccctctcgctacacccattattcggtctaaaatagaggagcctagcgttgtggagacaacacaccaggacagtcctctcccacacccggaatccacaacatctgacgagaaagaagtccctctggctcagacagcacaacccaccagcgccattgtgagacctgcctcactgcaggtgcccaatgtgctgctcacttcctcagacagttccgtgataattcagcaagcggtgccatcccccaccagcagcaccgtcatcacacaggccccatcttctaaccgtcccattgtaccagttcctgggccctttccactcttgctgcatcttcctaacggccaaacgatgcccgtggccatccccgcatcaatcacttcttcaaatgttcatgtgccggctgctgtgccccttgtccggcctgtgactatggtgccgtccgtccctggcatcccaggaccttcctctcctcagccagtccagagtgaagcaaagatgcgcttaaaggccgctcttacacagcaacacccaccagtgacaaacggggacaccgtcaaagggcacggaagtggactggtgaggacacagtctgaggagtcacggccacagtctctccaacagccggccacttctacaactgaaacacccgcatcccccgcccacaccacacctcaaacacagagcaccagcgggcgcaggcgacgtgccgcaaatgaagatcccgacgaaaaacgacgcaagtttctcgagaggaaccgtgcagccgcctccaggtgcaggcagaagcgaaaggtgtgggtccagtctttggagaagaaggcagaggacttgagttccctgaacggccagctccagtcagaagtgaccttactccggaacgaagttgctcagctcaagcagctgctgctggcccataaagattgtcccgtcaccgcaatgcagaagaagtcaggttaccatacagcagacaaggacgactctagcgaggacattagtgtgccttcttctccacacacagaggctatccagcacagctccgttagcacatcaaacggggtatcttctacctccaaagccgaggccgttgccacatctgtattgacgcagatggcagatcagtcgaccgagcccgctctatcacaaatcgtcatggctccatcatctcagtcccagccttcgggctcttag

SEQ ID NO: 22718 - DNA, 630 bp, Artificial Sequence
  Description of Artificial Sequence: Synthetic coding sequence
atgaagttcaagctgcacgtgaacagcgcccggcagtacaaggacctgtggaacatgtccgacgacaaaccttttctttgcaccgcaccaggttgtggtcaaaggttcacaaatgaagatcatctagcagtccacaaacacaagcatgagatgactctgaaattcgggccagctcggaatgattccgtaattgtggctgaccagacacccactcctacgaggttcctcaaaaattgcgaagaggtggggctcttcaacgagctggcatcacccttcgaaaatgagtttaagaaggccagcgaggacgacatcaagaaaatgcctcttgatctgtctccccttgccacacccatcatacgcagcaaaatcgaggagccaagcgtagttgagacaacgcaccaagatagtcctctgccacaccctgagtccactaccagcgatgaaaaagaggtcccgctggctcagacagcccagccgacttctgccatcgtccgccccgccagcctccaagtgcccaacgttctactgacttctagtgactcaagcgtgattatccaacaggccgtgccttccccgaccagtagtaccgttatcacgcaggcacccagctctaacagacccatcgtatag

SEQ ID NO: 22719 - DNA, 1188 bp, Artificial Sequence
  Description of Artificial Sequence: Synthetic coding sequence
atgaagttcaagctgcacgtgaacagcgcccggcagtacaaggacctgtggaacatgtccgacgacaagcctttcctgtgtaccgcccctgggtgcggccaacggttcacgaatgaagaccacctcgctgttcacaagcacaagcatgagatgacccttaagtttggccccgccaggaacgattccgtcattgtggcggaccagacccctactccgactaggttccttaagaactgtgaggaagttgggctattcaatgaactagcttctccgtttgagaatgaatttaagaaagcttctgaggatgacatcaagaagatgcccctggatctttccccactggccacccccatcatcaggagcaagattgaggagccttctgtcgtggagacaactcaccaggacagcccccttccccatccagagagcactaccagtgatgagaaagaagtgccactggctcagacagcgcagccaacctccgccatcgtgcgccccgccagcctccaggtgccgaatgtccttctcacctcatcagattccagcgtcattatacagcaggctgtcccaagtccaactagttccacagttataacccaagccccaagcagtaaccggcccatagtgcccgtgccaggtccctttccattgctcctgcatctgcccaatggccagaccatgccagtggccattccagcctcaatcacctcgtccaatgtacatgtgcccgctgcagtccccctggttcggcctgtgacaatggtccccagcgtaccaggtatacctggaccctccagcccacagcccgtccagtccgaggcaaagatgcgattaaaggccgccctgacccagcaacaccctcctgtaaccaacggtgacaccgttaaggggcatggctcaggcttggttcgtacacagtccgaggaatcccgtccccaatccctacagcaacccgcaacatcaacaacagagactcctgcctctccagctcacacaacaccgcaaacacaaagtacatccggacgccgacgcagggcagccaacgaggaccctgatgagaagcgaagaaaatttctcgagcggaatagagctgccgctagtaggtgtcggcagaaacgcaaggtctgggtacagagcctcgagaagaaggcggaggatttgtcttctctgaacgggcaattgcagtag

SEQ ID NO: 22720 - DNA, 714 bp, Artificial Sequence
  Description of Artificial Sequence: Synthetic coding sequence
atgaagttcaagctgcacgtgaacagcgcccggcagtacaaggacctatggaatatgtccgatgacaaacctttcctttgtacggcccctggttgtggtcagaggtttactaatgaagaccacctcgccgttcataagcataagcacgagatgaccctcaagttcggcccagcaagaaatgactctgtcattgtggccgatcagacgcccacccctacccggtttctgaaaaattgtgaggaagtgggcctctttaatgaactggcctcaccatttgaaaacgagttcaagaaagcctcagaagatgatatcaagaaaatgcccctggatttatcacccttagctacaccaatcattaggtctaaaatcgaggaaccctcggttgtcgaaacaacccatcaggactccccactgcctcaccccgagtcaacaaccagcgacgagaaggaggtgccccttgctcagaccgcacaaccaacatcagcaatcgtcagacccgcctctctacaagtgcctaatgtgctgctgacctcaagcgattcttctgtgatcatccagcaggctgtgccgtcacccacgtcttccactgtgatcacacaggctccgtcatcgaatcgtcccatcgtaagttttgatcagagcccgtggtgtctggtgttccaggagtcgcaagtcctgcctcttccaaatcagtattctcagaagcaaaagtag

SEQ ID NO: 22721 - DNA, 1464 bp, Artificial Sequence
  Description of Artificial Sequence: Synthetic coding sequence
atgagcgacgacaagcccttcctgtgcaccgcccccggctgcggccagcggtttaccaatgaagatcacctagcagtacacaaacacaagcatgaaatgactctgaaatttggtcccgcccgcaacgactccgtcatcgtcgcagatcagacacctaccccgacaaggttcttgaaaaattgcgaagaagtcggcctcttcaatgagctggccagcccattcgagaatgagtttaaaaaagcctcggaggacgatatcaaaaagatgccactggatctaagcccactggcaacccctataatcagatccaagatcgaggaaccatccgtcgttgagactacccaccaggacagtcccctgccccaccccgagtccacaactagcgatgagaaagaagtgcctcttgcccagaccgctcagcccactagtgccatcgttcggccagcctcactgcaagtccccaatgttctcctgacatcaagcgacagttcggtgatcattcagcaggctgttccaagtcccaccagttctacggttatcactcaggctccttcaagtaataggccaatagtccctgtgccaggaccttttcccctactcctccaccttcccaacggtcagaccatgccagttgccatccccgcttcaatcacttcttccaacgttcatgtgcccgccgcggttcctctcgtgcggcccgttactatggtgccatctgtgccaggaatcccgggacccagctccccccagcctgtgcagagcgaggctaagatgaggctcaaagccgctctcacacagcagcaccctccagtgacaaacggcgataccgtgaagggacatggctctggcctcgtgcggacacagtcagaagaatccaggccccagtcactgcagcagcccgcaacaagcaccactgagactccagcctcgcccgcacataccactccacaaacgcagagtacctccggcagaaggagacgggccgccaacgaagacccagatgagaagcgtagaaagttcctcgagcgaaatcgtgctgccgcgagcagatgtcgccagaaaagaaaggtgtgggtgcagagcttagagaaaaaggcggaggacctgtcttccttgaatggccaactccagtcagaggtgacactgcttaggaatgaggtcgctcagctgaagcaactgctgttagcccacaaagattgccccgtgaccgctatgcagaaaaagagtggatatcacacagcagacaaagatgattcctcagaggacatcagcgtcccatcttctcctcacacggaagccatccagcacagttctgtgagcacctctaacggtgtcagtagcacctctaaggctgaagccgttgccacctccgtcctcacgcagatggctgaccagtccactgagccagcgctcagtcagatcgtgatggccccttctagccagtcacaaccatcaggttcatag

SEQ ID NO: 22722 - DNA, 1188 bp, Artificial Sequence
  Description of Artificial Sequence: Synthetic coding sequence
atgaagttcaagctgcacgtgaacagcgcccggcagtacaaggacctctggaacatgagcgatgacaaaccttttttatgcacagccccagggtgtgggcaacggtttacaaacgaggaccacctcgcagtacacaaacacaaacacgagatgaccctcaagtttggccctgctcgaaatgattctgtcattgtggcagaccagacccccactcccacccggtttctgaagaattgcgaggaggtgggcctctttaatgagctggcgagcccttttgagaacgagttcaaaaaggcctcggaggatgatattaaaaaaatgcctctggatttgagcccactggctaccccaattatcagaagtaagatcgaggagccatccgttgtcgagacaacacatcaggactcccccttacctcacccggagtcaacaacatctgacgagaaagaggtgcctctagcccagacagcgcagcccacttcagccattgttcggcccgcaagtctccaagtgccaaacgtcctgcttaccagcagcgactcctcagtgatcatccagcaggctgtgccttcaccaacaagtagcaccgttattacacaggctccaagctcaaatagacctatcgtgccagtcccaggacccttccccctgttgctccacttgccaaacggacagaccatgccagtggccatccccgcttccattacatcctccaatgttcacgttccggcagccgtgcccctcgttcgcccggtgacgatggtaccttccgtacccggaattcctgggccctcatctccgcagcctgtgcagtcggaagccaagatgaggttgaaggcagcgctgactcagcagcacccacccgtgacgaacggcgatacagtcaaaggccatgggtcggggcttgtaaggacacaaagtgaagagagccgaccccagtccttacaacaaccagcaacctccaccaccgaaacaccggccagcccagcacacacgacaccacagacccagagcacatccggtcgtcggcgccgcgctgctaatgaagatccagacgaaaaaaggcgaaaattcctggagcgcaaccgtgcggctgcaagccggtgcaggcaaaagcggaaggtgtgggtacaaagcctggaaaagaaggctgaagacctgagttctctgaatggccagctgcagtag

SEQ ID NO: 22723 - DNA, 1188 bp, Artificial Sequence
  Description of Artificial Sequence: Synthetic coding sequence
atgaagttcaagctgcacgtgaacagcgcccggcagtacaaggacctctggaacatgtctgacgacaagcctttcctctgcactgcccctgggtgcgggcagaggtttactaatgaggaccacctcgcggttcacaagcataagcatgagatgacgctgaagtttgggcctgctcggaatgattctgtgattgttgctgaccagactcccacccctacccggttcttgaaaaattgcgaggaggtcgggttgttcaatgagttggctagcccgttcgaaaatgagtttaagaaggccagcgaggacgacattaagaaaatgccccttgacctgagtccccttgctacacccattatccgatctaagatcgaggaaccaagcgtggttgagactactcaccaggatagtcccctgcctcatccagaatctacgacttccgacgagaaagaagtgcccttagcccaaacggcgcagcctacaagcgccattgtgaggccggcctcactccaggtccccaacgtcctgttgacgtcctcagactcgagtgtgatcatccagcaggccgtccctagccctacatcctctaccgtgattacccaggcaccctcttctaaccgccctattgttccagtccccgggccctttccactcttgctgcatctgcccaatggtcaaaccatgcccgtcgcaattcctgctagcattacgtcctctaatgtccatgtacccgcggccgtcccactggtgcgaccagtgaccatggtgcctagtgtacctggcatcccaggtccatcctctccgcagcccgttcagtcggaggctaaaatgcgcctgaaagcggctctaacgcaacagcacccgcctgtcactaatggagatacggtcaagggacacggaagcggccttgtgagaacacaaagtgaggagtcgagaccgcagagtctgcagcaacccgctacaagtactactgaaacgccagccagccccgctcatactacgccccagacacagtcaaccagcggtcgtaggagacgagctgccaacgaggaccctgacgagaaacgcagaaaatttctggaaagaaaccgagctgctgccagtagatgcaggcagaagcgtaaggtttgggttcaatccctggagaaaaaagcagaagacctgtcctccctgaatggccaactgcaatag

SEQ ID NO: 22724 - DNA, 660 bp, Artificial Sequence
  Description of Artificial Sequence: Synthetic coding sequence
atgagcgacgacaagcccttcctgtgcaccgcccccggctgcggccaaagattcactaatgaggaccatctggctgttcacaagcataaacatgaaatgacactaaaattcggccctgcgaggaacgatagcgtgatcgtagctgaccaaactcccactccgacccgttttctgaagaattgtgaggaagtaggcctgttcaatgaactcgctagcccttttgaaaatgaatttaagaaggccagcgaggatgacattaagaagatgcctctggaccttagcccactagctacccccataatcagatctaaaatcgaggaaccgtccgtggttgagacaacacaccaagactcccctctcccccaccctgagagcacgactagtgacgaaaaagaggtcccgctcgctcagaccgcccaacccacatccgcaattgtgcgaccggcatccctgcaggttcccaatgtgctgctgacaagcagcgactcctctgtgattatccagcaggcagtcccctcaccaacatcgtccactgtaatcacacaggccccatcatcgaatcggcctattgtgagtttcgatcagagtccctggtgtctcgtgttccaggagagccaggtgctccccctgcctaaccaatactcccagaagcagaaatag

SEQ ID NO: 22725 - DNA, 1134 bp, Artificial Sequence
  Description of Artificial Sequence: Synthetic coding sequence
atgagcgacgacaagcccttcctgtgcaccgcccccggctgcggccagagattcacaaatgaggaccacctggctgttcacaagcacaagcacgaaatgactctgaaattcggacccgccaggaacgatagtgtgatcgtcgctgaccagactcccacccctacacggtttctgaagaactgtgaggaggtgggactgttcaacgagttggcttctccttttgagaatgagttcaagaaggcaagcgaggatgacattaagaagatgcccttggacctttcccctctcgcgactccgatcattcgaagtaagattgaagagccctctgtagtagagacaacccaccaggattccccactcccccaccccgagagtacgacctccgatgagaaggaggtccctctggcacagacggcccagccaactagcgccatcgtccgacctgcttccctccaagtgcccaatgtgctactgaccagtagtgattcctccgtaataatccaacaagctgtgccttccccgacttcatcgaccgtgatcacccaagcccctagtagtaaccggcccatcgttcctgtgccgggcccattcccccttctgttgcacctccccaatggtcagactatgccagtggccattcccgcttctatcacttcttctaacgtgcacgtccccgcagccgtgcccctggtacggcccgtcactatggttcctagcgtgccaggtattcctgggccatccagtccacagcctgtgcagtccgaggctaaaatgagacttaaggccgctctcacccagcagcaccctccagtcaccaatggggacacagttaagggtcatggtagcggactcgttagaacgcagtcagaagaatctcgccctcaaagcctccagcagcccgcgacatcaaccaccgaaactccagccagccccgcccataccactcctcagactcagagtactagtggcaggagacgccgagctgctaacgaggaccctgacgagaagagaaggaagttcctcgagagaaaccgggctgccgcctcacgttgccggcaaaagaggaaggtctgggttcagtcactcgagaaaaaggccgaggacctcagctccctaaacggccagctgcagtag

SEQ ID NO: 22726 - DNA, 1449 bp, Artificial Sequence
  Description of Artificial Sequence: Synthetic coding sequence
atgaagttcaagctgcacgtgaacagcgcccggcagtacaaggacttgtggaacatgtccgatgacaaacctttcctctgcacggcccctgggtgcggccaacggtttactaatgaggaccatctggctgatcagacccccacccccactaggttcctcaaaaattgcgaagaggtcggtctgtttaacgagttggcctctccattcgaaaatgagttcaagaaggccagtgaagacgatattaaaaagatgccgttagacttgtctccactggccactccaatcatccgcagcaaaatcgaggagccatctgtggtggagacaacccaccaggacagtccgctcccacaccctgagtcaacaacgagcgatgagaaagaagtgccactcgcacagactgcccaaccaacatcagcaatagtgcgcccagcgtcgctacaggtgccaaacgtcctgctcacctctagcgatagcagtgtgattatccagcaggccgtgcccagtcccacatctagcaccgtgatcacccaggcgccctcctctaatcgtcccatcgttcctgttcccggtccttttcctttgctccttcacctgcccaacgggcagactatgccggtagctatcccggcaagtattacatcttctaacgtgcacgttccggctgccgtaccattagtgcgtccggtaacaatggtgccatctgtgccgggcatccccggcccaagcagcccccaaccagtgcagtcagaagccaagatgcggctgaaagcagcactcactcaacagcaccctcccgtgaccaacggagacaccgtcaaaggccacgggagtgggctggtccgcacccagtccgaagagagtcggcctcagtccctgcagcaacccgcgacatcaacaaccgagaccccagcttcccccgctcacaccaccccccaaacacagtcaacttccgggcgccgacggagggctgccaacgaggacccagacgaaaagcgcaggaagttcttggagcgaaaccgggcagcagccagtaggtgccgccaaaaacgtaaggtgtgggtgcagtccctcgagaagaaagcggaggatttgagcagcttgaacggccagctgcagtctgaggttaccttgctgaggaatgaggtcgcgcagctgaagcagctgttgttggcgcataaagactgtcctgtgaccgccatgcaaaaaaagtccgggtaccataccgcggacaaggatgattctagcgaagatatctccgtgccatcatcccctcacaccgaggccattcaacacagcagtgtgagtacttccaacggagtttcaagcacgagcaaggcggaggccgttgccactagcgttctgacacaaatggcagatcagtccaccgaacctgctctctctcagattgttatggcaccttcatcccagagccagcctagcggcagctag

SEQ ID NO: 22727 - DNA, 2136 bp, Artificial Sequence
  Description of Artificial Sequence: Synthetic coding sequence
atgaagctgaagctgaacgtgctgaccatcatcctgctgcccgtgcacctgctaattaccatctactccgccctcatttttatcccttggtacttcctaaccaacgcgaagaagaaaaacgcgatggccaaaaggataaaagcaaagccaaccagcgataaacctggttccccttaccgcagtgtaacgcacttcgatagtctggccgtcattgacattccgggggcagacacccttgacaaactgttcgaccacgctgtgtccaagtttggcaagaaagacagtctggggacacgtgagattctgagcgaggaaaacgagatgcagcccaacgggaaagtatttaaaaagctgattctaggcaactataaatggatgaactacctcgaggtgaaccggcgcgtgaataatttcgggagcgggctaaccgccctaggtctgaagcctaaaaacacaatcgctatattctgcgaaacgcgggcagaatggatgattgccgcgcagacctgctttaaatacaacttccctcttgttactttatatgctactttgggaaaggaagctgtagttcacggtttaaacgagtccgaggcaagttatctgattacgagcgttgaactgctggaaagcaagctgaagacagcccttctggatatctcttgtgtgaaacacatcatatacgtcgataataaagcaattaacaaagcagaataccctgagggcttcgagatccacagtatgcagtccgttgaggaattgggttccaacccagagaacctcgggatacctccttccagacccacaccttctgacatggcaattgtgatgtacacctccgggtctacagggaggccaaaaggggtgatgatgcaccactccaacttgattgctggcatgaccggacagtgtgaacgcatcccaggccttggtcccaaggacacttacattggatatttgccactggcccacgttctggaattaactgccgagattagctgcttcacctacggatgccgaatcggatacagcagtcctctgacgctatcagatcagtcgagtaaaattaaaaagggcagtaaaggggactgtactgtacttaaaccgacccttatggcggcagtgcccgagattatggaccgtatttacaaaaatgtgatgtccaaggtgcaggaaatgaactacatccagaaaaccctgtttaagattggatacgactacaaactagagcagattaagaagggatacgatgcccccttatgtaacctgctgctgtttaaaaaggttaaggcacttctgggaggaaatgttagaatgatgctctcaggcggagcccctctcagcccacagacgcaccgattcatgaacgtgtgcttctgctgcccaattggacagggctacgggttgacagagagttgcggtgctggtactgttactgaggtaactgattataccacaggcagagtaggagcccccttaatatgttgtgaaattaaactgaaggactggcaagagggtggatacactatcaatgataaacctaaccccagaggggaaattgtgataggaggccagaacatctccatgggctatttcaaaaacgaggagaagacggccgaagattatagtgtggatgaaaatggtcaacgctggttttgtaccggcgacatcggggaattccatcccgacggctgcttgcagatcattgaccgcaaaaaggacctggtaaaactgcaggccggagagtatgtttcactcggcaaggtggaagcagccttgaagaattgtccattgatcgataacatatgtgcctttgcaaaaagcgaccagtcttatgtgatctcattcgttgttcccaaccagaagaggctgacattattggcccagcagaaaggcgtggagggcacttgggtagatatttgtaacaatcctgccatggaggctgagatcctgaaggagatacgagaggctgccaacgctatgaagctggagcgatttgagatcccaatcaaggtccggctgagccccgagccatggactccagaaacgggcctggtgaccgatgcatttaaattgaaacgaaaggagttacggaatcattacttgaaggatattgagaggatgtacggaggcaaatag

SEQ ID NO: 22728 - DNA, 2013 bp, Artificial Sequence
  Description of Artificial Sequence: Synthetic coding sequence
atggccaagcggatcaaggccaagcccaccagcgacaagcccggcagtccgtatcgcagcgtaacacatttcgacagcttagccgtgatcgacatacctggggccgacaccttagataagctgtttgaccatgcagtgtctaagtttggtaagaaggacagcttgggcactagggagattctatcagaagagaacgagatgcagccaaatggtaaagtgtttaaaaagcttattctcggaaactacaaatggatgaattacctggaagtcaatagacgggtgaataactttggcagcggtctcactgctctcgggctcaaacccaagaataccattgccattttttgtgagacacgtgccgagtggatgatcgccgcccagacctgctttaagtataacttccccttagtaacgttgtacgcaaccctgggcaaggaggccgtggttcatggcctgaacgaaagcgaggcctcataccttattactagcgtggagctgttggaaagtaagctgaagacagcattgttggacatctcctgtgtgaagcacattatttatgtggataacaaggctataaacaaggccgaatatcccgaggggttcgaaatccattccatgcaatctgttgaggagttaggtagtaatcccgaaaatctggggatcccaccttcacgccctacgcccagcgacatggccatcgtcatgtatacatcaggtagtactggtcggcctaagggtgttatgatgcatcatagcaacctaattgctggaatgacaggacaatgcgaacgcattccaggcctcggaccaaaggatacgtacatcggctacctgcctctggcccacgttctggaactgacagccgagatctcctgcttcacatatggatgtaggatcgggtattccagccctctgaccctctctgatcagtcttccaagataaagaagggtagcaagggcgattgcaccgtcctgaaaccgacattgatggctgcagtgcccgaaataatggacaggatctataaaaatgttatgagtaaggtgcaagagatgaattacattcagaagactctgttcaagatcggttatgactacaagcttgagcagatcaaaaagggttacgacgcaccactgtgcaacttgctattgttcaagaaagtcaaagccctcttggggggcaacgtgagaatgatgctgagtggtggagccccactgtccccccaaacccaccgatttatgaacgtttgcttctgctgcccaatcggccaggggtacgggctgacagagtcttgcggggccggcaccgtgacggaagtcactgactacacaaccggaagagtgggagctcccttaatttgctgtgaaattaagctgaaggattggcaggaaggaggctacaccataaacgacaaaccaaatccccggggggagatagtaataggaggccaaaatatctctatggggtatttcaagaacgaggaaaagacagcagaggactattctgtcgatgagaatgggcaaagatggttttgtacaggcgatatcggcgagttccatccagatgggtgcctgcagatcatagatagaaagaaagatctggtgaagctgcaggccggggaatatgtgtccctgggtaaagtcgaagccgccctgaaaaactgtcctttaatcgataatatctgtgctttcgcaaagtctgaccagagctacgtgatcagtttcgtggttccaaatcagaaacgactcaccctgttagctcagcaaaaaggagtcgaaggaacctgggtggacatttgcaataaccctgccatggaggccgagatactgaaagaaatccgcgaggcagccaatgcaatgaagctggaacgcttcgagatacctatcaaggtgcgtctgagccccgaaccctggacaccagaaacgggactggtgacagacgcattcaagttgaagcggaaggaacttaggaaccattacctgaaggatatcgagagaatgtacggcggaaagtag

SEQ ID NO: 22729 - DNA, 2136 bp, Artificial Sequence
  Description of Artificial Sequence: Synthetic coding sequence
atgaagctgaagctgaacgtgctgaccatcatcctgctgcccgtgcacctgcttatcacaatctatagcgccctcatcttcattccatggtacttccttactaacgccaaaaagaagaacgccatggccaagcgaatcaaggcaaagcctacctctgataagccaggctcaccctatcgctctgtgactcattttgattccctcgccgttatcgacatccccggtgccgacacactcgacaaattgttcgatcacgccgtgtctaagttcggcaagaaagacagcctgggaactcgcgaaatccttagtgaagagaatgagatgcagcctaacggcaaggtctttaagaagctgatcttagggaactataaatggatgaattaccttgaagtgaatcgtagagtcaacaactttgggagtggtctaaccgcactcggactgaaacctaaaaatacgatcgcaattttttgcgaaacccgcgccgaatggatgatcgccgcccagacatgcttcaagtacaactttcctcttgtgaccctttacgcgactctgggtaaggaggccgtggttcatgggctgaatgagagcgaggcatcctaccttattacatccgtcgaactcctggagtccaagttaaagacggccctattggacatcagctgcgtcaaacatattatttatgttgacaataaagcgatcaataaggccgagtatcccgaggggttcgaaattcatagcatgcagtccgtggaggaactcggatcaaatcccgagaatttgggcatccctcctagtcgtcctaccccctctgacatggctatcgttatgtatacatctggaagtaccggccgcccgaagggagtgatgatgcaccactccaacctaatcgctggcatgacgggccagtgtgagagaatcccgggccttggaccaaaagacacctacatcggatatcttccactagcccatgttctggaactcacggccgagatttcgtgcttcacatatggctgtcgtatcggctacagcagcccactcactttgagtgaccagtctagtaaaatcaagaagggcagcaaaggtgactgtaccgttctaaagccaacattaatggcagccgtgccggagattatggatcgtatatataaaaatgttatgtctaaagtgcaggaaatgaactatatccagaagacgctcttcaaaattgggtatgactataaattagaacagataaaaaaagggtatgacgctcctctatgcaacctgcttttgttcaaaaaggtcaaggccttactcggtgggaatgtgcggatgatgctgtctggcggtgcacccctttctccccagacccatcgatttatgaacgtctgcttctgctgccccattgggcaaggatatggactgacagagtcatgtggcgcaggaaccgtgacagaggttactgattatacaaccggccgtgtaggggcacccctcatatgctgtgagatcaagctgaaagactggcaggagggtggctacacgattaatgacaagccgaaccctcgcggcgagattgtaatcggagggcaaaatatctccatgggctactttaagaatgaggagaagactgccgaggactattccgtggacgaaaatgggcaacgatggttttgcaccggggacatcggcgagtttcaccccgatgggtgcttacaaattatagaccgtaaaaaagacttggtgaagctgcaggccggggaatacgtgtcgttgggaaaggtggaggccgccttgaagaattgccctctgatcgataacatatgcgcatttgcgaaatcagatcagagctatgtcatctctttcgtggtccccaaccagaagcggctgacactgctcgcccagcagaagggcgttgaggggacctgggtggatatctgcaacaatcccgctatggaggctgaaattctgaaggagatcagggaagcagccaacgcaatgaagctggagcgatttgaaattccaattaaagtcagactcagtccagagccttggactcccgagacgggcctcgtgaccgacgcctttaagttgaagcgaaaggagttgagaaatcattacctgaaggacatcgaacgtatgtatgggggcaaatag

SEQ ID NO: 22730 - DNA, 165 bp, Artificial Sequence
  Description of Artificial Sequence: Synthetic coding sequence
atgaagctgaagctgaacgtgctgaccatcatcctgctgcccgtgcatctgcttattacaatctactctgccttgatctttatcccatggtattttctgacaaacgctaaaaagaagaacgccatggcaaagaggattaaagcaaagccaactagcgataagtag

SEQ ID NO: 22731 - DNA, 438 bp, Artificial Sequence
  Description of Artificial Sequence: Synthetic coding sequence
atgaagctgaagctgaacgtgctgaccatcatcctgctgcccgtgcatctcctaattaccatctattcagctttgatcttcatcccttggtatttcttgactaacgcaaagaagaagaatgcaatggcaaagaggatcaaggcgaagccaacatcagataagcctgggtccccctatagaagtgtcacccacttcgacagtctggccgtaattgatatacccggggctgacacactcgacaaactgtttgatcatgcagtttctaagttcgggaagaaagactccctgggaacaagggaaatactgtctgaggagaatgagatgcaacctaatgggaaggtgtttaagaagctcattttaggaaattacaagtggatgaattatttggaggtgaaccggagggttaataactttggcagtgggcttacagccctgtag

SEQ ID NO: 22732 - DNA, 381 bp, Artificial Sequence
  Description of Artificial Sequence: Synthetic coding sequence
atgaagctgaagctgaacgtgctgaccatcatcctgctgcccgtgcatctgctaatcactatttacagcgccttaatcttcatcccttggtacttcctcactaacgctaaaaagaagaacgcaatggccaaaaggatcaaggctaagccaactagcgataaacccggcagcccctacagaagcgtcactcacttcgatagcttggctgtcatcgatatcccaggggccgataccctcgacaaattattcgaccatgcagtgtccaaatttgggaagaaggattccttaggaaccagagagattttgtcggaggagaacgaaatgcagccaaatggcaaggtattcaagaagctgatactgggaaactataaatggatgtag

SEQ ID NO: 22733 - DNA, 465 bp, Artificial Sequence
  Description of Artificial Sequence: Synthetic coding sequence
atggccaagcggatcaaggccaagcccaccagcgacaagcccggcagtccttacaggtccgtgacccattttgacagccttgccgtgattgatatccccggagccgacacccttgacaagctgttcgatcacgccgtctccaaatttggaaaaaaagacagcctagggacacgggaaatcctgtctgaggagaatgaaatgcagccaaacgggaaagtttttaagaaactcatcctgggaaactacaagtggatgaactacctcgaagtgaaccgaagagtgaataactttggttccggactaaccgcacttggtttaaagccaaagaacacaatcgccattttttgtgagacccgggctgaatggatgatcgccgcccagacgtgtttcaagtataatttccctctggtcacactgtacgccacactggggaaagaggctgtggtgcatggccttaacgagtag

SEQ ID NO: 22734 - DNA, 387 bp, Artificial Sequence
  Description of Artificial Sequence: Synthetic coding sequence
atgaagctgaagctgaacgtgctgaccatcatcctgctgcccgtgcacctgttgattacgatctactcagcgttaatttttataccatggtactttttaactaacgccaagaagaaaaacgcaatggcgaaacggatcaaagcaaaacccacttcggacaaaccgggaagcccttaccggagtgtcactcattttgactctctggcagtaatagacatccccggagctgatacgctggacaagctgttcgaccacgccgtttctaagtttggcaagaaggacagccttggaaccagagagattctgtctgaggaaaacgaaatgcagccaaacgggaaggtgtttaagaaacttattctgggcaactacaagtggatgaactattag

SEQ ID NO: 22735 - DNA, 2475 bp, Artificial Sequence
  Description of Artificial Sequence: Synthetic coding sequence
atgcggcagagcctgctgttcctgaccagcgtggtgcccttcgtgctggccccccggcctccagacgatcccggtttcggccctcaccagagactggaaaagttggatagtttactttcagactatgatatcctgtcactgagtaatatccagcaacattcggttcgcaaacgtgacctgcagacatcaacacacgtcgagacgctgctgacattctccgcactgaaaaggcattttaaattgtatctcactagctccactgagcggttcagccaaaactttaaggtggtggtcgtcgatgggaaaaatgaatcagaatacaccgtgaagtggcaggactttttcaccggacacgtagtgggcgagcccgattcaagggttctggctcatatcagagacgacgatgttattatacgcatcaataccgatggagctgagtataatatcgaaccactctggagattcgtaaacgacacgaaggacaagagaatgctggtgtataagtctgaagatattaagaacgtatccagattgcagagccctaaagtctgcggataccttaaggttgacaatgaagaactgctccctaagggtctcgtggacagggagccgcctgaagagctcgtacaccgggtgaagcgcagggccgatccagacccgatgaagaacacttgcaagctcctggtggtggctgaccataggttttataggtatatgggaaggggggaggaatcaaccacaaccaattacctcatcgagctgatcgatcgggtcgacgacatttatagaaacacaagctgggacaacgctgggttcaagggctacggaattcagattgaacagatccggattctaaagtcacctcaggaggtaaagcccggggaaaaacattacaacatggcaaagtcctacccaaacgaagaaaaagacgcctgggatgtgaaaatgctcctggagcagttttcttttgatatcgccgaggaggcgtcgaaagtgtgcctggcgcacctgtttacctaccaggatttcgatatgggaactctgggactggcttatgtcggtagtccacgcgccaatagccatgggggcgtgtgcccgaaagcatattactcacccgtgggcaaaaaaaatatctacttgaattccggactgacctccaccaaaaactacggaaagaccatcctcacaaaggaggcagacctggtgacaacccatgagctcggacataatttcggcgcagaacatgatcccgatggactggcagaatgcgctccaaatgaagaccaggggggaaaatatgttatgtaccccatcgcagtgtcaggagatcacgagaataacaagatgtttagtaattgcagtaaacagagcatctataaaacgatcgagagtaaggctcaagagtgcttccaagaacgctccaacaaggtctgcggcaactcccgtgttgatgagggcgaagaatgtgaccccggaattatgtatctgaacaatgatacctgctgcaatagtgattgcaccttaaaagagggcgtgcagtgttcagaccggaacagcccctgttgtaagaattgtcagttcgagaccgcgcagaaaaagtgtcaggaagctattaacgcaacttgtaagggagtttcgtattgcacaggcaatagttccgagtgcccaccgcccgggaatgcagaggatgatacagtctgtctcgatctcgggaagtgcaaggatggaaagtgtatcccattttgcgagcgcgagcagcagctggagtcgtgtgcctgtaacgagacagataatagctgcaaagtctgttgccgcgatctatccggacgatgcgtcccctatgtagatgctgagcagaaaaacctattcctgagaaaaggaaagccttgcacggtgggcttttgtgacatgaatggcaagtgtgagaaacgggtacaggacgtgatagagcgattttgggacttcattgaccagctgtctatcaatacctttggaaaatttcttgcggacaacatcgttggcagcgtccttgtgttctccctgatcttttggatcccattctccatcctcgtgcattgcgtcgacaagaagttagataaacagtatgagtcgctttcactctttcatccgagtaacgtcgagatgctcagcagcatggatagcgcctctgttcggatcataaagccattccctgctcctcaaacccctggaaggctgcagccggcccctgtcatcccctcggcgccagccgcccccaaactcgaccaccagcggatggacacgattcaagaggaccccagtacagacagtcacatggatgaggatggatttgagaaggacccctttcccaattcaagcactgccgctaagtcctttgaagatcttaccgaccaccccgtaacgcggtccgaaaaagctgcttcatttaagctccaaagacagaatcgagtcgactcaaaggaaactgaatgctag

SEQ ID NO: 22736 - DNA, 777 bp, Artificial Sequence
  Description of Artificial Sequence: Synthetic coding sequence
atgcggcagagcctgctgttcctgaccagcgtggtgcccttcgtgctggccccccgccctccagacgatccaggattcggcccccaccagcgcctagaaaaactggactcgctcttgtctgactacgacatcctctctctgagtaacatccaacaacacagcgtgagaaagagagatttgcagacaagcacccacgtagaaacattgctcacattctctgccctgaagcgacactttaagctgtacctcactagtagtacagagagattttcacagaatttcaaagttgtggtagtagatggcaagaacgaatccgagtataccgtgaaatggcaagacttctttaccggccacgtggtcggcgagccggattccagagttctggctcatatcagagatgacgacgtaattatccgtatcaatacagatggggccgagtataatatagagcctttgtggcggtttgtgaacgatacaaaagacaagagaatgctggtatataagtctgaagacattaagaacgtgtctcggctgcagtctccgaaagtctgtgggtatctgaaggtcgataatgaagagctcctgcctaaaggccttgtggatagggaacctccagaagaacttgtgcaccgcgttaagagacgcgcggatcccgacccgatgaagaatacgtgcaagcttctagtggtggcagatcatcgtttctaccgatacatgggtaggggggaagagagcaccacgaccaactacctcatccacacagatagagccaactag

SEQ ID NO: 22737 - DNA, 2499 bp, Artificial Sequence
  Description of Artificial Sequence: Synthetic coding sequence
atgaagccccccggcagcagcagccggcagccccccctggccggctgcagcctagccggagccagttgcggcccacagcgaggacctgctggttcagtgcccgcttctgcccctgcccgtacgcccccatgccgcttgctgttagtcttgctgctgttgcccccgctagccgcttccagtaggccaagggcctggggggcggccgccccatccgctccccactggaacgaaacagccgaaaaaaatctcggggtgttggccgacgaggacaatactctgcagcaaaattcgtcaagtaacatctcctacagtaacgcgatgcaaaaagagataactttgcccagcagactgatctattacatcaatcaagactctgaaagtccatatcacgttctggatactaaagcccgccaccagcaaaaacataacaaggctgtgcacttggctcaagctagcttccagattgaggccttcggatcgaaattcatcctggatctcattttaaataacgggctgctgagctctgattacgtggaaattcattatgagaatggcaagcctcagtactctaaaggcggtgaacactgttactaccatggcagcatacgaggggtaaaggactccaaggtggcgttgagtacctgcaacggcctgcatggcatgttcgaagatgacacctttgtgtacatgatcgagccactcgagctagttcatgatgaaaagagcaccggacgtcctcacattatccagaaaacattggccggacagtactcaaagcaaatgaagaatctgacgatggaaaggggtgatcagtggcctttcctgagtgaattacagtggcttaaaagaagaaaaagagcagtgaatccatcccgtggaatctttgaggaaatgaaatacttagagctgatgatagtaaacgaccataaaacttataagaaacatcgcagttcccacgcacatacaaataatttcgccaagagtgtggtcaatcttgtggacagcatttacaaggagcagcttaataccagggtggttctcgttgctgtggagacctggacggagaaagaccagattgacataaccacaaaccctgtgcaaatgctgcatgaattcagcaaataccggcagcgaatcaaacagcatgccgacgccgtccacttgatcagccgggtgacattccactacaaacgttcatcccttagttattttgggggggtctgttcacggaccagaggcgtgggcgttaatgaatatggcctgccaatggccgtggctcaggtgctgtctcagtcactggctcagaatttaggaatccaatgggagccttcttccagaaaaccaaagtgcgactgtacggaaagctggggcggctgcattatggaggaaactggagtcagccattcacggaaattctctaagtgttctatcctggagtaccgggatttcctccaaaggggggggggcgcttgcctctttaatcgccccaccaagctcttcgagccaacagagtgtggcaatggatatgttgaagccggagaagagtgtgactgcggttttcatgtggaatgttacggactgtgttgtaaaaagtgttcactctctaatggtgctcactgtagtgatggtccctgctgcaataacaccagctgtctatttcagccgaggggatatgagtgccgcgatgcagtgaacgagtgcgacatcaccgaatattgcacaggcgattcaggccagtgtccccccaatctgcataagcaagatggctacgcctgcaaccagaaccagggccgctgttataatggggaatgcaaaacccgggataaccagtgccaatatatttgggggaccaaagcggcgggctccgacaagttttgctacgagaagctcaataccgagggcacagaaaaaggcaactgtgggaaggacggcgaccggtggatccagtgtagcaagcacgacgtcttctgcggattcttgctgtgtaccaacctgaccagggctccccgaatcggccaattacagggcgaaattatccctacgagcttctaccatcaagggagggtgatcgactgtagtggcgcccatgttgttctcgatgatgacacagatgtcggatacgtcgaagacggaactccatgcggaccatctatgatgtgcctcgacagaaagtgcttgcagattcaggccctcaacatgtccagttgcccactcgactcgaagggaaaagtttgcagcggacacggagtctgctcaaacgaggctacctgcatatgtgacttcacttgggccggcactgattgctccatccgggatcccgtgcggaatctgcacccgcccaaggacgagggccctaaagggccaagtgccacaaacctaataatcggatcaattgctggggcaattctggtcgcagccatcgtgctgggtggcactgggtggggcttcaagaacgtgaagaagcgccggttcgaccccacccaacagggacccatctag

SEQ ID NO: 22738 - DNA, 2499 bp, Artificial Sequence
  Description of Artificial Sequence: Synthetic coding sequence
atgaagccccccggcagcagcagccggcagccccccctggccggctgcagcttggctggggcctcctgtggcccccaacggggccctgccggcagcgtgccagcctctgcccctgccaggacacctccatgtcgactcctgctggttctgctcctacttcctccgctcgccgctagcagcagaccacgtgcctggggcgcagctgctccaagcgcaccgcattggaacgagaccgccgaaaaaaacttgggggtcctggccgacgaggacaatacattgcagcagaactctagctctaacataagctatagcaacgctatgcagaaggagataaccctgccttccagattgatctactatattaaccaggactctgaaagcccctatcacgttctggacaccaaagccaggcaccaacagaaacacaataaggccgttcacttagcgcaggccagcttccagatcgaagcatttggctccaaattcattctcgatctcatcttgaataatggactgctctcctcagattacgttgagattcactatgagaatgggaagcctcagtactctaaagggggagagcactgctattaccacggaagcatccgtggtgtgaaagactcaaaagtcgcgctctccacatgcaatgggcttcacgggatgtttgaggatgacaccttcgtctatatgattgagcctttggagctggtccatgacgaaaagagtactggtcggccacatatcattcaaaaaacgctggccgggcagtattcaaagcagatgaaaaacctgactatggagagaggcgatcaatggcctttcctgtccgagctgcagtggcttaagcgtaggaaacgcgcagttaatccttcccggggcatctttgaagaaatgaagtacttggagttgatgatagtcaacgatcataaaacttataaaaagcaccgttccagtcacgcccacaccaacaactttgctaaatctgtcgtcaacctggtggatagcatatataaagaacagctgaataccagagtagtcctggtggccgtggagacctggactgagaaggatcaaatcgacattaccactaacccagttcagatgctgcatgagttcagcaagtatcgacagaggatcaagcagcatgctgatgctgtgcatctgatctcgagggtgacttttcattataaacgctcctccctatcgtattttggcggtgtctgttcacggacgcggggggtgggagtgaacgagtacggactgccgatggccgtggcccaagtgctcagtcaatcgctagcacaaaatctgggcatccaatgggagcccagcagccgaaaacctaaatgcgattgcaccgagtcctggggcgggtgcatcatggaagagacaggagtctcccatagtaggaagttctccaagtgcagtatcctggaatacagagacttcctgcagagaggcgggggcgcatgcctgttcaatcgccctacaaagctgttcgagccaacagaatgcgggaacggctacgtggaggctggggaggagtgcgactgcggattccatgtggaatgttatgggttatgctgcaaaaaatgctccctgtctaacggcgcccactgcagcgatggcccgtgctgtaataacacaagctgcttgttccaacctcggggatatgaatgtagagacgccgttaatgagtgcgatattacagagtactgtaccggagattctggccagtgtcctccaaaccttcataagcaggatggctacgcttgcaatcagaaccaaggccggtgctataacggggagtgcaagaccagagacaaccagtgtcaatacatctggggtactaaggcagctggatccgacaaattctgttatgagaaactgaatacagagggcacagaaaaaggaaactgcggaaaagatggggacaggtggattcaatgctctaaacacgacgttttctgtggctttctactgtgcaccaacctgacccgcgccccccgcatcggacagctccaaggggagattatccccacctctttctaccaccagggccgcgtaatagactgttctggagcgcatgtggtgttagacgatgacaccgacgtggggtacgtcgaagacggtaccccttgcggacctagcatgatgtgcctggacagaaagtgtcttcagattcaggcccttaacatgagttcatgcccactggattctaaagggaaggtgtgctccggacacggggtttgctccaatgaggctacctgcatttgtgattttacttgggcgggcacagactgctccattcgggaccccgtcaggaacttgcatccccccaaagacgaaggcccaaaggtgaatatggccacttctcggttaatcggtgccgtggctggaaccatcctggcactaggggtcatcttcggaggaaccggctgggggattgaaaatgtgaaaaaaaggcggtttgaccccacgcagcaagggcccatatag

SEQ ID NO: 22739 - DNA, 2499 bp, Artificial Sequence
  Description of Artificial Sequence: Synthetic coding sequence
atgaagccccccggcagcagcagccggcagccccccctggccggctgctccctagccggagcttcatgcggaccccagaggggaccagccggcagcgtgcccgcctccgcaccagcaaggactccaccctgtagattacttctggtcctgctgctgctgcccccactggcggcctcatctaggccccgagcttggggagccgctgcaccctccgcaccccattggaatgaaacagccgagaaaaacctgggtgtgctggccgacgaagataacaccctccagcagaatagttcctcaaatatcagctatagcaacgctatgcaaaaggagatcacattaccatcgcggctaatttactacatcaaccaggactcagagtccccatatcacgtgctggataccaaagcgcgacaccagcagaagcacaataaggccgtgcacttagcacaggcgagcttccagatcgaagcattcgggtccaagtttatcctagacctgatactaaacaatggcctgctgtcctccgattacgtggagatacactatgagaatggcaaaccacagtattcaaaaggcggtgaacactgttactatcatgggtcaatacgcggtgtgaaggacagcaaagtagcattgtcaacttgcaacggtttgcacggaatgtttgaggatgatactttcgtgtacatgatcgagcctctggagctggtacacgacgagaagtccacaggtcgcccccatatcatccagaaaacactggctggacagtacagcaaacagatgaagaatttaactatggagagaggagaccagtggcctttcctttccgaacttcaatggctgaaacgcagaaagcgggccgtgaacccatccaggggaattttcgaggagatgaagtacctagagctgatgattgtgaatgatcataagacatacaagaaacaccgatccagccacgcccatactaacaatttcgcaaagagcgttgttaatttggttgacagcatttacaaggaacaactcaacaccagggtggtgctggttgctgtggaaacatggacggagaaggatcagatcgacatcaccactaacccggtccaaatgctgcatgagttttcaaaatataggcaacggatcaagcagcacgccgatgcagtgcacttgatctctcgcgtcaccttccattataaacgcagcagcctgtcttactttggtggcgtctgtagcaggacacggggcgtaggcgttaatgaatatggactgccaatggccgttgctcaggtgctgtcccagtctttggctcagaatctcggaattcagtgggagccttcaagccgaaaacccaaatgcgactgtacggagagctggggcgggtgcataatggaggagaccggagtgagccactctagaaagtttagtaaatgcagcatcctcgaataccgggatttccttcagcgcggtgggggcgcctgtctcttcaatcgacccaccaaactttttgagcccacagaatgtggtaatggatacgtggaagccggtgaggagtgtgactgtggcttccacgtggaatgttatggactgtgttgtaagaagtgtagtttatccaacggagctcactgttctgatggtccatgctgcaacaacacttcctgtctgtttcagccacgcggttatgagtgcagggatgctgttaacgaatgcgacatcaccgagtactgcacaggagacagcggacagtgtcctccaaacctgcataagcaggatgggtatgcttgtaaccagaaccaaggtcggtgctataatggggagtgtaagacgcgggacaatcagtgccagtacatctggggcactaaagccgctggaagcgacaagttttgttacgaaaaattgaacaccgagggaactgagaagggtaactgcggaaaagatggagaccgttggattcagtgtagcaaacatgacgtgttttgtggtttcctcctctgcaccaatttgaccagggcgccacggataggccagctgcagggagagataatcccgacttccttttaccatcagggtcgtgttatcgattgcagcggcgctcacgtagtgctggacgacgataccgacgtgggatacgtggaagatggcacaccatgcggaccctcaatgatgtgtctggatcgcaagtgtttgcagatccaggccttgaacatgagtagctgccctctcgactcaaagggaaaggtctgtagcgggcacggggtctgctcaaacgaggccacctgtatttgtgatttcacttgggcaggtaccgattgttcgataagagatccagtccgcaatttgcaccccccaaaagacgagggccctaaggagatgtccaggcgggaggggtcaatccttctgtcaaaagccccatcagagagcgcggccctggatgggcaccgcctggcacttctcgactcagggtacgatatactggccgcggtgctgctggaattgctaagcctgtag

SEQ ID NO: 22740 - DNA, 2100 bp, Artificial Sequence
  Description of Artificial Sequence: Synthetic coding sequence
atgcagaaggagatcaccctgcccagccggctgatctactacatcaatcaggactccgagtctccctaccatgtgctggatacaaaagctagacatcagcagaagcacaataaagctgtccacctcgctcaggcgtcttttcagatcgaggcgttcggatctaagtttatcctcgacctgattcttaacaatggcctcttaagcagtgactacgtcgaaatacactacgagaatggcaaaccacagtactcaaaggggggtgaacactgttactaccacggttctatacgaggcgtcaaggacagcaaagttgctctgtccacatgcaatgggcttcacgggatgtttgaagatgacactttcgtgtatatgatagagccactggagctcgtgcatgacgaaaaaagcacaggccggccccatattatccagaagaccttggcagggcagtattccaagcaaatgaaaaacctaactatggagaggggcgatcagtggcctttccttagtgaacttcaatggcttaaaagaaggaagagggcggtaaacccatccagaggaatctttgaggagatgaaatatcttgaactgatgatcgtcaacgaccacaaaacttacaaaaaacatcgttcctcccacgcacacactaacaattttgcaaaatcagtggttaacctggtggattctatctacaaggagcagttgaacacgcgcgtagtcctggttgctgtggagacctggactgagaaggatcaaatcgatatcacgacaaatcctgtgcagatgctgcacgagttttccaaatatcggcagcgcattaagcaacacgccgacgcggtgcacctcatatccagagtaacatttcactacaaaaggagctcactctcctacttcggtggcgtgtgcagccgtaccagaggagtgggggtgaacgagtacggcctgcctatggcagtggcccaggtgttatcccagtcccttgcccagaacctgggcatccagtgggaacccagcagtcgaaaacctaaatgtgactgtaccgagagttggggtggttgcatcatggaggaaaccggcgtgagtcattcgcgcaaatttagtaagtgttccatcctagagtaccgagattttctacagcgcggaggaggcgcctgcctttttaaccggcctactaagctattcgaacccacggagtgtggcaacgggtatgtcgaggcaggcgaggaatgtgattgcggctttcatgttgaatgctacggcctctgctgcaagaagtgctcactgagcaacggtgctcactgctctgacgggccttgctgtaataacacctcatgcctcttccaaccacgggggtatgagtgccgggatgccgtgaacgagtgtgatattaccgaatattgtactggtgacagtgggcagtgcccaccaaacctgcataaacaggacgggtatgcttgcaatcagaaccagggtaggtgctacaacggggaatgtaagaccagggacaatcagtgccagtacatctggggcactaaagccgctggctcagacaaattctgttacgaaaagctgaataccgagggcaccgagaagggaaattgtggaaaagacggcgaccggtggatccaatgctcaaagcatgatgtgttctgcgggtttttgctctgtactaacctgacacgggccccacgtattggccagctgcagggagaaatcattccaacgagtttttaccatcaaggccgtgttattgactgttccggggcccacgtggtcctggacgacgacactgatgtgggatacgtagaggatggaacaccatgtggcccctctatgatgtgtcttgacaggaaatgcttgcaaattcaggcgttgaacatgagttcttgtccactggactcgaaggatgagggccccaaggcatgctttttgaagcgtacaaagtgcaaaagctaccctaagcaccgcaaatgccaggaggagaaagtgcgatcttactcagctagaccccaccttaatcagctaagatggatggacacagcccttcactgctggattctcggaatgacttattcacagcagtgctactggaactactag

SEQ ID NO: 22741 - DNA, 324 bp, Artificial Sequence
  Description of Artificial Sequence: Synthetic coding sequence
tgacagatccaggccctgaacatgagcagctgccccctggacagcaagggtaaagtgtgttcaggccacggcgtgtgcagtaacgaggccacctgcatttgcgacttcacatgggccggcaccgactgcagtattcgggatcccgtgcggaatctccatccaccgaaggacgagggacccaaagagatgtcccggagagaagggagcatcctcctgtctaaggcccccagcgagtctgccgccctggatggccaccgtctggccctgctagattctggctatgatatactggcggccgtgttactggaacttttgagcctgtag

SEQ ID NO: 22742 - DNA, 8532 bp, Artificial Sequence
  Description of Artificial Sequence: Synthetic coding sequence
atggccgccgccagctacgaccagctgctgaagcaggtggaggccctcaaaatggaaaattctaaccttaggcaggagttggaagataacagtaatcatcttaccaaactggaaacggaagcctcaaacatgaaggaggtactgaagcaactgcagggtagtatcgaggatgaggctatggcctcctctgggcagattgatctcctggaaagactcaaagagctcaatcttgattcctcgaattttccaggagtgaagctgcgatccaagatgtctctccgatcttacggatcaagggagggctctgtgagctcacggagtggcgagtgttcgcccgtgccaatgggatccttcccacggagagggtttgtcaacggaagtagagaaagcactggttatctcgaggaactcgagaaggaaagatcccttctgctcgcagatcttgataaagaagagaaggaaaaggactggtactatgcgcagttacaaaacctaacaaagcggatcgactcactaccgctgactgaaaatttttctctgcaaaccgatatgacgagacggcaactagagtacgaggcccgccagatcagggttgccatggaagagcagctggggacttgccaggatatggaaaagcgggctcagcgtcggatcgctagaatccagcagatagagaaagacatcctgcggatcaggcagctactccaaagccaggccaccgaagccgagcgttcaagccagaataagcacgaaactggcagccacgacgcagagcgtcaaaatgaagggcagggtgtgggagagatcaatatggcgacatcaggcaatggccaggggtccactactagaatggatcacgagactgccagtgtgctgtcatcctccagcacccactctgcaccacggaggctgactagccacctgggtaccaaagtggagatggtctatagcctgctgtcaatgctcggaacgcatgataaagatgatatgtcccgcacgcttcttgcaatgtccagctcccaggattcctgtatctctatgcgtcaatcggggtgcctgcctctgctcattcagttactccacggaaatgacaaagactccgtgctgctcggcaacagcagaggcagcaaagaggcccgtgcgcgcgcttccgccgcactgcataacatcatccactctcagccagatgataaacgcgggcggagagagatccgtgttctgcatctgctcgaacagattcgtgcctactgtgaaacctgctgggagtggcaagaggcacatgagcctggtatggatcaagataagaacccaatgcccgctcccgtggagcaccagatctgtcccgcagtctgcgtgctgatgaagctttcctttgatgaagagcatcggcacgctatgaatgaacttggcggcctccaggctatcgcagagctgcttcaggtcgactgcgaaatgtatgggctcaccaatgaccactacagtataactctgagacgctacgccgggatggctctgacaaatctcaccttcggcgacgtggccaataaggcaactctctgctccatgaagggttgcatgagagcacttgtggcacagctgaaatccgagtctgaggacttacagcaggtgattgcttccgtgttaaggaacctgtcatggcgggcagacgtaaatagcaagaagacgctacgagaagttggttccgtaaaggctctgatggagtgcgccctggaagtgaagaaagagtccaccttaaagtcagtgctgtcagctctatggaacctgagcgcccactgtactgaaaacaaggccgacatctgtgcagtggacggtgcgttagccttcctggtagggaccttgacttacaggtcccagactaacacattggccatcatcgaaagcggaggcgggattctgaggaatgtgagctctttgattgccacaaatgaagatcacaggcagatcctgagggaaaataattgtcttcaaaccttactgcaacatctcaaaagccacagcctgacaatcgtttctaacgcttgcgggacgctgtggaatctcagcgctaggaacccgaaggaccaagaagccctatgggacatgggagcggtgagcatgttgaagaacctgatccacagcaagcataaaatgatcgccatgggatccgccgcagcactgcggaatctcatggcaaataggccagccaaatataaagatgccaatattatgtcccccggctctagccttcctagcctccacgtccgaaaacagaaggcattggaagccgagctggatgctcagcatctatcagaaacatttgacaacatcgacaatctttcacccaaggcctctcacagatctaaacagaggcataagcaatctctctacggggattacgtcttcgacacaaatcgccacgatgataatcgcagcgacaactttaatactggcaatatgaccgtgctgagcccatatctgaacaccactgtgctaccaagctcctcatcttcacgcggaagcctggactcctcccgatcagagaaggatcgaagcttagagcgcgagcgaggcataggcctgggcaattaccacccagccaccgagaatccaggcactagctctaagcgtggattgcagatctcaactacagctgctcagattgccaaggtgatggaggaagtgagtgccatccacaccagccaggaagaccgcagcagcgggagtaccaccgaactccactgcgtcacagatgaaagaaatgcgctcaggaggtcttccgctgcacacacccactccaatacctataacttcacaaaaagcgagaattctaaccggacctgcagcatgccatacgctaaactcgaatacaaacggtcatcgaacgacagcctgaactccgtgagcagcagcgatgggtacggcaagaggggccaaatgaagccatcaatcgagagctactctgaagacgacgagtccaaattttgtagttatggtcagtaccccgctgaccttgcacacaagatccattctgccaatcacatggacgacaatgatggagagctggacactcccataaattactctcttaagtattctgacgagcagttgaacagcggcaggcaaagtccttcacagaacgaacgatgggcgcgcccaaaacacatcattgaggatgagataaagcagagtgagcagaggcaatcgaggaatcagagcaccacctatcctgtttacactgagtcaacagacgataagcatctgaaatttcagccccatttcgggcagcaggagtgtgtctcgccataccgctccaggggagcaaatggcagtgagaccaatagagtcggctcaaaccacggtataaaccagaatgtctctcagagcctgtgccaggaagacgattatgaagatgacaagccaacaaattattccgagcggtactccgaagaagagcagcacgaggaagaagagcggcctaccaattactctatcaagtacaacgaggaaaaacggcatgtggatcaacccatagactactcacttaaatacgctacggatattccatcctcgcagaaacagtcctttagcttcagcaagtcttcatccgggcagtcatccaagaccgagcacatgagctctagtagcgagaatacatctaccccctcctccaatgccaagcgtcagaaccagctacatccctcaagtgcccagtctcgatccggacagccgcagaaggctgctacgtgtaaggttagttctataaatcaggaaaccatccagacctattgcgtcgaggacacacctatctgcttcagccggtgtagctcactgagcagcctatcttctgcagaggatgagatcggatgcaatcagaccacgcaagaggctgacagcgcaaataccctgcagattgccgaaattaaagagaaaattggcacccgctctgccgaagacccagtatctgaggtgcccgccgtttctcagcatccccgcacaaaatcttcccgtttgcaggggtcttcactgtccagcgaaagcgcacgtcacaaggcagtagaattttcctcgggggctaagtccccctccaaaagtggagcacagacccctaagagcccacctgagcactacgttcaggagacccccctcatgttctcccgatgcaccagcgttagttctctagactcattcgaaagccgctctatcgccagcagcgttcagtctgagccgtgctcgggcatggtatcgggcattatcagtccctccgacttaccagacagcccaggacagaccatgcccccctcaaggagtaagacaccccctccacctccccaaacagctcagacaaaaagagaggtccctaagaacaaggcccctacggctgaaaagagagagagtggtcctaaacaagctgctgtgaacgcggccgtccagagggtgcaagtcctgcccgatgctgataccctcctccatttcgccactgagagcacacccgacggtttttcttgtagctcgtcgttgagcgctcttagccttgacgaaccctttatacagaaggacgtggaactgcgcattatgccccctgtccaggaaaacgataatgggaacgaaaccgagagtgagcaaccaaaagagagcaacgaaaaccaagaaaaagaggcggaaaaaactatcgactctgaaaaagacctcctggacgattctgacgatgacgatattgaaattctggaggagtgcattatctctgccatgcccaccaagtcaagccgcaaagccaaaaagcctgcccagacagccagcaaactgccacctcctgtggctcgtaagccttcccaactgccagtgtataaactgctgccttctcagaatagattgcagccacaaaagcatgtgagcttcacacctggggatgacatgccccgtgtgtactgcgtggaaggcactcccattaatttcagcactgcaacttcactgtcagaccttactatcgagtcgccgccgaacgagttggctgccggagagggggtgcggggcggagcccaaagtggcgagtttgagaagcgggacacaatcccgacagagggccgtagcacggacgaggcccagggaggcaaaacaagtagcgtgactattccagaacttgatgataataaggctgaggagggcgacattttagctgagtgcattaactccgccatgcctaagggaaaatctcataaaccatttcgcgttaaaaagatcatggaccaggtgcagcaggccagtgcctcttcttccgcccccaacaaaaaccaacttgatggaaagaagaagaaacccacctcccctgtaaagcccattcctcaaaatactgagtaccgcacgcgggtgcgcaaaaatgcggatagcaagaataaccttaacgcagagcgtgtcttttcagacaacaaagactctaagaagcagaacctaaagaacaattccaaagtttttaacgacaagctgccaaacaatgaagatagggttagaggctcttttgcattcgattccccccaccactacacgcctatcgagggcactccttactgtttctcacgtaatgactctctgtcatcattggatttcgatgacgatgacgtggatctgagtagagagaaagcggagctgcgcaaagccaaggagaacaaggaatccgaagctaaagtcactagccatactgagttaaccagcaatcagcagtctgcaaacaagactcaggcaattgcaaaacaacctattaacagaggtcagcctaaaccaattctgcagaagcaatcgacattcccacaaagttctaaagacatcccggaccgtggcgccgcaaccgacgaaaagttacagaattttgcaatcgagaatacgcctgtttgtttcagtcacaactcctcactgtctagcctctccgacattgatcaggagaacaataacaaagaaaatgaacccattaaggagacagagccacctgacagtcagggcgagcccagcaaaccccaagctagcgggtacgcacctaagtcttttcatgtcgaagacacccccgtctgcttctcccggaattccagtctgagttctctctcgatagattccgaggatgatctgctgcaagaatgcatttcaagtgcaatgcccaaaaaaaaaaagccctcccgtctgaaaggagacaatgagaagcacagtccgaggaacatgggaggaatccttggggaagatttgactctcgatctgaaggacatccagcggcccgactcagaacatggactttctcctgacagcgaaaattttgattggaaggctatccaggagggcgccaactccatcgtctcatctctgcaccaggcggccgccgccgcctgcttgtctaggcaagcgtcgagcgactctgatagtatattatcactgaaaagcggcatctctctgggttcaccatttcacctgactcccgatcaggaggagaagccattcacatccaacaagggcccccggattttgaagcccggagagaaatctaccctggaaactaagaaaatcgaatccgaatcaaagggcataaaaggtggaaaaaaggtgtataagtccctgatcaccggaaaagtgaggtctaactctgagattagtggacagatgaaacagcccctgcaggccaacatgccgtctatttcccgcggcagaactatgatccacatcccaggagtcagaaactcatctagttcaacatcaccagttagcaagaaaggtccaccgctgaagacccccgccagtaagtctccaagcgagggccaaactgcaaccacttctccaaggggggccaaaccgagcgttaagagcgagctctctccagtggcaagacagacctcgcaaattggtggcagtagtaaggccccctcaaggtccgggtctagagattctaccccatcgcggccagcccaacagcctctgagcagacctatccaatctcctggcagaaactccatatctcccggacgtaacggtatcagcccacctaataaactgagccagttgcctcgcacaagttccccttcgactgccagcacaaagtcaagtgggtccggcaagatgtcttacacatcccctgggcgtcagatgtcacagcagaacctcaccaaacagaccggactatcgaagaatgcctcctctatcccacgtagtgaaagtgcctcaaagggtctcaatcaaatgaacaacggcaacggcgcaaataagaaggtggagctttcacggatgtcctccacaaaatcatcgggctccgagtctgacaggtcagaacgccctgtccttgtgcgccagagtactttcataaaagaggctccgtcgccgactttgcggagaaagttggaagaatccgcctcgtttgagtccctgagtccgtcgagcagacccgcctctcccacccgcagccaggcacaaacccctgtcctctccccttcactgccagacatgtctctgtccacccactccagtgtgcaggcgggcggatggcgaaagcttcctcccaacctgtcaccgacaatagaatacaatgacggcaggccggccaagcgccacgatatcgcacggagtcactccgagagcccctccagattgcccattaatcggtcaggcacttggaagcgtgagcactccaagcactcgtcctcactcccacgcgtgagcacttggaggagaactggatcaagcagttcaattctctccgcgtcctccgaatcctctgagaaggccaagagtgaggacgaaaagcacgtgaattctatcagcgggaccaagcaaagcaaggaaaaccaagtatctgcaaagggcacttggcggaagattaaagaaaatgagttttccccaaccaactccacaagccagacagtgtccagcggtgctacgaacggtgccgaatccaaaacgctgatctaccagatggcacccgcggtgtctaaaacagaagacgtatgggtcagaattgaggattgccccatcaacaatccccggagcggtagatctcctaccggaaacactcctcccgtcatcgactctgtcagcgaaaaagcgaatccaaacatcaaggattctaaggataaccaggcgaaacagaacgtgggtaatggatctgtgcctatgaggacagtgggattggagaatcgtctgaacagttttattcaggtggatgcaccagatcagaaggggacggagataaagcctggtcaaaacaacccggtccctgtttcagaaacaaatgagtcaagtatcgttgaaaggacacctttttccagctcctccagtagtaagcactccagcccgtccgggaccgtcgccgcccgggtgacaccatttaattataacccctcacccaggaagtcatcagccgacagcacctctgctaggcctagccagattcccaccccggtaaataataataccaagaaacgggactccaaaaccgactcgaccgaatcatctggaacccagtcacctaagcggcacagtgggagctacctcgtcacgagtgtgtag

SEQ ID NO: 22743 - DNA, 8532 bp, Artificial Sequence
  Description of Artificial Sequence: Synthetic coding sequence
atggccgccgccagctacgaccagctgctgaagcaggtggaggccttaaagatggagaattcgaacttgagacaggagcttgaggacaacagtaatcatctcactaagctggagaccgaggctagcaatatgaaggaggttcttaagcagctccaggggtcgattgaagatgaagctatggcaagttccggccagattgacttattggagcgtctgaaagagctgaatcttgatagcagcaatttcccgggtgtcaaactgcgatcaaaaatgagtctcaggtcttatggctctcgggaggggtcggtgagttctagatctggagagtgtagcccagttccgatgggcagcttccctcgccgggggtttgttaatggctccagagagtccaccggataccttgaagagctcgagaaagagcggtcactacttctcgccgacctggataaggaggagaaggagaaagactggtactatgcccagttacagaaccttaccaagcgaattgactccctgccactgaccgaaaacttctcccttcagactgatatgacacgacggcagctggagtacgaagctcgccagattcgggtcgcaatggaggagcagctgggaacgtgccaagacatggaaaagagggcacaacgaaggatcgccaggatccagcagatagagaaagatatactgcggatacggcagctgcttcagtctcaggccactgaagccgagaggagctctcagaacaagcacgagacagggtctcatgacgccgagcgacaaaatgaaggacagggagtaggggagataaatatggccacctccgggaatgggcaggggtccaccacccgcatggaccatgaaactgcgagcgttctttcatcttcgtccacccacagcgctccacgccgtctcaccagccatctgggaacaaaggtagagatggtgtacagtttgctgtcaatgctaggcacccatgataaagatgacatgagtaggaccctgctggctatgtcgtccagccaggatagttgtatttccatgaggcagagcgggtgtctgccactgttaatccagctcctgcatggcaacgacaaagactccgtactgttaggaaacagccgaggcagcaaggaggcccgagcccgcgccagcgccgctctccacaatattatccacagtcagccagatgataaaagagggcggagagaaatccgggtgttacacctgctcgagcagattcgcgcctattgcgagacctgctgggagtggcaagaagcccatgagccgggtatggatcaggataaaaatcccatgcctgcacccgtggaacatcaaatttgtccagcagtgtgtgtgctcatgaaattaagcttcgacgaggaacataggcacgcgatgaacgaacttggcggcctccaggcaattgctgaattgctgcaggtcgattgtgaaatgtatggcctgaccaacgatcattatagcatcacgctcagacgatacgctgggatggcactgacaaacctcacattcggtgatgttgccaataaagccaccttatgttcaatgaaggggtgcatgcgcgctcttgttgcgcagctgaagagcgagtcagaggacctgcaacaggtcatcgcttccgtactgagaaacctctcttggcgcgccgatgtcaatagcaagaaaacactgcgagaggtgggctctgtgaaggccctcatggagtgtgcgttggaagtgaagaaggagtctaccctcaagtcagtgctttccgctctgtggaacctgtctgcccattgcactgaaaacaaggccgatatatgcgcagtagatggggcattggcgttcttagttggaacactaacttaccggtcccagactaatactctggccatcatcgaaagcggaggcggcatcctgcgcaatgtgtcgtccctgatagccacaaacgaggatcaccgacagatacttcgagagaataactgtctgcagaccctgctgcagcatttgaaatctcacagtctcaccatcgtctccaacgcctgtggcacgctttggaatctgagcgctcggaacccgaaggaccaagaggccctgtgggatatgggagcggtgagcatgcttaagaatctaattcactcaaagcacaaaatgatcgctatggggtctgctgccgctcttagaaatctgatggcgaatagaccagctaaatacaaagacgcgaacatcatgagcccaggctcttctttgccctcgctgcacgtgcgcaagcagaaggcactcgaggccgaactagacgcgcagcacctgtctgagacattcgacaatattgacaatctctcaccaaaagcaagtcaccgcagtaaacagcgacacaagcagagtttatatggcgactatgttttcgataccaataggcacgacgacaatcgctccgacaatttcaacacaggtaatatgactgtgctcagtccttatttaaatacgaccgtgctccccagttcctcttcctcacggggatctttggactcctctcggagcgaaaaggaccgctcactggagagagagcggggtatcggactcgggaattaccatccggctacagaaaacccaggcacctcttccaaacgtggcttgcaaatctccacaactgcggcacaaattgccaaggttatggaggaggtgagtgccatccacactagtcaagaagaccggtcttccgggagtaccacagaattgcattgtgtgacggatgagcggaacgccttaaggcgctcatccgcagcacacacccatagcaacacatacaattttacaaaatcagagaatagtaatcggacttgttctatgccgtatgccaaactggaatataaacgttcctccaacgattcattgaattctgtgtcttcctctgatggctatggtaaacgggggcagatgaaaccatccattgagtcttattccgaggacgatgaatctaagttttgcagttatggtcagtatccggccgacctcgcccacaaaattcactctgcaaatcacatggacgataacgatggcgagctggacacaccaatcaattattcccttaaatacagcgatgagcaattaaatagcggacgccagagcccttcacagaatgaacgatgggccaggccaaagcatattatcgaggatgaaatcaagcagagtgagcagagacagagtagaaatcagagcacaacgtaccccgtgtataccgagtccacagatgacaagcatctcaaattccaacctcacttcgggcagcaggaatgtgtgagcccttatcggtccaggggagcaaacggaagcgaaaccaatagggtgggaagtaatcacggcattaaccagaacgttagtcaatccctgtgccaagaggatgactatgaagatgataagcctaccaactactcagagcgctatagcgaagaagaacagcacgaggaggaggaaaggcctaccaactatagcattaagtacaacgaggagaagcgacacgtggaccagccaatcgattattctcttaagtatgcaacggacatcccctccagccagaagcagtcctttagtttcagtaagtcttcgtcaggtcagagctccaaaacggaacacatgagcagcagctctgagaacacctcaacacctagctcaaatgcaaagcggcaaaaccaactgcatccttccagtgctcagtccaggagtgggcagcctcagaaggcagccacatgcaaagttagttcaattaatcaggagacaatccagacatactgcgtagaagacactcccatctgtttctccagatgctcatctctgtcttccctttccagcgctgaggacgaaataggctgtaaccaaaccactcaggaggcagattccgctaatacgctgcaaatcgcggagattaaagagaagatcggcacccgaagcgcagaggaccctgtttctgaggtccccgctgtgagtcagcacccgagaaccaaatcctctcgactgcaggggtccagcctgagctctgagtccgcgcgccacaaggctgttgagtttagcagtggcgctaaaagccctagtaaaagcggggcacagactcccaaatcgcctcccgagcattatgtccaggagacccccttgatgttttcccggtgcacctctgtctctagtctggactcctttgaatcacgctccatcgccagtagcgtccagtcggagccttgcagcggtatggtgtctggcataatctccccttcagatttacccgatagtccaggacaaacgatgccaccttctaggtctaagacacctcctcctcccccgcagactgcacagacaaagagggaagtgcccaagaataaagcacccacagcagagaaacgggaaagcggtcccaagcaggccgcagttaacgctgcagtgcagagagttcaggttttacctgacgctgatacacttttacattttgcaacagaaagtacccctgacggttttagctgctctagcagtctttccgcgctgtccctggatgaaccattcatccaaaaagacgtcgagcttcgcatcatgcctcctgtgcaggaaaacgacaatggaaacgagaccgagtctgagcagccaaaagaatcaaatgagaatcaagaaaaagaagcggaaaagactatagatagtgagaaagacctgctcgatgacagcgacgatgatgacattgagattttggaggaatgtatcatttcagccatgcccacgaagagtagccgcaaagccaagaaaccagcccagacagcgagtaagttgccacctcccgtcgcacgcaaacctagtcaactgcccgtatacaaattactgccttcccagaaccgtttgcaaccccaaaaacacgtgtctttcaccccaggcgacgatatgcccagagtgtactgtgtagaaggaactccaattaacttcagtacagccacctcccttagcgacttgaccatcgagagccccccgaatgaactggcagccggggagggggtaagggggggcgcgcaaagtggcgagttcgagaagagagatacgattcccaccgaagggcgttccaccgacgaagcccagggcggtaaaacttcctccgtgacaattcctgaactggacgacaacaaggcagaggaaggtgacattctggccgaatgtatcaacagtgccatgccaaaggggaagagtcacaaaccatttcgggtaaaaaagattatggaccaagttcagcaggctagcgcctctagttcagcaccaaataagaaccagttagatggcaaaaaaaagaagcccactagtccagtgaaacctataccacagaataccgagtatagaacacgggtgcggaaaaacgctgacagcaagaacaacctgaacgccgagagggtgttctctgataacaaggacagcaagaagcaaaatctaaaaaacaatagtaaagtcttcaacgacaagttaccgaacaatgaagacagagtgagggggagcttcgcgtttgactcgcctcaccactataccccaattgagggcacaccctactgtttttccaggaacgacagcttgtcctctctggacttcgacgacgacgatgtggatctcagcagagagaaggctgagctccggaaagccaaggagaacaaagagtccgaggccaaagtgacttcacacaccgaactcacatctaaccagcagagcgccaacaagactcaggcaatcgccaagcagcccatcaaccgggggcaacccaagccaatactccagaagcagagtactttcccacaaagctctaaggatattccggataggggagcagccaccgacgagaaactgcagaattttgccatagagaacactccagtttgtttttcacataactcatccctctcatctctgtccgatatcgaccaggagaataataataaggagaacgagccaatcaaggagaccgagcctcctgattcccagggcgagccttcgaaaccccaggccagcggctacgcacccaagagtttccacgtggaagataccccagtgtgctttagtcggaattcaagcctgtcctctttgagcatcgattctgaggacgatctattgcaggagtgtatttcctctgccatgcctaagaaaaagaaaccttcgagattaaaaggggacaacgaaaaacactctcctaggaacatggggggcatactgggcgaagatcttaccttggacctgaaagacattcaaaggcccgactctgagcacggtctaagcccggattcggagaactttgactggaaagctatacaggaaggggccaactcaatcgtatcttctctacaccaggcggcagcagcagcttgcctgagccgtcaggcctcttcggattccgactcaatcttgtctctgaaatcggggatcagcctgggatccccctttcacctgacaccggaccaggaggagaagcctttcactagtaataagggacctcgcatcctgaagccaggcgaaaaaagcactctggagaccaagaagatcgagtccgagagcaagggaatcaagggcggcaagaaagtgtataagtcgttaatcacaggcaaagtgcgctccaatagcgaaatcagcggccagatgaaacagccgctgcaggctaacatgcccagcattagtcgcggcaggacaatgatccacatacccggtgtgagaaatagcagtagcagcacctcacctgtttccaagaaaggacctcctttgaagacccctgcttcgaagtctcccagcgagggacagactgccacaacctctccaaggggcgccaagccttctgtaaagagcgagctgtctcccgttgccaggcagacctctcagatcggcggctcatccaaagctccgagtcggtctggaagtagggattctacgccatcgcgaccagcccagcaaccgctgtccagacccattcagagccccggccggaacagtatctctccgggaaggaatggcataagtcctcccaataagcttagccagctacctaggaccagcagtcctagtacagctagcacgaagtcatcaggaagcggaaaaatgtcctatacatcacccggacgacagatgtcacagcaaaaccttactaaacagaccggactgagcaaaaacgccagcagcattccaaggtcagagagcgcgagtaagggcctcaaccaaatgaacaatggtaacggggccaataaaaaggtggaacttagcagaatgagcagcactaagagctcagggtctgaatccgacaggtctgaacggcccgtgcttgtccgccagagtacttttattaaggaagcaccatcaccaaccctccgacgtaagctagaagaatctgcatccttcgagtcattgagtcccagctcacgccctgccagtccgacacggtctcaggcccagacccccgtgctgtccccatctctcccagacatgtctctttcaacccattcctcagtgcaagcaggcgggtggcgaaagctcccacccaacctgagccctactatagagtacaacgacgggagacctgctaagagacacgacattgcccgatcccattccgaaagcccttctaggctgcccataaaccgatctggcacatggaaacgggagcacagcaaacattcaagttctctgcctcgcgtgtccacatggcgccgtacggggtcttctagcagcatcctcagcgcttcctccgaaagctccgagaaagccaagtcggaggatgaaaagcatgtcaactccatcagcggaaccaaacaatcgaaggagaaccaggttagcgctaaaggaacatggagaaaaattaaagaaaacgaattttcacctactaatagcacctcccagaccgtgagtagcggggccacaaatggagccgagtctaagactctcatttatcagatggcccctgcagtgtccaaaaccgaggatgtctgggtgcggatcgaagattgcccgatcaacaacccaaggtccgggcgctcccctaccggaaacactccacctgtcattgattccgtatccgagaaggccaacccaaacatcaaagattcaaaagacaatcaggccaaacagaacgttggtaatgggtctgtgcctatgcgcacagtgggcttggagaatcggctaaactctttcattcaggtcgatgcaccagaccaaaagggtacagagattaaacctgggcagaataacccagtccccgtgtccgaaacaaacgaaagcagtatagtagagaggactccattctcctccagtagtagctctaaacattcgagtccctctggaaccgtagccgccagggttaccccttttaactacaatccatctccccgcaaatctagtgctgactccacgtcagctagaccatcacagatccctacacctgtcaacaacaataccaagaaacgagactctaagacggattctactgagagctctgggacccagtcgcccaaacggcacagcggctcttaccttgtcacatctgtctag

SEQ ID NO: 22744 - DNA, 8532 bp, Artificial Sequence
  Description of Artificial Sequence: Synthetic coding sequence
atggccgccgccagctacgaccagctgctgaagcaggtggaggccctcaaaatggagaactctaacctaagacaggaactcgaagacaattcaaatcatctgaccaaactagagaccgaggcttccaacatgaaggaggtattgaagcagttgcagggcagtattgaggacgaggctatggcctcctccggtcagatagatctactggagcgactgaaggagctgaacttagacagctctaactttccgggagtgaagctgaggagcaaaatgagcctcaggagctacggctctagggagggatctgtgtcgtctcgctccggcgagtgcagtccagtacccatggggtcatttcctcggagaggatttgtgaacggcagtcgtgagagcacaggatatctggaagaactggaaaaggaacgctctttgctcctggccgatctcgataaggaggagaaggagaaagactggtattacgcccaactgcagaatcttactaaacgcatcgactcactgccacttacagaaaacttctctctgcaaacggacatgacccgaaggcaactggagtacgaggctaggcaaatccgggttgctatggaggaacagctgggtacgtgtcaagacatggagaagcgtgcccagcgccgtatcgctaggatccagcagatcgagaaagacattctgcgcattcgccagcttttgcagtctcaggccacagaggccgagcgcagctctcaaaataaacacgaaactgggtcgcacgacgcggagaggcagaatgagggccagggagtgggcgagattaatatggcaacaagcggcaacgggcagggtagcactaccagaatggaccatgagaccgcaagcgtgctgtcttcttcctccacacattcagctcctcgtcgactcacatcacaccttggcaccaaagttgaaatggtgtacagcttgttgagcatgctgggaacccacgataaggacgatatgtcaagaactctcttggcaatgtccagcagccaggattcttgcattagcatgcggcagtcaggctgtctacccttgcttattcagctcttgcacgggaatgacaaggattctgtcctgcttggcaatagcagaggatcgaaggaagcccgcgcaagagccagtgccgccttgcacaatatcatccactctcagccagatgacaaaaggggtcgccgcgagattagggttctgcacctgctcgagcaaattcgggcttactgcgagacatgttgggaatggcaggaggcacacgagcccgggatggaccaggataaaaaccccatgcccgctccggtcgagcaccagatttgcccggccgtatgtgtgctgatgaaactgagtttcgatgaggagcataggcacgctatgaacgagctaggcgggctgcaggccatagccgagctgctgcaagtggactgcgagatgtatggcctgaccaatgaccattattctatcacgcttaggcggtatgcaggcatggccctcaccaatctgacatttggcgatgtggcaaacaaagccaccctttgttctatgaaggggtgcatgcgcgctctggtggcacagctcaagagcgagtctgaagacctccaacaggtcattgccagcgtactccgcaatctctcttggcgggcagacgtcaacagcaagaaaaccctgagggaagtgggatccgtcaaagccttaatggagtgcgctctggaagttaagaaagagtctactctcaagagcgtgctctctgctctgtggaacctgtccgcccattgtaccgagaataaggcagacatatgtgcggtcgacggtgcccttgcgtttttagtcggcactctaacataccggtcacagacgaatacgctagccattatcgagtctgggggaggaattttgcggaacgtctcctctctcatcgctactaatgaggaccatcggcagattctaagggagaacaactgtctgcaaacactgctgcagcatctgaaatcccactctcttactattgtctctaacgcctgcggcacactgtggaacttgtccgcccggaatccgaaggatcaggaggccctgtgggacatgggcgccgtgagcatgctgaaaaatctgatccacagtaaacacaagatgatcgccatgggaagtgccgcagctctcagaaatctgatggctaatcggcctgcaaaatacaaagacgcgaacattatgtctcctgggtcatccctaccctccttgcatgttcgtaaacagaaagcattagaggctgagctagatgcccagcatctgagtgaaacattcgataacatcgataatctgtcccccaaggccagccacagaagtaaacaacggcacaaacagagcctatatggtgactatgtcttcgacacgaacagacacgacgataacaggagcgacaacttcaatacaggaaatatgactgttctctccccctacctcaatacgaccgttctgcccagctcttcatcatctcgaggctcactggacagcagtaggagtgagaaagacagatcgttggagagagagcgtgggataggcttgggaaattatcacccagccacggaaaatcctggcactagctctaaacgtgggttgcagatcagcacaactgcagcacagattgccaaggttatggaagaagtttctgctatccacaccagccaggaggatcggtcatcgggaagtacaaccgaactgcactgcgtaaccgacgagaggaatgcgcttagacgctctagcgctgcccacacacacagcaatacctacaacttcacgaagtcggagaatagcaacaggacatgcagcatgccatacgccaaactggaatacaaacgtagctcaaacgactcccttaactccgtcagctccagtgacggatatggaaagcgaggccagatgaagccttccatcgaatcgtactctgaggatgacgagtctaaattttgctcttatggccagtatccagcggacctcgctcacaaaattcattctgccaaccatatggatgacaatgatggcgagctggatacaccaattaactactctttgaagtacagcgacgaacagctgaattctgggcgccagagccctagtcagaacgaacgctgggctaggcccaaacacataatcgaggacgagatcaaacaatcagaacagcggcagtctcgcaaccagagcacaacataccctgtgtatactgaatctaccgacgacaaacacttgaaattccaaccccattttggccagcaggaatgtgtgtctccgtacaggtctcgcggagcgaatgggtccgaaacaaatcgcgtcgggtccaaccatgggataaatcagaatgttagtcagtccctttgccaggaagatgactacgaggacgataaacccacgaactacagcgaacgctattctgaggaggaacagcatgaagaggaggagcggcccacgaactattcaataaagtacaatgaggagaagagacatgttgatcagccaatcgactacagtcttaagtacgccaccgacattccatcgtctcagaagcagtcctttagtttctccaaaagctcttctggacagagttcaaaaaccgaacacatgtcctccagctccgagaacactagcacccccagtagtaacgccaaacggcaaaatcagctgcatccttctagcgctcaatctcgcagtggacagcctcagaaagctgccacatgtaaagtctccagcatcaatcaagaaacgatccagacgtactgtgtagaggacactcccatctgcttttcccggtgctcctcattgtcatcgttatcctcagctgaagatgagattggctgcaaccagacaactcaggaagcggactccgccaacacacttcagatagccgagatcaaagagaaaattggaacccggagcgcagaggaccccgtatcagaggtcccggccgtctcccagcaccctcgcaccaagtctagcagactgcagggcagttcactatcttctgaatcggcgaggcataaagcagtagaattttcaagcggtgcaaaatcccctagcaaatcaggcgcacagacaccgaagtccccaccagagcattacgtgcaggagacccctctgatgtttagccgatgtaccagcgtcagttctctcgattcctttgaatctagaagtatcgcctcttcagtgcaatcagagccctgctccgggatggtatcaggcatcatctccccatctgacctccccgattcccctggtcagaccatgcccccgagccggtcgaagacacctcccccacccccacagactgcccagaccaagagagaagtgccaaaaaacaaagcccccactgctgaaaagagggaatcaggccctaaacaggcagctgttaacgctgctgtgcaacgagtacaagtcctgcctgacgctgatactttgttacacttcgcgactgagagcacaccagatgggttttcctgttcttcaagtttgagcgcgctgtctctggatgaaccttttatccagaaggatgtcgagctgagaattatgccaccagtccaggagaacgataatggcaatgagacagagtctgagcagcctaaggagtctaacgaaaaccaggagaaggaagcagaaaaaactatagatagcgagaaagacttactcgatgactcagatgatgacgatattgagatattagaagagtgtatcatcagtgctatgcccaccaagtcatcaaggaaagcgaaaaagcctgcgcaaacagctagcaaattgccaccacctgtggctaggaagccttctcagttgcctgtgtataagctactcccctcccagaatcgccttcagccccaaaagcacgtgagcttcacacctggcgacgacatgcctcgtgtttactgcgtcgaaggaacccccatcaatttttcgaccgcaacaagcctgtctgacctcacgattgagagcccacctaacgaactggccgccggtgaaggcgtgagaggaggggcacagagcggcgagttcgagaaacgtgataccattcctacagagggcagaagtactgacgaagctcagggcggcaagacgagctcggttaccattccagaactggacgacaataaagcagaagaaggggacatactagcagaatgtatcaacagcgccatgcctaaagggaagtctcacaaaccctttcgcgtgaagaaaataatggatcaggtgcagcaagccagcgcgtcctcctctgcccctaacaagaatcagttggatggaaagaaaaaaaagcctacatctcctgttaagcccattccgcagaacaccgagtatagaacccgggtacggaaaaatgctgactcaaaaaataacctcaatgcagagagagtctttagcgataataaggattcgaagaaacagaacctgaagaataattccaaagttttcaatgacaagttgccgaataacgaagaccgggttcgagggtctttcgctttcgatagtccacaccattacacacctattgaggggaccccgtactgcttctcccggaatgattctttatcatccttggatttcgacgatgacgatgtagatctgagccgcgagaaagccgagctgcgcaaagccaaagagaacaaggaaagcgaggcaaaggtgacctcacacacagaacttacctccaaccagcagagcgccaataagacgcaggcgatcgctaagcagcccatcaatcggggccagcccaaacccattctccagaaacagtctaccttccctcagtcctctaaggacataccagacagaggcgcagccactgacgagaagctgcaaaatttcgccattgaaaacacccctgtgtgcttctctcacaactcatcgctgtctagccttagtgatatcgatcaggagaataacaacaaggagaatgagccaattaaagagaccgaaccccccgattctcagggcgaaccgagcaagccacaggctagtggctacgcccccaaaagttttcacgtcgaggatacgcctgtgtgcttctcgcgaaattcgagcctctcaagcttaagcatcgacagtgaggacgacctcctccaggaatgcatttcttctgctatgccaaaaaagaagaaaccatcgagactgaagggcgacaatgaaaaacattcccccaggaacatgggagggatcttgggtgaagacctgaccctggacctgaaggacatccagcgacccgattctgaacacggcctgtcccccgacagtgagaacttcgattggaaagccatacaagaaggagccaattcaatcgttagctcactacatcaggcggcagcggcggcctgcttgtcacgccaagcaagctccgatagcgactctatcctcagcctgaagagtggcatatctttgggctcaccgtttcacctaactccagatcaagaggagaagccattcacaagtaataaaggacctcgcattctcaaacccggtgaaaaaagcacgctggaaacaaagaaaattgagtccgagtcaaagggtattaaaggaggaaagaaagtgtacaagtcactgattacagggaaagttcgcagtaactccgaaattagtggacagatgaaacagcctctgcaggctaacatgccttcaatctcacggggaagaacaatgatccatatacctggagtgcggaattcttcgtcttctacgagccccgtgagcaagaaggggcctcccttgaagacacccgcaagtaaatcacccagcgagggccagaccgcaacgacttcacctcggggcgctaaaccatcagtcaaatcagagctgagtccagtggctcggcagacatctcagatcggtgggagcagtaaagcgccaagtagatcaggctcaagggatagcactccatcccggcctgcacagcaaccactgagtagacctatccagagcccaggtaggaactcgataagtcctggcagaaatggtatctcaccaccgaacaagctctcccagctacctaggacgagctccccctcaacagcgagcactaagagcagcggcagcggaaagatgagctatacatctcccggacggcagatgagtcagcagaatctgaccaaacagacaggcctcagtaagaacgcatcgagtatcccacgatccgagtctgctagtaaagggctaaaccagatgaacaacggcaacggtgctaataagaaagtggaactgagcagaatgagcagcaccaaatcaagcggcagtgagtctgaccggtccgagaggcctgtactggtgcggcaatccacattcatcaaggaggccccatcgcccacgctcagaaggaagctggaagaatccgcgtccttcgagtctctgtccccctcatctcgccccgcaagccctacaaggtcgcaggcccagacgccggttctctcaccatcacttccagatatgagcctgagtacgcacagcagtgtgcaggccggaggctggcgaaagttgccccctaatctatctcctaccatagagtacaatgacggcagaccggctaaaaggcacgatattgcacggagccatagcgagtcgcctagccggctgccaatcaacagaagcggtacatggaagcgcgaacatagcaaacactcatcatccctgccgcgtgtcagtacctggaggagaaccgggagcagctcttctatcttgtcagctagcagcgaatcctccgagaaagctaaaagcgaggacgagaagcatgtcaacagcataagtggcaccaaacagtctaaggaaaatcaggtttccgccaagggcacctggcgcaagataaaggagaatgagttcagccccaccaatagcacctcacagactgtgagtagcggtgctacgaatggcgcagaaagcaagacattaatttaccaaatggcaccggccgttagcaagaccgaggacgtttgggtgaggattgaagactgtcccatcaataatcctcgatcagggcggagccctaccggcaacaccccaccagtgattgactcagtttctgagaaagctaacccgaacatcaaagacagcaaggataaccaggctaaacaaaacgtgggaaacggatcagtgcccatgcggacggtggggctagagaaccggctgaactctttcatccaggtggacgcccctgaccagaaaggaacagagattaagcctggccagaataaccctgtgccagtttcggaaacgaacgagagcagcatcgtggagcgcacgcccttctccagttctagcagctcaaaacactcgtccccttccggcaccgtggccgcacgtgtgacccccttcaattacaatccaagtcctcggaagtctagtgctgattccacaagcgcaagaccttcgcagatcccaaccccagttaacaataatacaaaaaagcgtgactccaaaacggatagcacggaatcatccggcacccaatcccctaagagacattccggatcatacctcgtgacttccgtgtag

SEQ ID NO: 22745 - DNA, 864 bp, Artificial Sequence
  Description of Artificial Sequence: Synthetic coding sequence
atggccgccgccagctacgaccagctgctgaagcaggtggaggccctcaagatggagaactctaatctgcgccaggaattggaggacaactcaaatcatctgactaagttggagaccgaagctagcaacatgaaggaggtcctcaagcaactccaaggaagcatcgaggacgaagcgatggcatcgagcgggcagattgacctcttagaaagactcaaagagctgaacttagactcaagcaactttcctggagtgaaactcaggtccaagatgtctctacggtcttatgggagtagggaaggatcagtctcttccaggtcaggagagtgcagcccagtgcctatgggcagctttccaaggcgaggattcgttaatggctcacgggagtccacaggttacctggaggagctggaaaaagagagatcattgctcctcgccgatttggacaaggaggagaaggagaaggattggtattacgcccaactgcaaaatcttacgaagcggatagactccctgccgctgacagaaaatttctcgttacagactgatatgactagaaggcagctcgaatatgaggcccgccagataagagttgccatggaagagcaattggggacttgtcaggatatggaaaaacgggctcaaagaagaattgcacgcattcagcagatcgagaaggatatcctgcgcatccggcaactgttgcaaagtcaggcaactgaggctgagaggagttcacaaaacaagcatgagacaggaagccatgatgctgagcgccagaatgaggggcagggagttggggaaattaatatggccacatctggtaacgggcagatagagaagatgcggatgttcgagtgctag

SEQ ID NO: 22746 - DNA, 357 bp, Artificial Sequence
  Description of Artificial Sequence: Synthetic coding sequence
atggccgccgccagctacgaccagctgctgaagcaggtggaggccctgaaaatggagaacagtaacctgcggcaggaactcgaggacaactctaatcacctgacgaaacttgagacagaggcttccaatatgaaagaagttctgaaacagctgcaaggatccattgaggatgaggccatggcctcctcaggacagattgacctgctcgagcgtctaaaggaactgaacctggatagttcgaatttcccaggcgttaagctccggtccaaaatgtccctccggagctatggaagccgcgagggttcggtctcttctcggtcaggggagtgttctcccgtgcctatgggatctttttag

SEQ ID NO: 22747 - DNA, 3918 bp, Artificial Sequence
  Description of Artificial Sequence: Synthetic coding sequence
atggccgccgccagctacgaccagctgctgaagcaggtggaggccctgaaaatggagaacagcaatctgagacaggaactggaggataacagcaaccaccttaccaaactggagaccgaagcctctaatatgaaggaagtcctgaaacagctgcaggggtcaattgaggatgaagctatggcctccagcggtcagatcgatctgctggagagattaaaggagctgaatcttgacagctccaactttcctggggttaagttgcgcagcaaaatgtccctgagatcatatggcagtcgtgaggggtcggtgtcttctcgtagcggagagtgttccccggtgccaatggggtcctttcctcggagggggtttgtgaacggaagtcgtgagtccacagggtatctcgaggagctggaaaaggaaaggtcacttctgctggcagatcttgataaagaagaaaaagaaaaagattggtactacgcccagctccagaacttgaccaaaaggatcgactcactgcccctaacagagaatttctccctacagacagacatgacgcgccggcagttagagtacgaggcccggcagattcgagtagcaatggaggaacaactgggaacgtgccaggatatggagaagagagctcaacgcagaattgcccggatccagcagattgagaaggacattcttcgtatccgacaattgctgcagagccaggcaaccgaagctgaaagatccagccagaacaagcacgagaccggtagccatgatgctgagcggcagaatgaggggcaaggggtgggcgaaatcaacatggcaaccagcggaaatggccaaggctctaccacgcgcatggaccacgaaaccgcgtccgttctgagttcttcttccacgcattcagctcccaggcggctgacttcacacctgggaaccaaagtcgagatggtctattcacttctgtccatgctggggacgcatgacaaggacgacatgtccaggactctattggctatgagctcatcccaggatagctgcataagcatgcggcagagcggctgtttgcctttactcatccagttattgcacggcaacgacaaagactccgtgctgctgggcaattctcgcgggagcaaagaggcccgggccagggcgagcgccgctttgcacaacataattcactctcaacctgatgacaaacgggggcggagggagattagagttctccacctgctcgagcaaataagggcttattgtgagacttgctgggagtggcaagaggcccacgaacctggcatggaccaggataagaatcctatgccagctcctgttgaacaccaaatctgtccagctgtctgcgttcttatgaagctgtcttttgatgaagagcaccgccacgcgatgaatgagctaggcggtttgcaggcaattgctgagctactacaagtagattgcgagatgtacgggctgactaacgaccactacagcattacactgaggaggtacgccgggatggcactgactaacctgaccttcggtgacgtcgccaataaggctacgctgtgcagcatgaaaggatgcatgcgcgccctggtggcccaacttaaaagtgagagcgaggacctccaacaagtcattgcgagcgtgctccggaatctttcttggcgcgcagatgtgaatagcaagaaaacgttgagggaggttggttccgttaaggcactcatggaatgcgctctggaagtcaaaaaagaaagcacactgaagagcgttctgtcggccctctggaacctgagtgcccattgcacagaaaacaaagcagatatctgtgctgtggatggggcacttgcgtttctagtggggacactgacgtatcgcagccagacgaataccctagctataatcgaaagcggcggtggaatactgagaaatgtctccagtctgatcgccactaacgaggatcacagacagatcctgagagaaaacaactgtctccagacactgctccagcaccttaagagtcatagtttgacgatcgtgtctaatgcttgcggaactttgtggaatctctcagcaagaaaccctaaggaccaggaggctctgtgggatatgggagccgtgtctatgctgaagaacctgatccactcaaaacacaagatgatagcgatgggatctgccgctgcgctcaggaatcttatggccaatagacctgccaagtataaggacgccaacattatgtcaccaggatcatcattgccgtctctgcatgttcgaaagcagaaggctctggaagcggagctcgacgcacagcatctgtccgagacatttgacaatattgacaacctatcacctaaagctagccataggagcaagcaacggcacaagcaatccctgtacggggactacgtctttgataccaaccggcacgatgacaacaggtcagacaatttcaatactgggaacatgaccgtgctgagcccctatctcaatacaactgtgctgccttcgtcttcttctagtcgggggtcattagatagctcaagaagcgagaaggatcgttctcttgagcgagagcgggggatcggcttgggaaactatcacccagcaaccgagaatcctggtacgagctccaagagaggccttcaaattagtactaccgccgcgcagattgctaaagtaatggaggaggtgagtgccatccataccagccaagaggacagatcttctggcagcacgacagaactccactgtgtgaccgacgagcgtaacgctttgcgaagatcaagtgcggcccacacccatagtaatacctataacttcacaaagtccgagaactctaatagaacatgttccatgccatatgctaagttagagtacaaacggtcatcaaatgattccctcaacagcgtctcatcgtctgacggatacggcaagaggggccagatgaagcccagcattgaatcgtatagtgaagacgacgaaagcaagttttgttcatatggacagtatcccgctgatctggctcataagatccacagcgccaaccacatggatgacaatgacggtgagctagacactccgatcaactatagccttaagtatagtgatgaacagctgaactcggggcggcaatctccatctcagaacgaacggtgggcacgcccaaaacacatcatcgaagacgaaattaaacagagtgaacagcgtcagagcaggaatcaaagcaccacctatcctgtctacacggaaagtaccgacgataaacacctcaaatttcaaccccacttcggtcagcaggagtgcgtaagcccatacagaagccgaggggccaatggcagcgagacaaatcgcgtcggtagcaaccatggtatcaaccagaacgtttcacagtccctgtgccaggaggatgactatgaggatgacaaacctacaaactattcagagcgctactctgaggaggagcagcacgaggaagaagaacgcccaactaattattcgatcaagtacaatgaggagaagaggcatgtcgaccagcccatagactattcattaaagtacgcaacagatattccgtcctcacagaaacagtctttctcttttagtaagagttcatctgggcagtccagtaaaactgaacatatgtcatcaagctctgagaacacgtcaaccccctcgagcaatgcaaaaagacaaaatcagctccatccttcgtccgctcagtctcggagcggtcagccacagaaagctgcgacttgtaaagtgtcaagtatcaaccaggagaccatccagacctactgcgtggaagacacgccaatatgcttttccaggtgtagctcacttagcagtctgtcttctgctgaagatgagataggttgtaatcagactacacaagaagccgattccgcgaacacattgcaaatcgcatag

SEQ ID NO: 22748 - DNA, 2796 bp, Artificial Sequence
  Description of Artificial Sequence: Synthetic coding sequence
atggccgagatcaaggagaagatctgcgactacctgttcaacgtgtccgacagctctgccctgaatctggccaagaatatcgggctgaccaaggcgcgggatatcaacgcagttctgatcgacatggagaggcagggcgatgtctatagacagggcacaacaccacccatttggcacttaaccgacaagaagagggaacggatgcagatcaaaaggaacacaaacagtgtacccgaaactgcccccgccgcaatccccgagacaaagcgcaacgcagagtttctgacatgcaacatcccaacctccaatgcctcaaataatatggtgaccacagaaaaggttgaaaatggccaggaacccgtgatcaagctggagaacaggcaagaagcccgccctgagcctgcccgtttaaagccccccgtgcattataacggcccttctaaagcaggctacgtcgatttcgagaacggccaatgggcaacagacgacattcctgacgacctcaacagcattagagcagcacctggagaatttcgcgctattatggagatgccttcattctactctcacgggctccctaggtgctccccttataagaaactcaccgaatgccaacttaagaatccaatctcaggcctgcttgagtacgcacagtttgcctctcagacgtgcgagttcaacatgattgaacaatcaggccccccacacgaacctcgattcaaattccaggtagtgatcaatggtcgcgagtttccaccagccgaggcgggttccaaaaaagttgccaagcaggacgccgccatgaaagcgatgacgatactgctggaggaggctaaggccaaggattcgggaaagtcagaggaatcttcccactattccaccgaaaaagagagcgaaaagaccgccgagtctcagacacccactcctagcgcgacttccttctttagtggcaaatctcccgtgactacccttttagagtgtatgcataaactgggtaacagttgcgaattccggttactgtctaaagaagggcccgcacatgaacccaaatttcaatactgtgtagctgtcggtgctcagacatttcccagcgtctctgctcctagtaaaaaggtggcgaaacaaatggccgccgaagaggcaatgaaggccctacacggtgaggcgactaattccatggccagtgacaatcagcccgaggggatgatttccgagagtctagataaccttgaatcaatgatgccaaacaaggtgcggaagatcggcgaactcgtgcgatacttaaacactaacccggtaggcgggctacttgaatacgctaggtcccacggcttcgctgcagagtttaaattagttgatcagtcaggaccaccgcatgaacccaagtttgtgtaccaggccaaagtgggcggtagatggtttccagccgtttgcgcccactccaagaaacaggggaaacaagaagccgccgacgcagccctcagagtgctgatcggcgagaatgagaaagccgaaagaatgggatttacggaagtaacacctgtgacaggcgccagcctcagacggactatgctgctcctcagtagatcacctgaagctcagccaaagaccttgccccttacaggtagcacgtttcacgatcagatcgcaatgctctcacacagatgcttcaatacacttacgaactccttccagccttccctgctgggaaggaagattcttgcagcaatcatcatgaagaaagatagcgaggacatgggggtggttgtctcactgggcaccggcaacaggtgtgtgaagggtgattcgctgtccctgaaaggagaaaccgtgaacgattgtcatgctgagataatcagcagacgaggctttatccgcttcctctacagtgagcttatgaaatacaactcccagactgcgaaggacagtattttcgagcctgccaagggaggcgaaaagctgcaaatcaaaaaaacggtgtcctttcatctctatatatccacggctccttgcggggatggcgcattatttgacaaatcttgttccgatcgggcgatggaatctactgagtcacgccactatccagtgtttgagaaccccaagcaaggaaaattgcgaacaaaggttgagaacggcgaggggactatcccagtggaatcatccgacatcgttcccacgtgggacggtattcgcctcggcgagaggctcagaaccatgtcatgctcagacaaaatactacgatggaatgtgctggggttgcagggcgcgctacttacacactttctacagcccatctacttgaaaagcgtaacccttgggtacctgttcagccaaggccatctaacgagggccatctgctgcagagtcactcgggatgggtctgcctttgaggacggtctgcgccacccctttattgtgaatcatcctaaggtgggaagagtctcaatatatgacagtaaaagacagtcgggtaagaccaaagagacctccgtcaactggtgtctagctgacggctacgacctggagatacttgatggaacaaggggtaccgtagacggacctcgcaacgagttgagtcgggttagtaagaagaatatctttctgcttttcaagaagctttgttccttcaggtaccgccgtgaccttctgaggctctcctatggcgaagcgaagaaggcagcgcgcgattatgagactgccaaaaactatttcaagaagggcctcaaggatatgggctatggaaactggataagtaagccccaagaagagaagaatttttatctctgtcccgtctag

SEQ ID NO: 22749 - DNA, 3681 bp, Artificial Sequence
  Description of Artificial Sequence: Synthetic coding sequence
atgaacccccggcagggctacagcctgagcggctactacacccaccctttccaggggtacgaacatcggcaacttcgctaccagcagcccggccccggatcttcaccaagcagctttctactgaagcagatcgaatttctgaaaggacagctccccgaagctcctgtgattgggaagcagaccccttcactgccaccctcccttcccgggttaagaccgagattccccgttctcctcgcctcctctacaaggggaaggcaagtcgacatacggggcgttccgaggggggtgcacctcagatcacaagggctgcagcggggcttccagcacccctcccccaggggacggtctctaccccagcgcggcgtcgactgtctgtcgtctcactttcaggagctctctatctatcaggaccaagagcagcgaattctgaagtttttggaagagctgggcgagggcaaggctacgaccgcacacgacttgtccggaaaattgggcaccccgaagaaagagataaatcgggttctttatagtctggcgaaaaaaggcaagcttcagaaggaggcaggcacgccccctttgtggaagatagcggtcagcacccaggcctggaatcagcactctggagtcgtgcgccccgacggacactcacaaggcgcgcccaacagcgaccctagcctcgagccagaggaccgtaactcaactagcgtctccgaggacttactcgagcctttcattgctgtatctgcacaagcttggaaccaacacagcggggttgttagaccggactcgcactctcaaggttcgcccaacagtgaccctggactggagcccgaagatagtaattccacttctgccctggaggatcctctggagtttctggatatggctgaaatcaaggagaaaatatgcgactacttgtttaatgtttcagacagcagcgcactgaacctggctaagaatatcggcctgacaaaggctcgcgatataaatgcggttctgatagacatggagcgtcagggggacgtgtaccgccaagggacaacgcccccgatctggcacctgactgacaaaaagcgcgagcgaatgcagataaagcgtaacaccaatagcgtgccggagactgcccctgccgctatcccagagaccaaaaggaatgccgaatttttaacatgtaacattcccacatccaatgccagtaataacatggttacgacagaaaaagtagagaatggccaagagccagtgatcaagctcgaaaataggcaggaggccagacccgagcccgccaggctcaagcctcctgttcactacaatggcccatccaaggccggctacgtagactttgaaaacggccagtgggccacagacgatatcccagatgatctcaacagcattagggctgctcctggcgaattccgggccatcatggagatgccatctttctactcacacggacttcctcgctgttctccctacaaaaaactcacagaatgccagttgaaaaacccaatctcaggactgctagaatatgcgcagttcgcaagtcagacctgtgaattcaatatgatcgaacagtcgggccccccacatgaaccccgatttaagttccaagtggtcatcaacggaagagaatttccccccgccgaagcgggcagcaagaaggtggccaagcaagatgcagctatgaaagccatgactattctattggaggaggctaaggccaaagacagtggcaagagcgaagaatctagccattactccacggaaaaggaaagcgagaagacggccgagagccagacacctacaccgagtgcaacctcttttttctccggcaaaagccccgtgacgactctacttgagtgtatgcacaaattgggcaacagctgcgaatttcgcctcttgtccaaggaggggcccgcccatgaacctaaattccagtactgtgtggccgtgggagctcagaccttcccttcagtcagtgcacccagcaaaaaggtcgccaaacagatggccgccgaagaagcaatgaaggcgctgcacggcgaggccactaacagcatggccagtgataaccagcccgaaggcatgattagtgaatcactggacaatctggagtcaatgatgcccaataaggtgaggaagataggggaattggtgagatacctcaatactaatcctgtggggggactcctggaatacgctaggtcccatgggtttgctgcggagttcaaacttgttgaccagtcaggtccaccgcacgagccaaaatttgtgtaccaggcaaaagtcggggggcggtggttccccgctgtatgcgcccattccaaaaaacagggaaaacaggaagccgcggatgcagcactcagagtcctgattggcgagaacgaaaaggctgagcgcatggggtttaccgaggtaacccccgtgacgggcgcctccctgaggcgcactatgcttctgttatctcgctcgccagaagcccagcccaagaccttgcctctgacgggcagtacttttcatgatcagatcgcgatgctgagccatcgctgctttaacactttaactaattcctttcagccctccctcctgggccgtaaaatcctggctgctattatcatgaaaaaagactccgaagatatgggagttgtggtgtctttggggactgggaatcgttgcgttaaaggggatagtctttcactgaagggggagactgtgaatgattgtcatgccgagattatttctaggagggggttcatacgtttcctgtacagcgaactgatgaagtacaattctcaaactgcaaaagactctatcttcgagcctgcgaagggcggggagaaacttcagatcaagaagacagtgtcgtttcatctctatattagtacagccccttgcggtgatggtgctctgtttgataaatcttgctccgatcgggccatggaatcgaccgaaagtagacattatcccgtcttcgagaaccctaagcagggtaagctgcgaacgaaggtcgagaacggtgaagggaccatccccgtggaaagctccgacatagtgccaacgtgggacggcataagactcggagaaagattgagaacaatgtcttgcagtgataagatactccggtggaacgtgctgggactgcagggggctttgctcacgcactttctacaacccatatacttgaaaagtgtgacccttggatatctgttttcccagggtcacctcaccagagccatttgttgcagggtgaccagggatggcagcgctttcgaggatggattgaggcatcctttcatagtgaatcacccaaaagtgggacgcgttagtatttacgactctaagagacagagtgggaaaaccaaggagacgtcagtgaattggtgtctcgctgacggctatgatttggagattctcgacggaactcgtggcaccgttgatgggcctcgaaacgagctctccagggtgtctaaaaaaaacatctttttactgttcaagaagttgtgcagttttagatatcggagagatctgctccgactgtcatatggcgaggctaaaaaggctgcccgggattacgagaccgcaaagaactatttcaaaaaaggactcaaggacatgggatacggcaactggatttctaaaccacaggaggagaagaatttctacttatgcccggtgtag

SEQ ID NO: 22750 - DNA, 3588 bp, Artificial Sequence
  Description of Artificial Sequence: Synthetic coding sequence
ggctacagcctgagcggctactacacccaccccttccagggctacgagcatcgccagctgcgctatcaacagcccggacctgggtcctccccatcaagcttcctgctcaaacagatcgaattcttaaaaggacagcttcccgaagctccagtgattgggaagcaaacccccagtctgcccccttccctcccaggcttgcgtccgcgcttccctgtgttgcttgcgtcctccacacgggggcgccaggttgatatccgcggagtaccacggggggtccatctgagaagccagggcctacagcgcggcttccagcacccaagcccacgcggaaggtcactcccccagcggggagtggattgcttgtctagtcacttccaggagctgtctatctatcaggatcaggaacagcgcattttgaaattcctcgaggagttaggagaaggcaaagctactacagctcatgatctcagcggcaagcttggcacccccaagaaggaaatcaacagagtcctgtactcacttgctaagaaggggaaactgcagaaggaagctggcacacccccattgtggaagatcgctgttagtactcaggcgtggaatcaacattccggcgtagtgagacctgatgggcattcccagggcgcacccaatagcgacccatccttggagccggaagaccgaaacagcacctccgtatctgaagatttgttagagcccttcatagccgtgtccgctcaggcatggaaccagcactccggcgttgtccgcccagacagccactctcagggcagccccaattcagacccaggactcgaacctgaagacagcaatagcacttccgccctcgaggatccgttagagttcctggatatggcagaaatcaaggaaaaaatttgcgactatctgtttaacgtgagcgactcgtctgccctaaacctggccaaaaatattgggcttaccaaggctagagatatcaatgccgttctgattgatatggagagacaaggagacgtttacagacaagggactactccaccaatttggcatctgacagacaaaaagagggagcggatgcaaattaagaggaatactaacagtgtccctgagaccgctcccgccgcaatcccagagaccaaaaggaacgccgagttcctgacctgcaacatccctacctccaatgctagtaataacatggttacaactgagaaggtagagaacgggcaggagcctgtcatcaaacttgagaaccgacaggaggcaagaccagaacccgctaggctcaaacctccagttcactacaacggcccttccaaagcaggttatgtggactttgagaatggacagtgggcgaccgacgatatacctgacgacctgaacagtatcagggctgctccgggagagttccgcgctattatggaaatgcccagcttttacagccatggtctcccacgatgcagcccttataagaagttaactgaatgtcagctcaaaaacccaatatccggactcctcgaatatgcccaatttgcgagccaaacgtgtgagtttaatatgatagagcagtctggcccaccgcatgagcctcgattcaagttccaggtcgttatcaacggtcgcgaattcccccctgctgaagccggctcaaaaaaggtggccaagcaagacgctgctatgaaagccatgacaatcctcctcgaagaggccaaagccaaagactctggaaagagcgaagagtcttcccattattcaacagaaaaagaatctgagaaaacggcagaatctcagacgccgactccgagcgcaacttccttttttagcggcaaatccccggtaaccacgttgctggaatgtatgcataaattaggcaacagctgcgagttccgcctgctttctaaggaaggccctgcccatgaaccgaagtttcagtactgcgtggccgtgggcgcccaaaccttcccctccgtgagcgcaccctcgaaaaaggtagctaaacagatggccgcggaggaggctatgaaggccttgcacggggaagctactaactctatggcctccgacaaccagcccgagggaatgattagtgagagtctggacaatttagagagtatgatgccaaataaggtgcggaagattggcgaactcgtgagatatctgaacacaaacccagtaggcggcctactcgagtacgctaggtctcatgggttcgccgctgagtttaagctcgtagatcagagcggaccaccccacgaaccaaagtttgtgtatcaggcgaaggttggcggaagatggttccctgctgtctgcgcccattctaagaaacagggcaagcaagaggctgcggatgccgcactgcgggttttaattggcgagaacgaaaaggccgagcggatgggcttcaccgagttgcctctcacaggctccaccttccatgatcagatcgccatgttgagccatcgatgctttaacaccctcacaaacagtttccaaccgtcccttctgggtagaaaaatcctggctgctatcatcatgaagaaagactcagaggacatgggcgtggtggtgtccctcgggaccgggaacagatgcgtgaaaggagatagcttaagcctcaaaggtgagaccgtcaatgattgtcatgccgagatcataagccgcaggggcttcattcggttcttgtattcagaactgatgaagtataacagccagacagctaaagactctatcttcgagcctgcaaaggggggcgagaagttgcagattaagaaaacagtgagcttccatctgtacatctctaccgctccttgcggcgacggcgcattatttgataaatcttgttctgatagagctatggagagcactgagagccggcactaccccgtatttgaaaatccgaagcagggcaaactgagaacgaaagttgagaatggcgaggggacaatcccagtggagtcatcagatatagtccccacttgggacggcattcgccttggagagcgtctccgcaccatgagttgctccgacaagatcctccggtggaacgtccttggcctgcagggcgccttgctgactcacttcctccagcccatctatttaaagagcgtcacgttaggatacctgttttcacagggccatctgactcgggccatctgttgtcgcgtgaccagagatggttctgctttcgaagatgggttaaggcatcccttcatcgttaaccatccaaaggtcggacgcgtatctatctatgatagtaaaagacagtctggcaagactaaagagacttctgtgaactggtgccttgccgatggctatgacctggagattctggacggaactaggggcaccgtggacggtcctcgaaatgagctaagtagggtatcaaaaaagaatatatttctgctgttcaaaaagctgtgctcctttcgatacagacgggacctgttgagactgtcatacggtgaggcaaagaaagccgctcgcgactacgagactgcaaagaattattttaagaaaggcttgaaagacatggggtatggaaactggatctctaaaccccaggaggagaagaacttctacttgtgcccagtgtag

SEQ ID NO: 22751 - DNA, 528 bp, Artificial Sequence
  Description of Artificial Sequence: Synthetic coding sequence
atgggcaaggtgctgagcaagatcttcggcaacaaggagatgcggatcttgatgctgggcttagacgcagcaggcaaaacaactatcctgtataagctgaagctgggacaaagtgtcaccacaataccgacggtcggctttaatgtagagactgtaacttacaagaatgtaaaatttaatgtgtgggacgtgggaggccaggacaagattcgccctctctggcgacattactataccggcacccagggactgatcttcgttgtggattgtgctgatcgggacagaattgatgaagctaggcaggaactccatcgcataattaacgacagagagatgcgagacgccataatcctgatattcgctaataaacaggacctcccagacgcaatgaaacctcacgaaatccaggagaaactaggcttaactcggatccgcgatagaaactggtatgttcaaccttcctgtgcaacaagcggagatgggctgtacgagggtttgacatggctgacaagtaactataaaagctag

SEQ ID NO: 22752 - DNA, 1398 bp, Artificial Sequence
  Description of Artificial Sequence: Synthetic coding sequence
atgttccggcaggagcagcccctggccgagggcagcttcgcccccatgggctccctgcaacccgatgcgggtaacgctagttggaatggcactgaagctcccggtggcggcgcaagggctaccccctattccttgcaggtaaccttaaccctggtgtgtctcgctggtcttttgatgctgcttaccgtgtttggcaatgttctggtcatcatcgctgtctttacttcccgggcgcttaaggcaccccagaacctgttcctggtgtccctggcgtccgccgacattttagtcgccacattagtgatccccttctcattagcaaatgaggttatggggtattggtatttcgggaaagcctggtgtgagatttatctggctttagacgtattattttgtacttcttcaattgtccacttgtgcgcgatctcattggaccggtattggtctattactcaggctattgagtataacctcaagcgcactccacgccggattaaagccatcatcattacggtctgggtcatctctgcggtcatcagttttcccccattgatcagtatcgagaagaagggcggaggcggtggtccgcaaccggctgagcctaggtgcgaaatcaacgatcagaagtggtacgtcatttcctcttgcatcggctctttcttcgccccctgcctgatcatgatccttgtatatgtccgaatctatcaaattgccaaacggcggacgcgcgtccctccttcaaggcgcggacctgacgcagtcgctgccccaccaggcgggactgaacgacggcctaatggactgggccccgagcgaagcgcaggcccaggaggagctgaagcagagccactgccgacgcagttaaatggcgctcctggggaacccgctccggccggcccacgcgacacagacgccctggatctggaggagtcttcaagttctgatcatgctgagcgaccgccaggccctaggcggccagagagagggccaaggggcaaaggcaaggctcgggcgagccaagtgaaaccgggcgactctcttccacgcaggggtcctggcgctacgggcataggaacgcctgccgcaggccctggcgaggagagggtgggggctgccaaagcctcaagatggaggggcagacagaacagagaaaaacgcttcacattcgtactcgctgtggtgattggtgtattcgtggtgtgctggttccccttcttttttacctacaccctaacagccgttggctgcagcgttccacgtacgctgttcaagttcttcttttggttcggatattgcaatagctcactcaaccccgttatttatactattttcaaccatgacttcaggcgtgccttcaagaagattctgtgcagaggggaccggaaacgtatagtgtag

SEQ ID NO: 22753 - DNA, 285 bp, Artificial Sequence
  Description of Artificial Sequence: Synthetic coding sequence
atggcccccctgaagatgctggccctggtgaccctgctgctgggcgctagtctccagcacatccatgcggcgcgggggaccaacgtcgggcgagagtgctgtttagagtacttcaagggagccatcccccttagaaaacttaaaacctggtatcagacatccgaggattgttcccgggatgctatagtgtttgtcacggtgcaggggagagctatctgttctgacccaaataataagagggtcaaaaacgcggtgaagtatcttcaatctttggagagaagctag

SEQ ID NO: 22754 - DNA, 1635 bp, Artificial Sequence
  Description of Artificial Sequence: Synthetic coding sequence
atgcccggccggtgccagagcgacgccgccatgcgggtgaacggccccgcttccagggccccggcaggttggacctccggcagcctgcacaccggaccacgggcaggccgtcccagggcccaagcccggggtgtccgtgggcgggggctgcttctccgcccaagacccgctaaagagctgccactgccccgtaagggcggcgcatgggcgcctgccggtaaccccggccctttgcatcctttgggggtcgccgtgggaatggctggctccggacgcctggtcctccgcccttggataagggagctgatcctcggcagcgagacacccagtagtccccgtgccgggcagctgttggaggtcctgcaagatgccgaggcagcggtggctgggcccagccatgcacccgacaccagcgatgttggcgcgacgctgctggtgtccgatgggacccacagcgtacggtgtctggtgacccgcgaagccttggacacatcagattgggaggaaaaagaattcgggttccgagggaccgagggccggcttttactcctccaggactgcggcgtgcacgtgcaagtagctgaggggggtgcacctgcggaattctatttacaggtcgacagattttcactactcccgacagaacagcccagactccgcgtaccaggatgcaaccaggatctggacgtccagaagaaattgtatgactgtctcgaagaacatttaagcgaaagcacatccagcaatgccggcctgtcgctgagtcagctactggacgagatgcgtgaggaccaggagcatcagggtgccctagtgtgcctcgctgagtcttgcttgaccctggagggaccctgcaccgcgccacctgtcactcactgggcggcatcacggtgtaaggccactggggaggcggtttacactgtcccttcttcaatgctgtgcattagcgagaatgaccagctgatcctctcttcgcttggaccgtgtcagcgcacacaaggtcccgaactgcccccgcctgatcccgctttgcaagacttgagcctgactctgatagcctcccctccctctagcccttcaagttcaggcaccccagcactgcctgggcacatgtcttcggaggaaagcggaacctcaatcagcttgctgcccgcgttgtcactcgcagctcctgatccagggcagagatcctcctcccagcccagccctgccatttgtagcgctcccgccactcttacaccccgttcccctcacgctagcaggaccccatccagtcccctgcaaagctgtactccgtccctgtctccaagatcccatgtgcccagcccacaccaggcactggtgacgcgaccgcagaagccatcactggagtttaaggagttcgtgggcctcccctgcaagaataggccaccattccctcgaactggggcaacacggggggctcaggaaccttgctccgtgtgggagccccccaaacggcatcgcgacggttcggcttttcagtatgagtacgagcctccctgtaccagtctgtgcgcacgcgtccaggccgtgcgtctcccgccacagctcatggcctgggccttgcatttcctaatggatgcgcagccagggtcagaacctaccccaatgtag

SEQ ID NO: 22755 - DNA, 558 bp, Artificial Sequence
  Description of Artificial Sequence: Synthetic coding sequence
atgaagctggtgagcgtggccctgatgtacctgggcagcctggccttcctgggcgcggatactgcccgcctggatgtagcttccgagttccggaaaaagtggaataagtgggccttgtccagaggaaagcgtgagttgaggatgtcgtcttcatacccgacaggtctggcagatgtcaaggccgggccggctcagactctgataaggccacaagacatgaaaggagcatcacgctcaccggaagattccagtcccgacgccgcgaggatcagggttaaacgttatcggcagagcatgaataattttcagggtctccgctctttcggctgccggtttgggacatgtacagttcaaaaactagcacaccaaatctaccaatttacagataaggacaaagataacgtcgccccacgaagcaagatctccccccaagggtacggacggagacggagaaggtctctccccgaggcaggccccggcagaacactggtgtcatccaaaccccaagctcacggggcgcccgctcccccctcaggctccgccccccactttctgtag

SEQ ID NO: 22756 - DNA, 558 bp, Artificial Sequence
  Description of Artificial Sequence: Synthetic coding sequence
atgaagctggtgagcgtggccctgatgtacctgggcagcctggccttcctgggcgcagacaccgcccgtctcgacgtcgcatcagagttccgcaaaaaatggaacaaatgggcactctctagagggaaaagagagctcagaatgtcttccagctatcctacagggctcgccgatgtgaaagccggacctgcacagacattgattagacctcaggacatgaaaggagcaagccgatctcccgaggattcaagtcccgacgccgccaggatccgagtgaaacggtatcggcagagcatgaacaactttcagggattgcggtcctttgggtgccgcttcgggacttgcacagtacagaaactcgcccaccagatctaccagtttaccgacaaggacaaggacaatgtggcccctaggtcgaaaatctcaccacaaggatacggacgccgccgtaggcgctcccttccagaggcaggccccggtcggacactggtgagctctaagcctcaggcgcacggggcacctgctccccccagcggttccgcaccccattttttatag

SEQ ID NO: 22757 - DNA, 558 bp, Artificial Sequence
  Description of Artificial Sequence: Synthetic coding sequence
atgaagctggtgagcgtggccctgatgtacctgggcagcctggccttcttgggggccgataccgccagactggacgttgcctctgagtttaggaaaaagtggaacaaatgggccctgtccagggggaagcgagagctaaggatgtcgagctcctatcccacaggcctggccgatgttaaggccggccctgcgcagacgctaatccgcccccaggatatgaaaggagcgagtagaagcccggaggactcatctcccgatgcggcccgaatccgggttaagaggtatagacagtccatgaataacttccagggactgaggtcattcggctgtaggtttggtacatgtaccgtgcagaaattagctcaccaaatctatcagttcacagacaaagataaggacaatgtagctccaaggagcaagatcagcccacaggggtacgggcgtcgcaggcgaagaagtttgccagaggcagggcccggtagaacattggtgagcagtaaacctcaagcccacggtgcaccagcgccacccagtggatctgccccccatttcctctag

SEQ ID NO: 22758 - DNA, 702 bp, Artificial Sequence
  Description of Artificial Sequence: Synthetic coding sequence
atggccgccggcaccgccgtgggcgcctgggtgctggtgctgagcctgtggggcgcggtggtgggcgctcagaacataactgctcgtattggtgaacctctcgtgttaaagtgtaaaggcgcccctaagaaacccccacaacggctggaatggaaattaaatacaggccgcacggaagcttggaaggtcctgtcaccccaaggaggaggtccttgggattcagtcgcacgggtgcttcctaatagttctcttttcctcccggcagtgggcatccaggatgagggaatatttcggtgccaggcaatgaatcgcaatggaaaggagactaagtctaattacagagttcgcgtttaccagatcccagggaagcctgagatcgtagactccgcttctgagttgacagcaggcgtccctaataaggtagtggaagaatcaagaagatctcgaaagcgcccctgtgagcaagaagtggggacatgtgtgtccgaaggatcatatccagccgggacattgagctggcacttggacggcaagcccctggtgccgaacgagaagggggtgtcagtcaaggaacagacacggcgtcatccagagactggtctcttcaccttgcaaagcgagcttatggtgacccccgccagagggggcgaccctaggccgaccttttcctgtagtttcagtcccggcctgcctcgccactag

SEQ ID NO: 22759 - DNA, 1029 bp, Artificial Sequence
  Description of Artificial Sequence: Synthetic coding sequence
atggccgccggcaccgccgtgggcgcctgggtgctggtgctgagcctatggggagctgtggttggcgctcaaaacattactgcaagaattggcgaacccttagttttaaagtgtaaaggcgccccgaagaaaccaccccagaggctggaatggaaactcggaggaggtccatgggactcagtagcccgagtgctacctaacagttccctcttcctcccggccgtcggcattcaggacgagggaattttcaggtgtcaggctatgaatagaaatggcaaagaaactaagtcaaactatcgggtgagggtttaccagatccccgggaagcccgagattgtggattctgcatccgagctgacggcaggggtgcccaacaaagtgggcacatgtgtgtctgagggcagctaccctgctgggaccctgagctggcacctggacggaaaaccattggttcctaatgagaaaggtgtaagcgttaaggagcagacaaggcggcatcccgagaccggactgtttacccttcaaagcgaactgatggtgacccccgctcggggtggggacccccgtcccacctttagctgttccttcagccctggactaccacggcatcgcgcactccgcacagccccaattcaacctagggtgtgggaaccagtacctctggaagaggtgcagttagttgtggagcccgaagggggagcggtggcaccaggcggcaccgttacgctgacttgtgaagtgcccgcccagccctctcctcagatacattggatgaaggacgtgtcagacctggagcgaggagccggaaggaccagaagagggggcgccaactgcagattgtgcggtcgcatccgagcaggcaatagtagtccaggaccgggggaccccgggaggccaggggactcgaggcccgctcactggggccatttggtggcaaaggccgccactccacgtcggggcgaagagggaccaagaaaacccggaggtcgtggtggggcttgccggactgagtccgtgggcggaacatag

SEQ ID NO: 22760 - DNA, 1044 bp, Artificial Sequence
  Description of Artificial Sequence: Synthetic coding sequence
atggccgccggcaccgccgtgggcgcctgggtgctggtgctgagcctttggggagccgtcgttggagcacagaacataaccgctcgcattggcgagccgctggttttaaaatgcaagggagccccgaagaagccacctcagcgtctggagtggaagctgaatacaggacgaaccgaggcctggaaagtgctgagcccccaaggaggcggcccctgggacagtgtggctcgagtgttgccaaactccagcctgtttctcccggccgttggaatccaggacgaggggatcttcagatgccaggcgatgaaccgcaatgggaaggaaactaaatctaactacagggtgagagtctatcagatacctgggaagccggagattgttgactctgcctccgaactgactgctggcgttcccaacaaggttggaacctgtgtgtcagagggctcgtatcccgctggaacacttagttggcacctagacggcaaacccttggtgcccaacgagaagggcgtctcagtcaaagagcagaccaggaggcaccccgaaactggtctttttaccttgcagagcgagctgatggtcacacctgctcgcggtggagatcccagacccaccttttcctgctcttttagccctggtctcccccgccaccgcgccctgcggactgctcccatccagccgcgggtgtgggaaccagttccactagaggaggttcaacttgtggtcgagccggaagggggcgccgtggctccagggggaactgttactctcacctgcgaagtgcccgctcagccatcaccgcagattcactggatgaaggatggagttcctctcccccttcctccgtctccagttctcatcttgccagagataggaccacaggaccagggaacctatagctgcgtagcgacccatagtagccacgggccacaggaatctagggctgtgtccatttccattatcgagccaggtgaagagggccctacggccggggaggggtttgacaaagtgagggaggctgaagattcacctcagcatatgtag

SEQ ID NO: 22761 - DNA, 1215 bp, Artificial Sequence
  Description of Artificial Sequence: Synthetic coding sequence
atggccgccggcaccgccgtgggcgcctgggtgctggtgctgagcttgtggggtgccgtggtaggggcacaaaacataactgccagaattggagaacccttagttctaaaatgcaagggggctccaaagaagcctccccaaagattagagtggaagctcaacacaggccggaccgaggcctggaaggttctgtctccccaggggggcggaccctgggactcagtggccagggtgcttcccaattcatctctcttcctgcctgccgtggggatccaggatgaaggtattttccgctgtcaagcaatgaaccggaatggtaaggagaccaaaagtaattaccgggtgagggtttatcagatccctggaaagccggagatagtagattccgcctcagaactgacagctggagtgccaaataaggttggaacgtgcgtgagcgagggatcctatccagcagggaccctctcctggcatctcgacggtaagccgctggtccctaatgagaagggcgtgtccgtcaaagaacaaactagaagacaccctgagaccggcctgtttaccctacagtcggaactgatggtaaccccagctcgaggcggggatcctagacctaccttttcatgctctttttcacccgggctgccaaggcaccgcgcactgagaaccgccccaattcaaccacgcgtgtgggagcccgtgccactggaggaggttcagctggtggtggagccagaaggtggagcagtggcccctgggggcacagttaccctgacttgtgaagtgcccgcgcagccttcaccacaaattcattggatgaaagatggggtaccattacccctgccaccgtctcctgtcctcatcctccccgagattgggccgcaggatcagggtacctattcctgcgttgctactcactccagccacggtccccaggagtctagggccgtatctatcagtatcatcgaaccaggggaagagggtcccaccgctggttccgtgggaggttccgggctcggaacactcgccctggcactcggaatcttgggaggtctgggcaccgcagccctactaattggggtgatcctgtggcagagacggcagcgtcggggtgaagagcggaaggcccctgagaaccaggaggaagaagaagagagggcggagctaaaccagtctgaagagcccgaagccggcgaaagctcaaccggtgggccctag

SEQ ID NO: 22762 - DNA, 705 bp, Artificial Sequence
  Description of Artificial Sequence: Synthetic coding sequence
atggccgccggcaccgccgtgggcgcctgggtgctggtgctgagcttgtggggggccgtggttggcgcacagaacattactgcaaggataggggagcctctggttctcaagtgcaaaggcgccccaaagaaaccacctcagcgtctggagtggaaattaaacacgggaaggacagaggcatggaaggtgctgtctccgcagggggggggcccctgggactccgttgccagagtactgccaaattcctctctttttctgcctgctgtggggatccaggacgagggcatcttccgctgccaagctatgaatcgtaatggcaaggagacgaagtctaattaccggagcctccgaacatttaccatcacagccagtgattggatctttcctcctagcgaaattccagggaaaccagaaatagtagacagcgcctctgaactgacggctggcgtaccaaataaggttggcacctgtgtaagtgaaggatcctatccggctggtacactgtcatggcacctcgacggcaaaccgcttgtgccaaatgagaagggtgtctccgtgaaggaacaaacacggcgtcacccagagacagggctgttcactctgcagagtgagctcatggtgactcccgccagaggcggcgacccacgtccaaccttttcgtgcagctttagccccggtctgcctcgacatcgagccttaagatag

SEQ ID NO: 22763 - DNA, 402 bp, Artificial Sequence
  Description of Artificial Sequence: Synthetic coding sequence
atgaaggacggcgtgcccctgcccctgccccccagccccgtgctgatcttgcccgagattggtcctcaagaccagggaacatactcttgtgtggcaacccattcatctcatggaccacaggaatcacgggctgtgtcaatctcaatcattgaacccggagaggaagggccaacggcgggatccgtgggcggatcggggctggggactcttgcactggcgctggggatactgggtgggttagggaccgctgctcttcttataggcgtgatcctgtggcaacgacgccagaggcgtggggaagagcgtaaggcaccagaaaatcaggaggaagaagaagagcgcgccgaactgaaccagtcagaagaacccgaggctggcgagagcagcacaggaggaccatag

SEQ ID NO: 22764 - DNA, 1308 bp, Artificial Sequence
  Description of Artificial Sequence: Synthetic coding sequence
atgggcgccggcgagcgggtgcaggcccccccccgggccgaggccacggccggacggggggccgatcgagcccgtactttggaagggagccggatggccgcagggacagcagtcggagcctgggtcctggttttgtccctttggggcgcggtggtaggggcccagaacattactgccaggataggggagcccctagtgctaaagtgcaaaggcgctcccaagaaacccccacagcggctggagtggaagctgaatacgggccgcacagaagcttggaaagttctctccccacagggaggcggcccgtgggacagcgtggccagagtcctcccaaactcatcactgttcctcccggcggttggtattcaggatgaagggatctttaggtgccaggccatgaatcggaacggcaaggaaactaagagtaattacagggtgcgcgtctaccagattccaggaaaaccagaaatcgtcgactccgcctctgaactcactgcgggggtcccaaacaaggtgggcacctgcgtctccgaagggtcctacccggccggaactctgtcttggcatttggacggcaagccattagtgccaaatgagaagggggtttcagtcaaagaacaaactcgtaggcatcctgagactggcctctttacacttcagagtgaactgatggtgactcctgctagaggtggcgatccaaggccgacgtttagctgtagtttttcccccgggcttccgagacatcgtgcattaaggactgcacctatacaacctagggtctgggaaccagtgcctctagaggaggtgcagctggtagtggagccagagggaggagctgtggcccctggagggactgtcaccttgacttgcgaggttcccgcacaaccttccccacagatacactggatgaaggacggtgtcccactccctctgcccccatcacctgtactcatccttcccgagattggtccacaagaccaaggaacatacagttgtgttgccacacatagcagccacggcccacaagagtctcgagccgtgagtatatcaattatcgaacctggcgaggagggacccactgccggctcggtgggtggttcagggctgggaacacttgcgcttgccctcgggattcttggcggactggggactgccgccctgcttatcggggtgattctatggcaaagacgacagcgccggggagaagaacgcaaggctcctgagaaccaagaagaggaagaagagcgggcagagctgaaccagtcagaagagcctgaagctggagaatcgagcacaggcgggccctag

SEQ ID NO: 22765 - DNA, 387 bp, Artificial Sequence
  Description of Artificial Sequence: Synthetic coding sequence
atggccgccggcaccgccgtgggcgcctgggtgctggtgctgagcctttggggggccgtcgtgggagcccaaaacataactgcccgaatcggggagccattagttcttaagtgtaaaggcgctccaaagaaaccaccacagcggttggagtggaaacttaacacgggtaggaccgaggcctggaaagtgctgtcgccacagggtggtggtccctgggactctgtagcaagagtgctgccaaacagtagcctgtttctgccggccgtaggcatccaggacgagggaatcttccgctgtcaggctatgaataggaatggtaaggaaaccaagagcaactatcgggtgagagtctaccagttcgaaaacctgcataactacagcctctag

SEQ ID NO: 22766 - DNA, 462 bp, Artificial Sequence
  Description of Artificial Sequence: Synthetic coding sequence
atggccgccggcaccgccgtgggcgcctgggtgctggtgctgagcttgtggggcgccgtggtcggcgcccaaaatatcaccgcccgcattggcgaacctcttgtcctcaaatgcaaaggcgcacccaagaaacctccacagaggctggaatggaaactaaacaccggaaggactgaggcttggaaggtgctgagcccacaaggcggcggcccatgggattcagttgcccgcgtcctgccgaactcatcacttttcctgcccgcggtcggaatccaggacgaggggattctgggaggactgggcacggctgcgctactcataggtgtgattctctggcagcggcgccagcggaggggagaggagagaaaagctcctgaaaaccaggaagaagaggaagagagggctgagttgaaccagagtgaggagcctgaagccggggagagctcaactggaggaccttag

SEQ ID NO: 22767 - DNA, 885 bp, Artificial Sequence
  Description of Artificial Sequence: Synthetic coding sequence
atgaaccggaacggcaaggagaccaagagcaactaccgggtgcgggtgtaccagatcccaggcaagcccgaaatagttgacagcgctagcgagttgacagctggggtgcccaacaaggttggcacatgtgtatcagagggtagctacccagccggaacacttagttggcacctagatggtaagcccttggtccccaacgagaagggagtgagcgtgaaggagcagacccgtagacatcctgagaccggcttgtttaccctccaatccgagcttatggttactcccgctcgtggcggtgatcctagacccaccttttcctgctccttcagccccgggctgccccgtcacagggcattacgcactgctcctattcaaccccgtgtctgggagcccgtccccttggaagaagtgcagcttgttgtggagccagaagggggcgccgttgccccaggaggcacggtgaccctgacttgtgaggtgccagctcagcctagccctcagatccactggatgaaagatggagtgccattgcctctgccccccagtccagtccttatcttacccgagattggtcctcaggatcaaggcacttacagttgtgtagctacacactcctctcacggaccccaggaatcacgcgccgtttccatttcgattatcggctcggtgggagggtcaggactcggcaccctggccttggcccttggaatcctcggggggctgggtaccgctgccctcttgattggcgtgatcttgtggcagaggcgacagcgcagaggggaagagcgtaaggcccctgagaaccaagaggaggaggaagagcgtgcggagctgaaccagagtgaagagcccgaggccggagaaagctctactgggggcccatag

SEQ ID NO: 22768 - DNA, 366 bp, Artificial Sequence
  Description of Artificial Sequence: Synthetic coding sequence
atggccgccggcaccgccgtgggcgcctgggtgctggtgctgagcctatggggtgctgtagttggagcccagaacataactgctaggattggtgagcctctagttctgaagtgcaagggcgcacccaagaagcccccacagcggctggagtggaagttgaacactggccgtaccgaggcttggaaggtactctccccccagggaggaggcccatgggactctgtcgcccgcgtcctgccaaactcctcactatttctacctgctgtcgggatacaggacgagggaatcttccgatgtcaggccatgaacagaaacgggaaagagactaaatcgaactggtggtggagccagaaggtcgagcaatag

SEQ ID NO: 22769 - DNA, 1092 bp, Artificial Sequence
  Description of Artificial Sequence: Synthetic coding sequence
atggccgccggcaccgccgtgggcgcctgggtgctggtgctgagcctctggggtgctgtggtcggcgcccagaacataactgcaaggattggggagccgttagtcctaaagtgcaaaggagccccaaaaaaacccccccagcgcttggagtggaagctgaacactggacggacagaagcctggaaggttctgtcaccccaggggggaggtccttgggactcagtcgccagggtcttgccaaattcctcactgttcctgccagccgtcggcatccaggacgagggaatcttccggtgtcaggccatgaatagaaatggcaaagagactaaatccaattacagagttagagtttaccagatacccggaaagcccgagatcgtggattcggcgtcggagttgactgctggagtgcctaacaaagtcgtcgaggagtcccgcagatctcggaaaaggccttgtgagcaggaagttggcacatgtgtatctgagggatcctatccagccgggacattatcttggcacctcgacggcaaacctctggtccccaacgagaagggcgtctcagtgaaagaacagacccgccgacatccagaaaccggattgttcacattgcagtctgagcttatggtaacccctgctcgtggaggcgatcctcgacctacgtttagttgcagtttttcacctggtctgccccgccacagggccctgaggaccgcaccaattcagccaagagtgtgggaaccagtgccactggaagaggtgcagttggtggtggagcccgaagggggcgcagtcgccccaggaggcaccgtcaccttgacatgtgaggtacccgcacagccttcacctcagattcattggatgaaggatggcgtgccgttacccttgccccctagccccgtgttaatcttacccgagatagggccccaggatcagggaacatattcctgtgtcgccacacactccagtcatggtccccaggaaagcagagctgtatccatatcgattatcgaacctggcgaggaaggtcctacagctggggagggattcgataaggtcagagaagccgaagactcacctcagcacatgtag

SEQ ID NO: 22770 - DNA, 3633 bp, Artificial Sequence
  Description of Artificial Sequence: Synthetic coding sequence
atggccgcccagagcagcctgtacaacgacgaccggaacctgctgcggattcgtgaaaaagagcggcgaaatcaggaggcccaccaggaaaaggaggcattccccgaaaagattccgctgttcggggagccatacaaaaccgccaaaggggacgagctgagtagccggatccagaatatgctgggaaactatgaggaggttaaggagtttttgtccaccaaatcccacacccataggctggatgcctcggaaaacaggctcgggaagcccaagtatccattaattccagataaaggctccagtatcccttccagttccttccacacctccgtgcaccatcagtctatccacacacccgccagcgggcctctttctgttgggaatattagccacaacccaaagatggctcaacccaggactgagcccatgccatccctgcatgctaaatcgtgtgggccaccggacagccaacatctgactcaggacaggctgggtcaagagggattcgggtcatcccaccataagaagggcgatcgtagagctgacggcgaccattgcgcttcggtcaccgactcagcccctgaaagggaactctcgcccctgatttctctgcccagccccgtccctcctctctcccccattcattccaaccaacaaacactgccaaggactcagggatcttctaaggtgcacggttcctcaaataattctaaggggtattgccccgcaaagagtcctaaagaccttgcagtaaaagtgcacgacaaagaaacacctcaggacagtctggtcgcacctgcacaaccaccgagccagactttcccccctccatcactaccctctaagtccgtggccatgcagcagaagcccaccgcatacgtgcgacctatggatgggcaggaccaggcccctagtgaaagccccgagttgaaacccctccctgaggactacaggcagcagacattcgagaaaacggatctgaaagtgcctgcaaaggccaagttgacgaaactgaagatgccctcccagagtgtggagcagacttattccaatgaggtccactgcgtcgaggaaatcctgaaagagatgactcatagttggccccctccgctgacagccatacatacacccagcacagccgaaccatctaagtttccttttcctaccaaagattcccagcacgtttcaagtgtgacacagaatcagaagcagtatgatacgagctccaaaacccactcaaatagccaacagggtacatcctcaatgctcgaggacgatctgcagctgagcgatagcgaggactccgacagcgaacaaacacccgagaagcctcctagcagcagcgctcctcccagtgctccacagtcccttcctgagccagtggctagcgcccactcaagtagcgcggaaagcgaatccaccagtgattccgactcatcttcagatagcgaaagtgagtcgagttcaagcgatagtgaggaaaatgagcccctcgaaaccccagcacctgaacccgagccacccaccaccaataaatggcagttagataactggctgaccaaagtttcacaacctgctgcaccgcccgagggaccacgatccaccgagcctccacggcggcaccctgaatcaaagggctcgtcagattctgctacgagtcaggagcattctgagagtaaagatccgccccccaagagttcgagtaaagctccaagggcccctcctgaggcaccccaccctggcaagcggtcgtgccagaaatcacccgcccagcaggaacctcctcagcgccagacagttggaacaaagcaacctaagaaacctgtgaaagcaagcgcccgggctggttcgaggaccagcttacagggagaaagagaacctggtttactcccctatggtagtcgagaccagacctcaaaagataagccaaaagttaagaccaaggggaggcctagagctgcagccagtaacgaacccaaacccgccgtacccccatcctccgaaaagaagaagcataaatcttcactacctgccccttcaaaggcactctcaggccctgagcctgctaaggacaatgtcgaggatcgaaccccagagcattttgcgctcgtgcctctgacagagtcccagggccccccccactcaggttcaggcagccgcacatccggatgtagacaggccgtcgtggtgcaggaagatagccgtaaggataggctgcccctccccctcagggacaccaaacttctgtcgccactccgggacaccccacctccccagagcctgatggtgaagataaccctagacctgttatcaaggattcctcagccccctgggaagggcagtagacagaggaaagccgaagacaaacagcctccggccggcaaaaaacattcttctgagaagcgaagtagtgactcgtcttctaagctggccaaaaagcggaagggggaggcagagcgagactgcgataataagaaaattaggctcgagaaagaaattaaatcacagagttcctcttctagctcctctcacaaggagtccagcaagaccaagccaagcaggccctcctcccaaagctccaaaaaggaaatgctcccgcctccccccgtaagttccagtagtcaaaaacccgcgaaaccagcactgaagcgatctcgacgagaggcagacacatgtggtcaggacccacccaaaagcgcgtcaagcacaaagagtaaccataaagattcttctatccccaagcagaggagggttgaaggcaaaggcagccgatcatccagcgagcacaaaggctcctcgggtgatacagccaatccgttccctgtgccttcactgccaaatggcaactcaaagcctggaaagccccaggtgaagttcgataagcagcaggccgacctgcacatgcgggaagccaagaaaatgaagcagaaagctgaactgatgacggatcgggtgggtaaggcattcaagtacctggaggccgtcctgtctttcatcgagtgcggaattgctactgaatctgaaagtcaatcctccaaaagcgcctacagcgtctatagcgaaacagtggatctgatcaagtttatcatgtctctcaagtccttcagcgacgcaaccgccccaacccaggaaaagatcttcgcagtgttatgcatgcgttgtcagagcatactcaacatggccatgtttcgctgtaagaaagacatagcgattaagtacagtcggaccttgaataagcacttcgagagcagttctaaagtcgcccaggccccaagtccatgcattgcctcaactggaacccctagcccactttcgccaatgccatctcccgcctcatccgtaggatcccaaagctccgccgggtccgtgggctcatcaggcgtggctgcaaccatcagtacccctgtgaccatccagaacatgacaagttcatatgtgaccatcacgagtcatgtcctgacagccttcgatctgtgggaacaggccgaggcactgactcgtaagaataaggaattcttcgcgaggctatcaacaaacgtatgtaccctggcgctcaacagcagcctggtggatctcgtgcattacactaggcaggggttccaacagttgcaggaactcacaaaaaccccctag

SEQ ID NO: 22771 - DNA, 1266 bp, Artificial Sequence
  Description of Artificial Sequence: Synthetic coding sequence
atggccttcaccgagcgggtgaacagcagcggcaacagcctgtacaatgacgacagaaatttgctgaggatacgggagaaggagaggaggaatcaggaggcacatcaggagaaggaggccttccccgaaaaaatccctcttttcggtgaaccatacaagaccgcgaagggagatgaattatccagccggattcagaatatgcttggaaactacgaagaggtgaaggagttcctgtcgacaaagtctcatacacatcgacttgacgcctctgaaaataggctcgggaagccaaagtatccgctgattccggataaaggttcctctatcccctcgagctcattccatacaagcgtgcaccatcagtctattcacacacccgcaagtggccccctctccgtaggcaacataagccacaaccccaaaatggctcagccacgtactgagcctatgccttccttgcatgccaaaagctgcgggcctcccgactcccagcatctcacccaggaccgtttaggacaggaagggttcggatctagccaccacaaaaaaggtgacaggcgggcagacggagaccattgtgcatccgttaccgactcggcccctgaaagagagttatcccctctcatcagtttgccgtcgcccgtgccgcccttatccccaattcactctaaccaacagacccttcccagaactcaagggtcttcaaaggttcatggctcaagcaacaacagcaaaggttattgtccggctaagtcacccaaagaccttgccgtcaaggtgcacgataaggagaccccgcaggactctctggtggcgcccgcccagcctccaagccagacttttcctcctccctctttaccttcaaagagtgtcgcaatgcaacagaagccaacagcttatgtgagacccatggatggacaggaccaggcaccatcagaaagtcctgaactgaagccccttccagaagattacagacagcaaacatttgaaaagacagatctaaaggtcccagccaaggccaagctgaccaagctgaaaatgccctcccaaagcgtagaacagacctactcaaatgaggtacattgcgtcgaagaaatcctgaaagactcacagcatgtgtcctccgtgactcagaatcagaagcagtacgacacgtcgtctaaaacccacagcaatagccagcagggtacctcttcaatgctggaggatgacctgcagctcagtgattccgaggacagcgacagtgaacagacccccgccccttag

SEQ ID NO: 22772 - DNA, 3657 bp, Artificial Sequence
  Description of Artificial Sequence: Synthetic coding sequence
atggccttcaccgagcgggtgaacagcagcggcaacagcctgtacaatgacgatagaaatctgctcaggattagagaaaaggagcgccgtaatcaggaggctcaccaggagaaggaggctttccccgaaaagatccccttgttcggtgagccttacaagactgctaagggagacgagttgtcctctaggatccaaaacatgctgggcaactatgaagaagtgaaagagttcttgtctacaaagagccatacccatagactggacgcttctgaaaatcgtttagggaaacccaaataccccctgataccagacaagggcagctcgattcccagttctagctttcacacgagcgttcaccaccagtctattcatactcccgcctctggtcctctgtctgtgggcaatatttcacacaatccaaaaatggcccagccaaggacagagcccatgccttcacttcacgctaaaagttgtggcccccctgattcccagcacctgacgcaagataggctcggtcaggagggcttcggttcatcccaccataagaaaggcgaccgacgcgccgatggagaccactgcgcctcagttactgatagcgcacctgagagggaactctccccgcttatctctctgccctcccccgtgccccccttgtcccctatccattctaatcagcagaccttgccgaggacacagggtagcagcaaggttcatggaagcagtaataattccaaggggtactgtcccgctaagagtcccaaagacctggccgtgaaagtccatgacaaggaaacgccacaagactccctcgtggctccagcccagccccctagccagacttttcccccaccctccctgccttctaaatctgttgcgatgcaacagaaaccgacagcctatgtgagaccaatggatgggcaagaccaggcaccttccgaatccccagagttaaagcccctgccggaggactaccgtcagcagacttttgagaagaccgatctgaaggttcctgccaaggccaaattaacaaaacttaaaatgcccagccaatcagtggagcagacctattcaaatgaagtccattgcgttgaggagatcctgaaagagatgactcatagctggcctcccccattgacagcgatccacacacccagtactgccgaaccctctaagtttccgtttcccaccaaagactcacagcatgttagttccgtgacacagaaccagaagcaatatgatacttcaagcaaaacacattctaatagccagcagggcaccagcagtatgctggaggacgatctgcaactgtctgacagcgaagacagcgattctgaacagacgccagagaagcctccatctagctctgccccaccatctgctcctcagtctttgcctgagcccgtcgcgagtgcacacagtagctctgccgaaagcgagagcaccagcgattcagactctagctccgattctgagtcagagagttcctcttctgactctgaggaaaatgagccgctggagacaccagcgcccgagcctgaaccacccactactaacaagtggcaattggacaactggctgacaaaggtgagccagcccgctgcgcctccagaaggccctaggagtaccgagccaccaagaaggcaccccgaatcgaaaggctcttctgacagtgctacaagccaggagcatagcgaatccaaagacccacctcctaagtcctccagtaaggcccccagggccccccccgaggcacctcaccccggtaaacggtcttgtcagaagagtcctgcgcagcaagaaccaccccagaggcagacggttggcactaagcaacccaaaaaaccagtgaaagcaagcgctagggcaggaagtcgtacctcactgcagggcgaaagggaacctggactgctgccatacggatcccgcgatcagacttccaaagacaagcctaaagtaaaaacaaaagggcgacccagggcggccgcgagcaacgaacctaaacctgcagtgccaccctcatcagaaaagaaaaaacacaagtcttccctcccagctccaagcaaggcacttagcggccccgaacccgccaaggataacgtggaggaccgcacccctgaacattttgcactggtgccgctgacagagagccaaggccctccacacagtggttcaggttctaggacatccgggtgtagacaggccgtggtggtacaggaggactcacgcaaagaccgactcccccttccgttacgcgatacgaagttactgtcaccgcttcgggacactccccctcctcagagcttgatggtgaagattacacttgatctgctctccaggattccacaaccccctggtaagggctcacggcagcgaaaagcggaggacaaacagcctccggccggaaagaagcatagctccgagaaacgctcctccgacagctcatcaaagctcgccaaaaaacgtaaaggcgaggctgaacgtgactgcgataataagaaaattcggctggaaaaagagatcaaaagtcagagcagcagctcatcctcttctcacaaggagagctccaagaccaagccctcccggccttcttctcagtcatccaaaaaggagatgcttccaccccccccagtctcttcttcatcacagaagcctgcaaagccggccttgaagcgctccagacgggaggccgatacatgcggacaagatccccccaagtccgcgtcgagcacaaagtcaaatcacaaggattcctccattcccaaacagcggcgggtcgagggtaagggttctcggtcctcatccgaacacaagggctccagtggagacaccgcgaacccgtttcctgtcccaagcctgcctaatggaaattctaagcccggtaaacctcaggtgaaattcgacaaacaacaggcggatctgcacatgcgagaagcaaaaaagatgaaacagaaggcggagctgatgactgaccgtgtgggtaaggcctttaagtatctcgaggctgtattatctttcatcgaatgcggtatcgccacagagtcggagagccagagctccaagagtgcatactcggtgtactctgaaaccgtcgatctgataaagtttattatgagcctgaagtcattcagcgatgccactgcgccaacacaagagaagatctttgcagtcctgtgtatgcggtgtcagtctatcctgaacatggccatgttcagatgtaagaaggatatcgccataaagtacagccggacacttaataagcacttcgaatctagttcaaaggttgctcaagcaccatctccatgtatcgctagaagcactgggacgccatcgcctctcagccccatgccatccccagcgtcctctgtgggatctcaatcatctgcaggcagcgtgggctcaagcggcgtggccgccacgatatctacgcccgtgacaatccagaatatgacaagttcatatgtgaccatcacgtcacatgtgctcaccgcattcgatttgtgggaacaggcagaggctctaacacggaagaacaaagagtttttcgctcgattaagcacaaatgtttgtacgttggcattaaactccagtttagtcgatcttgtgcactacacacgccaaggtttccagcagctgcaggagctcaccaaaacaccttag

SEQ ID NO: 22773 - DNA, 1221 bp, Artificial Sequence
  Description of Artificial Sequence: Synthetic coding sequence
atggccttcaccgagcgggtgaacagcagcggcaacagcctgtacaatgacgacagaaatctactccggatccgagaaaaagagcgcagaaatcaggaggcgcatcaggagaaggaagctttcccagaaaagatcccactgtttggggagccctacaaaacggcaaagggtgacgaacttagttcaagaatccagaatatgctcggaaactacgaggaagtgaaagaattcctctctaccaaatcccacactcataggttggacgcgtctgaaaatagactcggcaaacctaagtaccccctgatccccgataagggctcctcaataccatctagctcattccatacctccgtacatcaccagtctatccacacccctgccagcggcccactgtctgtgggcaacatcagccacaaccctaagatggctcagccacggaccgagccgatgccgtctctgcacgcgaagtcctgcggaccgcctgattcccagcacctgacacaggaccgcctgggacaggaagggtttggaagctcacatcataagaaaggcgatcgacgcgccgacggagatcactgtgcaagtgtgacggacagtgctccagagcgcgagctctctccgcttatcagtctaccatcgcctgttcctcctttgtccccgattcattccaaccagcagaccctccccaggacccagggtagctctaaggtgcatggcagctccaacaactctaagggctactgccccgccaagagcccaaaggatctcgccgtgaaggtgcacgacaaagaaacccctcaggattccctcgtggcacctgcccagccaccttcccagacattcccccctccctctctcccatcaaagtcagtggccatgcagcagaagcctactgcctatgtgcggcccatggacggacaggaccaggcgcccagcgagtctcctgagctgaagccactgccggaagactatcgacagcagaccttcgagaagactgacctgaaggttcctgccaaagcgaagcttacgaagctcaagatgccgtcccaatcagtagagacctacagtaacgaggtgcactgtgtggaagagattctaaaggagatgacgcactcctggcccccaccgctgaccgccatacacaccccctccacggctgagccttcgaaatttcccttccccactaaagatagtcaacacgttagtagcgtgactcaatag

SEQ ID NO: 22774 - DNA, 1473 bp, Artificial Sequence
  Description of Artificial Sequence: Synthetic coding sequence
atgcccagccagagcgtggagcagacctacagcaacgaggtgcactgtgtggaggagattttgaaggaaatgactcacagctggcccccccccctgactgctattcacacgccaagcaccgccgagccctctaagtttccgttccccactaaggactcccagcacgtgagctcagtcactcaaaatcagaaacagtacgacactagttccaagacacatagtaacagtcagcagggaacatcaagtatgctggaagatgatctgcaattgtccgattctgaggacagcgattcagaacagacaccagaaaagcctccccatctccacctgcaagtattgcacagcccctttcagaatcagtggcaccagcatatacccgctgttcagtcacagaaagcccccgtcacgcagacagtgccacagactcagcgcgcacgcgccgtccaagattccgaagagaacgaacctctcgagactccagcacctgagcctgaaccgcccaccaccaataagtggcaactggataattggctgacgaaagtgagtcagcccgccgcgcctcccgagggcccgcgcagcaccgaacctcccaggcggcacccagagagcaagggttcatcagattctgcaacatctcaggagcattccgagtccaaagatcctccgcccaagagttctagtaaggcccctagggcacctcccgaagctccccatccaggaaaaaggagttgtcaaaaatccccagcccagcaggagcctccacagcgacaaacagtgggaactaaacagccaaagaagccggtcaaagctagtgcgcgcgccggcagtcgcacgtcccttcagggcgaaagagagcctggattgctgccttacggcagtagagatcagacttccaaggataagccaaaggtgaaaaccaaagggcggcctcgagccgctgcttctaacgaaccaaaaccggcagttcctccatcctcagagaagaagaagcacaaaagcagtttgccagccccatcgaaggcgctgtccggtccagaaccagccaaagacaacgtggaggatcggacccccgagcacttcgctctggttcccctgacggaaagtcaggggccaccccactccggaagcggatctagaaccagcggatgtcgccaagctgtagtggttcaggaagattcccgaaaggatcggctcccccttcctcttcgggacactaaattattgtcacccctgcgcgatacgcctcccccccagtctcttatggtgaagattacgctcgacctgctgtccaggataccccagccacctgggaagggaagtcgtcagcgtaaggccgaggacaagcaacccccggccgggaaaaagcactcctccgagaagaggagcagcgattcttccagtaagctagctaagaagaggaaaggtgaagccgagcgcgactgtgacaataaaaagataagacttgagaaatag

SEQ ID NO: 22775 - DNA, 2550 bp, Artificial Sequence
  Description of Artificial Sequence: Synthetic coding sequence
atgacccacagctggcccccccccctgaccgccatccacaccccctcaactgccgaacccagtaagttccctttccctaccaaggactcccagcacgtgtcatctgtcacacagaaccagaagcaatatgatacttcttctaagacacacagtaattcccagcagggcactagttcaatgctggaagacgatctccaactgtcagacagcgaagacagtgactcagagcagacaccggagaaacctccaagttcatctgcaccaccttccgccccccaaagcctcccggagccggtggcttctgcccactcctcaagtgcagagtctgaatcgacatccgattcggatagctctagcgactccgaatctgagtcgagctccagtgacagtgaggagaatgagcccctggagacaccagcaccagagcccgaaccacctaccacaaacaagtggcagttagacaactggctgaccaaagtatctcagcctgccgccccaccggaaggcccacgctccaccgagccccccaggaggcaccccgagtctaaaggttcctctgatagcgccacctcccaagaacactcagaaagtaaggaccctccccccaaatcttcttctaaggcgccccgcgcacctccggaagctccacatcccggaaagcgctcatgtcagaaatctcccgcacagcaggaacctccacagcgccagacggtggggacaaagcaacccaagaagccggtcaaggcttcggctagagctggatccaggacatccctgcagggggaaagagagcctggcttgctgccgtatggaagtcgggatcagacaagcaaggataagccaaaggttaagaccaagggacggcccagggcagctgcctccaacgagcccaagcccgccgtccccccatcttctgagaaaaagaagcataagtccagtttgcctgctccctccaaagcgttgtccgggccagagccggctaaagataatgtggaagataggactccggagcatttcgcccttgtgcccctcactgagtcccaagggccacctcatagcgggtccggctcaagaacctcaggatgtcgccaggccgtggtcgtgcaggaggattctcgtaaggaccgtctccccttgccgctccgtgacaccaaacttctgtcgcccctgcgtgataccccacctccacaatccctgatggtgaaaattactctggatctcctgtcgcggattcctcagccaccaggaaaaggctctagacaacgcaaggcagaggacaaacagcctccagcaggaaaaaaacacagctctgagaaaagaagctccgactcgtcttcaaaacttgccaagaaacgcaagggcgaggccgagcgggactgcgataataaaaaaatcagattggaaaaagaaataaaaagccaatcatcctcaagctcatctagccacaaggagtcctctaaaaccaaaccctccagacccagttcccaaagttccaaaaaggaaatgttgccccctccgccagtgagcagctcgtcacagaaacccgcaaagccagcactgaagaggagtaggcgagaagcagacacttgcggtcaggatcccccaaagagcgccagtagcacgaaatctaaccataaggacagctcgatacccaagcagaggcgtgtggaagggaagggatcccgcagttccagcgagcacaaggggagctcaggcgatactgccaacccctttccagtcccgagcctgcccaatggcaattctaaaccaggcaagcctcaggtgaaattcgacaagcaacaggctgatctgcacatgagggaggcaaagaagatgaagcagaaggccgagctgatgacagacagagtgggcaaggccttcaagtaccttgaagcagtattgtcttttatagagtgtgggattgctaccgagtctgagtctcagtcaagtaaatctgcctactcagtctacagtgagaccgtggatctgatcaagtttataatgagcttgaaatctttttctgatgccacagcgccaacccaagagaagatattcgcagtgctgtgcatgcggtgccaatctatcctgaatatggcaatgttcagatgcaaaaaagacattgcaattaagtactcccgcaccttaaacaagcatttcgagtctagttcaaaagtcgcccaggccccgagcccctgcatcgctaggtccaccggcacccctagtcctttgagcccaatgcccagtcccgcgtccagcgtgggctcccagagttctgcaggttccgtgggtagtagcggtgttgcggctaccattagcaccccggtgactatacagaacatgacgagctcatacgtcaccatcaccagtcacgtgctcactgccttcgacctgtgggagcaagcagaagccctcaccaggaaaaacaaagagttcttcgcccgcctgtctactaacgtgtgtacactggcactgaactctagcctcgtagacctcgttcattataccaggcaagggtttcagcagctccaggaactaactaagacaccctag

SEQ ID NO: 22776 - DNA, 2376 bp, Artificial Sequence
  Description of Artificial Sequence: Synthetic coding sequence
atgcccgacatgcacttcaaggcccccaagatcagcatgcccgacgtggatctccatttaaaggggcccaaagtaaagggagacgtggatgtgtccgtgcctaagttagaaggtgacctgaccgggccctcagtcggagtagaagtgccggatgttgagttagagtgcccagacgcgaagttgaagggccctaagtttaagatgcctgaaatgcatttcaaaactcccaaaattagcatgcctgatgtggacttgcatctgaaaggtcctaaagtgaagggcgacatggacgtctcagtgccaaaggtggagggggaaatgaaagtgccagacgtcgacataaaaggtcctaaaatggacattgatgcacctgacgtggatgtgcatggccctgactggcatctgaagatgcccaaaatgaaaatgcccaaatttagcatgcccggatttaaggccgaaggtcccgaagtcgacgtcaatctccccaaggccgacgtggtcgtgtccggccctaaggtggacgtggaggtgcccgatgtgagccttgagggccctgagggaaagctgaaaggcccaaaacttaaaatgcccgaaatgcattttaaagccccaaagatcagcatgccagacgtagatctccatttaaaaggccccaaagtgaaaggcgatgtggacgtgtctctccccaagctggaaggcgatctgacgggacctagcgtggatgtggaagtgccggacgtcgagctggaatgtcccgacgctaagttaaagggccccaaattcaagatgccggaaatgcattttaagacgcccaaaatcagcatgccagacgtgaacctaaacctgaaggggcccaaagttaaaggtgacatggatgtaagtgtgccaaaagttgagggtgagatgaaggtgccagacgtggacattagaggacccaaagtggatatcgatgcccctgacgtcgatgtacatgggcccgattggcacttgaagatgcccaaaatgaaaatgcctaagttctcaatgccaggattcaagggagaaggaccagaagtagatgtgaatctgcccaaagcagatgtagatgttagcggacccaaggttgacgtcgaagtgcccgacgtgagcttagagggacctgagggtaaactgaagggcccaaagttcaagatgcccgagatgcacttcaagacacccaaaatctcaatgccagacgtagatttcaacttgaagggcccaaagatcaaaggtgatgtagacgtgagcgccccaaagcttgagggagaactcaaagggcccgagttagatgtgaaaggcccaaaactcgacgcggatatgccagaagtagccgttgagggacccaatgggaagtggaagacgccgaaatttaagatgccagatatgcacttcaaagcaccgaaaatctccatgcccgacctggacttacatctcaaaagcccaaaagccaagggcgaggtcgacgttgatgtgccaaaactggaaggggacctgaaaggccctcacgtggacgtgtccgggcccgacatcgacatagagggcccagaaggaaaactgaaggggcccaagttcaaaatgcctgacatgcacttcaaagccccaaacatttcaatgccagatgtggacctcaatctgaaggggccaaagataaagggggacgtggatgtgtcagtgccagaggtagaagggaagctcgaagtgccagatatgaatatccggggacctaaggtggatgtgaacgcccccgatgttcaggctcctgattggcacctgaaaatgcccaaaatgaagatgccaaagttcagcatgcccgggtttaaagccgagggccccgaggtggacgtgaacctaccaaaagctgatgtggatatttccgggccgaaggtagacattgaaggacctgatgtgaacattgaaggaccagaagggaaactgaaggggccaaaactgaagatgccagagatgaacattaaggcacccaagatctccatgcctgactttgatctgcatctgaaggggccgaaggtgaagggtgatgtggatgtgtcccttccaaaggttgaaggcgacttgaagggccctgaggtggatatcaagggtcccaaagtggatataaatgctcctgatgttggggtgcaggggcccgactggcacctgaaaatgccaaaagtgaaaatgccaaaattttccatgccagggttcaagggggaaggcccggacggggatgtaaaattgccgaaagcggatatcgacgtgtccggccctaaagtggacattgaagggccagatgtgaatattgagggcccagaaggaaaacttaagggtccaaaattcaagatggcgcaacggtggtggtag

SEQ ID NO: 22777 - DNA, 450 bp, Artificial Sequence
  Description of Artificial Sequence: Synthetic coding sequence
atggagaaggaggagaccacccgggagctgctgctgcccaactggcagggatcaggatctcatggactgacaattgcccagcgcgacgacggagtctttgtacaggaggtgactcaaaactcccccgcggctagaacaggtgtggtcaaagagggagaccagattgtcggggccacaatctacttcgacaacctgcagtccggggaggtaacgcagctcttgaatactatgggccaccataccgtagggctaaaacttcacagaaaaggcgataggtcaccagagccaggccagacctggacccgcgaagtcttttccagttgtagttcggaggtcgtgctcaatactccgcagcctagcgctctggaatgcaaagatcagaacaagcagaaggaagcttctagccaggcaggagccgtgagtgtcagcacacctaacgccgggctgtag

SEQ ID NO: 22778 - DNA, 17673 bp, Artificial Sequence
  Description of Artificial Sequence: Synthetic coding sequence
atggagaaggaggagaccacccgggagctgctgctgcccaactggcagggaagtggcagccacggactcacgattgcccagcgggacgacggcgtcttcgtgcaagaggtgacccaaaatagtccggccgcaagaacgggcgttgtaaaggagggagaccagatagtgggtgccactatctacttcgataatttacaatcaggggaggtgacgcaattgctcaacacaatgggacaccacactgtcgggctaaagctgcaccgcaagggcgatagatcacctgagcccggccagacatggactcgggaggtcttttcatcatgttcttctgaggtagtcctaagcggtgatgacgaggaataccagcgaatctatacaaccaagattaagcctagactgaaatctgaggacggcgttgaaggagacctaggcgagacccagtcacggaccatcaccgtgacaaggagggttacggcctacacggtcgatgtgacaggccgcgagggcgccaaagacattgatatttcatccccggaatttaaaattaaaatccctaggcacgagctcacagagatcagcaacgtggatgtggagactcagtcggggaaaacagtgattagattaccctccgggtccggcgctgcctcgcctacgggtagcgcggtagacattcgcgcgggggccatcagcgcatccggcccagaattacagggcgcaggacacagcaagctgcaggtgacaatgcctggcatcaaagtgggtggctccggtgtcaacgtaaacgcaaaggggctcgatttgggtggtcgtggcggagtccaggtgcccgccgtggacatctcctccagcctgggcgggagggctgtggaagtgcagggcccgtccctggaaagtggcgatcacggtaaaattaaattccctacaatgaaagtgccgaaattcggtgtcagcaccgggcgggagggacagacaccaaaggcgggactgagggtatcagcacccgaggtgagtgtaggccacaaggggggaaagcccggacttaccatccaagccccccagctagaagtaagtgtgcccagcgccaatatagagggtctcgagggcaaactcaaaggtccacagattactggacccagtctggaaggtgacctggggctgaagggagccaagccccaaggtcatataggcgtcgacgcctcagcccctcagattggcggatcaattactggccctagcgtggaggtccaagccccagacattgatgtacaagggcctggatccaaactcaacgtcccgaagatgaaggtgcccaagttttccgtgagcggagccaagggagaagaaactggcattgacgttacactaccaaccggggaggtgacagtgccaggtgttagtggagacgtgagtctgccagagatagcaactggaggtctggagggtaaaatgaagggcaccaaggtgaagactcccgagatgattatccagaaaccaaaaatcagcatgcaggacgttgacctttccttaggcagtcctaaactgaagggagacatcaaggttagcgcccctggggtccagggcgatgtcaaaggacctcaggtagcacttaaaggcagccgggttgacatcgaaaccccaaatctggaggggaccctcaccgggcctagactcgggtcgccaagcgggaagactggaacctgccgaatcagcatgtcagaggtggatctgaatgtggctgcgcccaaagtgaagggaggcgtcgacgtcactctgccaagggtggaaggaaaagtgaaagtgcccgaggtcgacgtgagaggccctaaggtcgatgtcagtgcacccgatgttgaagcgcatgggccggaatggaatctcaagatgcccaagatgaaaatgccaactttttccaccccaggagccaaaggcgaaggccctgatgttcacatgacgctgccgaaaggtgacatcagcatctccggccctaaagttaatgtggaggctcccgacgtgaatttggagggcctcggaggtaagctgaagggtccagatgtgaagctgcctgacatgtccgtcaagacgcctaaaattagcatgccagatgtggatctacacgtgaagggtaccaaagtcaagggggagtacgatgtgacggtccccaaactggagggcgaactgaaaggacctaaggtggacattgatgccccagatgttgatgtccacggccccgactggcacttgaaaatgccgaagatgaagatgccgaaattctccgtgccgggtttcaaggctgaaggccccgaggtggacgttaatctgcctaaagccgacgtggatatcagtgggcccaaaatcgacgttaccgcaccagatgtgtcaatagaggagcctgaaggtaaactaaagggccccaaattcaaaatgcctgagatgaacataaaagtgcccaaaatctcgatgcccgacgtagacctgcacctcaagggacctaatgtgaagggagagtacgacgtcactatgccaaaggtggagtctgaaatcaaagttcccgacgtagagctcaagagcgccaaaatggatatagatgtacctgatgtggaagtgcaggggcccgactggcacttgaagatgcccaaaatgaagatgccgaagttcagcatgccaggcttcaaagcagaagggccagaggtggacgttaacctcccgaaagcagacgtcgatatctccggtccgaaagtgggagtcgaggtgcccgatgtcaatattgaggggccagaaggcaaactgaagggccccaaattcaagatgcctgaaatgaacataaaggcgccgaagatttccatgcccgacgttgatcttcatatgaagggccctaaagtcaaaggtgaatacgacatgactgtgcctaagctcgaaggcgacctgaaagggccgaaagtggacgtgtctgcccctgacgttgaaatgcaaggtccagactggaatctgaaaatgcccaagataaagatgccaaaattttccatgccttccctgaagggggagggcccagagttcgacgtaaatctgtcaaaggccaatgtggatatctccgctcctaaggtggatacaaacgcccccgacctaagcctggaggggcccgagggcaagttgaaggggccgaaatttaagatgcctgagatgcattttagagcacctaagatgtccctgccagacgtcgacctggatctgaagggccctaagatgaagggaaatgttgacatctcagcccccaaaattgaaggcgagatgcaagttcccgacgtcgatatccgcggcccaaaagtagatattaaggcacctgacgtcgagggacagggtcttgattggtctttaaagatccctaagatgaagatgcccaaattttccatgccaagtctgaagggggaagggcccgaggttgatgtcaacctgcctaaagccgacgtcgttgtttcaggacctaaggtggatatcgaagccccagatgtcagcctggaaggccctgagggcaagctgaagggaccaaagttcaaaatgccagagatgcactttaagaccccaaaaatatctatgcccgatgtcgatctgcacttaaagggcccaaaggtaaagggcgacgtcgatgtaagcgtgcccaaagtcgagggcgagatgaaggtccctgacgttgaaattaaagggcctaagatggatatcgacgccccagacgtggaggtgcaggggcctgattggcacttaaaaatgcccaagatgaaaatgcccaaattctccatgcctggcttcaagggtgagggccgagaagttgatgtgaatctgccaaaagcagatatcgacgtgagcggcccaaaggtggacgtggaggtgcccgatgtgagcctagagggccctgaaggaaagttgaagggcccaaagtttaaaatgcctgagatgcattttaaggcccccaaaatcagcatgcccgacgtagacctgaatctcaagggacccaaattaaaaggtgatgtggacgtctcactgcctgaagtggaaggggaaatgaaggtccccgatgtggatatcaagggaccgaaggtggacattagtgctccggacgtcgacgtacatggacctgactggcatctgaagatgcccaaagtgaagatgcccaaattttctatgcccggcttcaagggcgagggacctgaggtggatgtcaaattacctaaggccgacgtggatgtgtccgggccaaaaatggatgcagaagtccccgacgtaaacatcgaaggacccgacgcaaaactgaaaggacctaaattcaagatgcccgagatgagcatcaagcctcagaagatctctattcctgatgttggactacacctgaaggggccaaaaatgaagggagattatgatgttactgttccgaaagttgaaggagagattaaagcccccgatgtcgacattaaggggccgaaggtggacatcaatgcccctgatgtggaagtgcacggacctgattggcacctgaagatgcctaaggtaaaaatgccaaaattctccatgcctgggttcaaaggggaaggacccgaggtagacatgaatctgcctaaagcagatctcggcgtgtcagggccaaaagtggacatcgacgttccggatgtgaaccttgaagcccccgagggcaagttgaaaggtcctaaattcaaaatgcctagcatgaacattcagacacacaagatttcaatgcccgacgttgggctaaacctgaaggccccaaaactgaaaacagatgtcgacgtaagtcttccgaaagttgaaggagacctcaaaggacctgagattgacgtgaaggcgccaaaaatggacgtgaacgtgggcgatatcgacattgagggcccggagggtaagctgaaaggtcctaaattcaaaatgccagagatgcacttcaaagcccccaagatctcaatgccggacgtagatcttcacttaaagggcccaaaggtgaagggagacatggatgtttcggtccccaaggtggagggggaaatgaaagtgcccgacgtggacattaaagggcccaaagtggatatcgatgctcctgatgtcgaggtgcacgatcccgattggcatctgaaaatgcccaagatgaaaatgccaaagttcagcatgcctggctttaaagctgaaggacctgaagtcgatgtgaacctgccaaaagccgatatcgatgtctcagggcctagtgtcgacacagacgcacccgatcttgatatcgaggggccagagggcaagctgaaggggtctaaatttaaaatgcctaaactgaacatcaaagcgcctaaagtgagtatgccagacgttgatctcaatcttaagggacccaagctgaagggcgaaatcgatgcgtccgtacctgagctcgaaggtgatctgcggggtcctcaagtagatgttaagggacctttcgtggaagctgaagttccggacgtcgatctggaatgccctgatgctaagttgaaggggcctaaattcaaaatgccagagatgcattttaaggccccaaaaattagtatgcctgatgtggacctgcacctcaagggaccgaaggtcaaaggtgacgctgatgtgtcagtcccaaagttggagggggatctcaccggtccttcagtgggcgtggaggttcccgatgttgagctggaatgccccgatgcaaaacttaaaggacctaaatttaaaatgccagacatgcacttcaaagcgccgaaaatctcaatgccagacgtcgacctgcacctaaagggacccaaagtgaaaggcgacgtcgacgtcagcgtgcccaagctcgaaggcgacttgaccggcccctcagtcggggtcgaggtgcctgacgtggagcttgagtgtcccgatgcaaaactcaagggcccgaaattcaaaatgcctgaaatgcacttcaagacccccaaaatctccatgcccgatgttgatctgcatctgaaaggcccaaaagtcaagggggatatggatgtcagcgtcccaaaggtagagggggaaatgaaagttccggacgtcgatattaagggccctaagatggacatcgacgcccctgacgtggatgttcacggacctgactggcatttgaaaatgcctaagatgaagatgcctaaattctccatgccaggtttcaaagccgagggccccgaagtagacgttaacctccccaaagccgatgttgtagtatctgggccaaaagttgatgtggaggtaccagacgtctctttagaaggcccagaggggaagcttaagggacctaagcttaaaatgccggaaatgcattttaaggctccaaagatctctatgcccgatgtagaccttcacctgaagggacctaaagttaagggagacgtcgatgtttccttgccgaaacttgagggcgacctcacaggtccaagtgtcgatgtcgaggtgcccgacgtggaactagagtgtccggacgctaagcttaaaggaccaaaatttaaaatgcctgaaatgcattttaagaccccgaagatatcaatgcctgacgtgaatttgaacctaaaaggacccaaggttaagggtgatatggacgtatcagtccctaaggttgagggcgaaatgaaggttcccgacgtggacattcgcggacccaaggtcgatatcgacgccccagacgtggatgtgcatggaccggattggcacctgaagatgcctaagatgaaaatgcccaagtttagcatgccaggctttaaaggcgagggcccggaagttgacgtaaacctccctaaggctgatgtggatgtttctggccccaaggttgatgtggaggtgcctgatgttagtttagaagggcccgaggggaagttaaaaggaccaaagtttaagatgcctgagatgcacttcaagacgcctaagatttcaatgcctgatgttgactttaacctcaaggggcctaagattaagggagacgttgatgtgtctgcccccaaattggagggtgaactgaaaggccctgagctggacgtaaagggccccaagctggacgccgacatgcccgaagtggccgtagaggggcccaacggaaaatggaaaacgcccaagttcaagatgccagatatgcattttaaagcacccaaaatctccatgcctgacctggatttacacctcaaatcaccaaaagctaagggagaagttgacgttgatgttccgaagctggagggagatcttaaaggccctcatgttgacgtcagcggcccggacatcgacatcgaaggacctgagggcaagttaaagggaccgaaatttaaaatgcctgatatgcatttcaaggctccgaacatttccatgccggacgtggacttgaatctcaaaggcccaaagatcaagggagacgttgacgtcagtgttccggaagtggaagggaagctggaggttcccgatatgaacattcgaggtcctaaggtggacgtaaacgcgccagatgttcaggcaccagattggcatctgaagatgccaaagatgaagatgcctaagttttctatgcccggtttcaaggccgaggggcctgaggtggatgtgaatctccccaaggctgatgtggatatttcaggccctaaggttgacattgagggaccagacgtcaacattgaaggaccagaaggtaagctgaaaggcccaaaacttaagatgcccgagatgaatattaaggcccctaagatctcgatgcccgacttcgatctgcatctgaagggtcccaaagtaaagggtgacgtggacgtgagcctgcctaaagttgagggggacctcaaaggtccagaggttgatattaagggacccaaagtggacatcaacgccccagatgtgggagtgcagggaccagattggcacctcaagatgcctaaggttaagatgccaaagtttagtatgcctggatttaaaggggagggtccagacggagatgtgaaacttccaaaggcagacattgatgtgagcggccccaaggtcgacatcgagggccctgacgtcaatatcgagggaccagaggggaaattaaagggaccgaagtttaaaatgccagaaatgaatattaaagcaccaaaaatctcaatgcccgatattgatctgaacctgaagggaccgaaagtgaaaggcgatgttgatgtgtccctcccaaaggtggaaggtgaccttaaaggtccggaggttgacattaagggtccaaaagttgacatcgatgcgccagatgttgacgtccacgggcccgattggcacctgaagatgccaaagatcaagatgcctaagatcagcatgcccggttttaagggtgagggcccagacgtcgacgtgaacttgcccaaggccgacattgacgttagcgggcccaaggttgatgttgagtgcccagacgtcaatatcgagggcccggagggaaagtggaagtcccctaagtttaagatgcccgagatgcactttaaaacgccgaaaatttcgatgccagacattgatttgaatcttacgggcccaaaaatcaagggagacgtggacgtaaccggtccaaaggtggagggagatttgaagggccctgaagtcgacctaaagggccctaaagtggacattgacgtgccagacgtaaacgtgcagggtccagactggcatctgaaaatgccgaaaatgaaaatgccaaaatttagcatgccaggcttcaaggcagaaggtcctgaagtcgatgtaaatctgcccaaggcagatgtagatgttagtggacctaaggtggatgtcgaaggccccgacgtcaacattgagggaccagaaggaaagttgaagggacctaaatttaaaatgccggaaatgaatattaaagcacctaaaatcccgatgcccgattttgatctgcacttaaaaggacctaaggtaaagggcgacgtggatatcagcctgcctaaggtcgagggagacctgaagggcccagaggtggatattcgtgggccccaggtcgatatcgacgtgcctgacgttggcgtgcaaggtcctgattggcacttaaagatgcccaaagtgaaaatgccaaagttctccatgccaggcttcaagggggagggccccgacgtggacgttaacctccctaaggccgatctcgatgttagtggaccaaaggtggacattgacgtgccagacgtcaatatagagggaccagagggaaaactgaagggcccaaagtttaagatgcccgaaatgaacatcaaagcaccgaaaatttccatgccagacatcgatcttaacctcaagggcccgaaggtgaagggcgatatggacgttagcttacctaaggtggagggcgatatgaaggtgcccgatgtggatattaagggacctaaggtcgacatcaatgcccctgacgtggacgtacagggtcctgactggcacctgaaaatgcccaagatcaagatgcccaagatctctatgcctggcttcaagggagagggacctgaagtcgatgtcaacttaccaaaggccgatctcgacgtcagcggtccaaaagtcgacgttgacgtccctgatgtgaacatcgagggccctgacgctaaactcaagggccccaagttcaagatgcccgagatgaatattaaggcacctaaaatctctatgccagaccttgatctgaacctgaaaggtcccaaaatgaagggagaggtggatgtttccttagccaacgtcgagggcgacctaaaaggacccgcattagatattaagggaccgaaaattgacgtggacgcacccgatatcgatatacatggccccgacgcaaagctgaaaggccctaaattaaagatgcccgatatgcacgtcaatatgccaaagatctctatgcctgagatagacctgaatctgaaaggaagcaaattgaaaggagatgttgatgtttccggcccaaagcttgaaggagacatcaaggctccctccctagacatcaaggggccagaggtagacgtgtccggtcctaaactgaatattgagggaaagagcaaaaagagcaggtttaagcttcccaagttcaacttctcagggtcaaaagtgcagacacccgaggtcgatgtgaaagggaagaagccagatatagatattacaggccctaaggttgacatcaacgcacccgatgtcgaggttcagggcaaggttaaaggctcaaagtttaaaatgccattccttagcatctcctctcctaaagtctcaatgccggacgtggagttgaatctgaagagtcctaaggtaaaaggtgatctggatatcgccggaccgaatctcgagggtgattttaaagggccaaaagtcgatatcaaggctcctgaggtcaatctgaacgcgcctgacgttgatgttcatggtccagactggaacctgaagatgcctaagatgaagatgcccaagtttagtgtcagtggcctgaaagcggaaggacccgatgtggccgtggacctccccaagggagacatcaatatagaggggccttctatgaacattgaagggccagacctcaatgtggagggaccggaaggaggtttaaaagggcctaaattcaagatgcccgacatgaatattaaggctcctaaaataagcatgccagacattgacttgaatcttaaaggtcccaaggttaagggcgatgtagacatttcactgcctaagctggaaggggatttgaaaggcccagaggtagacatcaaaggtccaaaggtggacatcaacgcccccgacgtggacgtccatggccctgattggcacctgaaaatgccaaaggtcaagatgcctaagttttcaatgcccggattcaagggtgaaggccccgaagtggatgttacattacctaaggcggacatcgatatttccggccctaacgtggacgtcgacgtccccgacgttaacatagaagggccagatgccaagttgaagggacctaagtttaaaatgcccgaaatgaacataaaagccccaaagatatcaatgcccgacttcgatttgaatcttaagggccctaaaatgaaaggagacgtggttgtttctctccccaaggtggaaggggacttaaagggaccagaagtagacattaaaggccctaaggtcgatatagacactccggacattaacatcgagggctccgaaggtaagtttaagggccccaagttcaagatccccgaaatgcaccttaaagctcccaaaattagcatgcccgacatcgatcttaacttaaaaggccctaaggtgaagggtgacgtggacgtgtctttgccaaaaatggagggcgaccttaaaggccccgaagttgacattaaaggccctaaggtggacatcaacgctcccgacgttgacgtccagggtcctgattggcatctgaaaatgccgaaggtgaaaatgcctaagttcagcatgccgggattcaagggcgaaggacccgatgtggatgttaacctgccgaaagcagacttggacgttagcggtccgaaagtggacattgatgtacccgatgtcaatatcgagggccctgaaggcaagctaaaagggcccaagttcaaaatgcctgagatgaatatcaaagcccccaaaatatctatgccagacatagatcttaaccttaagggcccaaaagtgaagggagacatggatgtgtctctgcctaaggtggagggcgacatgcaagtgcccgacttagatataaagggcccaaaggtggacataaacgccccagacgtggatgtgcgcggtcctgattggcacctgaaaatgccaaagataaaaatgccaaagattagcatgcccggattcaaaggcgagggacctgaagtcgacgtcaacttgccaaaggccgacctcgatgtgagtggccctaaggtcgacgtcgatgtcccggatgttaatatcgaaggtcccgacgcaaagttaaaaggacccaaatttaagatgcctgaaatgaacattaaggcacctaagatttctatgcctgactttgacttgcacctgaaaggcccaaaggtgaagggagatgtcgacgtgtcccttcctaaaatggagggtgatctgaaggcaccggaggtcgacattaaggggccaaaagtggacattgacgcaccggacgttgatgtgcacggccctgattggcaccttaagatgcctaaagttaagatgcccaaattctccatgccagggtttaagggggaggggcccgaggtggatgtcaacctgcccaaggcagacattgacgtgtcggggccaaaagtcgacattgacactcccgatatcgatatccatggtcctgagggcaagctgaagggtcccaagttcaagatgcccgacctacacctaaaggccccaaagatatccatgccagaagtagacttgaacctgaaaggcccaaaaatgaagggggatgtggacgtatccctcccaaaggtagagggtgacctaaagggccctgaagtggacattaaaggccctaaggtggacattgacgttcctgacgtggatgtacaaggcccagattggcacctcaaaatgcctaaagtcaaaatgccaaagttttctatgcctggattcaaaggcgaggggcctgacgtagatgtgaacctccccaaagctgacttagacgtctctggtccaaaagtggatatagacgttcctgacgtcaacatcgaaggacccgacgcgaagctgaaaggccctaagttcaagatgcctgagatgaacattaaggctcctaagatcagcatgcccgacttcgacttacatctcaagggaccgaaagtgaaaggggacgtcgatgtgtctcttcctaaggtggagggagaccttaaaggccctgaagtggacattaaaggccctaaagtggatatcgatgcccctgacgtggacgtgcacggcccggattggcatctgaagatgcccaaagtcaaaatgccaaaattttctatgcctgggtttaaaggggaggggccggatgttgatgtgacactccccaaagcagacatcgaaatctctgggccaaaagtggacatcgacgcgccagatgtatctatagagggacccgacgccaaactgaagggcccaaaatttaaaatgcctgaaatgaacatcaaggcccccaagatttctatgcccgacatcgatttcaatctgaagggtcccaaagtaaagggagatgtagatgtcagcttacccaaggtggaaggcgacctgaagggacccgagattgacatcaagggccctagccttgatattgatacccctgatgttaatatcgagggaccagagggcaagctgaaaggaccaaagttcaagatgcctgagatgaacatcaaggctccaaagatcagcatgcctgatttcgatttacacttgaagggtcccaaggtaaagggggacgtggacgtgtccttgcctaaagtggagagcgatctgaaaggaccggaagtcgacattgaggggccagagggcaaactgaaaggaccaaagttcaaaatgcccgacgtacatttcaagtcaccacaaatctccatgagtgatatcgaccttaacctgaagggaccgaagattaagggagatatggacatatctgttcctaagttggagggggatcttaagggtcccaaagtcgacgtgaaggggcctaaggtggggattgatactcccgatatagacattcatggccctgagggcaagctaaagggtccaaaattcaagatgccggatctgcatctgaaggcacccaaaatctccatgcctgaggtcgatttgaacttaaagggccccaaagtgaaaggagatatggatatttcacttccaaaagttgaaggcgacctcaaaggtcccgaagtggacattagggacccaaaggtggatatcgatgtccctgatgtggatgtgcaaggccccgactggcatctgaagatgccgaaggtcaagatgccaaagttctcgatgcccggcttcaagggggagggaccagacgtggacgtgaacctccctaaagcggatatcgatgtatccggtcccaaagtggacgtggatgtcccagacgtgaatatagaaggccctgatgcaaaattgaagggacctaagtttaagatgccagaaatgtctattaaggctccaaaaatctcaatgcctgacatcgatcttaatctgaagggcccaaaggtgaagggggatgtcgatgtgacgctgccaaaggtggaaggagatctgaagggaccagaggccgacataaagggcccgaaggtcgatattaatacaccagatgtggatgtgcacggacccgattggcatctgaagatgcccaaggtaaagatgccaaagttttcgatgccggggtttaaaggggagggccccgatgttgacgtgtctttgccaaaggccgacatagacgtgagcggtcccaaagtcgatgttgacattcctgacgtgaacattgaggggcccgatgctaagctaaagggccctaaatttaaaatgcccgagattaacattaaggcccccaagatcagcatccccgatgtggacctggacttaaagggaccaaaggtcaagggcgattttgacgtatctgtcccgaaggtcgaaggcacacttaaaggccccgaagtggacttgaagggcccacgactcgacttcgaggggcccgatgctaaactatccggcccatctttgaaaatgccttccctcgaaatcagcgccccaaaggtgaccgcacccgacgtcgatttgcacctcaaggcacccaagatcggtttcagcggccccaagctcgagggaggggaggtggatttaaaggggcctaaagtcgaggccccgtccttggacgtccacatggatagccctgacatcaacatcgaaggaccggatgtgaagattcccaaatttaagaagcccaaatttgggttcggggcaaagagccctaaggccgatattaagtctccctccctcgacgtgacagtgcctgaggcggagctaaacctagagacccccgaaatatctgtgggtgggaaaggcaagaagagcaagtttaaaatgcccaagatccatatgagcggccccaaaattaaggccaagaagcaaggctttgatttaaacgtccccgggggtgaaatcgatgcctcattaaaggcccctgacgtggacgtgaacattgccggccccgatgcagccttaaaagttgacgtcaagagtccaaagacgaagaaaaccatgtttggaaaaatgtacttccctgacgtggagtttgatataaaatcccctaaattcaaggccgaagccccactaccgtcacccaaactggagggagaactccaggcccctgatctggagctgtccctccccgctattcacgtagagggcctggacatcaaggcaaaagccccgaaagttaagatgccagacgtagacatttcagtcccaaagatagaaggcgatctcaagggtcccaaagtacaggcaaatttgggtgcccccgatatcaacatcgaaggactcgacgcaaaggttaaaactccctcttttggtatcagcgccccccaggtctctatccctgatgtaaatgtgaaccttaaggggcccaagatcaaaggggatgtccctagcgttggtctcgagggcccagacgttgacctacagggacccgaggctaaaataaagttccccaagttctccatgccgaaaattgggattccaggagtgaagatggaaggaggcggtgctgaggtgcacgcgcaacttccttccctagaaggggatctccgcgggcctgatgtcaagttggaaggccccgacgtgtcactgaaaggccctggagttgacttaccgagcgtaaacttgtcaatgcctaaggtttctgggcccgacctcgatcttaacctcaaaggccctagtctgaagggcgacctggacgccagcgtgccctccatgaaagttcacgccccgggcctgaacttaagcggcgtgggagggaagatgcaggtgggtggggacggggtcaaggtacccggcattgacgcaactacgaagctgaacgtgggtgcacccgacgtgactctaagggggccatctcttcaaggtgatctggccgtgtctggcgacatcaaatgcccaaaggtcagtgtgggtgccccagacctgagcctggaagcctctgaaggcagcataaagctgcctaagatgaagctgccccagtttgggatcagcacgcctggatccgatctccacgtcaacgccaagggacctcaggtgtccggggaactgaaaggccccggcgtggacgtcaacctgaaggggccaagaatttcagcaccgaacgtggattttaacctcgaaggacccaaggtaaaaggaagcctgggagcaactggagaaatcaagggaccaaccgtggggggggggctgcctgggatcggtgttcaggggctcgagggaaacctacagatgcctggcatcaagagctcaggctgcgatgtgaacctgcccggagtaaatgtgaagctgccgacgggacagatctctgggcccgaaattaagggaggtctcaaggggtctgaggtgggcttccacggcgctgccccagatatcagcgtgaagggccctgcgttcaacatggccagtccggaaagcgattttgggattaatctgaaggggccaaaaattaaaggcggcgccgatgtgtccggaggggttagtgctccagatatttctctcggagaaggccacctctccgttaaaggaagtggaggcgaatggaagggcccccaagtgtcgagcgctctcaatcttgatacgagtaaattcgctggaggtctccacttctctggcccgaaggtcgagggcggagtgaaaggcggccagataggactccaagctcccggtctctccgtttcaggcccccagggacatcttgaatctgggtccggtaaggtcacctttccaaaaatgaaaatccctaagtttactttctcaggccgggagcttgtcggccgagaaatgggcgtggatgttcacttccctaaagctgaggcctccatccaggccggcgcaggggacggagagtgggaagagagcgaagtgaaactgaagaagtcgaaaatcaagatgcctaagttcaacttctccaaacctaagggtaaggggggcgtcacgggtagccccgaggcatcaatatccggctcaaagggagatttaaaaagctctaaggctagtctggggagcttggagggcgaagctgaggccgaggccagcagcccaaagggaaagttttccctgtttaagtccaaaaaacctaggcatagaagcaactccttttctgacgaacgagaattcagcggacctagtaccccaactggcacgctggagttcgagggaggagaagtctctctagaaggcggaaaagtgaagggtaaacacggaaagttaaaattcgggaccttcggaggtttaggatccaagagcaaaggccactacgaggtcacagggtccgacgacgaaactggtaaactgcagggttctggcgtttctctggcatctaaaaaatccagattatcttcttcgtccagcaatgacagcggtaacaaagtgggaatccaattgcctgaggtggaactgtctgtgtccactaagaaagaatag

SEQ ID NO: 22779 - DNA, 372 bp, Artificial Sequence
  Description of Artificial Sequence: Synthetic coding sequence
atggagaaggaggagaccacccgggagctgctgctgcccaactggcagggatctggatcccatggcttaaccattgcacaaagagatgatggtgtcttcgtccaggaggtgactcagaattcacctgctgctcggacaggggtggtaaaggaaggcgatcaaatcgtaggggctaccatatattttgataacctccagtctggggaggtcacgcaactcttgaacactatgggtcaccacactgtgggactaaaactgcatagaaaaggtgatcgtagccctgagcccggccagacctggaccagggaggtctttagttcatgctcatccgaggtcgtcctctccggagacgatgaggagtatcagcgttag

SEQ ID NO: 22780 - DNA, 435 bp, Artificial Sequence
  Description of Artificial Sequence: Synthetic coding sequence
atggagaaggaggagaccacccgggagctgctgctgcccaactggcaaggatccggttcccacggactgacaatagcacagcgggacgatggtgtcttcgtccaagaggtgacccaaaattcaccagcggctcggactggcgtcgtgaaggagggggatcagatagttggcgctactatctattttgataacctgcagtctggtgaggtgacacaactcctaaatactatgggccatcacactgttggtctcaaactacaccggaaaggagataggagtcccgagcccggtcagacctggacgcgggaagtcttttcctcatgctcatccgaggttgtgcttagcggagatgatgaggagtaccagcggatatacacaaccaaaatcaagccccgcttaaaaagcgaggacggagtagagggcgacctgggctag

SEQ ID NO: 22781 - DNA, 261 bp, Artificial Sequence
  Description of Artificial Sequence: Synthetic coding sequence
atggagaaggaggagaccacccgggagctgctgctgcccaactggcagggcagtgggtcacacggactaactatcgctcaacgggatgacggagtgtttgtgcaggaggtgactcagaatagccctgcagcccgcaccggagtggttaaggaaggagatcagattgtgggtgcaactatttattttgacaatctgcagtccggtgaggtgactcagctgctcaacactatggggcaccataccgtcggattgaaattgtag

SEQ ID NO: 22782 - DNA, 366 bp, Artificial Sequence
  Description of Artificial Sequence: Synthetic coding sequence
atggagaaggaggagaccacccgggagctgctgctgcccaactggcaggggtctggcagtcacggcctgacaatcgctcagcgagacgatggggtgttcgtgcaagaagtgacacagaatagcccggctgccagaacgggtgtggtaaaggaaggagatcaaattgtcggagctaccatatatttcgacaacctgcagtcaggtgaggttacacagcttctgaatactatgggtcatcacactgttggtctgaaattacacagaaaaggagaccggtcacctgaaccaggccagacttggaccagggaagtgttctcttcctgttcatctgaagttgtcttaaatacccctcaaccatccgcttag

SEQ ID NO: 22783 - DNA, 2904 bp, Artificial Sequence
  Description of Artificial Sequence: Synthetic coding sequence
atggccaagggcttctacatcagcaagagcctgggcatcctgggcattttactgggcgtggccgcagtatgcactattattgcgctgtctgtggtttactcccaggagaaaaataagaacgccaattctagcccagtggcatcaaccacacctagcgcgagtgccaccactaaccctgcaagcgccacgactctcgaccagtctaaggcctggaacagatatcggctgccaaatacgctgaaacctgattcttatcgggtaactctgcgaccctacctgacacccaacgatcggggactgtatgtcttcaaagggtcatccacagtcagatttacatgtaaagaagctacagacgtcataattatccatagcaaaaaattgaactacaccctgagtcaagggcatcgagtggttctgcgaggggtcgggggatcccagccaccagatattgataagacagagctcgtggaaccaaccgaatacctcgtggttcatctcaaggggtccctcgtgaaggatagccagtatgaaatggactccgagttcgagggggagctagccgatgacctggccggcttctaccggagtgaatacatggagggaaacgtaagaaaagtggtagccacaacccagatgcaagccgccgacgctcgcaaaagcttcccctgctttgatgaacctgccatgaaagctgagttcaacattactctcatccacccaaaggatctgaccgctttgagcaatatgctaccaaaggggccctcgacccccctcccagaggaccccaattggaatgtgacagagttccatacgactccaaaaatgtcaacctatctgcttgccttcattgtgtcagagttcgattatgttgaaaagcaggccagcaatggagtgctgataaggatctgggccagaccctccgcgattgccgcgggccatggagattacgcgttgaacgtgacaggcccaattctcaatttctttgccggacattacgacactccgtaccctttgccaaagtcagaccagatcgggctgcctgactttaacgccggcgcaatggaaaattggggactggtgacctaccgagaaaattccctgctctttgatccattgtcttcatccagctcgaataaagagcgagtcgtgaccgtcatcgcgcatgaactggctcatcagtggtttggaaatctcgttactatcgagtggtggaacgatctatggctgaatgaaggatttgcgtcctacgtggaatatctgggggctgactacgctgaacccacttggaatctgaaggacctgatggtactgaacgacgtctaccgagtgatggccgttgacgccttagcctcatcccaccccttgtcaacaccagcaagcgagattaatactcccgcacagatcagtgagttgttcgacgccatttcatattccaagggtgcgtctgttttgcgcatgttgtcctcatttttgtccgaggacgtgtttaagcaaggtctcgcgtcatatctgcacacctttgcttatcagaacactatatatctaaatctgtgggaccacctacaagaggccgtgaataaccggagcattcagcttccgactacggtgagagatatcatgaaccgctggacactgcagatgggttttcccgtcattactgtggacaccagtaccgggaccttgagccaggaacatttcttgttggatcccgatagtaacgtgactagacccagcgaattcaactacgtgtggatcgtgcctattactagcatccgggacggcagacagcagcaggactattggctgatagatgtgcgagcccagaacgatttgttctcaacctccggaaacgaatgggtgctcctaaatcttaacgtaacagggtactaccgggtgaactatgatgaggaaaattggcgaaagatccagactcagttacagcgtgatcactcagccattcctgtgatcaaccgtgcgcagataattaatgatgcatttaatctcgcctccgcccataaggtgccagttactctcgcccttaacaacacgctgtttctgatcgaggaaaggcagtacatgccatgggaagctgcactctcgagcctctcatatttcaaacttatgttcgatcgcagtgaagtttacgggcctatgaagaactaccttaaaaagcaggtcaccccgctttttattcacttccgaaacaataccaacaactggagggagatcccggagaacctgatggatcagtacagcgaggtcaatgctatttccaccgcttgttccaatggagtgcccgagtgtgaagaaatggtttccggactgtttaaacaatggatggaaaaccctaacaataatcccatccacccaaaccttagatctactgtgtattgcaatgccattgcgcaggggggggaagaggaatgggattttgcatgggaacagttcagaaacgcaacccttgtcaacgaagccgataagctgcgggccgccctggcctgctccaaagaactctggatactgaatcgatacctgagctacacgcttaatcctgatcttattcgaaaacaggacgcaacaagtacaattatctccattaccaacaacgtcataggtcaggggctggtgtgggatttcgtgcaatcgaattggaaaaagttattcaacgattacggcggcggctctttcagcttctccaacttgatacaagccgtgaccagacgattttccacggaatatgagctccagcagcttgagcaatttaaaaaagacaacgaagagactggtttcggaagcggaaccagagcattggaacaagctcttgagaaaacaaaggccaacataaaatgggttaaggaaaataaggaggtcgtcctgcaatggtttacagagaattcgaagtag

SEQ ID NO: 22784 - DNA, 312 bp, Artificial Sequence
  Description of Artificial Sequence: Synthetic coding sequence
atggccaagggcttctacatcagcaagagcctgggcatcctgggcattttgctgggcgtcgctgccgtctgtacaattatcgcacttagtgtggtatattcccaggaaaaaaacaagaatgcgaattctagccctgtcgcctctacaacaccctctgcatctgcaactacaaatcccgcatccgctaccacacttgaccagagtaaggcctggaatcgctatagattacctaatacattgaaaccggattcttaccgtgtgaccctgcgaccttatctgacccctaatgaccgaggcttatatgtgttctag

SEQ ID NO: 22785 - DNA, 186 bp, Artificial Sequence
  Description of Artificial Sequence: Synthetic coding sequence
atggccaagggcttctacatcagcaagagcctgggcatcctgggcatcctgctgggtgtagccgcagtatgtacaattatagccctcagcgtggtctactcgcaagagaagaacaaaaatgcaaacagctcaccagtcgcgagtaccacaccatctgcctccgcaaccacaaatcccgctagctag

SEQ ID NO: 22786 - DNA, 381 bp, Artificial Sequence
  Description of Artificial Sequence: Synthetic coding sequence
atgaaccagaacaccgacaagatcagcggcagcggcagcaacagcgacatgatggaaaattctaaagaggagggtacatcctcttccgaaaagagcaagtcaagtgggtcaagcaggagcaaaaggaaaccatcgattgtgacaaagtacgtggagagcgacgatgaaaaaccactggatgatgaaacagtcaacgaggatgccagcaatgaaaattcggaaaacgacattacgatgcagtctctgcctaaggggaccgtaatcgtccaacccgagcccgtcctgaatgaggacaaagatgattttaagggccctgagttccgtagccgctccaagatgaagacagagaatcttaagaaaagaggtggaaagtataagtag

SEQ ID NO: 22787 - DNA, 7479 bp, Artificial Sequence
  Description of Artificial Sequence: Synthetic coding sequence
atgaccgccgagcccatgagcgagagcaagctgaacaccctggtgcagaagctgcatgattttctagcgcactctagcgaagaaagcgaggaaacaagcagccctcctcgcctcgcaatgaaccagaacaccgataaaatttcagggtctggaagtaactccgacatgatggagaattctaaggaggaggggaccagctcatcagaaaaaagcaagtcttccgggtcctctcgctctaagcggaaacccagcatcgtgaccaaatatgtcgagtcagacgatgagaagcccctggatgacgagacagtgaacgaggacgccagcaatgagaactccgaaaatgatatcacaatgcagtcactgccaaaaggaactgtgatcgtccagccagaacctgtcctgaacgaagataaagatgatttcaaaggacctgaattccgttcccggagcaaaatgaagaccgagaaccttaaaaagcgcggcgaggatggtcttcatggtatagtgtcctgtactgcatgcggccaacaagtcaatcacttccagaaagattccatttatcggcacccaagcttacaagtccttatttgcaagaattgctttaaatactatatgagcgacgatataagtcgtgattctgatggtatggacgaacaatgccgctggtgtgccgaaggaggtaacctcatatgctgtgacttctgccacaatgccttctgcaaaaagtgcatcttgagaaatctggggagaaaagagctgtccaccattatggacgagaataaccagtggtattgctatatctgccaccccgaacctcttctggatctcgttactgcttgtaactccgtctttgaaaacctggagcaactcttgcagcagaacaagaagaagatcaaggtggactctgagaaatcgaataaagtgtacgagcacacatcgagattcagcccaaagaaaacctcaagcaattgtaatggggaggagaagaaacttgacgacagttgctcgggaagcgttacctatagctatagtgcgctgattgtccctaaagagatgattaagaaagctaagaagctgatcgagacgaccgccaacatgaactctagttacgtaaagtttttaaagcaggctaccgataactctgagatctcctcggcaacaaaactgagacagctgaaggcctttaagtcagtactggcagacataaagaaggcccatctggccttagaggaagatttaaactccgagttccgagccatggacgccgttaataaggaaaaaaatactaaagagcacaaagtgatagatgccaagttcgaaacaaaagccagaaagggggagaagccttgcgccctggagaaaaaggacatcagcaaatccgaggctaagctgtccaggaaacaagtggactccgagcacatgcaccagaacgtcccgaccgaggaacagcgtacaaacaagtcgacaggcggcgagcacaaaaagtccgacagaaaggaggaacctcaatatgagcctgcaaacacatccgaagatctggatatggacatcgtgtccgtcccgagcagtgtgccagaagatatctttgagaatctggaaactgccatggaagtccagtcctctgtggatcaccagggcgatggcagctccggtaccgagcaggaagttgagtcaagttctgtcaagttgaatatttcaagcaaggacaaccgggggggaatcaagtctaaaacgaccgctaaagttactaaggagctttatgtaaaactgacccctgtctccctgtcgaattcgccaattaaaggagctgactgccaggaagtgccccaggataaagacggctacaaatcttgcgggctgaaccctaagctggagaagtgcggcctgggccaggaaaattccgacaacgaacatctcgttgagaacgaggtgagtctactgctggaggagagcgaccttcgacgatccccccgggtgaagactacccccctgagacgaccaactgagaccaatcctgtaaccagcaattcagacgaggagtgcaacgaaactgtcaaggagaagcagaagctttctgtgcccgttcgcaaaaaggacaagaggaactcctccgatagcgccattgataaccctaagcctaataagctgccgaaaagcaagcagagtgagaccgtggatcagaacagcgactccgacgaaatgcttgccatcctgaaggaggtgtcccggatgagccactcaagtagctccgacactgacatcaatgaaattcataccaaccacaaaacactatatgacctcaagacccaagcggggaaagatgacaagggcaaaaggaagagaaaaagctctaccagtggctccgacttcgatacaaaaaaggggaagagcgccaaatccagcataatcagtaaaaagaagagacaaacacagtctgaaagttctaattatgactcggaactcgaaaaggagatcaaatcaatgagtaaaattggggcagcccggaccacaaagaaaaggattccaaacaccaaggacttcgactcctccgaagacgagaaacatagcaaaaaggggatggataatcaagggcataagaacctcaagactagccaagaaggatctagcgacgatgccgagagaaagcaggagcgggaaacctttagctcagccgaggggactgtcgacaaagatacgacaatcatggagttacgagatcgcctccctaaaaagcagcaagcctcagcttctacagatggcgttgacaaactctctggaaaggaacagtcatttaccagtcttgaggttcgtaaggtcgcagaaactaaagagaaatctaaacacctgaagacaaagacttgcaaaaaggttcaagacggtttgtctgacatagccgagaagtttctcaaaaaggatcaaagcgacgagacgagcgaggacgacaaaaaacagagcaagaagggcactgaggaaaagaagaagccttctgacttcaagaaaaaggttatcaagatggagcaacaatatgagagcagcagtgacggcaccgagaagctccctgagagagaagaaatatgccactttcccaaagggatcaagcagatcaaaaatggcactaccgatggggaaaagaaatccaagaagatacgtgataaaacttcaaaaaagaaagatgaactgtcggattacgccgagaagtccacaggcaaaggggacagttgcgactcttctgaggataagaaatctaagaacggcgcgtatggcagggagaaaaagagatgtaaattgcttggaaaatcctcacggaagcgccaggactgttcatccagtgataccgaaaagtacagcatgaaagaagacggatgcaacagcagcgataagagactgaaaagaattgaactgagggaacgtcgcaacctgtcctcgaagcgcaataccaaagaaattcaatcaggctcttctagctcggatgccgaggagtcgtcagaggacaataaaaaaaaaaaacagaggacttcctccaagaaaaaggctgtgattgtcaaggagaagaagaggaattcactgaggacatcaactaagagaaagcaggccgatattacatcctccagctcttctgacattgaggacgatgaccaaaactctatcggagagggaagcagcgacgaacagaagataaagcctgtgacggaaaacctcgtgctcagcagccacacagggttttgccagagcagtggcgatgaagctctgagcaagtccgtgccggtcacagtcgacgacgatgatgatgacaatgacccagaaaatagaatcgccaagaaaatgctgttagaggagatcaaggccaacctctcatccgacgaggatggttcttcagatgacgaacccgaggaaggcaagaagaggaccgggaaacagaatgaggagaatcccggtgatgaggaggcgaaaaaccaagtgaactctgagtctgattctgattcagaagaatccaagaaaccacggtataggcaccgtcttctgagacataagcttacagtgtcagacggcgaatcaggagaagagaaaaaaactaaacctaaagagcacaaggaagtaaagggtaggaataggcggaaggtctcctctgaggacagtgaagactcggactttcaggagtctggcgtctcggaggaggtgtctgagagtgaagatgagcagaggccccgaacgagatcagccaaaaaagcagaactggaggagaatcagcgatcctacaaacaaaaaaagaagagaaggcgcatcaaggttcaggaagattcttcgagtgaaaacaaatccaactctgaggaggaagaggaagagaaggaggaagaggaggaggaggaggaggaggaggaggaggaagaagaagacgaaaatgatgacagcaagtcaccggggaaaggacgtaagaagataaggaagatcctgaaggacgacaagctgcggaccgaaactcaaaacgctctaaaggaggaagaagagcgtcggaagcgcatcgctgaacgggaacgggagagggagaaactccgtgaggtgatcgagatagaggatgccagccccaccaagtgcccgattactacgaagctggtgctggacgaggatgaagaaacaaaggagccgcttgtgcaagtgcataggaacatggtgattaagctcaagccccaccaggttgatggtgtgcagtttatgtgggactgttgctgtgaaagcgttaagaagacgaagaagagccctggtagcggctgtatcttagcccactgtatgggcctgggcaagacactccaggtggtatcgtttctgcatactgtgctgttgtgcgataagctggacttctctaccgccctcgttgtgtgccctctaaacacagccttgaactggatgaacgaatttgaaaagtggcaggaggggttgaaagacgacgagaagctcgaggtatctgaactagccaccgtgaagaggcctcaggaaaggtcatatatgctgcagcgctggcaagaggatggaggtgtcatgattatcggctatgagatgtaccgcaatttggcgcagggccggaatgtcaagagccgtaaactcaaagaaatcttcaacaaggccttggtcgatcctggtcctgactttgtggtctgcgacgagggccatattctgaagaatgaggcaagcgccgtcagcaaagcaatgaatagcataagatcgcggcgccgcattattctgacgggtacgccacttcaaaacaacctgatagagtaccattgcatggtgaatttcatcaaggagaatcttctgggtagtattaaagaattcagaaatagattcatcaacccaattcagaatggtcagtgcgctgattctacaatggtagacgtcagggtcatgaagaagagggctcatatactgtacgaaatgttagcaggttgtgttcagcgcaaagattatacagccctgaccaagttcctcccgccaaagcacgagtatgtactggcagtgaggatgaccagtatccagtgcaagttgtaccaatactacctcgatcacttgacgggggtgggcaataactcagaaggtgggaggggtaaggcaggcgctaagctgtttcaagattttcagatgctcagtaggatatggacccatccctggtgtctccaactggactatatctccaaagagaataaagggtatttcgatgaggattctatggatgagttcatcgccagtgatagcgatgaaacaagcatgagcttgtcatccgatgactacaccaaaaagaaaaagaagggcaagaaaggtaagaaagattctagtagtagcggtagcgggagtgacaatgatgttgaggtgatcaaagtatggaacagcagatcaagagggggcggcgaagggaacgttgacgagactggcaacaaccctagtgtgtcactaaaactcgaggagtctaaggccacctcctcctccaacccaagttcgcccgcgccagactggtataaggattttgtgaccgatgcagatgcagaagtgctcgagcacagtggcaaaatggtgttactcttcgaaattctgcgcatggcagaagagattggcgataaggtgctggtgttcagccagtccttaatcagtctggacctcatagaagacttcctcgagctcgcgtcgagagagaaaaccgaggataaggacaaacctctgatttacaaaggcgagggcaagtggttacgaaacattgactattaccgtctcgacggaagcactacagcccagagccggaagaagtgggccgaggagttcaacgacgaaaccaatgtcaggggccggctgttcattatttcaacaaaagcaggatcgctgggaatcaatctggtcgcagcaaaccgcgtcatcatatttgacgcatcttggaacccttcatacgatattcagtccatcttccgggtctaccgctttgggcaaactaagccagtgtatgtctaccggttcctggctcagggaaccatggaagacaagatttacgaccgccaggtgactaaacagagcctttcctttcgagtggtggatcagcagcaggtggaaaggcatttcactatgaacgaactgaccgagctgtataccttcgagccggacttactcgatgaccccaattcagagaagaagaagaagagagacactcctatgctccctaaagatacaatcctcgctgaattgctgcagatccataaagagcacatcgtggggtatcacgaacacgatagtcttctcgatcacaaagaagaagaggagttgaccgaggaagaaaggaaggctgcctgggcagagtacgaagcggaaaagaaaggcctgactatgcgatttaacattcctacagggacaaacctgccacctgtttccttcaatagccagaccccatacattccttttaatcttggcgccctgtccgctatgtcgaatcagcagctggaggatttgatcaaccaaggcagagaaaaggtcgtagaggccactaactctgtcactgcagtccgtatacagcctttggaggacatcatttcagcagtgtggaaagaaaacatgaacctgtccgaggctcaggtgcaggccctcgcgctgagtcggcaggcctctcaggagttggacgtaaagcggcgggaggctatatataatgatgtcttaactaaacagcaaatgcttataagctgcgtccagcgaatcctaatgaacaggcgcctccaacagcagtacaatcaacagcagcaacagcagatgacctaccagcaagcaactctggggcacctgatgatgcccaagcccccaaacctgattatgaacccctcaaattatcagcaaatcgacatgcggggtatgtatcagccggtggccgggggtatgcagcccccaccattacaaagagctccacctccaatgcggtctaagaacccaggccccagccagggcaagagcatgtag

SEQ ID NO: 22788 - DNA, 7365 bp, Artificial Sequence
  Description of Artificial Sequence: Synthetic coding sequence
atgaccgccgagcccatgagcgagagcaagctgaacaccctggtgcaaaagctccacgattttctggctcattcttccgaagagagcgaggaaacaagttcgccaccaaggctggcgatgaatcagaacactgataagatctctgggagcgggtcaaatagcgatatgatggagaactctaaggaggaggggacctcatcgtcggagaagtcgaagagttccggatctagtaggagcaaacggaaaccatccattgtgaccaaatacgttgaaagcgatgacgaaaagcccttggacgacgagacggtcaacgaagatgcttcaaatgagaactccgaaaatgatataaccatgcagtctctccccaaagaggacggattgcacggcatcgtgagctgtacggcctgcggccaacaggtcaaccactttcagaaagattcaatttatcgacacccctcgctgcaggtgctgatctgcaagaactgtttcaagtactacatgtccgacgatatctcacgggacagcgacgggatggacgagcaatgtcgatggtgcgctgaagggggcaatcttatatgctgtgatttttgccacaatgccttctgtaagaaatgtattcttcggaatctgggtaggaaagaattgagtacaatcatggacgagaacaatcagtggtactgctatatatgtcaccctgagccgttactcgatctggtaacggcttgcaacagcgttttcgaaaatcttgagcagctgctacagcagaataaaaaaaaaataaaggtggacagcgagaaaagtaacaaggtctatgaacacacgagcagattctcacccaaaaagacatcctcaaactgcaacggcgaggaaaagaagttagacgacagctgcagcggcagcgtgacctactcttactccgctctcattgtgccgaaggaaatgatcaagaaagccaagaagctgatcgaaaccaccgctaacatgaacagcagttacgtgaagttccttaaacaagccacggataattcagaaatctcttcagccactaaactgaggcaactcaaagcattcaagtcagtcctggcagacattaagaaggcccacttagctctggaggaagaccttaatagcgagttccgtgccatggacgctgtgaacaaagaaaagaataccaaggaacacaaggtcattgacgccaaatttgagaccaaagctagaaaaggagagaagccatgtgctctcgaaaaaaaagacatcagcaagtccgaggctaaattaagtaggaagcaagttgacagcgagcacatgcatcagaacgtaccaaccgaagaacagaggaccaataaaagcactggcggcgagcacaagaagtccgatcgaaaggaggagcctcagtacgaaccagccaatacttccgaggatctggacatggatatcgtgagcgtgccaagctctgtgcccgaagatatcttcgaaaacctagaaaccgccatggaggtccagagttccgttgaccaccagggggatggcagcagtggcactgagcaggaggtcgagtcgagcagtgtaaagctcaacatctcctctaaagataatcgcggcggcatcaagtcgaaaactacagccaaagttacaaaggagttatatgtgaagctgacacctgtcagcttgtcgaacagtcctatcaaaggggccgactgccaagaggtgccccaagacaaggatggctacaagtcctgcggccttaaccccaagttagagaagtgcggcctgggacaggagaactccgataacgagcacctagttgaaaacgaggtgtctttactgctggaagagagtgatcttaggcgcagccccagggtgaagaccactcctctgaggcgccccactgagactaaccccgtgacttcgaatagcgacgaagagtgcaacgagacagtgaaagaaaagcaaaaacttagcgtgcctgtgcgtaagaaagataagagaaacagcagcgactctgctattgacaacccaaaacctaataaactgccaaagtccaaacagtccgaaaccgtcgaccaaaactccgattctgacgagatgttggctatcttgaaagaagtatccaggatgagtcactccagttcgtcagacaccgacattaatgaaatccacaccaatcacaaaacactatacgatctgaagactcaggctgggaaggatgacaagggtaagcgcaaaaggaagtcaagcacttcaggatccgatttcgacacgaagaaaggtaagagcgccaagagctctattatatctaaaaaaaaaaggcagacgcagtctgaaagcagcaattacgacagcgagctggaaaaggagatcaaatcaatgagcaaaattggcgcagccaggacaactaaaaagcgcattcctaacaccaaggactttgatagctccgaggacgagaaacattctaagaaaggaatggacaaccagggacataagaatctgaaaacatctcaggaaggaagctccgatgatgccgagaggaagcaggaaagagaaactttttcatctgctgagggaacagtggacaaagacaccacgattatggaattgcgcgatagattgccaaagaagcaacaggcaagcgcttccactgacggagtggataagttgtccgggaaggagcagtcttttactagtctggaggtcaggaaagttgctgaaactaaggagaaaagcaagcacctcaagactaagacctgtaagaaagtgcaggatgggctatctgacatcgccgaaaagtttctgaagaaggatcagtctgacgaaacctccgaggacgacaagaagcagtcaaagaaaggcaccgaggaaaagaagaaaccctccgactttaaaaagaaggtcatcaagatggaacagcagtacgagagctccagtgatggcaccgaaaagcttcccgagcgcgaggagatttgccatttccccaaaggtattaaacagatcaaaaacggaacaaccgacggggaaaagaaaagtaaaaaaatcagagataagaccagtaaaaagaaggatgaactcagcgattacgcagagaaatcgacgggtaagggcgattcctgtgattccagtgaagataaaaaatctaagaacggtgcttacggcagagaaaaaaaacgctgcaaattgttgggaaaatcttccagaaaaagacaggactgctcaagctcagacactgagaaatactctatgaaagaagacggttgcaacagcagtgataaaaggctgaagcgaattgagctgcgtgagcgccggaacttatcgtcaaaacggaacacaaaggaaatacaatcaggctcctcctccagtgacgcggaagagagcagtgaggacaataaaaagaagaaacagaggacctcaagcaaaaagaaggcggtaatcgtgaaggaaaaaaagaggaatagcttgcgtacatctaccaagaggaaacaggccgacatcactagcagctcaagcagtgatatcgaagacgatgatcagaacagcataggcgaaggcagctctgacgaacagaagatcaagccagtgaccgagaacctggttctatcatcccacaccgggttctgtcagtcgtcaggtgatgaagctctgtccaagtccgtgcccgtgactgttgacgacgatgatgatgacaatgatccagagaatcgcattgcaaagaaaatgttactcgaggaaataaaagcgaatttatccagtgacgaagatggctctagcgacgatgagcccgaagaagggaaaaagcgcaccgggaaacaaaatgaggaaaatccaggagacgaggaggcaaaaaaccaggtgaattccgaatccgattccgattcagaagagtccaagaaaccaagatatagacatagactgctgaggcacaagctgaccgtttcagatggagagagcggagaagaaaaaaaaacgaaaccaaaggaacacaaggaggtgaagggcagaaacaggcgcaaagtgtctagcgaggacagtgaagactctgacttccaggaaagtggtgtcagtgaggaggttagcgagtctgaggacgagcagaggccccgcactcgatctgcaaagaaagctgagctcgaagagaaccaacgctcctacaagcagaagaagaagcgccggagaattaaggtgcaggaggacagtagctcagaaaataagtcaaacagcgaggaagaggaagaggaaaaagaggaggaagaggaggaagaggaagaagaggaggaagaggaggaagacgaaaacgacgattctaagtcaccaggaaagggtaggaagaaaattcggaaaatactcaaggatgataaattgagaacggagacgcagaatgcactgaaggaagaagaagagcgccgaaaacggatcgccgaaagggagcgggagcgggaaaagctgagggaggtaattgaaatcgaggatgcctcccctacaaaatgtcctataactaccaagttggtgttggatgaggacgaggaaactaaggagccactggtgcaggtccataggaacatggtcatcaagctcaaaccccatcaagtggatggggtacagttcatgtgggactgctgctgcgagagcgtgaagaaaaccaaaaaaagtcctggtagtggatgtattctcgctcactgtatggggttaggcaagaccctccaggtggtcagtttcctgcacaccgtgcttctgtgcgacaagctggacttttcgaccgctctggtcgtgtgtccattaaacacagccctaaactggatgaacgagtttgagaagtggcaggaggggcttaaggatgatgagaaattggaagtgagtgagctggcaacagtgaagaggcctcaagagcggtcttacatgctgcaaagatggcaagaggacgggggggtgatgataatcggttacgaaatgtaccgtaatctggcccaagggagaaatgtaaaatctcggaagttgaaggaaattttcaacaaagctctcgtagatccagggcctgacttcgtggtgtgcgatgaaggtcacattctgaagaatgaggcctccgcagtttccaaggctatgaattccattagatctagaaggcggattatacttacaggtacccccctccagaataatctgatcgagtaccactgtatggtgaattttataaaggagaatctattgggatccatcaaggaatttcggaacagattcataaatcccatacagaatggtcagtgcgccgacagcaccatggtggacgtgcgtgtgatgaaaaagagagcgcacatcctgtacgagatgttagccggttgtgtgcagcgcaaggactacacggccctgacaaaattcctcccacctaaacatgaatacgtgcttgctgttagaatgacaagtattcagtgtaaactctatcaatactacctagatcacctgacaggggtcggcaacaattccgaggggggtagggggaaggctggagcaaagctatttcaggatttccaaatgctcagccgcatctggactcatccttggtgccttcagttggattatatttcaaaagagaacaaagggtacttcgacgaggactcgatggacgagtttattgcctccgatagcgatgagactagcatgtcgctgtcctccgacgactatactaagaaaaaaaagaagggcaaaaagggcaagaaagatagcagctcctcaggcagtggctcagacaacgatgtggaagtcattaaagtgtggaactcccggagtagggggggaggtgaaggcaatgtcgacgagactggcaacaacccgtcagtgtcacttaaactggaagaatcaaaagccacgtcatcaagtaacccttcctctcctgctcctgattggtacaaagacttcgtgactgacgctgacgccgaagtcctggagcactccgggaagatggtactgctttttgaaatcctccgcatggcagaagaaatcggagataaggtgctcgtgttctcacagagcctgatctcgctcgacctgatcgaagacttccttgaacttgcgagcagagaaaagaccgaagacaaggacaaaccactgatttacaaaggcgagggaaaatggcttagaaacatagattattaccgactcgacgggagcaccacagcgcagagcaggaaaaaatgggccgaagagttcaatgacgagaccaacgtgcgcggacgcctcttcataatctcaacaaaggccggctctcttgggattaacctcgtggctgcaaatcgggtgatcatctttgacgccagttggaacccatcctatgatatccagtccattttccgcgtgtataggttcgggcagaccaagcctgtctacgtatatcgtttcctagctcaaggaaccatggaagacaaaatatacgatcggcaggtgaccaaacagtcactgagttttcgcgtcgtggatcagcagcaggtggagcggcattttactatgaacgaactgaccgaactctatacgtttgaaccagaccttctcgatgaccccaatagtgagaaaaagaagaagagagacactcccatgcttccaaaggataccatcctcgccgagctgctacagatccataaggagcatattgtggggtatcatgagcacgacagtctgcttgaccataaagaagaagaggagctcacagaggaagaaagaaaagcagcgtgggcagagtacgaggcagaaaagaaaggactgactatgagattcaatatccccacagggactaatctacctccagtgagttttaattctcagaccccctacatcccttttaacctgggcgcacttagcgctatgagcaaccagcagttagaggatctgatcaatcagggacgcgagaaggtggtcgaggctacaaattctgtaacagcagtgcggattcagcccttagaagacatcatcagtgccgtctggaaggagaatatgaatctttcagaggcacaggttcaggctcttgcactcagtagacaagcctcccaggagctggatgtgaaacgcagagaggcgatatataacgacgtgctgaccaaacagcagatgctcattagctgcgtgcaaaggatccttatgaacaggcggctacaacagcaatataaccagcagcagcagcagcagatgacctaccagcaggctaccttaggccaccttatgatgcccaagccacctaatttgattatgaatccttccaattatcagcagatcgacatgcgcggaatgtaccagccagtagccggcggcatgcaacccccgcctttgcagcgtgcccctcctcctatgcgaagcaagaacccaggccccagtcagggcaaaagcatgtag

SEQ ID NO: 22789 - DNA, 369 bp, Artificial Sequence
  Description of Artificial Sequence: Synthetic coding sequence
atcaactacaaccgggacaagatcagcggcagcggcagcaacagcgacatgatggaaaactcaaaggaggaagggaccagttccagcgagaaatccaagtccagtggatcctcaaggagtaagcgcaagccgtccatcgtgacaaagtacgtggaaagcgacgacgaaaagcccttagatgatgaaacagtgaacgaagacgcaagcaacgaaaacagcgagaacgatataacaatgcagtccttaccgaagggcacagtgattgtccaacctgagcccgtcctgaatgaggataaagatgattttaagggccctgagttccgctctcggagcaagatgaagaccgaaaacttaaagaagagggggtag

SEQ ID NO: 22790 - DNA, 4038 bp, Artificial Sequence
  Description of Artificial Sequence: Synthetic coding sequence
atgagcgagagcaagctgaacaccctggtgcagaagctgcacgacttcttggctcattcctccgaggaatccgaagaaacaagctctccgccgagactcgcaatgaatcagaacacagataagattagcgggtccggttcaaatagcgacatgatggaaaactcaaaggaggaagggactagttcttccgaaaagagcaaatcatctggcagctcccggtctaagcgaaaaccctctattgttaccaagtacgtagagtcggatgacgagaaaccgctggacgacgaaacagtgaatgaagatgcgtccaatgaaaacagcgagaacgacatcactatgcagtcactgccaaaggacggtctgcacggaatagtttcatgcaccgcctgtggacagcaggtgaatcactttcagaaagactctatatatcggcacccatcactgcaggtgttgatatgcaaaaactgcttcaagtattatatgtccgacgatataagccgggactccgatgggatggatgagcagtgtagatggtgtgcagaaggtggcaatcttatttgctgtgatttttgtcataatgccttctgtaaaaagtgtattctccggaatcttgggcgaaaggagctctccacgatcatggacgaaaataatcagtggtattgctatatctgtcatccagagcccctgctggacctagtaacagcctgtaacagtgtgtttgaaaatcttgagcaactcctgcagcagaacaaaaaaaagataaaggtcgactctgaaaaatctaataaggtgtatgaacacaccagccggttctcaccaaagaaaacctcctctaactgcaatggtgaggagaagaaacttgatgacagttgctcagggagcgtaacatattcctatagcgccctcattgtgccgaaggagatgatcaaaaaagctaagaagctcattgaaacaacagctaacatgaactcatcgtacgtgaagttcctgaagcaggccacggacaactctgaaatcagtagtgctactaaactgaggcagctaaaagcctttaaaagcgtactagccgacatcaagaaggcgcaccttgctctggaggaagatttgaacagcgagtttcgagccatggatgctgtcaacaaggagaagaacacaaaagaacataaggttattgatgcaaagtttgaaacgaaggccaggaaaggtgagaagccctgcgccttggaaaagaaagatatcagcaaaagcgaggccaaactatcccgaaagcaagtcgactctgaacatatgcatcagaatgtgccaacagaagagcagaggacaaataagtcaaccggtggggagcataaaaagtctgatagaaaagaggagccccagtacgagcctgctaatacttcagaagacctcgatatggacattgtgtcagtccccagctctgtccccgaagacatctttgaaaatcttgagaccgcgatggaagtccaatcttctgtagaccaccaaggggacggttcttctggaacggagcaggaggtcgagagtagcagcgtcaagttaaatatcagcagtaaggataataggggcggtgctgactgccaagaagttccgcaggacaaggatggatataagtcctgcgggttgaatcctaaattggagaaatgcggcctgggccaggaaaattcagacaacgaacacctggtcgagaatgaagtcagcctcctccttgaagaatccgatctcaggcggtctcctcgggtcaagactactcctctgcgccggcccactgaaacaaacccagtcacgtcaaattctgatgaagagtgtaacgagacagttaaagagaagcaaaaattatcagtgcccgtgagaaaaaaggacaagagaaattcttccgactcggccatcgacaacccaaaacctaacaaactacccaaatctaaacaatcggaaaccgttgatcagaacagcgatagtgatgaaatgcttgccatcctgaaggaggtgtcaaggatgtcacatagcagctcatcagatacagatataaatgaaatccatacgaaccataagacattgtacgacctcaagactcaggcaggtaaggacgataaaggaaaaaggaaacgcaagagctctacttctggcagcgactttgatacgaagaaaggcaaaagcgccaagagtagcataatctctaaaaaaaaaagacagacacagtccgagtcctccaattacgacagcgagctggagaaggagatcaagtctatgtccaaaattggagctgcgcgcacaaccaagaagcggatccccaatactaaagactttgacagctcagaggatgaaaaacactctaagaagggcatggacaatcaaggccataagaatctgaagacctctcaggagggaagcagcgacgatgctgagagaaaacaagaacgtgagacgttcagttctgcagagggtactgtagacaaggacaccacaatcatggagctgcgagatcggttgcccaaaaaacaacaggcaagtgcgtccaccgatggtgttgataagctgtccgggaaggagcagtcatttacctccctggaggtcaggaaagttgcggaaaccaaggagaagagcaaacacttaaaaaccaagacgtgcaaaaaagttcaggatggcctcagcgacatagccgaaaaattcctcaagaaggaccaaagcgatgaaacctcagaggacgacaagaagcaatcaaaaaaaggcaccgaagaaaagaagaagcccagtgacttcaaaaagaaggtgatcaagatggaacagcagtacgaatcatctagtgacggaactgagaagctaccagagcgggaggaaatctgccatttccctaaggggattaagcagatcaagaacgggacaaccgatggcgagaagaagagtaagaaaatccgcgataagacaagcaaaaaaaaggatgagcttagtgactatgccgagaagagtacaggcaaaggcgacagttgcgactccagcgaggacaagaagtcaaaaaatggggcatacgggcgcgaaaaaaagcggtgcaaactccttggtaaaagttcgaggaagagacaggattgtagctccagcgatactgagaagtactcgatgaaggaggacggatgtaactcttccgataaaagacttaagaggattgagctcagggagcgcaggaacctgagcagcaaacgcaacaccaaggagatccaatctggttcgtcctcttctgatgctgaggagagtagcgaggacaataagaaaaaaaagcagagaacttcatctaagaagaaggccgtgatcgtcaaggagaaaaagagaaattctctgaggacaagcacaaaacggaagcaggccgacatcacaagttcttccagttccgacatagaggacgatgaccaaaacagcataggtgagggttcttcagacgaacagaagatcaaaccagtgactgaaaatctcgtcctttcttctcataccggcttttgtcagagctctggagacgaagccctgagcaaatcagttccggtaactgtcgatgatgatgatgacgataatgatcccgaaaatcggatcgcgaagaagatgttattggaggaaatcaaggccaacctctccagtgacgaagatggctcatcagatgatgagcctgaagaagggaagaagcgtactggcaagcagaatgaagaaaaccccggagacgaggaggcgaagaatcaggtcaactctgaatccgattcagactctgaagagtcaaaaaagccaagatataggcaccgccttctgagacacaagctaacagtctctgatggagagtcaggcgaggagaaaaagacgaaaccaaaggagcacaaggaagtcaaaggccgcaaccggaggaaggtctcctcagaggatagcgaagattcggacttccaggaatccggcgtttctgaggaggtttccgagtcagaggatgagcagcgcccacgtacccggtccgctaagaaagccgaactggaagagaatcagaggagctag

SEQ ID NO: 22791 - DNA, 483 bp, Artificial Sequence
  Description of Artificial Sequence: Synthetic coding sequence
tgacccgacttcgtggtgtgcgacgagggccacatcctgaagaacgaagcttctgccgtgagtaaagctatgaacagcataagaagtagacgacggattatcctgacagggacccctctgcagaacaacctcatcgaatatcattgcatggtcaacttcatcaaagagaacctccttggaagcataaaggaatttcgcaatcgatttatcaatcctatccagaatggtcaatgcgcagattccacgatggttgacgttagggtcatgaagaagcgggcccacatcctttacgagatgctagccggctgcgtccagcgcaaggactatactgctttaacaaaatttctgccccctaaacatgaatatgtacttgcggtgcggatgacctctattcagtgcaagctctatcagtactatctggaccacttgacagtgcttcacctgaacaaaatggggatgctgaagagtatcaagtatttctag

SEQ ID NO: 22792 - DNA, 2514 bp, Artificial Sequence
  Description of Artificial Sequence: Synthetic coding sequence
atgaaccacctggagggcagcgccgaggtggaggtgaccgacgaggcggccggaggggaagttaacgagtcagtagaggccgacctggagcatccagaggtcgaagaagagcagcagcagccaccacaacaacaacattacgtgggtaggcatcagcgaggcagagcactggaggatctgagagcccagttagggcaggaagaggaggagaggggtgagtgcctcgctcggagcgcaagtacagaatctggcttccacaatcatacagacacagccgagggagatgtgattgctgccgcccgggatgggtacgatgccgaacgcgctcaagacccagaagacgaatccgcctacgcagtgcaatatcgccctgaagctgaggaatataccgagcaggcagaagcggaacacgctgaagcaactcataggcgggccctgccaaaccacctgcatttccactctcttgaacacgaggaggccatgaatgccgcgtattctggatatgtctacacccaccgattgttccatcggggcgaggatgagccgtactcggagccctatgctgactatgggggattacaagagcacgtgtacgaggagataggagatgctccagaactggatgcaagggacggtttgcgtctctacgagcaggaaagggacgaggccgcagcatatagacaggaagcacttggcgcacgactgcaccactacgatgaaagatctgatggagaatcagactctcccgaaaaggaagctgaatttgcgccctaccctaggatggactcctacgaacaagaggaggacattgaccagatcgtggcagaggtgaagcagtcaatgagcagtcagagtctagataaggctgctgaagacatgcctgaagccgagcaggatctggaaaggccccctacccctgcaggagggagaccagatagccccggcctgcaggcgccggccgggcagcagagagccgttggtcctgccgggggaggtgaagctggccagaggtatagtaaagagaagcgagatgccatcagcctggccataaaggatatcaaagaggccattgaggaggtcaaaacaaggacaatacggagcccttacacccccgatgaacccaaggagcccatctgggtaatgcgacaggatatctcccctactagagactgtgatgatcagcggccaatggatggggactccccctcccccggcagtagttccccactgggagctgagagttcatcaacaagcctgcatcccagcgaccctgtcgaggcttcaacaaataaagagtctcgtaaaagccttgcctcctttcctacctatgtagaggtgcccggtccttgcgaccccgaggatctgatcgacggtatcattttcgccgccaactacttgggtagtactcagcttctaagcgataagactccttctaaaaacgtcaggatgatgcaggcacaggaggcagtgagcaggattaagatggcacagaaactggcgaaaagtcgtaaaaaagcccccgagggggaatcgcaacccatgaccgaagtagatctcttcattagcactcagaggatcaaggttcttaatgcggacacccaagaaactatgatggatcatcccctcagaacaattagctacatcgctgacatcgggaacatcgtcgtgctgatggcacgacgacgcatgcctagatctaattcgcaagagaacgtagaggctagccaccccagccaggacggcaagaggcaatataaaatgatttgtcatgtgtttgagtctgaagacgctcaactgatcgcccaaagtatcgggcaggcgttttcggtcgcctaccaggaattcttgagagctaatggcatcaatcccgaggacctgagtcaaaaagagtactctgacctgcttaatactcaggacatgtataacgatgatctcattcatttctccaaatccgaaaattgtaaagacgtgttcatcgaaaagcaaaaaggcgaaatactgggggttgtgatagtggagtccggttggggctctatccttcctactgttatcattgcaaatatgatgcacggaggacccgcagagaaatcagggaagctaaatatcggcgatcaaatcatgtccatcaacggcacctctttggtaggactccctctttctacctgccagagtattataaagggtctcaaaaatcaatctcgggttaagctcaacattgtgaggtgcccacctgtgaccaccgttttgatcaggcggcctgaccttaggtaccagcttggctttagtgtccaaaacggcataatttgcagcctcatgagaggaggaatcgccgaacgaggaggtgtccgggtgggccatcgaatcatcgagatcaacggccagtccgtggtagcaactccacacgagaaaatcgtgcatattctgagcaatgctgtgggggagattcacatgaaaactatgcccgcggccatgtaccgcctgctcacggcccaagagcagccggtctacatttag

SEQ ID NO: 22793 - DNA, 2469 bp, Artificial Sequence
  Description of Artificial Sequence: Synthetic coding sequence
atggccgccgccgtggtggtggccgagggcgacagcgacagccggccgggccaggagctgttggtggcttggaacaccgtctccaccggcctcgtgccccctgctgctcttgggttggtgtcttcaaggacctctggtgccgttccgcccaaagaagaggagctccgcgccgccgtggaggttctgcggggtcatggtctgcactctgtgttagaagagtggtttgtggaggtcttacagaacgacctgcaagcgaacatatcacccgagttttggaacgcaatttcacagtgcgagaatagtgcggacgaaccccaatgtctcctgttgctgctggacgcattcggactgcttgaatcgcggctggacccctaccttcgttctctcgaactgctggagaaatggactcgcctgggactgctgatgggtaccggcgctcagggcttacgcgaagaggtccatacgatgctgagaggggttctgttcttctctacgccacgcacatttcaagagatgattcagcgcctctacggatgtttcctgcgagtgtatatgcagagtaagaggaaaggagagggcggaacagacccagaactggaaggtgaactggatagtcgctacgctcggcggagatactacagactgctgcaatcaccactttgtgctggttgctcgagcgacaagcagcaatgctggtgccgccaagccctcgagcagttccatcagttatcccaagtgttacaccggttgtctttacttgagagagtatctgcagaagccgtgacaactaccctgcatcaggtgacacgggagagaatggaggaccggtgccgaggcgaatacgaacgtagttttcttcgggagttccataaatggatagagcgggttgttggctggctaggcaaggtcttcttacaggatggcccagcaaggccggcctcccctgaggcgggcaatacactgcgaagatggcgatgccatgtgcagagattcttttatcgtatatacgcctccttgagaatagaagaactgttcagtattgtgagagatttcccagattcaaggccagcaatcgaggacctcaagtactgcctggaacggactgatcaacgacagcagctcctggtctccctaaaggccgctctcgagaccaggctgctccatccaggcgttaacacttgtgacattattaccttatacatttcagccattaaggccctgagggtgttggacccgagtatggtgatactggaagtcgcttgcgagccgatccgtcgctacctgcgaaccagggaggataccgtcaggcagattgtagccggattgactggggatagcgacggcacaggagacctagcagtggagctttctaagactgatcccgcctctcttgagacaggtcaggatagtgaagatgactctggtgaaccggaggactgggtgcctgaccctgtagacgctgatccagggaagagctcaagtaaaagacgctcaagcgacatcatctctctgctggtgtctatatatggatcaaaggacctgtttattaatgaatacagaagtctgttggctgacagactgctacaccagttcagtttctctcctgagcgagagatccgcaacgtggaacttcttaagctgagatttggggaggctcccatgcacttttgcgaagtcatgctcaaggacatggcagacagtcgacggatcaacgcgaacataagggaagaagacgaaaagcggccagcagaggagcagccaccttttggtgtttacgccgttattctgtcaagcgagttctggcctccttttaaagatgagaaactggaggtcccggaggatataagggctgctctagaggcatactgtaagaaatatgaacagttaaaagcaatgagaacactatcctggaagcacaccttgggcctcgtgacgatggacgtcgagctcgccgaccgtaccctctctgtggccgttacccccgtgcaggccgtgatattgctgtatttccaggaccaggcaagctggactttagaggaactgtccaaggccgtgaagatgcctgttgctctgctgcgtcgccgcatgagtgtgtggctccagcagggtgtgttgcgggaagaaccgcctggtacgtttagcgttatcgaagaagaacgtccacaggatagggataacatggtgcttatcgacagtgacgatgaatctgatagtgggatggccagccaagctgatcagaaagaggaagagctcctgcttttctggacatatattcaagctatgctaacgaacttggaatcactctctctggaccgcatttacaacatgctaaggatgttcgtggtgaccgggccagctttagccgagatcgacctccaggagctccaggggtacctccaaaagaaggtgagggaccaacagcttgtatattcagccggcgtatatcgtttgcctaagaactgctcttag

SEQ ID NO: 22794 - DNA, 4863 bp, Artificial Sequence
  Description of Artificial Sequence: Synthetic coding sequence
atgggcgccatcggcctgctgtggctgctgcccctgctgctgagcacagcagctgtaggctctggaatggggactggacagagagctggatctcccgcagccgggccacccctgcaacctcgcgaacctctctcttatagtaggctgcaaagaaagagcttggctgtcgacttcgtagtaccttcactatttcgcgtgtacgcacgggacctcctcctccctccaagctcttctgagctcaaagccggacgccccgaggccagaggttcactggctttggattgcgcgcctctcctacgcctgcttggcccagctcccggcgtgtcctggactgcagggtctccagcccccgccgaggccaggaccctatcacgggttctgaagggcgggtccgtccgcaagctccgccgggccaagcaactggttcttgagctgggcgaagaagctattttagagggttgtgtgggcccaccaggcgaggcagctgtgggacttttacaattcaatttaagcgagctgttctcttggtggatccggcaaggagaaggcaggttgaggattcggctgatgcctgagaagaaggcctcagaggtggggcgagagggcaggctgtcggcagcgataagggcctcccaaccccggttgctgttccagatatttggtacagggcactcgagtctggaaagtccgactaacatgccctctccctcccccgattacttcacctggaacctcacttggatcatgaaagactccttccctttcttgagccatcgaagtcggtacggactggagtgttcattcgacttcccttgtgagctggagtactccccccctctccacgatctgagaaatcagagctggagttggcggcgtattccaagcgaagaagccagtcaaatggatctattagacggccctggggcggaaagatcaaaagagatgccgcgcggttctttcctactgctcaatactagcgcggacagcaagcacactatcctgtccccatggatgaggtcctcttcagaacactgcacactggccgtgagtgtccatcgtcacttgcagccatcgggaagatatattgcccagctgctcccccacaatgaagcagcccgtgagattctgttaatgccaactcccgggaaacatggttggacagtgctgcagggacggataggcagacccgataaccccttcagagtggcgctggagtatatttcctctggcaacaggtccttgagcgctgtggacttcttcgcgctgaaaaactgtagcgaaggtacctccccaggaagtaaaatggctctgcagtcgtcttttacctgttggaacggcaccgtgctccagttaggccaagcatgcgactttcatcaggactgtgcccagggcgaggatgaaagccagatgtgtaggaagttaccagtcggattttactgcaacttcgaagacggcttttgtggctggacacagggcaccctgagtccgcacacaccccagtggcaagtgcgaacactaaaggatgcacgatttcaggaccaccaagatcacgcattgttgttgtcaacaacagatgtacctgctagcgaatccgccactgtcacgagtgccacatttccagccccaattaaaagcagcccctgcgaactgagaatgagttggctgatcaggggagtcctcaggggcaatgtgtcattggttctcgtcgaaaataaaactggcaaggaacaaggacgaatggtttggcacgttgcagcgtacgaagggctgtctctctggcagtggatggtgctgccactgctcgatgtctctgaccgtttttggctccagatggtggcttggtggggccagggcagcagagccattgtcgcctttgacaatatttccattagcctcgactgttaccttactatcagtggagaagataagatactgcagaacaccgcacctaagtcccgcaatctatttgagagaaatcccaacaaggaacttaagccaggtgaaaatagtccgcgacagacaccgatcttcgacccaactgtccactggctatttaccacgtgtggcgcctccggcccccatggaccgacccaggctcaatgcaacaacgcataccagaattccaatttgtctgtggaggtgggttccgagggcccattaaagggaattcagatttggaaggtgcctgcgaccgatacatattctattagcggttacggagccgcgggcggcaaagggggaaaaaacaccatgatgcgcagccacggagtctctgtcctggggatatttaacttagaaaaagatgacatgctttatatactcgtgggacagcagggtgaggatgcatgccccagtactaatcagcttatacagaaggtgtgcatcggtgaaaacaacgtcatcgaggaggaaattcgcgtcaataggtcggtccatgaatgggcggggggcggtggaggcggaggcggggccacatacgtgtttaagatgaaagatggggtgcctgtcccgcttattatagcagccgggggaggtgggcgggcgtatggcgccaaaacggacaccttccatcccgaacgactggagaacaatagttccgtgcttggacttaacggtaactcaggcgctgcaggtgggggcggagggtggaatgacaatacaagtctgctctgggctgggaagtccctgcaagagggggcaacgggaggtcactcgtgtcctcaggccatgaagaagtggggatgggaaactcgtggcggcttcggtggcggcggcggcggctgcagttcaggtggcggtggtggtggttatatcgggggaaacgccgcttcaaacaatgaccccgaaatggacggagaggatggggtctcctttatctcacctctgggtatcctgtacaccccagcattgaaggtgatggagggccacggtgaggttaacatcaagcactatctgaactgtagccactgtgaggtcgatgagtgccacatggatcccgagagccacaaggtgatttgcttctgtgatcatggtaccgtgttggccgaggatggagtgtcttgtatagtaagccccacgcccgaaccgcatctgccactgagtctgattctctccgtggtaacctcggctctggtcgccgccctcgtgttggctttctccgggataatgattgtgtatcggcgtaaacaccaagaattgcaagcaatgcaaatggagttgcagtcgcccgagtacaaattaagtaaactgcgtacttcgaccattatgacagattacaatcccaactactgcttcgcagggaagaccagcagtatttctgaccttaaggaggtccctcgtaagaacattacactcatcaggggcctgggtcacggtgcctttggtgaggtgtacgaaggacaggtgagtggaatgcctaatgacccgtcacccctgcaggttgctgtcaaaacccttcccgaggtctgttctgagcaggatgagctggattttctcatggaagcattgataatcagcaagtttaaccatcagaacatcgtaagatgcattggagttagtcttcagagcctccctcgcttcatcctcctggaactaatggcagggggggaccttaagtctttcttaagggagacccggcctagaccgagccagccatcctcgctcgccatgctagatctgttacacgtagcaagagatattgcctgtgggtgtcagtacttggaggagaaccacttcatccatcgcgacatcgccgccagaaactgcctgttaacgtgtccgggacctggacgggttgccaaaattggcgacttcgggatggcgcgcgacatctatcgcgcctcttactatcgtaagggcggttgcgctatgctaccagttaaatggatgccacctgaggcattcatggagggcatcttcacaagtaaaacagacacctggtcctttggtgttctgctatgggagattttttccctgggctatatgccatacccctcaaagagcaatcaggaagttctggaatttgtgaccagcggtgggagaatggatccacccaagaattgcccaggacccgtgtatcggatcatgacccaatgctggcagcatcagccagaggaccgcccgaacttcgctatcattcttgaacgcatcgaatattgtacacaggaccctgacgtgataaatacagctctgcctattgagtatgggcctttagtggaagaagaagagaaggtcccggtacgccctaaggaccccgaaggggtgcccccactgctggtgtcacagcaggccaaacgggaggaggagagaagtcccgccgctccaccccctcttcctaccacatccagcggcaaagctgccaagaagccaacggcagccgaaatcagcgtgcgggtccctcgcggtccagccgtcgagggaggtcacgttaacatggccttcagccaatccaatcccccatctgaactgcataaggtccatggatcccgaaataaacctacgtctctgtggaacccaacctatggatcctggtttacagaaaagccaaccaagaaaaacaatcccatagcaaaaaaagagccgcacgaccgggggaatttaggactggaaggctcctgcactgtgccacctaacgtcgccactgggaggcttccaggtgcaagcctcttgttagagccttctagtttgacagccaacatgaaagaggttcctctcttccggctgcggcatttcccgtgtggaaacgtgaactatggttatcagcaacagggtctgcccctggaggccgctacagcgccaggggctggacactacgaggacacaattctcaaatctaagaactctatgaaccaaccaggcccttag

SEQ ID NO: 22795 - DNA, 1353 bp, Artificial Sequence
  Description of Artificial Sequence: Synthetic coding sequence
atgggcgccatcggcctgctgtggctgctgcccctgctgctgagcacagccgctgttggcagcggcatgggaacagggcagcgggctggcagtcctgctgccggccctccgttgcagccgcgcgagccacttagttattctaggctacaaaggaagtcactggcagtcgacttcgtggttccttccttattccgagtctacgcacgcgatcttcttctgccaccatcctctagtgagctgaaggcggggagacccgaagcgagaggcagcctggctctcgactgtgctccgctcctgaggttgctgggccccgctccaggggtatcatggaccgccgggagccctgcacctgcggaagcacgaaccctctcacgggtcctcaaaggtggtagcgttcgaaagctgaggcgcgccaaacagctcgtcctagaactcggagaggaagccatactggagggctgtgtcggaccgcccggggaggccgctgtggggctgcttcagttcaatctttcggagctgttttcttggtggattaggcaaggggaggggaggcttcgaatccgactgatgcctgaaaaaaaagcttctgaggtaggcagggaaggcaggttgagcgctgccatcagggcatcccaaccgcggctgttatttcagatttttggaacgggccactccagcctggagagccccacgaatatgccgtccccttcgcctgattattttacttggaatctgacgtggattatgaaggacagcttcccgttcctgtctcacagaagtcgctatggcaaggagcggtctccagccgcccctccaccgctgccaactaccagcagcgggaaagctgcaaagaagcccacggccgctgagatatctgtgagagttccccgcggaccggccgtggagggagggcacgtgaacatggcttttagccagagcaatccaccatctgagctccataaggtccatggaagccgcaataagcccacgtccctctggaacccaacatacgggtcatggtttactgagaagcccaccaagaagaacaatcctatcgccaaaaaggagcctcacgaccgtggcaacctgggcctggaaggtagctgcactgtaccgccaaacgtcgccactggacggcttcccggggccagcttactgttggagccatctagtctcacggctaatatgaaagaagttcctcttttccgcctgaggcactttccctgtggaaatgtgaactacggctaccagcagcaagggctgccattggaagcagcgactgcacctggggcgggacactacgaggatacgatcctgaagtcaaagaactcgatgaatcaacccgggccgtag

SEQ ID NO: 22796 - DNA, 1935 bp, Artificial Sequence
  Description of Artificial Sequence: Synthetic coding sequence
atggaggtgcagctgggcctgggccgggtgtacccccggcccccctccaaaacatacagaggtgccttccagaacctcttccaaagcgtacgcgaggtcatccaaaaccctggtcccagacatcctgaagcagcctccgccgcaccgccaggggcatctctgcttttgcttcagcagcagcagcagcagcagcagcagcaacagcagcagcagcagcaacaacaacagcagcaacagcaggaaacttctccaaggcagcagcagcagcagcagggcgaagacggctccccccaggcacatcggagagggcccactgggtacctggtgctggacgaggagcagcagccgtctcagcctcagtctgctctggagtgccatcctgagagaggttgtgtcccagaacctggggcggccgtggcagcgagcaagggtctgccacagcagcttcctgctcctccagacgaggatgattcagccgccccttccacattgtccttgctggggcccacttttccagggctgtccagctgctctgccgatctcaaagacatcctatcggaggcttccaccatgcagctcctgcaacagcaacagcaggaggccgtgtccgaaggctcatcaagtgggagagcacgtgaagcctctggagcccccacgtcttctaaggataattatctgggaggcactagcacaatttctgacaacgcaaaagagctctgcaaggccgtaagcgtgtccatgggattgggcgtcgaagcattggaacatctatcgccgggggaacagttaaggggggactgtatgtatgcgccgctgcttggggttcccccggccgtgcgccctacaccttgcgctccactggccgaatgcaagggctcactactcgatgactccgccggcaagtcaactgaggacactgccgaatacagtccctttaagggaggatacacaaaaggcctggaaggcgaatctttgggttgcagtggatcagccgctgccggctcttctggaactctggagctgccgagcacgcttagcctttacaaatcaggagccctcgacgaggcggctgcatatcaaagccgcgactattacaattttcctctggccttggcaggccctccacctcccccccctccaccccatccccacgcccgcataaagctggagaaccctctggattatggttcagcctgggctgccgccgccgcacagtgcagatacggcgacctggcctcacttcacggggccggcgcagccggcccaggtagcggttctccgtccgctgccgcctcctcttcttggcataccctctttaccgccgaggaggggcagctatacgggccatgtgggggagggggcggcggcggaggcggtggcggggggggagggggtggaggaggaggtggcggagggggcgaagcaggagccgtagctccttatggatacacccggccgcctcagggcttggctggacaggaatccgacttcaccgctccagacgtgtggtacccaggtggcatggtctcacgcgtaccatatccgtcccccacttgtgtgaaatccgagatgggcccctggatggattcctatagtgggccttatggagatatgcggctcgagacagcccgcgatcatgtgctccctattgattactacttccctcctcagaagacgtgcctgatatgtggtgatgaagcctctgggtgtcattacggggccctgacatgtggttcttgcaaagtgttttttaagagagcagccgagggaaaacagaaatatctgtgtgcctcccgcaacgactgcactatagataagtttcgacgaaagaactgcccatcatgtcgtcttcgcaaatgctatgaagctggaatgaccctcggtgagaaatttcgagtcgggaactgtaaacacctcaagatgacccgtccctag

SEQ ID NO: 22797 - DNA, 1803 bp, Artificial Sequence
  Description of Artificial Sequence: Synthetic coding sequence
atggaggtgcagctgggcctgggccgggtgtacccccggccccccagtaaaacctatagaggcgcattccaaaacctgttccagagcgtgcgcgaggttatccagaatccaggccctcgtcaccccgaagctgcttcagctgcccccccaggggcctcattactgctgctgcagcagcagcagcaacagcaacagcagcagcagcagcaacagcagcagcaacagcagcagcagcagcaagagacatccccacggcaacaacagcagcaacagggggaggatggcagtcctcaggcgcacagacgaggtcctactggctacttagtgttggatgaagagcaacaaccttctcaaccacagagtgccctggaatgccatcctgagagagggtgtgtgccagagcctggggctgccgtggcggcatccaaaggtctgcctcaacagctcccagcaccccccgatgaagatgatagtgccgctcctagcactttgagtctgcttgggccaactttcccggggctctcttcatgtagcgctgacttgaaggacatattatctgaggcatccacgatgcagctcctacagcagcagcaacaggaggccgtgtctgagggatcttcatctgggcgggccagggaagcctcaggtgcacctacgtcaagcaaggacaattatcttggaggcactagtacaatctcagataatgcaaaagagctctgcaaagctgttagtgtgtcgatgggcctcggcgtcgaggctctggagcacttgagcccaggtgagcagttaaggggcgactgcatgtacgctcctctgctcggcgtgcctcctgcagttcggccgacaccctgcgcccctttagctgaatgcaaagggtcgctcttggatgacagtgccggaaaatctaccgaagacactgcagaatatagtccgttcaagggcggttatacaaaaggcctggaaggcgaatccttgggttgctccggttccgctgcggccgggtctagtggcacactggaattgccgtcaactctgtcattgtataagagtggcgccctggatgaggcggctgcttaccaaagtagggactattataatttccctctggccttggccgggcctcctccacccccacctccccctcacccccatgccaggatcaagctagaaaatccactggactatggtagcgcctgggccgctgccgccgctcaatgtcgctatggcgatttggcctctctgcacggggccggcgctgccggacccggcagcggctctccatcagcagctgctagtagctcttggcacactctttttacggcagaggaagggcagctgtacggaccctgtggaggaggcggcggcggaggaggtgggggaggtgggggcggtgggggcggcggaggtggcggcggaggagaggccggtgccgttgcaccatacggttacacccgccccccgcaaggtctggccggacaggagagtgatttcacagctccagatgtatggtaccccggtggtatggtctccagagtgccttacccttcacccacctgcgttaagtccgaaatgggcccttggatggatagctacagcggaccatatggagacatgcgtctggagactgcccgcgaccacgtgttgccaatcgattactatttccccccccagaaaacctgtcttatctgcggggacgaggcgtcgggatgccactacggcgcattgacttgtgggagctgtaaggtgttcttcaaacgtgctgctgaaggattcttccggatgaataagttgaaggaatcgtag

SEQ ID NO: 22798 - DNA, 444 bp, Artificial Sequence
  Description of Artificial Sequence: Synthetic coding sequence
atggtgatgggcctgggcgtgctgctgctggtgttcgtgctgggcctcgggctcaccccacctacactcgctcaggacaactcccgatatactcactttctgacgcagcactacgatgcaaaacctcagggcagggacgaccggtactgtgaatctattatgcgccggagagggttgacctccccctgcaaagatatcaacacgttcatccacggtaacaagcgatcaattaaagcgatatgcgagaacaagaatgggaacccccacagggagaatttgcggatttctaagtcatcgttccaagtcaccacctgcaaactgcacggtggcagtccctggcctccctgccagtacagggccaccgcagggtttaggaacgttgtagtggcttgcgagaatggcctgccggtgcatctggatcagagtatctttcgccggccctag

SEQ ID NO: 22799 - DNA, 444 bp, Artificial Sequence
  Description of Artificial Sequence: Synthetic coding sequence
atggtgatgggcctgggcgtgctgctgctggtgttcgtgctgggcctcggactaacacctccaactcttgcccaggataacagccggtatacacacttcctcactcagcattatgatgctaaaccgcagggcagggacgatagatattgtgagagcatcatgagaagacgaggtctgaccagtccatgcaaggatattaacaccttcattcacggaaacaagcggtctatcaaggcaatttgtgaaaacaagaatgggaatccgcaccgcgagaacctgagaatctccaagagcagtttccaggtgactacatgcaagctccacggtggctcaccctggcccccctgccagtaccgggccaccgccggatttcggaatgtagtggtggcttgtgaaaatgggctgcccgtgcacttagatcagagtatattccggcgaccttag

SEQ ID NO: 22800 - DNA, 1494 bp, Artificial Sequence
  Description of Artificial Sequence: Synthetic coding sequence
atgaccgtgttcctgagcttcgccttcctggccgccatcctgacccatatcggttgttccaaccagaggcgcagccctgagaattcggggaggcggtacaatagaatccagcacggccagtgtgcttatacctttattttgcccgagcacgacggtaattgcagggaaagcactacagaccagtataacaccaatgcactccagcgggacgctccccacgtcgaacccgactttagttcccagaagctgcaacacctggaacacgttatggaaaattacactcagtggctgcagaagctggaaaattacatagtcgagaacatgaagtctgagatggctcagatccagcagaacgcagtgcagaaccacaccgctacgatgctcgagatagggacaagtttgttgtctcagactgcagagcaaacaaggaaactaaccgatgtggagacccaggtgctaaatcagaccagcaggcttgagatccagcttttagagaacagtctgtcaacttacaagttggagaaacagctcctgcagcagaccaacgagatcctgaagatccacgagaaaaactctctgctagagcacaagattcttgagatggagggcaagcacaaagaggaattagacaccctgaaagaagagaaagagaatcttcagggcctggtaactagacagacttatatcatccaagagcttgaaaagcagctgaatcgagctacaacaaacaattcagttctgcaaaaacaacagctcgaactcatggatacagtccacaatttagtgaatctttgcacaaaggaggtgctcttaaagggcgggaagcgcgaggaagagaagcctttcagagattgtgctgatgtgtatcaggccggatttaataagtcaggtatctacaccatatacattaacaatatgccggagccaaaaaaggtgttctgcaacatggacgtcaacggaggcgggtggacggttatccagcaccgtgaagatgggagcctggacttccagagaggatggaaggagtataagatgggtttcggtaatccatcaggagaatactggttggggaatgaattcatcttcgctatcacgagtcagaggcagtacatgctccgcatcgagctgatggactgggaaggaaatagggcctattcccagtacgatcgttttcatatcgggaatgagaaacagaactataggctgtacttaaaaggccacaccggcacggctggcaagcagtccagtcttatcctacacggggcggatttctcaactaaggatgccgacaacgacaattgcatgtgcaagtgtgctctgatgctcactggagggtggtggttcgatgcttgcggaccatccaatctgaacggcatgttctataccgctggccaaaaccatggcaaactgaacgggattaagtggcattacttcaagggtccctcctacagcctgcgttcgaccaccatgatgattcgtcccctcgacttttag

SEQ ID NO: 22801 - DNA, 459 bp, Artificial Sequence
  Description of Artificial Sequence: Synthetic coding sequence
accgtgagcaacctgctggagcacaagatcctggagatggagggcaagcacaaagaggagctggatacacttaaagaagagaaggagaatctacaggggctggtgacacgacagacttatattatccaggagctggagaagcagctgaatcgagcaaccactaataactcagtactacagaagcaacagttggagcttatggacaccgtccacaatctcgtgaacctgtgtactaaagagggagtactactgaagggtgggaaaagagaagaagaaaaaccttttagggactgtgcagacgtttaccaagcgggcttcaataaatctggcatttacaccatttacattaataatatgcctgaacccaagaaggtgttctgcaacatggacgtaaatgggggagggtggacagttattcagcaccgggaagatggtagcctggactttcagcgcggctag

SEQ ID NO: 22802 - DNA, 1497 bp, Artificial Sequence
  Description of Artificial Sequence: Synthetic coding sequence
atgaccgtgttcctgagcttcgccttcctggccgccatcctgacccacataggttgcagtaatcaacgacgatcacccgagaactctggccgcagatataataggatccagcatgggcagtgtgcctatacattcatcctgcctgagcatgacggaaactgcagggaaagtaccactgaccagtataacacaaacgccctccagcgagacgcgcctcacgtagagcccgacttttcctctcagaaattgcagcaccttgagcacgttatggaaaactatacgcagtggttgcaaaagctcgaaaactatatcgtagagaatatgaagtccgagatggcccagattcagcagaatgcagtccagaatcatactgctactatgttagaaatcggtacttccctactgagccaaaccgccgagcagacacgcaagctgacagacgtcgaaacacaggtcctgaatcagacgtccagacttgagatccagctactggaaaactcgctatctacgtacaagctcgaaaaacagctactgcagcagaccaacgagattctgaagattcacgaaaagaacagcctgttagaacacaagatcctcgaaatggaaggtaaacataaagaggaactggacactctgaaggaggagaaagagaacctccaggggctggtgactcggcagacatatatcattcaagaactggagaaacagctgaatagagccactactaataattctgtgctgcaaaagcagcagttggaactgatggacacggtgcataacctggtcaatctgtgcactaaggagggcgttctgctgaaaggaggaaagagggaggaggaaaaaccatttcgcgactgcgccgacgtttatcaggctgggtttaacaagtctggaatttacacgatctacatcaacaatatgcccgaaccaaagaaggtcttctgcaacatggacgtgaacggggggggctggacagtgatccagcatcgggaagacggcagtctggactttcagagggggtggaaggagtacaagatgggcttcgggaatccttctggagagtactggctgggcaatgagtttatcttcgccattaccagccagcgtcagtatatgctgagaattgagttgatggattgggaaggcaatcgtgcttactctcaatatgataggtttcacatcggcaatgaaaagcagaattatcggctgtatctgaagggacatacggggaccgccggcaaacagagcagtctgatccttcacggcgcagatttctctacaaaagatgccgataacgataactgcatgtgtaaatgtgcccttatgctcaccggtggctggtggtttgacgcttgcggccctagcaacctgaacgggatgttctataccgctggccagaaccatggcaagctaaatggcattaaatggcattacttcaaagggccctcgtacagtctccggtccaccactatgatgataaggccactggacttttag

SEQ ID NO: 22803 - DNA, 894 bp, Artificial Sequence
  Description of Artificial Sequence: Synthetic coding sequence
atggagggcaagcacaaggaggagctggacaccctgaaggaggagaaagaaaacctccaagggctagtcacgcggcagacctacatcattcaggaactggagaagcaactgaatcgggccaccactaacaactctgtgctgcagaaacagcaacttgaactcatggatacagtgcacaacttagtgaacctttgtaccaaggaagtacttcttaaaggtggcaagcgggaggaggagaaaccttttcgtgactgcgcggatgtttatcaagctgggtttaataagtctgggatctataccatttatatcaacaacatgcccgagcctaaaaaggtattctgtaatatggatgtgaatggcggcggatggacagtgattcagcaccgagaggatggtagtctggattttcaacgaggctggaaagagtataagatgggctttgggaacccttccggagaatactggttaggaaatgagtttatcttcgccatcactagccagagacagtacatgctgaggatcgaactcatggactgggaggggaaccgggcatactcccagtacgatcgattccacatcggcaatgaaaaacagaactaccgactatatctcaaaggacacaccggtaccgccggtaagcagtccagtctgatactgcacggcgctgattttagcactaaggatgccgacaatgacaactgcatgtgtaaatgtgccttgatgttgacagggggctggtggttcgacgcctgtggcccctccaacctaaatgggatgttttacaccgcaggccagaaccacgggaaattaaatggaatcaaatggcactatttcaagggtccctcttatagtctcagatccactacaatgatgattaggccattagacttttag

SEQ ID NO: 22804 - DNA, 897 bp, Artificial Sequence
  Description of Artificial Sequence: Synthetic coding sequence
atggagggcaagcacaaggaggagctggacaccctgaaggaggagaaggaaaatctgcagggattggttaccaggcagacttatattatccaagaactcgagaaacaactcaatagagccacaaccaataacagtgtgcttcagaaacagcaactggaactcatggataccgtccacaaccttgttaatctgtgcactaaggagggagtgctgctgaagggcgggaagagggaggaggagaaacccttccgcgattgcgccgatgtgtaccaagccggatttaacaagagcggtatctacaccatttacattaacaacatgccagagcctaagaaagtgttttgcaacatggacgtgaatgggggaggatggacggtgattcagcatagagaggatggaagtctggattttcagcgtggatggaaggaatacaaaatggggtttggaaacccaagcggtgaatattggctgggaaacgagtttattttcgcaatcaccagtcaacgccagtatatgctcaggattgaactgatggactgggaagggaaccgcgcttacagccaatacgataggttccacatcggcaacgaaaaacagaactatcgattgtatctgaaaggccatactggaaccgccggcaagcaatcttctcttatcctccatggcgctgatttctccacaaaggatgcagacaatgataattgtatgtgtaaatgtgccctaatgcttacaggggggtggtggtttgacgcttgcggccccagtaaccttaatggcatgttttacactgcaggtcaaaatcacggtaaactaaatggaatcaagtggcattacttcaaaggcccgagctattcccttaggagcacaacaatgatgattcggcctcttgatttttag

SEQ ID NO: 22805 - DNA, 1491 bp, Artificial Sequence
  Description of Artificial Sequence: Synthetic coding sequence
atgtggcagatcgtgttcttcaccctgagctgcgacctggtgctggctgctgcatacaataacttcagaaaaagtatggatagtattggaaaaaagcagtatcaggtccagcacggatcctgcagctacaccttccttttgcccgagatggacaattgccggtcctctagtagcccatatgtgtcgaatgccgtgcagagggatgccccgcttgagtacgacgattctgttcaacgcctccaggtgctggagaatatcatggaaaacaacacacagtggcttatgaagttagagaactacatccaggataatatgaaaaaggaaatggtggaaatccagcagaacgcagtccagaaccagaccgcggtgatgattgagatcggtaccaacctcctgaaccagactgcggagcagactcgcaagctgaccgacgtggaagctcaagtccttaaccaaactacaaggttggagcttcagttactcgagcacagcctctctactaataagttggaaaagcagattttggaccagacttccgagataaataagctgcaagacaaaaattcattcctggagaagaaggtgttagccatggaagataaacatattatacaactgcagtccatcaaggaagagaaggatcagctccaggtgctggtcagcaagcagaacagcataatagaggaattggagaaaaagattgtgacagccaccgttaataactctgtgttgcaaaaacagcagcatgacctaatggaaacggtgaataatctgttgaccatgatgagtacatcaaatagcgccaaggatcctacagtggccaaggaggaacaaatctcattccgagactgtgccgaggtgtttaagtctggacacaccactaatggtatctataccttgacgttccccaacagcaccgaagagatcaaagcctattgcgatatggaggcaggcggtggcggctggacaatcattcagcggcgagaggatggaagcgtcgactttcagagaacttggaaggaatataaggtagggttcggcaatccttccggagaatattggctggggaatgagtttgtatcgcaactgacaaaccaacagaggtacgttctcaagatacacctcaaagactgggagggcaacgaagcctattctctctacgaacatttttacttgagctctgaggagctgaattaccgcatacatttgaaggggctgacagggaccgccggaaagatatcctccatctcccagcccggcaatgatttcagcacgaaagacggcgacaacgataagtgtatctgcaaatgctcccagatgctcaccggcggctggtggtttgacgcctgcggcccatccaacctcaatggcatgtattatcctcagcgccaaaatacgaataaatttaacggaatcaagtggtactattggaaaggcagcgggtatagcctgaaagctaccacgatgatgatccggcccgccgacttctag

SEQ ID NO: 22806 - DNA, 1488 bp, Artificial Sequence
  Description of Artificial Sequence: Synthetic coding sequence
atgtggcagatcgtgttcttcaccctgagctgcgacctggtgctggctgccgcttacaacaacttccgaaaaagcatggattccatcggcaaaaagcagtatcaggtgcagcacggatcttgctcatataccttcctattgccggagatggataattgccggtcttcctcttcaccatacgtctctaatgctgtgcaacgagacgcacccttagaatatgatgacagcgtacagaggctgcaggtgctggagaatataatggagaacaacacccagtggctgatgaaactggagaattacatccaggacaatatgaagaaggaaatggtggaaatacaacagaacgccgttcagaaccagactgcagttatgattgaaatcggcacgaatttgctgaatcagaccgctgaacagacccgtaaactgactgatgttgaagcacaggtcctgaatcagacaacgcggctggaattgcagttgctggagcattctctctctactaataagctcgagaaacagattttggaccaaacaagcgagatcaacaagttgcaagacaagaattcttttctggaaaaaaaagtgcttgcaatggaagataagcatatcatccagctgcaatcaatcaaagaggagaaagatcagctgcaggtgttggtgagcaaacagaactccattatcgaggaacttgaaaagaaaatagttactgccacggtcaataattcagtgttgcagaaacagcagcacgacctgatggagaccgttaataacctcctgacaatgatgtctaccagtaacagtaaagaccctactgtggcaaaggaggagcagatatcgttcagagactgcgctgaagtgttcaaaagcggccacaccacgaacgggatatacacgctcacgtttcccaattccactgaagagatcaaagcctactgtgatatggaagctggtggcggggggtggactatcatccagaggagggaggatgggtctgttgacttccagagaacctggaaagagtacaaggttggattcggtaatccctcaggagaatattggctggggaacgagtttgtgagccagctaaccaatcaacagcgctacgtcctgaagatacacctcaaagactgggagggaaatgaggcctattctctctacgagcatttttacctgtcatccgaggaactaaactaccgtatacatcttaagggactcacaggcactgccggcaagatctctagcatctcgcagcccggcaatgatttctccacaaaggacggggataatgacaaatgtatctgcaagtgtagccagatgctcacaggaggttggtggttcgacgcatgcggaccatcaaatctgaacggaatgtattaccctcagcgccagaacacaaacaaattcaacgggatcaaatggtactattggaaggggtccggctatagcctgaaggcaacgacgatgatgatacgccctgccgacttctag

SEQ ID NO: 22807 - DNA, 1335 bp, Artificial Sequence
  Description of Artificial Sequence: Synthetic coding sequence
atgtggcagatcgtgttcttcaccctgagctgcgacctggtgctggcagctgcctacaacaacttccgcaagtctatggattccatcgggaagaagcagtaccaggttcagcacgggagttgcagctacacatttttgctcccggagatggataattgccgctccagcagttccccctacgtgtctaatgcagtacaaagggacgcgccccttgagtacgacgacagcgtccagaggttgcaggtgctggagaacatcatggaaaacaacactcaatggctgatgaaggtgcttaaccagactactcgactggaattacagctgctggaacacagcctgagtaccaacaaacttgagaaacaaatcctggatcagacgtcagaaattaacaaactacaagacaagaacagtttcctggagaagaaggtcttggccatggaggataagcacattatacaactccagtccatcaaggaagaaaaagatcagctgcaggtgctggtctcaaagcagaattccatcatcgaggaactggaaaagaagattgtcaccgctaccgtgaataacagcgtgctccaaaagcagcaacatgatttgatggagaccgtcaataatctgctgacgatgatgtctacttctaattctgcaaaggaccctacggtggcaaaggaggagcaaatctccttcagggactgcgcagaggtgtttaaaagtggacacacaacaaatgggatctacaccctgacatttcccaactccacggaggaaattaaagcgtactgtgacatggaggcgggggggggtggatggaccatcatccagaggcgggaagatggtagcgttgattttcaaaggacatggaaggagtataaggtggggttcggcaacccaagcggcgagtactggttggggaatgagttcgtgtctcagctgaccaatcagcagcgatacgtcctgaaaatccatctgaaggattgggagggtaatgaggcctactcactttatgagcacttctacctctcatctgaggaattgaactatcgaattcaccttaaagggctcaccggtactgcgggcaaaatcagcagcatcagtcaacccggcaatgacttctcaacgaaagacggggacaacgacaaatgcatttgcaagtgttcgcaaatgctgaccggaggctggtggttcgatgcatgcgggccttctaatctcaacggcatgtactaccctcagagacagaatactaataaatttaatggaatcaagtggtactattggaaaggatcaggatactccttgaaggctacaactatgatgatccggccggccgacttttag

SEQ ID NO: 22808 - DNA, 1221 bp, Artificial Sequence
  Description of Artificial Sequence: Synthetic coding sequence
atgagcggcgcccccaccgccggcgccgccctgatgctgtgcgccgccactgccgtgttgctctctgcgcaaggcggtcctgttcagagcaaatcccctaggtttgcgagctgggatgagatgaacgtgctcgcccatgggctgctgcaactgggccaggggttgcgtgagcacgctgagaggactcgttcacaactgtcagcactcgaaagaagactgtcagcctgcggcagcgcttgccagggaactgagggatccaccgatctgccactggcccccgaaagtcgggtggaccctgaagttctacacagcctccagacccagctcaaggcccaaaatagtcgcattcagcagttatttcataaggtggctcagcaacagcggcacttggagaaacagcatctaaggatccagcacttacagtctcagtttggactgttagaccataaacacttagatcacgaagtcgcaaagccagcaagaagaaaacgcttacccgagatggcccaacccgtggatcctgcccataacgtcagtagactgcaccgcctgcccagggattgccaggagctcttccaggtgggcgagcggcaaagtggcctgtttgaaattcagccacagggaagtcctccatttctagtgaattgcaagatgacgtccgacggaggatggacagtgatccaaaggcgacatgatgggagtgtggacttcaaccgtccttgggaggcctataaggctggctttggcgatccacacggcgagttttggctcggactcgaaaaagtgcattctatcaccggcgatcgcaacagcaggctggccgtgcagctacgagactgggacggcaatgcagaactgctccagttttccgtgcacctaggcggtgaagacaccgcctacagcttgcagctgacggcacccgtagccggtcagctgggggctactactgtgccaccgtctggcctttcggtcccattctccacctgggaccaagaccacgacttacggcgggataagaattgcgcgaaaagcctgtctggcggttggtggttcggtacctgctcccactccaatctgaacggacagtatttccggtctatacctcaacagagacaaaagctgaaaaaaggcattttctggaaaacatggagaggacggtactacccccttcaagccaccacaatgctcatccagcccatggccgccgaagctgcctcttag

SEQ ID NO: 22809 - DNA, 1107 bp, Artificial Sequence
  Description of Artificial Sequence: Synthetic coding sequence
atgagcggcgcccccaccgccggcgccgccctgatgctgtgcgccgcaacagcagtgctcctgtccgcccaaggcgggcctgtgcaatccaagagtcctcggtttgcctcatgggacgaaatgaatgtactcgcccatggcctgcttcaactgggccaggggctccgcgagcacgctgagcgtactcgctcacagctgagcgcattggaacgtcggctcagcgcctgtggatcggcttgtcagggcactgaaggctccaccgatctcccactcgctcctgagtcccgggtcgacccagaagtgttgcacagcttgcagacgcaattgaaggcacagaactcacggatccagcagctctttcataaagtcgctcaacagcagaggcacctggaaaagcagcatcttaggattcagcatctgcagagccagtttgggttgttagatcacaagcatcttgaccacgaggtggcaaaacccgcccggaggaaaagacttcctgagatggcccagccggtggaccccgctcacaatgtgtcaaggttgcaccatggaggctggacagtgatacaacgtcgccacgacggatcggttgacttcaacaggccttgggaggcctataaagccggctttggtgaccctcatggagagttctggctgggcctggaaaaggtccatagtatcaccggagatcggaatagcagactggcggttcaactcagggattgggatgggaacgctgagttattgcagttttccgtgcacttggggggcgaggacacagcctacagcctccagcttacagcccccgtcgctgggcaattaggtgcaaccaccgttcctccaagtgggctctctgtcccattttccacctgggatcaagatcacgacttgcgtcgcgataagaactgcgccaagtccctgagcggtgggtggtggttcggcacctgcagccacagcaacttgaacgggcagtacttccggagcatacctcagcagcgccagaaacttaagaaaggaatattctggaaaacctggagagggagatactatccccttcaggctacaacaatgcttattcagcctatggccgctgaggccgcctcttag

SEQ ID NO: 22810 - DNA, 720 bp, Artificial Sequence
  Description of Artificial Sequence: Synthetic coding sequence
atggcccagcccgtggaccccgcccacaacgtgagccggctgcaccgtttacctcgggattgccaggagctgtttcaagtgggcgagcgtcagagtggcttgttcgagattcagcctcagggctcacctccctttctggtgaattgtaagatgacctcagatggggggtggacagtgatacaacggaggcacgacggaagtgtagatttcaatcggccttgggaggcctataaagctggcttcggggatccgcacggcgagttctggctcggactggaaaaagtgcattctattacgggggaccggaatagcaggctggctgtgcagttacgtgattgggacggcaacgccgaattgctgcagttctcggtacatctgggcggcgaggatactgcatactcacttcagctgaccgcccctgtcgccggccagctgggcgccaccacagttcccccaagtggtctatccgttccattcagcacgtgggaccaggatcatgacctgaggcgtgacaagaactgcgcgaagtcactgtcaggaggatggtggtttgggacctgtagccattcaaatctaaatggacagtactttaggtccatacctcagcagagacagaagttgaagaagggcatattttggaaaacatggcggggccgatactatcctttgcaggctacgaccatgctgatccagcctatggccgctgaagcagcgtcatag

SEQ ID NO: 22811 - DNA, 837 bp, Artificial Sequence
  Description of Artificial Sequence: Synthetic coding sequence
atggagccccgggccgccgacggctgcttcctgggcgacgtgggcttctgggtcgaaagaacacctgttcacgaggccgcgcagcgaggcgaaagtctgcagctgcagcagttaattgaaagtggtgcgtgtgttaaccaggtgaccgtggattccatcacaccactccacgcagcttcactgcaaggccaagcgcgatgcgtacagctcttgttagccgcgggagcccaagtagacgctaggaacatcgatggtagcactccactgtgcgatgcctgtgccagcgggtccattgaatgtgttaagctcctgctctcgtacggtgctaaggttaacccccctctgtacactgcttcaccactacatgaagcatgcatgtcaggatcctccgagtgcgtgcgcttgttgatcgatgtgggagccaacttggaggcacatgattgtcattttggcactccactgcacgtggcctgcgcccgagagcatttggactgcgtcaaagtactactcaatgccggcgctaacgtgaatgctgctaagttgcatgagacggctctccatcacgccgctaaggtgaagaatgtagatcttatcgaaatgctcatcgaatttggcggcaacatctatgctcgggacaatcgcggaaaaaaaccctcagactacacctggagttcatcggcccctgctaaatgtttcgagtactatgagaaaactcccctgaccttgtcccagctctgtagagtgaacttgagaaaagcgaccggagttagggggctggagaaaattgcaaaattaaacattccacccagactcatcgattacctttcctataattag

SEQ ID NO: 22812 - DNA, 396 bp, Artificial Sequence
  Description of Artificial Sequence: Synthetic coding sequence
atggagaagatccccgtgagcgccttcctgctgctggtggccctgtcctatactctggctagggacacaactgtcaaaccaggggccaagaaggatacaaaagattctcgtcctaagcttccacagacactgtcacggggttggggggatcaactcatctggacacagacctacgaagaggctctgtataagtctaaaacatcaaataaaccgcttatgattatccaccacctggacgaatgcccccattctcaggccctgaaaaaggttttcgccgagaataaggaaatccagaaactggctgaacaattcgtgctactgaatctggtatatgaaaccacagataaacacctctcaccagatggtcagtatgtgccaagaataatgtttgtgtag

SEQ ID NO: 22813 - DNA, 528 bp, Artificial Sequence
  Description of Artificial Sequence: Synthetic coding sequence
atggagaagatccccgtgagcgccttcctgctgctggtggccctgagctacactctggccagggatacaacagtaaaacccggtgcgaaaaaagacaccaaggatagccgccccaaattgccccagactctctcccgcggctggggagaccagctgatctggactcagacctacgaggaggctctgtataagtcaaagaccagcaataaacctctcatgattatacaccacctcgatgaatgcccccacagtcaggccctgaagaaggtcttcgctgaaaacaaggaaatccaaaagctggctgaacaatttgtgctgctgaacctagtgtatgaaacgaccgacaagcacttgtcccccgatgggcagtacgtcccgagaattatgttcgtggaccccagcttaaccgtgagagctgacattacaggccgatatagcaaccgcctgtatgcgtatgagcccgccgatacggccctgttattagataacatgaagaaagctctgaagctgttaaaaacggaactttag

SEQ ID NO: 22814 - DNA, 588 bp, Artificial Sequence
  Description of Artificial Sequence: Synthetic coding sequence
atgagcaactacaccgacgccgagagcagcttcagcaagcaggagatcatccgagtggccatggagaaaatcccagtttcagcatttctcctgttggttgccctgtcttatacgctcgcccgcgataccacagtgaaacctggcgcaaagaaagacaccaaggatagccgccctaagctgccccagaccttatccagagggtggggagaccagctgatctggacacagacatacgaggaagctttatataaaagcaagactagtaataaaccgctgatgataattcaccacctggatgaatgcccgcattcacaggccttaaagaaggtattcgccgaaaacaaggagattcagaaattagccgagcagtttgtccttcttaacctggtgtacgaaactaccgataagcacctgtcgcccgacggccaatacgttcctagaataatgttcgtggacccaagcctgacagtgagagcagacatcacaggaaggtactccaataggctctacgcctatgaacccgctgacacagcactgctcttggataacatgaaaaaagcgttgaagttgctaaaaaccgagctgtag

SEQ ID NO: 22815 - DNA, 1251 bp, Artificial Sequence
  Description of Artificial Sequence: Synthetic coding sequence
atgtggcccacccggcggctggtgaccatcaagcggagcggcgtggacggtccccactttcccctttccctcagcacctgcctgtttggcaggtatgagaacgaatcgctgcagaatggacgcaaaagcactgagttccccagaaagattagggaacaggagcccgctaggagggtttccagatctagtttctcttccgaccctgacgagagcgagggaatcccgttgaagaggaggcgggtgagctttggaggccacttaagacctgagcttttcgatgagaatttgccgccaaatactcctttgaagcggggggaggctccaactaaacggaaatcgctcgtcatgcacaccccaccagtgctgaaaaaaatcattaaagaacaaccacagccttccgggaaacaggagagcggcagcgaaatccatgtggaggttaaagcgcaaagcttggtgataagccccccagcaccatcaccacgtaaaacccccgtagcaagtgaccaacgccgacgctcatgtaagaccgcccccgcctcctcgagtaagtcccaaactgaagttccaaagcgggggggccgaaagtccggaaacctgccctcaaaacgagtgagcatctcgagatcacagcacgacatcctccaaatgatttgctccaagaggcgttctggcgcttccgaggcaaatctcattgtggcaaagagttgggccgatgtggtgaagctgggagcaaagcagactcagaccaaggtgatcaagcacggcccccagagatcaatgaataaacgccagaggcgcccggcgactcccaagaagcccgtgggcgaggtgcactctcaattctcaaccgggcacgctaacagcccttgcaccatcataatcggaaaggcccacacagagaaggtgcacgtgccggcgcgaccttacagggtactcaataactttatttccaaccagaagatggattttaaggaggacttgtctggtatagctgagatgtttaaaacaccagtcaaagagcagccccagctcacctctacatgccatatagccattagcaattctgagaatctgctcggcaagcaatttcaaggcactgatagtggtgaagagcccctgctccccactagcgaatcattcggaggcaatgtgtttttctctgcccagaacgcagccaagcagcctagcgacaaatgctcggctagcccaccactgaggaggcagtgcatccgagagaacggcaacgtgtag

SEQ ID NO: 22816 - DNA, 8691 bp, Artificial Sequence
  Description of Artificial Sequence: Synthetic coding sequence
atgtggcccacccggcggctggtgaccatcaagcggagcggcgtggatggacctcactttccactgtcactttcaacctgcttatttggcaggggtattgaatgcgatattcgaatccagctgcccgtggtgagcaagcaacactgtaagattgagatacatgagcaggaggcaatccttcacaacttttcttccaccaatcctacacaggtgaacgggtccgtgattgacgagcctgtgcgcttgaagcacggtgatgtaattaccatcatcgatcggtctttccgctacgaaaacgagagcctgcagaacggacggaaatctaccgagttccccagaaaaattcgagagcaggagcctgcccggagagtctccagatccagcttctcgtccgaccctgatgagtctgagggcatcccgctgaagcggcggcgggtgtcgtttggcggtcacctgcgtcctgagcttttcgatgagaacctgcccccaaacactcctctaaaacgtggggaggctcccacaaagcggaagtctctggtgatgcatactcctccagttttgaaaaagatcatcaaagagcaaccccagccaagcggtaagcaggagtcggggtctgagattcacgtggaggttaaggcccagagcctggtaatttccccacctgcccctagccccaggaaaactccagtcgcgtcagaccagcggagacgatcctgcaagaccgcgccggccagctcaagcaagtcccagaccgaggttcctaagcggggaggacgcaagtccgggaatttgcctagcaaacgagtttcgatatcgcggagccaacacgatattttgcagatgatatgttcaaagcgccggtcaggcgctagcgaagcaaatcttattgtggccaagagctgggctgatgttgtgaaactgggcgcaaaacagacacagactaaagtcattaaacacggcccacagagaagtatgaacaagcgccagagaagacctgccacgccgaagaagcctgtgggagaggtgcatagtcagttttctaccggtcacgcgaattccccatgtaccatcatcattggcaaagcccatactgagaaggtgcatgtgcccgctaggccatacagagtgctgaacaatttcatctcaaaccagaaaatggattttaaagaggacttatccggcatcgctgagatgttcaagacacccgtgaaggagcagccccaacttacctccacctgccacattgcaatttccaatagcgaaaatctgctggggaagcaattccagggtactgatagcggagaggaacctttgctccccacgagcgaatcctttggggggaatgtgtttttctctgcacaaaacgctgctaaacagccatccgacaagtgttcagcctctccacctctcagacggcagtgcattagggagaacggcaacgttgcgaagacacccaggaacacctacaagatgacaagtctggagacaaaaactagcgacaccgagactgagccttcaaagaccgtatcaaccgccaatcggtctggaaggtcgactgaattccggaatatccaaaaactacctgtagagtccaaatccgaggagaccaacacggaaatcgtcgaatgtatcctcaagaggggtcaaaaagccaccctgcttcagcaaaggcgcgagggcgagatgaaggaaattgaaaggccttttgagacatataaggagaatattgagctgaaggagaacgacgagaagatgaaggccatgaagcggtcacgtacatgggggcagaagtgcgcacctatgtccgacttaaccgatctgaagtcgctccccgatactgagttgatgaaggatactgcacgaggacagaatctgctccagacccaagatcatgcaaaagcacctaaaagtgagaaggggaaaattaccaaaatgccttgtcagtccctgcagcccgaaccgatcaacacccccacccataccaagcagcaattgaaggcgtccctgggaaaggtgggcgtgaaagaagaacttctagccgtgggcaagtttactaggactagtggcgagacgacacatacacatcgcgaaccagccggcgatggcaaaagtatcaggacttttaaggagtcaccgaagcagatacttgatcccgccgccagagtgactggcatgaagaagtggcccaggaccccaaaagaagaggcccagagcctcgaagacctggccggcttcaaggaactattccaaactccagggccttccgaagagtccatgacagacgagaaaaccaccaaaatagcctgtaagtcacccccacctgagagcgtggacactcccacgagcacaaagcagtggccaaagaggtccctgagaaaagcggacgtcgaagaggaatttctggctctaagaaaacttactccaagtgctggaaaagcgatgctgacaccaaagcccgctgggggcgatgagaaagatatcaaggctttcatggggaccccagtccagaagttggacctggccggaaccctgccgggctctaagagacagctgcagacccccaaagaaaaagcccaggcgctggaagacctggcagggtttaaggaactgttccaaactccaggccatacagaggaattggttgccgctgggaagaccaccaaaatcccttgcgactcacctcagagcgacccagtagacactcccactagcacaaagcagaggcccaagcggagcatcagaaaagccgacgttgagggggaactgctggcctgccgcaatctcatgccctcagcagggaaggcaatgcatactcctaagccctccgtaggcgaggagaaggacatcatcatctttgttggcactcccgtccagaagctcgaccttaccgagaacctcactggctcgaagagaagacctcaaacacccaaagaggaggcccaggctctggaggatttgaccggcttcaaggagctgttccagacacctgggcatacagaggaggcagtggcagcagggaagacaactaagatgccctgcgagtcatccccccctgaaagtgctgatacccctacaagtacacgacgccaaccaaaaactccattggagaaaagggacgtacagaaggaattaagcgcacttaagaagcttacccagacttctggggagactactcacacagacaaggttcctggcggcgaggataaaagtataaatgcgttcagggaaactgccaaacagaaactggatccagctgcaagtgttacggggtctaagcgacaccccaaaacaaaagaaaaggcccagccccttgaagacttggcagggctgaaagagctgttccagactcctgtttgtacagacaagcccaccacccacgagaaaacgaccaagatcgcctgcagatcgcagcctgatcccgtcgatacccccacctcctccaagccccagagtaagcgttctctccgtaaggttgacgtggaagaagagttctttgccttgaggaagcgaacacctagtgctggtaaagccatgcacacccctaagcccgctgttagcggcgaaaaaaacatctatgcgtttatgggaactccagtgcagaaactggaccttactgaaaatcttaccgggtctaaaagaaggttgcagacccccaaggagaaggcacaggcattagaggatctcgctgggtttaaggaactgtttcagaccagagggcatactgaggaatcaatgaccaacgataagaccgctaaagtggcctgcaaatcaagtcagcccgatcccgataagaatcccgcttcgtctaagcgaaggctcaagacaagcctgggaaaagtcggagtgaaggaggaactgctggctgtgggcaagctcacccagacctctggcgagactacccacacccatacggaacccaccggagacgggaagagcatgaaggcctttatggaatctcctaagcagatcctcgattctgctgcctctcttaccggaagtaagagacaattgagaacacccaagggtaagtcggaagtcccagaagatctggcaggttttatcgagctcttccaaacacctagtcacaccaaagaatctatgaccaacgagaaaactactaaggtttcctaccgcgccagccagcccgacctagtggatacgccaacctcaagtaaaccacagcctaaaagatctctgcgaaaagccgacaccgaggaagagttcctggcatttaggaagcaaactccctctgctggaaaagcaatgcacaccccaaaaccagctgtcggcgaggaaaaagacatcaacaccttcctgggaacccctgtccagaagctagaccaacccgggaatctgcccggcagtaatagaaggctgcagacacggaaagagaaagcgcaggccctagaggaattaaccggcttccgagaattattccagactccctgtacggataaccccaccactgatgagaagaccacaaagaagatcctttgcaaatctccccaatctgacccagcggataccccgaccaacaccaagcagcgacccaagcgctctttaaaaaaggcggatgtcgaagaggagttcctcgccttcagaaagctgaccccttccgcaggcaaagccatgcatacccccaaggctgctgtcggagaagagaaggacatcaatacgttcgttggaacaccggtggagaaactggatctgctggggaacttgcccggctccaaacggcgtccccagacacccaaggagaaggccaaagcacttgaggacttagcggggtttaaagaactttttcagacccccggacataccgaggaaagcatgaccgacgacaagattacagaagtctcatgcaaatccccccaaccagatcctgtcaaaactcccacctcctctaagcagcgtctcaaaatcagcttaggaaaagtcggggtgaaggaagaagtgctgccggtgggcaagctgactcagacgtcagggaaaaccacgcagacccaccgcgaaaccgccggcgacgggaagtctattaaggcttttaaagagagtgccaaacagatgttggatcctgctaattacggaacgggaatggagcggtggccaagaacaccaaaggaagaggctcagtccctagaagatcttgctggcttcaaagagctcttccagactcccgaccacacggaagaatctaccaccgatgataagaccactaagatcgcttgtaaatccccaccgccggagagtatggacacacccacttcgacacgaaggaggccaaaaaccccattgggcaaacgggacatcgttgaggaattaagcgcccttaagcagcttactcagacaacccacactgataaggtgcctggcgacgaagataagggcattaatgtctttcgtgagacagccaaacagaagctggatcccgcagcgtcagtcacggggtcgaagagacagccccgcacacccaaagggaaggcccagcccctggaggatcttgctggcctgaaggaactgtttcagaccccaatctgcactgataaacctactactcacgagaaaactacaaaaatagcatgccggagtccacagcctgatccagtcgggacgcccacaatctttaaacctcagtcgaagaggtccttgcgcaaagccgatgttgaggaggaatctttggctcttaggaagcggacgccttccgttggaaaagctatggacacccctaaaccagcaggaggcgatgagaaagacatgaaggccttcatgggcacccctgttcagaagctggacctccctgggaatctccccggaagtaaacgatggcctcagactcctaaagagaaggcacaggcattggaggacctggccggcttcaaggagctctttcaaaccccgggtaccgataagcccacaaccgatgaaaagacaaccaaaatcgcctgtaagtccccacagcccgacccagtcgatactcctgcaagtacaaagcaaagaccaaagcgcaatctcagaaaggcagacgtcgaggaggagttcctggctctgaggaagagaacacccagcgccggcaaggcgatggatacacctaagccagctgtgagcgatgagaagaatatcaatactttcgtggaaacgccggtccaaaagctggatctgcttggaaatctgcccgggtccaaaaggcagccccagacccctaaggaaaaggctgaggctctggaagatctggttggctttaaggagctgtttcagacacccggccatacagaagagtccatgacggacgacaaaatcacagaggtgtcatgtaaaagcccccaacccgagtctttcaaaacgtcccggtccagcaagcagagattgaagataccccttgttaaggttgatatgaaagaggaacctctagcagtttccaaactgacccgcacctccggtgagaccacccagacacacacagagccaacgggagacagtaagtccataaaagcgtttaaggagtcaccaaagcagatcctggaccccgccgccagtgtgactggctctcgacggcagctgaggacaagaaaagagaaggcccgggcgctggaggacttggtcgattttaaggagcttttctccgcccccggccataccgaagagtccatgacaatcgacaagaacaccaaaattccctgtaagagtccccccccagaactcactgatacagccaccagcaccaagagatgtcctaaaacacggcccaggaaagaggtgaaagaggagctgagcgctgtcgaacgactcacacaaaccagcggccagtccacacatactcacaaagagcctgccagcggggatgaagggatcaaagtgttaaaacagcgggctaaaaagaaacccaaccccgtggaggaggaaccatctcgccggagaccaagggccccaaaagaaaaggcccaacctctcgaggatcttgccgggtttacagagctgtccgagactagcggccatacgcaggaatcactgaccgccggaaaagcaactaagatcccctgcgaatcacccccgctcgaggtcgtagacactacagcctccacaaaaaggcatttgcggacacgcgtgcagaaggttcaggtgaaggaggaaccctcagctgttaaatttacacagactagcggtgaaacaaccgacgcagacaaagagcccgccggggaggacaaaggaattaaagccttgaaggaaagcgccaagcagacaccagcccctgccgcttctgttactggcagtcggagaagacctcgggccccccgagagtccgctcaggcaattgaagaccttgctggctttaaagatcctgctgctggacatacggaggaatccatgactgacgacaagaccaccaagatcccttgcaagtcaagccctgaactcgaggacaccgctacatccagcaaacggaggcctcgcacaagggcccagaaggtggaagtcaaagaagagttactggctgttggcaaactgacccaaaccagtggggagaccactcataccgacaaggagcccgtgggagaaggaaaaggaaccaaggccttcaagcagcccgccaagaggaaactggacgcagaggatgtcatcggtagtaggcggcagcctcgggcaccaaaggagaaggctcaaccgctggaggatctggccagctttcaggaactgtcgcagacgcccggacacaccgaggagcttgcgaatggtgcagccgattcctttacctccgcacctaagcaaactcccgacagcggcaaaccactgaagatcagccgccgggtcttgcgcgcaccaaaggtcgaaccggtcggagacgtagtttcaaccagagacccagtgaagagtcaaagcaaaagcaacacaagcttgcctccactgcctttcaagagaggtggcggaaaagacggcagtgtcaccggaactaaaaggctgaggtgcatgcctgctcccgaggagatcgtcgaggaattacccgcttctaaaaagcagcgggtcgcaccacgggctcgggggaagtcctccgagccagtggtgatcatgaagcgatccctaaggacttcagctaagcggatcgagcctgccgaggagctgaacagtaacgacatgaaaacaaacaaagaggagcacaagttacaggacagcgtccccgaaaataagggaatttcactccgcagcaggcgccaaaacaaaaccgaggctgagcagcagatcactgaggtgtttgttctggcggagcgcatcgagatcaacagaaacgagaagaaaccgatgaagactagtccggagatggatattcaaaatccagatgatggagcgaggaaaccaatccccagggacaaggtgacggaaaacaaacgatgtttgcgcagtgcaagacaaaacgaaagctcccagcctaaggttgccgaagagtctggcgggcagaagagcgccaaggtcttgatgcaaaaccaaaaggggaagggagaagcgggcaactcagacagcatgtgtctcagatcacgcaaaaccaaatcccagcccgccgcttctacactcgagtcaaagtctgtccagagggtgacaaggtctgttaagcgttgcgctgagaatcctaagaaggctgaggacaatgtgtgcgtgaaaaaaattcgcacgaggtctcaccgggattcagaggacatctag

SEQ ID NO: 22817 - DNA, 9771 bp, Artificial Sequence
  Description of Artificial Sequence: Synthetic coding sequence
atgtggcccacccggcggctggtgaccatcaagcggagcggcgtggatgggccacatttccccctgtctctgagtacatgtttgtttggccggggcatcgagtgcgatattaggattcagttaccagtggtgtccaagcagcactgcaagattgaaattcatgagcaggaggccatattgcataatttctcgagtacaaatcctacacaggtgaatggaagcgtaatcgacgagcccgtaaggctcaaacacggtgacgtgattactataatcgacaggtcatttcgatatgagaatgagtccctgcagaacggacggaagtcaaccgagttccccaggaaaatccgggagcaggagccggcccgtcgggtgagcagatcttccttttcatctgacccagatgagaaggcgcaggactctaaggcctactccaagatcaccgagggcaaagtttcaggcaaccctcaggtgcacatcaaaaatgtaaaggaggattccacagcggatgacagcaaagattcagtcgcccaaggcacaacaaacgtccatagctccgaacacgccggccggaacggcaggaatgccgccgatccgatcagcggagattttaaggagatttcatccgttaagttagtgtccaggtacggcgagctcaagagtgtcccaactacccaatgcctggataatagtaagaagaacgaatcacctttttggaagctttacgagtccgttaagaaagaattggatgttaagagtcaaaaagaaaacgtgcttcagtactgtaggaagtccggcctgcagaccgattatgcaaccgaaaaggaatcggccgacggcttacagggagaaacacaattgctggttagtagaaaaagtaggcctaaatcaggagggagcggacacgccgtggcggagcccgcatcacccgaacaagagctcgatcagaacaaggggaagggcagggacgtggaatctgtccagaccccctcaaaggccgtaggcgcatcgtttccattatacgagcctgctaagatgaagacacccgtgcaatactctcagcagcaaaacagccctcaaaagcataagaataaggatttgtatactacaggtcgccgtgagagtgtgaatcttggaaagagcgagggctttaaggctggagacaagaccttgaccccccggaaactcagcacgcgcaacagaactcctgcaaaagtagaagatgccgccgactctgctaccaaacccgaaaatctttcgtctaaaacacgcggctctattcctaccgatgtggaggtactcccaacagaaacagagatccacaatgaacccttcttaaccctctggctgacgcaggtggagcggaaaatacagaaggatagcttgtccaaacccgagaaattgggtacgactgccggccagatgtgttccgggctccctggactgagctccgtcgacatcaacaatttcggagactccatcaacgaatccgaaggcatcccattgaaaaggcgacgggtgtcctttggtggtcacctgagacccgagttgtttgacgagaatctgccacccaacactccactgaagcgaggtgaggctccaaccaagaggaagtccttagtcatgcacacaccccccgtcttaaaaaagatcatcaaagaacagccacagcccagcggaaaacaagaaagcggaagcgaaatccacgtcgaggtcaaagctcagtccttagtcatatcaccccccgcgccctcaccgaggaagactcctgtggcgtccgaccagcgcaggagaagctgcaaaacagcaccagcatctagctctaagagccagaccgaagtccccaaacgcggggggaggaaatccggaaacctgcctagtaagcgcgtgagtatcagtcggtcacagcatgatatcctgcagatgatctgctctaagagacgcagtggtgcaagcgaagccaacttaatcgtggccaagagctgggctgatgtggtgaagctgggcgcaaaacagacccagacaaaggtaatcaagcatgggcctcagagatcgatgaacaaacgtcaacgccggcccgctacccccaagaaacccgtaggcgaagtgcactctcagttttccacagggcatgctaatagtccgtgcacaatcattatcggcaaggctcacacggagaaagtgcacgtccctgcacgaccgtatcgggttcttaataatttcatttccaatcagaagatggatttcaaggaggatctgtctggaatcgccgaaatgttcaagactcctgtgaaagagcagccacaactcaccagcacctgccacattgctatttctaattccgagaatctcttggggaagcaattccaaggtacggattccggcgaggagccactgctgcccacctctgaaagctttggcggcaacgttttttttagcgcgcagaacgccgcgaagcagcccagtgataaatgcagcgcaagccctccactaagaaggcaatgtataagggagaacgggaatgtggcgaagactccacggaacacgtataagatgacaagccttgaaaccaaaacaagcgacaccgagacggaaccgtccaagactgtcagcaccgccaatagatcaggaagatctacagagtttcgcaatatccaaaagctcccagtcgagtctaaatctgaggaaacaaacacagagatcgtggaatgcatcctcaagcgcggacagaaggccaccttgctgcagcagcgtcgcgaaggcgagatgaaagaaatcgagcgcccattcgagacttataaggaaaacattgaactcaaggagaatgatgaaaagatgaaggcaatgaagagatcaagaacctggggtcagaaatgtgcccctatgagcgatctcaccgacctgaagagcctgccagacaccgagctcatgaaggatacggctcgcgggcagaatcttctgcagacacaggatcacgcaaaggcacctaagtctgagaagggaaagatcactaaaatgccttgtcaaagtttacagcctgagcccatcaacacgcctacccataccaaacaacagctcaaggcaagtcttgggaaagtgggggtgaaagaggagttactggctgttggtaagtttacaaggacgtcgggcgagaccacccatacccatcgtgagcccgcgggagatggtaaatctattcgtaccttcaaggaatctccaaagcaaatacttgatcccgcagctcgagtgacaggaatgaagaaatggcccaggaccccaaaagaggaggcccagtctttagaagacttggcaggttttaaggagctcttccaaacgcccggaccctccgaggaatctatgaccgacgagaagaccactaagattgcttgcaagtctcccccccctgaatccgtcgacactccaacatcaacaaaacaatggcccaaaaggagtcttcggaaagcggacgtggaggaggagttcctggcactaagaaagctgacgccatccgctggaaaggctatgttgacccctaaaccagccggaggggacgaaaaggacataaaagccttcatggggactcccgtgcagaagctggatctagcagggacactgcccggaagtaagcggcagttgcagacacccaaggaaaaagcgcaggcactggaagacctcgctggctttaaggagttatttcagacacccggccacaccgaagaactcgtcgcggccggaaagaccacgaagatcccttgtgattccccccagtcagatcccgttgacacccccactagtactaagcaacggcccaaacgtagtatccgaaaagccgatgtggaaggcgaactgttggcctgcaggaacctgatgccctctgcaggaaaagctatgcacacccctaaaccctcagtgggggaggagaaggacataatcatctttgtgggtacacctgtacagaagcttgaccttactgagaatctgactggtagtaagcgccggccgcagactcccaaggaggaagcacaggccttagaagatctgacaggatttaaagagctgttccagacacctggacatactgaagaggcagtcgcggccgggaaaacgaccaagatgccctgtgagagtagtcctccagaatcagccgacacacctaccagtaccagaagacagccaaagacccccctggaaaagcgcgacgttcagaaagagctgtctgctttgaagaagctcacccagacctcaggcgaaacgactcacactgacaaggtgccggggggtgaggacaaatccattaatgcattcagagagaccgcaaaacagaagttagaccctgccgcctctgtcactggaagtaagagacaccctaagaccaaagagaaagcccagccattggaggacctggccggcctcaaagagctcttccaaacgcctgtctgcaccgataaacctaccactcatgagaagacaacaaagattgcatgccgttcccaaccggaccctgtggacactcccaccagtagcaagccccaaagcaaaagatccttgagaaaagtggacgtggaggaagagttcttcgctctgcgaaagcgtactcccagcgctgggaaagccatgcacactcctaagcccgcagtctctggggagaaaaatatctacgcattcatgggtacaccagtacagaagctggatctcactgagaatctcacagggagtaaaagacgcttgcagactcccaaagagaaggcccaagccctcgaagatctcgccggcttcaaggaactgttccaaacccggggacataccgaagaaagcatgaccaatgacaaaaccgccaaagtcgcctgtaaaagcagccagcctgatcctgacaagaatccggcttcctccaaaagaagactcaagacatcccttggaaaggtcggggtgaaggaggaactgcttgccgttggcaaacttacccagacctccggcgagacaacccacacacacactgaacccaccggagacggcaaatcaatgaaggcgttcatggagtcaccaaagcagatattagattccgctgcaagcctcacaggaagcaaacggcagctgaggacccctaaagggaaaagtgaggttcctgaggatctggccggcttcattgagcttttccaaaccccgtcacacaccaaagaaagtatgactaacgaaaagacaactaaagttagctacagggcttcccagccggacctggtggatacaccaactagcagtaaacctcagcctaagcggtctctgcgcaaggcagatactgaagaggagttcctagccttccgaaagcaaacaccctctgctggcaaggccatgcacactcccaaacctgcagtcggggaagagaaggatatcaacacatttcttggaacaccagtgcaaaagctggaccagccagggaatctgccagggtccaatcgccgcttgcagacccgtaaagagaaggctcaggctttggaagagctaacagggttcagagagttgtttcagaccccttgcaccgacaaccccacaacagatgagaaaacaaccaagaagatcctgtgcaaatccccccaatcagaccccgctgacactcccaccaacaccaaacagcggccaaagcgttccctgaagaaagccgatgtggaggaagagttcctcgcattcaggaagttaactccctccgcaggtaaagctatgcatacccccaaggccgcagtgggtgaagaaaaggacatcaatacatttgttggtacacccgttgaaaagcttgatctgttggggaatctccctgggagcaaacggcggccccaaactcctaaggaaaaggctaaggccctggaggacctcgccggcttcaaagaactctttcagaccccaggccatactgaagaatcaatgacggacgacaaaatcaccgaggtcagctgcaagtccccccagccagaccccgtgaagacacctacatcatcgaaacaacgacttaaaatatccttgggaaaggtgggcgttaaggaggaagtccttcctgtgggaaagctcactcaaaccagcgggaaaacaactcagacacatagagaaactgccggcgatggcaaaagcattaaagcctttaaggaaagcgcgaagcaaatgttggaccccgcaaattatggtactgggatggagcgctggccccgaactcccaaggaggaggcccagtcactggaagacctggcagggtttaaagagttgttccagacacccgaccacacagaggaaagcaccacagacgataaaactacgaagatcgcctgtaagagcccgcctcctgagtcaatggatacgcccacaagtactcgccgcaggccaaaaactccccttggaaaacgggatatagtcgaggagctctccgctcttaaacagttaacgcagaccacccacactgataaggtgcctggagacgaggacaaaggcatcaatgtttttcgggaaaccgccaaacagaagctggatcccgccgcatctgtgactgggtctaagagacaacctcgtacacccaaaggcaaagcgcagcccttggaagatctggccgggcttaaagagctgttccagacaccaatctgtacggataaacccactactcacgaaaagaccacgaagatcgcgtgtaggtcgccacagcctgaccctgttggcaccccaacaatctttaagccacagtccaagcgctcccttagaaaggctgacgtcgaagaggaatccctggccctaagaaaaaggacaccttccgtgggtaaagctatggacactccaaaacccgctggtggtgacgagaaggacatgaaggcctttatgggaaccccggtgcagaagctggacctgcccggaaatctgcccggaagcaaaaggtggccccagacccccaaggaaaaagcacaagctctggaggatctagcaggatttaaggagttattccagacgcctggtactgacaagcccactaccgatgagaaaaccaccaaaatcgcatgtaagagccctcagcccgacccggtagatactcccgccagcactaaacaacgtcccaaacgaaacttgcggaaggctgacgttgaggaagaatttttggcgctgaggaagcgtacgccctcggcgggcaaggccatggacacccccaagccagcagtgtccgacgagaagaacattaacaccttcgtagaaactccagtgcagaaacttgatctcctgggaaacctcccagggagcaagcggcagccacaaacgcccaaggagaaggctgaagccctggaagatctagtggggttcaaagagttgttccagacacctggccatacagaggaatctatgaccgacgacaagataaccgaagtgtcctgtaagagtccacagcccgagtcatttaagaccagtagatcatcgaagcagcgcctgaagatacctctggtgaaagttgatatgaaggaggaaccactggctgtctcaaagctgacgcgcaccagtggcgagaccacacagacccacaccgagcccactggcgactctaagtccattaaagccttcaaggaatcccctaagcagatacttgatcccgctgccagtgttaccgggagccgaagacagttgcgcactcggaaagagaaggccagagcactggaggacctggtggatttcaaggagctcttctcagccccgggccacaccgaagagagcatgacaattgacaaaaacactaaaatcccctgtaagtctccgccccccgagctgaccgacactgccacaagcaccaaaaggtgtccgaagactagaccccgcaaagaggtcaaggaggagctgagcgctgtcgagagactgacccagaccagcgggcagtccactcacacccataaagagccggcatctggtgacgagggcatcaaggtgctcaagcaaagggcgaagaaaaagccaaatcccgttgaagaagagccgtcgaggcgccgaccaagggctccaaaggaaaaggcccagcccctggaggacctggccggatttactgaactatccgaaacctctggacacactcaggagagtctgacggctgggaaggccaccaagatcccctgcgaaagcccgcccctggaggtcgtggacacaactgcttccactaagcgtcatctgcgaactagggtgcagaaggttcaagtaaaggaggaaccctctgcggtgaagtttactcagacgagtggggagaccacagacgccgacaaggaaccagccggtgaagataaaggcatcaaagctctaaaagaaagcgctaaacagacccccgcaccggcagcctcagttaccggcagtcgacgacgcccacgagctcctcgcgagtccgctcaggccattgaagatctcgccgggttcaaagaccctgctgctggtcacactgaggagtctatgacagacgataaaaccaccaagatcccatgtaaatcttcaccagaactggaggacactgcgaccagcagcaaacgtcggccgagaactagggcgcaaaaagttgaagtgaaagaagagcttctggcggtgggcaagctcacacagaccagcggcgagaccacacacaccgacaaagagccagtcggggaaggtaagggcacaaaggccttcaaacagcccgccaaaaggaagcttgatgccgaagacgtcatcggctccaggagacagccaagagctcccaaagaaaaggctcaacctctggaagatctggcttcttttcaagaactctcacagacaccaggccacactgaagaactggccaacggcgccgctgatagttttacatctgcccctaagcagacacccgactcggggaaaccattgaagatttcccgcagagtgttgcgggcccccaaggtggagcctgtgggagatgtggtgagtacacgggaccccgtgaaatcccaatctaaaagtaacacgagcctccctcccctgcccttcaagcgcggcggtggaaaagacggcagcgtaacagggaccaagcgcctcaggtgcatgccggcccccgaagagatcgtcgaggagctgcctgcgtcaaagaaacagcgggtggccccaagagcccgtggtaagagttccgagccagtggtaataatgaagcgctcactgaggaccagtgctaaaagaatagaaccggccgaagagctgaatagcaacgacatgaaaacgaacaaggaagagcacaagctccaggattcagtaccggaaaacaaaggcatttcgctgcgcagcagacgccagaataaaactgaagccgaacagcaaatcaccgaagtctttgtgctcgctgagagaattgagatcaacaggaacgagaaaaagcctatgaaaaccagccctgagatggacatccaaaatcctgacgacggtgccaggaaacctataccacgagacaaggtaaccgagaataagcgctgtctacgcagcgccaggcagaacgagtcttctcagcctaaagtggccgaggagtcgggcgggcaaaagagtgctaaagtgctgatgcagaaccagaaggggaagggagaggccgggaactccgactccatgtgcctgcgctcacgaaagacaaagagccaacccgccgctagtacactggaatccaagtccgttcagcgggtaactcggagtgttaagcggtgcgcagagaaccctaaaaaagccgaagacaacgtatgcgtgaagaagatccgaaccagatcacaccgtgattctgaggacatctag

SEQ ID NO: 22818 - DNA, 9768 bp, Artificial Sequence
  Description of Artificial Sequence: Synthetic coding sequence
atgtggcccacccggcggctggtgaccatcaagcggagcggcgtggacggccctcatttcccgctgtccctgagcacgtgtctcttcggacgtggaattgagtgtgatattagaatccaactacccgtcgtaagcaaacagcattgcaaaatcgagatccacgaacaagaagcaattctccataatttttcgtccacaaatcccacacaggtcaatggctccgttattgacgagccagtgcgtctgaaacacggcgatgtgataaccattattgaccgcagctttaggtacgaaaatgagtctctgcagaacggccgtaagtccacagaattcccccggaaaatccgagagcaagagcccgccaggcgcgtatctcgttcaagcttttccagcgaccccgatgagaaggcccaagactctaaagcctattccaagattacagaaggcaaggtgagcggtaatcctcaagtgcacatcaaaaacgttaaagaagactccacagctgatgattctaaagactcagtcgctcaaggaacaaccaatgtccacagtagcgagcatgcaggaaggaatggacgcaatgcagctgacccaattagcggagactttaaagagatttcatctgtgaagctcgtttcacgttatggtgagctcaaaagcgtccccacaacgcagtgcctggacaattccaaaaaaaacgagtctccgttctggaaactgtacgaaagcgtgaagaaggagcttgacgtgaaatcacaaaaggagaacgtcctacagtactgtaggaagtctgggctgcaaactgattacgcaacagaaaaagaaagtgccgatgggctgcagggcgagacccagttacttgtgagtagaaaatcccgaccaaagtccggcggctcgggccatgcagtcgctgaacccgcttcacctgagcaggagttggatcagaacaagggtaaaggacgtgatgttgagagtgtgcaaacacctagcaaggctgtcggagcgtcgttccccctttacgagccagccaagatgaagacgccagttcagtattcccagcagcaaaactctccacagaaacacaagaacaaagatttgtacactacagggcgcagggagtccgtgaatctcggcaagagtgaaggattcaaggccggggacaagaccttgacccctcgaaagctgagtacgcgcaaccgtacccctgctaaggtggaggacgcagccgactccgcaacaaaaccggagaacctgagcagcaaaacgaggggcagtataccaactgatgttgaagtattacccacagagacagagattcacaatgagccattccttaccctttggcttacccaggtagagaggaagatacagaaggactcattgagcaagccagaaaaattggggacaactgccgggcagatgtgttccggactcccagggctttcctccgtagacatcaacaattttggcgattctattaatgagagcgaagggattcctctgaaaaggcgccgcgtgagttttggcggacacctccgccccgagcttttcgacgagaatctgccacctaatactccccttaagcgaggtgaggccccgaccaaacggaagagtttagtcatgcacacaccaccagttcttaagaaaatcatcaaagagcaaccgcagccctccggaaaacaggagagcgggtcagagattcatgtggaggtaaaagcccagagtttggtcattagcccccctgcccccagcccaagaaaaaccccagtggctagcgatcagcggcgcagatcctgtaagacagctcctgcatcttcaagtaagtctcagaccgaagttcccaagcgcgggggagaacgggttgccacatgcctgcagcgggtttccattagtcggtcccagcacgacatcctgcagatgatatgtagtaagcgaagatcaggcgccagcgaagccaaccttatcgtagccaaaagttgggctgacgtggtaaagcttggagctaagcagactcagacaaaggttattaaacatgggccgcagcgatctatgaacaaacgacagcggcggccagcaacccccaagaaaccagtgggggaggtacactctcagttttctaccggtcacgccaatagcccctgcaccatcatcatcggcaaggcgcacaccgaaaaagtgcacgttccagcaagaccatacagagttctgaacaacttcatctccaaccagaagatggattttaaagaagacctgtctgggattgctgaaatgttcaagacgcccgtaaaggaacagccccagttaacttctacatgtcatatagcgattagtaacagtgagaatttgctcgggaaacagttccaaggaaccgattccggagaggaacccctcctgcctacatccgagtccttcgggggaaatgtgttcttttcggctcaaaacgctgctaagcagccgagcgataagtgctcagcctctcctccactccgtcggcagtgcatcagggaaaacggcaatgtcgcaaagacgccacgcaatacttacaaaatgacctcgttggagactaaaaccagcgacaccgaaactgagccctcaaagaccgtgtccacagctaataggtctgggcggtctaccgagttcaggaatatacagaagctgcctgttgagagcaagtctgaggaaaccaataccgaaatcgtggaatgcattcttaagagggggcaaaaagctaccttgctccagcagagacgggagggggagatgaaagagattgagcggccatttgaaacatacaaagaaaatatcgaactcaaggagaacgatgaaaagatgaaagccatgaaacgcagcagaacatgggggcagaaatgtgcacctatgtcggatttgacagatctaaagagtctaccagataccgagctgatgaaggataccgcccgtggccaaaacctgctgcaaacgcaggatcacgcgaaggcacctaaatcggagaaaggcaaaatcaccaaaatgccctgtcaatctttacagccagaacccatcaatactccaacacacacaaaacagcaattaaaagcttctttaggcaaggtgggcgttaaggaggagctgctcgccgtaggtaaattcacccgcacgtccggagaaaccacccatacgcacagggagccagcaggcgacgggaagtccatcaggacatttaaggagtccccaaaacagatccttgaccccgcagctagggtgacgggcatgaagaagtggccccgcacccccaaggaggaggcacagtccttagaggatctggctggctttaaggaattgttccagactcctgggccgtcggaggaatctatgacagacgaaaagaccaccaagattgcatgcaaatctccccctccagagtccgtcgacactccaacaagcacgaaacaatggcctaaacgcagtctccggaaggccgatgtggaggaagaatttctggccctacgtaagctcacaccgagcgctggaaaggccatgttgacccccaagcccgccggtggggacgaaaaagatattaaggctttcatgggcaccccagtccagaaactggatctggctggcaccctacccggctctaaacggcaactccaaacgcctaaagagaaggcacaggccctggaagatttggctggtttcaaagagttgtttcagacacccggccatacagaagaacttgttgccgctggaaaaaccacgaagatcccctgcgattcgccccagtccgatccagtggacacccccacgtcaactaagcagcgcccaaagagaagtatccgtaaggctgatgtcgagggcgaattgttggcatgtcgcaatctcatgcccagtgcaggtaaagctatgcacacccctaaaccgagcgtaggcgaggaaaaagatatcattatctttgtgggcacacctgtacagaagctggatcttaccgagaacctaacgggttcaaaacggcggccacagactcccaaggaagaggcccaggccctcgaagacttgacaggcttcaaggagctctttcagacgccaggacacaccgaagaagctgttgctgccggcaaaacgacaaagatgccttgcgagtcttcacctccagagagtgccgatactccaacaagtactcgcaggcagcctaagacgccacttgaaaagcgagacgtccagaaagaattgtcagccttaaaaaaactcacacagacttctggggagacgactcatacggacaaggttcccggaggtgaggataagtccatcaacgcatttagggagaccgcaaaacaaaagcttgatcccgctgcctctgtcactgggagcaagcgacaccccaaaactaaggaaaaagcccagccgctggaggacttagccggtttgaaagaattgtttcaaactccagtgtgcaccgacaaacctacgactcacgagaagacaacgaagattgcctgtagatctcagcctgatcctgtcgacacgccgactagttctaaacctcagtccaaaagatccctgcgcaaagtcgatgtagaggaggaattcttcgcactaagaaagcgcacaccatctgccggcaaggccatgcacactccaaagcctgcggtctccggcgaaaagaacatctacgcatttatggggacacctgtacagaagttagatttgactgagaacctgacggggtctaaacgccgattacagaccccaaaggagaaagctcaggcattagaagatctcgcggggtttaaggagctatttcagacccgcgggcacacagaggaatcaatgaccaacgacaagaccgccaaggtcgcttgtaagagctcacaacctgatccggacaagaatccggcttcaagtaagcgtcggctcaaaactagcttgggcaaagtgggtgttaaggaggagcttcttgcagtggggaagttgacccaaacttcaggagaaactacacatactcacactgagccaacaggggatggcaagtccatgaaagccttcatggaatcaccgaaacagatcctggactcggccgcttcactcactggctcaaaaagacagctccggacccctaagggcaaatcggaagtgccagaggacctcgcaggattcatcgagctgttccagaccccgagccataccaaggaatccatgaccaatgaaaagaccactaaggtgagctaccgggcaagtcagcctgacctggtagatactccgacatcttccaaaccgcagcccaaacgaagcctccggaaggctgatacggaagaagagttcctggctttcaggaaacaaacacctagcgcagggaaagctatgcacacccctaaacccgccgtgggtgaggagaaagatatcaacaccttcctggggactcctgttcagaagctggatcaacctggcaaccttccaggctcaaacaggcgattgcagacccgaaaggagaaagcccaggcgcttgaggagctgacagggtttcgggaattattccaaaccccctgcaccgacaacccaacgacagatgaaaaaactactaaaaaaatcctctgtaagtctccacaatcagacccggccgatacccccacaaatacaaaacagagaccaaaacgctctcttaagaaagccgatgtagaggaggagtttttggcgttccgcaaactcaccccctccgcaggaaaggcaatgcatacaccaaaagcagcggtgggcgaggagaaggacattaacacttttgtaggaactccagttgaaaagctggatctactcggtaatctccctggctctaagagaagaccgcagacaccaaaagaaaaagccaaggccctagaagacctggccggatttaaggagttgttccagacaccgggccacaccgaggagagcatgaccgatgataaaatcacagaagtctcctgcaaatctcctcaacctgatcctgttaaaactccaacctcatccaagcagcggcttaaaatctccttgggtaaggttggtgtaaaggaggaagtgcttcctgttggcaagttgacgcagacgtctggcaaaactactcagacacatagggagaccgctggtgacggcaagagtatcaaagctttcaaagaaagcgcgaaacagatgctcgatcctgctaattatgggacaggcatggaacgctggcccaggactccaaaggaagaggctcagtccttggaggacctggctggtttcaaggagctgttccagacgccagatcacacagaagagagtacaacggacgacaagaccacaaagatcgcttgtaagtccccacccccggaaagcatggataccccaacttctacacgtcgtagacccaagactccactgggcaagcgcgacattgtggaggaattatccgctctgaagcagcttacacaaaccactcacaccgacaaggttccgggggacgaggacaaggggatcaatgtcttccgggaaacagctaaacagaagctggaccctgccgcatccgtcacgggtagcaaacgacaaccgagaactcctaagggtaaggcccaacctctggaggatctggcagggctcaaggagctgttccagactcccatatgcacggacaaacctactacacacgaaaaaaccaccaaaattgcctgccgcagtccgcaacccgacccagtggggacccccactatttttaaaccgcaatctaagaggtctctgcgtaaggccgacgtggaagaggaatctctggcactgaggaaaagaactccaagcgtaggaaaagccatggatacgcctaagccagcaggaggggacgaaaaagacatgaaagcctttatggggacaccggtccagaaattggacttgcctggcaatctgcctggttccaaaagatggccccaaactcccaaggaaaaagcccaggcactcgaagatttagcaggattcaaagaattatttcaaactccagggaccgataaacctactaccgatgagaaaaccaccaagatcgcgtgtaagagtccgcagcctgaccccgtggacacccccgcatcgacaaagcagagacctaaaagaaacctccggaaggcagacgtggaggaggagtttctggctctgcgaaagcggacaccttccgctgggaaggctatggacacacctaagcccgctgtcagcgatgagaagaatatcaatactttcgtcgaaacgcccgtccagaaactggaccttctgggcaacctaccaggctcaaaacgacagccccagacaccgaaggaaaaggccgaggccctggaggatttggttggatttaaagagttgttccagacccctggccacaccgaggaaagcatgacagacgacaagatcaccgaagtatcttgcaaatctccccaacccgaatccttcaaaacctcccgttcctcaaaacaacggctcaagatcccactcgttaaagttgatatgaaggaagaaccgctggccgtatcaaagctaacgcgcacttctggtgagactactcagacccatactgaacctactggcgactctaagagtattaaggcgtttaaggagagcccaaagcaaatcttggatccagcagctagcgtcacaggatctagaagacagctccgcacgagaaaagagaaggcccgcgcgttggaagacctggtggactttaaagagctgttctcagctcccggccacacagaagagagtatgaccatcgacaaaaacaccaaaatcccatgtaagagcccaccccccgagctgaccgacacagctacttctacaaaacggtgcccaaagacaagacctcgcaaagaagtgaaggaggagctgtccgcagtggagagattgactcagacaagtggacaatctacacatacccataaggagccggctagtggagatgaaggcatcaaggtgctcaagcagcgcgcgaagaagaagcctaaccccgtggaggaggaaccctcaagacggcggcccagagcccctaaggagaaagcccagcccctggaagatttagcgggattcacagaactgtctgaaacaagcggacacacacaggagagtctaactgccggaaaggctaccaagataccttgcgaaagcccaccactcgaggtggtggacaccaccgcctcaacaaagcgacaccttcgaactagagttcaaaaagttcaggtaaaggaggagccctctgccgtgaagttcactcagacctccggagaaaccaccgatgcggataaagagccagccggggaggacaaggggatcaaagctctgaaggaatccgcaaaacagaccccagctcctgctgcctctgtgacggggagcagaagaaggccacgggcccccagagagagtgcccaggcaattgaggacttagcagggttcaaggatcctgcggccggccatacagaagagtcaatgactgacgataagacaaccaagatcccatgtaagtcttctccagagctggaagacaccgccacctctagcaaaaggcgaccccggaccagggctcaaaaggtggaagtgaaagaggagttgctggctgtgggcaagctgactcagacgtctggcgaaacaacccacacagataaggaacccgtaggagagggaaagggtacaaaagcctttaagcagcctgccaaacgtaaattagacgccgaagatgtgatcggctctcgacggcagccaagggcccctaaggaaaaggctcagcccctggaagatctagcgtcatttcaagaactgtctcaaacccccggacacacagaggaactcgcgaacggagctgccgactcttttaccagcgcacccaagcagacgcccgacagtggaaagcctctcaaaatctctcggcgcgtgcttcgtgctccaaaggtggaacctgtgggcgacgtagtatctactcgagacccagtcaagtcgcagagtaaatccaacacttcactgccacccttgccctttaagcgtgggggcggcaaagatggctctgttacaggcacaaaacggctgcggtgtatgcccgcacctgaagagatcgtggaagagcttcccgcttctaagaaacagcgggtcgcaccacgagccagagggaagtcatccgagccagtggttatcatgaagaggagcttgcgcaccagtgccaaaagaatcgagcccgcagaagagctgaacagtaacgacatgaaaaccaataaagaggagcacaaactccaggattccgtccccgaaaataaggggatctcactccgttcacgcaggcaaaacaaaacggaagcggagcaacagatcaccgaagttttcgtactcgccgagagaatagagattaatagaaatgagaagaaacctatgaagacctctccagagatggacattcagaatcccgatgacggtgcacgaaaacctattcctcgggacaaggtgaccgaaaataaaagatgtctgaggtccgccagacagaacgagtcctctcagcctaaggtcgccgaggagtccggggggcaaaagtcagccaaggtcctcatgcagaaccagaagggaaagggggaagcgggtaattcagatagtatgtgtcttaggtcacgcaagactaaatcacagcctgctgcaagcacactggaaagcaaaagtgtgcagcgtgtcacacgctctgttaaacgctgcgctgagaatccaaagaaggcagaagacaatgtgtgtgtcaaaaaaatccgaactaggagccacagagacagcgaggacatctag

SEQ ID NO: 22819 - DNA, 141 bp, Artificial Sequence
  Description of Artificial Sequence: Synthetic coding sequence
atgtggcccacccggcggctggtgaccatcaagcggagcggcgtggacggccctcatttccctctgtctctgagtacttgcctgttcggccggcgcaagtgtgtacttcagtgcaccgagtgcagtaaaacagctatctag

SEQ ID NO: 22820 - DNA, 1557 bp, Artificial Sequence
  Description of Artificial Sequence: Synthetic coding sequence
atgctgcgggtggtgagctggaacatcaacggcatccggcggcccctccagggcgtagccaaccaggagcccagcaactgtgctgctgtcgccgttgggaggatcctggatgaactggatgctgatatcgtgtgcctgcaggagacgaaggttactcgcgacgcactcaccgaaccacttgccatcgtagaagggtacaatagctacttttcattctctcgtaaccgcagtggctactcaggtgtcgccaccttctgcaaggataatgccaccccagtcgccgcggaggaagggttaagcggactgtttgctacacagaatggcgatgtaggttgctacggtaatatggacgaatttacacaagaagagctccgcgcactggattccgaaggccgggctctcttgactcaacacaagataagaacatgggagggcaaggaaaaaaccctgacgctcattaacgtgtactgtccacatgcagatccgggccgcccggagaggctcgtcttcaaaatgcggttttacaggctgcttcagatacgtgccgaggccctacttgcggctggttcacacgtcatcattctgggagacctcaatacggcccatagacctatagaccactgggatgccgtcaacctggagtgttttgaggaggacccaggaagaaagtggatggactccctgctgtccaacctcggatgccaaagcgctagccatgtgggaccattcattgacagctacagatgtttccagccaaagcaagagggggcctttacatgctggtccgcagtaaccggggcacgccacctgaattatgggtctcgcctggactatgtccttggagacagaactctggttatcgacacttttcaggcctctttcctgcttccagaggttatgggctccgaccactgcccagttggcgcagtactgtcggtgagctctgtgcccgccaagcaatgtcctccactctgcacaagatttctgccagagtttgccggcacccaacttaagattctccgtttccttgttccgctcgaacagtcccctgtgctggagcagtctactctgcagcataataaccagacccgggtgcagacttgccagaacaaagcacaggttcgaagtacgcggccacaacccagccaggtcggctccagccgggggcagaagaacttgaagagttactttcagccgagcccctcatgcccacaagccagtccggacatcgaacttcctagcctcccgttaatgtctgcgctgatgacgcccaaaacccccgaggagaaagccgtggccaaggtggtgaaggggcaggccaaaactagcgaagccaaagacgaaaaagaattgcggacatcattttggaaatcagtcttagccggtccccttaggacacctctttgcgggggtcatcgcgaaccatgcgtaatgcgcaccgttaagaagcccgggccgaaccttggacgcagattctacatgtgtgctcgacctcgcggcccccctaccgatcctagttcgcggtgtaattttttcctgtggtcacggccttcgtag

SEQ ID NO: 22821 - DNA, 1191 bp, Artificial Sequence
  Description of Artificial Sequence: Synthetic coding sequence
atgccccgggtgaaggccgcccaggccggccggcagagcagcgccaaacgacatttggcggagcaatttgctgtgggggaaattatcaccgacatggcaaagaaagaatggaaggttggactgcccatcgggcagggggggttcgggtgtatttacctggccgacatgaattcctcagagtccgtcggttccgacgccccttgcgtggtgaaggtcgagcccagcgacaatggaccactgtttacagaacttaagttctaccagcgcgcagcaaagcctgagcagatccagaagtggattagaacaaggaaactgaagtacctgggcgtgccaaagtattgggggtcaggcctgcatgacaaaaacggtaaatcctaccggtttatgatcatggatcgcttcgggtcggatctgcagaaaatttacgaagcaaacgcgaagcgctttagccgaaagaccgtgctgcaactgagtctgaggattttagatatcctcgaatacattcatgagcacgagtacgtacacggcgacatcaaagccagcaacctgctcttgaactacaagaaccctgaccaagtatacctcgtggactacgggcttgcttacagatactgtccagagggcgtgcataaagagtacaaagaagacccaaagcgttgccacgacgggaccatcgaattcacatccatcgacgctcacaacggagtggccccttcgcggcgtggcgacttagagattctggggtattgcatgatccagtggctgaccggtcacttgccttgggaggacaaccttaaagacccgaaatacgtgcgggacagtaagatccggtaccgggaaaacattgccagccttatggacaagtgcttcccagagaagaacaaacctggcgaaatcgcaaaatacatggaaacagtgaagctgctggactataccgagaaacctctctatgagaaccttcgcgacatactgctgcaaggcttaaaggcaataggcagcaaggatgatggcaaactagacttgtccgtggtagaaaatggaggcctcaaagccaagactattacaaagaaaagaaagaaagaaatcgaagagtcaaaggagcctggggtagaggacacagagtggtcaaacacgcagaccgaagaggcaatccaaacccgcagccgaaccagaaaacgggtgcagaagtag

SEQ ID NO: 22822 - DNA, 957 bp, Artificial Sequence
  Description of Artificial Sequence: Synthetic coding sequence
atgcccaagcggggcaagaagggcgccgtggccgaggacggcgacgagctccgcactgaacccgaagcaaaaaaaagcaagacggccgctaagaagaacgataaagaagccgccggagagggtcccgcactctacgaggatccgccagaccagaaaacgtctccttccgggaagccagctaccctgaaaatttgttcgtggaatgttgacggcctccgcgcctggatcaagaagaagggcctggattgggttaaggaagaggctcctgacatcctctgtctccaggaaacgaaatgctcagagaataaactccctgccgaattgcaggagctcccaggtttatctcaccagtactggtctgccccttccgacaaggaagggtattctggggttgggctgctctcccggcaatgccctctgaaagtttcttatggtattggagatgaagagcatgaccaggagggccgggtcattgtggccgaattcgactccttcgtacttgtgacagcttacgtgcctaacgccggccgcggcctggttcgacttgagtacaggcagagatgggacgaggctttcaggaagttcttgaaaggactggcctcgcgtaaaccactggtattgtgtggcgatctgaatgtagctcatgaggaaattgatctccgaaatcctaagggcaataagaaaaacgccggatttaccccccaggaaagacaagggttcggagagctcctgcaggctgtacctctggcggactcgttcagacacctctatcccaataccccatacgcgtatacgttctggacgtatatgatgaatgctagatctaaaaatgtggggtggagacttgactattttctcctcagccacagcctattgcccgccctgtgtgactcgaagatccgcagcaaggccttggggtcggaccactgtcctattactctgtacctggctctttag

SEQ ID NO: 22823 - DNA, 792 bp, Artificial Sequence
  Description of Artificial Sequence: Synthetic coding sequence
atgcccaagcggggcaagaagggcgccgtggccgaggacggcgacgagttgcgcaccgagccggaggctaagaagagtaaaaccgctgcaaagaagaatgacaaggaggccgcaggggagggccctgccttatatgaggacccccccgaccagaagaccagcccttctggaaaacctgctacactgaagatttgctcatggaacgtagacggccttcgggcatggattaaaaagaagggactagattgggtgaaggaggaggcccctgatatcctgtgtttgcaggagacgaaatgcagcgagaataagctaccagctgagctccaggaactgccgggcctatcacatcaatattggtccgcgccttcggataaggaggggtacagcggcgtcggcctcttgtctagacaatgcccgcttaaggtctcatacgggatcggggacgaggaacacgatcaagagggacgggtgattgtagcggagttcgatagctttgtcctggtgacagcctatgttccaaatgccggcaggggactggtgcgactggagtatcgccaacggtgggatgaggccttccgaaagtttctcaaaggtttggccagtcgcaagcctttagttctctgtggcgatttaaatgtggctcatgaggagattgatctgagaaaccccaagggaaataagaaaaacgccggtttcacaccacaggagcgacagggcttcggggagctcctccaggctgtgcccttggccgactccttccgacacttatacccaaatacgccttacgcctag

SEQ ID NO: 22824 - DNA, 957 bp, Artificial Sequence
  Description of Artificial Sequence: Synthetic coding sequence
atgcccaagcggggcaagaagggcgccgtggccgaggacggcgacgagctgaggactgaacctgaggctaagaaatctaaaaccgccgccaagaaaaatgacaaagaggccgccggggaaggaccagcactgtacgaggacccacctgatcaaaaaacttcaccgagtggtaagccagccaccctgaagatctgctcttggaacgtggatgggctgcgagcgtggatcaaaaaaaaggggctggattgggtcaaggaggaagcacctgatatcctttgcttgcaagagaccaaatgcagtgagaataagctgccagccgagttgcaggagctgcctggcctgtcgcatcagtactggtctgcaccatctgacaaggaaggttattctggtgtgggcttactgagcaggcaatgccctttgaaagtgagttatggtatcggcgatgaggagcacgaccaggaggggagagtgattgtggccgaattcgacagttttgtcttggtgaccgcttacgtgccaaacgcgggaagggggttggtgcgtttggaatatcgccagagatgggatgaagcgttccggaagtttctgaaggggctcgcttcaagaaagcccttggtgctgtgcggtgacctaaacgttgcacacgaagaaattgatctgcgcaaccccaagggcaacaagaaaaacgctgggtttacaccgcaggaaaggcagggtttcggtgagctcctgcaggctgtaccgctcgctgattcctttaggcacctgtatcctaatacaccttacgcttacacgttctggacctacatgatgaatgctcgctccaaaaacgtcggctggagattggattatttcttgctgtcccacagtcttcttcccgcactgtgcgatagtaagatcagaagcaaggccctgggcagcgatcactgcccaataaccctgtacctcgctctttag

SEQ ID NO: 22825 - DNA, 525 bp, Artificial Sequence
  Description of Artificial Sequence: Synthetic coding sequence
atgcccaagcggggcaagaagggcgccgtggccgaggacggcgacgagctgcgcactgagcctgaagccaagaagagcaagacggccgcgaaaaagaacgataaggaggccgcaggcgaaggaccagctctctatgaggatccccctgatcaaaaaacctcaccttcaggaaaacctgccactctgaaaatttgctcctggaacgtcgatgggcttagagcctggataaagaagaagggactcgactgggtgaaagaggaggccccagacatcctgtgtctgcaagagacaaaatgcagcgaaaacaaattgcctgccgaattgcaagaactgcccggcctgtctcaccagtactggtctgccccatcggataaggagggctactccggtgtagggctgctgagtcgtcagtgccctctgaaggtgtcttacgggattggcgacgaagagcacgaccaggaagggagggtgatcgtcgccgaatttgattcctttgtactggttaccgcctatgtacccaactag

SEQ ID NO: 22826 - DNA, 327 bp, Artificial Sequence
  Description of Artificial Sequence: Synthetic coding sequence
atgcccaagcggggcaagaagggcgccgtggccgaggacggcgacgagctccgaacagagccagaagccaagaagagtaaaaccgctgccaaaaagaatgataaagaagctgcgggcgagggtccagctctgtatgaagacccaccggatcaaaagaccagcccaagcggcaaacctgcaacactgaaaatttgtagctggaacgtggacggcttgcgcgcatggatcaaaaagaaaggcctggactgggtaaaggaggaagcccctgacattttgtgtctgcaggaaacaaaatgttccgagaacaagttaccagctgaactgtag

SEQ ID NO: 22827 - DNA, 441 bp, Artificial Sequence
  Description of Artificial Sequence: Synthetic coding sequence
atgcccaagcggggcaagaagggcgccgtggccgaggacggcgacgaactacgaactgagcccgaggccaaaaagagcaaaaccgccgctaaaaaaaacgataaagaggcggccggggaagggcccgcgctttacgaggatccaccggatcagaaaacatctcctagcgggaagccagccaccctgaagatctgctcttggaacgtggacggcctacgggcgtggattaagaagaagggcctggattgggttaaagaggaagctcccgacatcctgtgtctccaggaaacaaagtgcagtgagaacaaactcccggccgaattgcaggaactgcctggcctctcgcaccagtattggagtgcccccagcgacaaagaggggtactctggcgttggcctcttaagccggcagtgtcccctgaaagttagctacggaatttag

SEQ ID NO: 22828 - DNA, 975 bp, Artificial Sequence
  Description of Artificial Sequence: Synthetic coding sequence
atgttccggtgcggcggcctggccgccggcgccctgaagcagaagctggtccctcttgtgcgcaccgtatgcgtgaggagcccaaggcagcgcaatcggctccctgggaacttatttcaacggtggcatgttccgctagaactgcaaatgacccgacagatggcttcttccggggcaagtggtggcaaaatagataactctgtgttggtcctgatcgtcggactgagcaccgttggcgccggggcctacgcatacaagaccatgaaggaggatgagaagagatataacgaaaggatcagcggtctgggactgacacccgagcaaaaacagaagaaggccgccctgtccgcctctgaaggggaagaggtaccccaagacaaagctccatcccatgtaccctttctgctcatcggagggggaacagccgcctttgcagccgcaagaagcattcgtgctagagaccccggtgctagagtgctcatagtctctgaggaccccgagctgccctacatgcgcccccccctctccaaagagttgtggtttagcgacgaccccaatgtcacgaagaccctgcggttcaagcagtggaatgggaaggaaaggtctatttattttcagccaccgagcttctacgtttccgctcaagatcttccacatattgagaacggcggggttgctgttctgaccggaaaaaaggtcgttcagctggatgtgagagataatatggttaagcttaatgatggttcccagatcacctatgaaaagtgcctgattgcaacaggcggtacccccaggtcattaagcgccatcgatagagcaggcgccgaggttaaatctaggactactctgtttcgcaagattggtgacttcagaagtctggaaaaaatcagcagggaggtgaagtcaatcactatcatcgggggagggttcctggggtctgaactcgcatgtgcactggggagaaaagacatttag

SEQ ID NO: 22829 - DNA, 1842 bp, Artificial Sequence
  Description of Artificial Sequence: Synthetic coding sequence
atgttccggtgcggcggcctggccgccggcgccctgaagcagaagctggtgcccttagtgcggaccgtgtgtgtaaggagcccacgccagagaaaccgtctgccaggcaatctgtttcagcgttggcatgtgccactggaactacaaatgacacggcaaatggccagcagcggcgcctcaggtgggaaaattgacaactcagtcctggtgctgatagtgggattgagtacagtcggggcaggcgcctacgcgtacaaaactatgaaagaagatgagaagcgctacaatgagaggatttcggggctaggcttgaccccagagcaaaagcagaaaaaggcagccctgagtgcttctgagggggaggaagtgccccaggacaaggccccttcccacgtccccttcctcctgataggcggcggcacagcagcattcgcagcagctcgcagcatccgggctcgagatcctggggcgagggttctcattgtgtccgaggatccggagctaccttacatgagaccacccctgagcaaggaactttggttctctgacgatcccaatgtgaccaagactctgaggttcaagcagtggaatgggaaagaacgttccatatactttcagcctccctccttctatgtttcagctcaggatcttccgcatatagagaacgggggggttgccgtgctgactggtaagaaagtagtgcagctcgacgtcagggataacatggtaaagttaaatgacggttctcagattacatatgagaaatgtctcatagcaaccggcggcaccccccgttcccttagcgcaatcgaccgggctggagctgaggtgaagtcgcgtaccacgttatttaggaagattggggattttcggagtctggaaaaaatttcacgagaagtgaagtctatcaccatcattggcgggggcttcctgggatccgaactggcctgtgcgctgggtaggaaagcacgcgccctgggcaccgaagtgatccagctttttcccgaaaaggggaatatgggcaagattttgcccgagtatctgtctaattggaccatggagaaggtccggagagaaggggtaaaggttatgcccaacgcaattgttcagagtgtgggagtttcctctggtaaactgctaataaaactcaaagatgggagaaaggtcgagacggatcacattgtggcggccgtgggactcgagcccaatgtggagctcgccaagactggcggactggaaattgactctgatttcggcggcttcagggtgaacgctgaactgcaggcacggtctaatatttgggtggcgggggacgccgcgtgtttctacgatatcaaactgggccggcgccgggtcgaacatcacgaccacgctgttgtgtctggccggctcgccggcgagaacatgacaggagctgccaagccttactggcaccagtctatgttctggtccgacttgggtccggatgtagggtatgaggctatcggtctggttgatagcagcttacccaccgtcggggtgttcgccaaagcgacggcccaggacaaccctaaatctgcaactgagcagtccggaaccggcattagatctgagtcagagacagagtctgaagcttcggaaatcaccatcccgccatctaccccggccgttcctcaggccccggttcagggcgaagattacggaaagggtgtaatcttttatctccgggataaagttgtggtgggtatcgtgctgtggaatattttcaatcgcatgccgatcgccagaaagatcataaaggacggggaacagcatgaagacctgaacgaagtggcaaagctattcaacatacatgaggactag

SEQ ID NO: 22830 - DNA, 1830 bp, Artificial Sequence
  Description of Artificial Sequence: Synthetic coding sequence
atgttccggtgcggcggcctggccgccggcgccctgaagcagaagctggttcctttggtgaggaccgtttgtgttaggagccctagacagcgcaatcgcctgcctgtggtacagtcccatcacttaggctctcctagcaggtcactcgctagcaccggggcatctggtaaggatgggtcaaacctggtgtacttcctgatcgtaggcgctactgtgacgggcgccggcgtgtattacgcatataagactatgaaagaagatgaaaaacgttataacgagcgtatctctggcctcggactgaccccggagcaaaaacagaagaaggcagcacttagcgctagcgaaggggaggaagttcctcaggacaaagccccatcacatgtcccattccttctgataggcggaggcacagccgcctttgcagctgcccgctccatccgggctcgtgacccaggcgccagggtcctaattgtcagtgaggatcctgagctcccctatatgcgcccgcccttgtctaaagaactgtggttcagcgatgacccaaacgtgaccaaaacactgcgcttcaaacaatggaatggaaaggaacggtccatttacttccaacccccaagcttctatgtgtctgcccaggatcttcctcatatcgagaacggcggagtggctgtcttaaccggcaaaaaagtggtacaacttgacgtgcgcgacaacatggtcaaattgaatgacggatctcagataacctacgagaagtgcctcatagctacaggtgggactcctcggtctttgagtgctatcgacagagctggcgcagaggtcaagagtcgaacaacactctttcggaagatcggggatttccgaagtcttgaaaagatctcccgggaagttaagtctataacgatcattggcggaggcttcctggggagtgagcttgcctgtgcgctcggtcgaaaagcccgagctctgggcaccgaggtaatccaacttttccccgagaaaggtaacatgggcaagatcctgcctgagtacctgtcaaattggacaatggaaaaagtgcgcagagagggcgtcaaagttatgcctaatgcaattgtacagagcgtcggagtcagctctggaaagctgcttattaagctgaaggatggccggaaggtggaaacggaccatatcgtggctgccgtgggtttggagcctaatgtggaactcgctaagacgggcggattggaaatcgattccgactttggggggtttagggttaatgccgagctgcaggcgagatccaatatatgggtggccggcgatgctgcctgcttctatgacatcaagctcggtagaagacgagttgagcatcacgaccacgccgtcgtgtcaggccgactggctggtgagaacatgacaggcgccgcaaagccatactggcaccagtccatgttttggtccgatttgggaccagacgtgggctatgaggcaattgggcttgttgactcatctctgccaacagttggggtgttcgccaaggctacagctcaggacaatcccaaatctgccacggagcaaagtggtacgggaattaggagtgaatccgagactgagtcggaggcctcagaaataactatcccaccgtccacgccagccgtgcctcaagcacccgtgcagggggaggactatggcaagggagtcattttctatctgagagataaggtcgtcgtgggtatcgtcctgtggaatattttcaaccgaatgccaatcgctcgcaagataattaaggacggcgaacagcacgaggatctgaacgaggtcgcaaaactgtttaatattcacgaggactag

SEQ ID NO: 22831 - DNA, 981 bp, Artificial Sequence
  Description of Artificial Sequence: Synthetic coding sequence
atgttccggtgcggcggcctggccgccggcgccctgaagcagaagctcgtgcctttagtccggactgtttgtgtgcgatccccccgccagcgtaacaggctaccggcacgcgctcttggaaccgaagtgatccaactcttcccggagaaaggcaacatgggtaagatacttcctgagtatctttctaattggactatggagaaggtgcgaagggagggagttaaagttatgccgaatgccattgtacagagtgtgggggtttcctccggaaagctcctgatcaaactgaaagatggacgcaaggttgagaccgatcacatagtggcagcggttgggttagaacccaacgtggaactggcgaaaacaggagggctggagatcgactctgactttggaggtttcagagtgaacgctgagcttcaggcccgttcgaacatatgggtggccggagatgcagcctgtttctacgatattaaacttggacggcgaagggtggagcatcacgaccacgccgtggtatccggtcgcctagctggagagaacatgacgggagccgctaaaccctactggcaccagagcatgttctggagcgacttggggccagacgttggctacgaggcaattgggttggtggatagctctctccccaccgtgggagtgtttgctaaggccactgcccaggacaaccccaagtctgcaaccgaacagagcggcacagggatacggtccgaatcagagactgagagcgaggcctctgagattacaatacccccctccactcctgccgtcccacaagcacccgtacagggcgaagattacgggaaaggtgtaatcttttacctgcgcgataaggtggtagttggaatcgtgttgtggaacatattcaatcgtatgccgattgctcggaaaatcatcaaagatggagagcagcacgaggatctaaacgaagtggccaagttgttcaatatccacgaagactag

SEQ ID NO: 22832 - DNA, 786 bp, Artificial Sequence
  Description of Artificial Sequence: Synthetic coding sequence
atggagaaggtgcggcgggagggcgtgaaggtgatgcccaacgccatcgtacagtcagtcggagtctcatccggtaagttgctcattaagttgaaggatggtagaaaagttgagaccgaccatatcgtggcggccgtgggacttgagccaaacgtcgagctcgcgaagaccggcggtctggagattgacagcgattttggcgggttccgcgttaacgccgagctccaggctcggtctaatatatgggtggctggcgatgccgcctgcttctacgacataaagctcggcagaagaagagtcgagcaccatgatcacgcggtggtgtctggacgccttgccggggagaacatgactggcgccgccaaaccctattggcaccagtcaatgttttggtctgaccttgggcccgacgtcgggtatgaagctattggtcttgtggatagttctttacccaccgttggcgtttttgctaaagcaactgcccaggataatcccaaatcagccacagagcagtccggtaccggaatccgatctgaaagcgagactgagtcggaggcttcggagattacaattccgcccagtactcctgcagtgccacaagctcccgttcaaggggaagattatggcaaaggagttatattctacctccgtgacaaagttgttgttggaatcgtcttatggaacatcttcaacagaatgcccattgctagaaaaattatcaaagatggagagcagcacgaagacctgaacgaagtggccaagctctttaacatccacgaagactag

SEQ ID NO: 22833 - DNA, 825 bp, Artificial Sequence
  Description of Artificial Sequence: Synthetic coding sequence
atgggcaagatcctgcccgagtacctgagcaactggaccatggagaaagtgaggagagagggggtcaaagtcatgcccaatgcgatcgtacaatccgtcggagtgtcctcgggaaagttgctaatcaaactgaaggacggacgtaaagtggaaaccgatcatatcgtcgctgcggtgggtcttgagcccaacgtggaactcgctaagactggcgggctggaaattgacagcgatttcggaggctttagagtgaacgccgagctgcaggcaaggagcaatatttgggtcgccggcgacgctgcttgtttttatgacatcaagctgggacgaagacgtgtagaacatcatgaccacgccgttgtgtcaggaagattagctggcgaaaacatgacaggcgctgccaagccctactggcatcaatctatgttctggagtgacctcggccccgatgtcggttatgaagcgattggtctcgtggactctagcttacccaccgtgggggtcttcgcaaaagccaccgcccaggacaaccccaaatctgcgaccgaacagtctgggaccggaattagaagtgaatccgagacggaaagtgaggcgagtgaaatcactattccaccatccactcctgccgtgcctcaggcaccggtgcagggagaggactatggcaaaggcgtcatcttttacttacgggacaaggtagtcgtgggtattgtgctgtggaatatcttcaacaggatgccaattgctcgaaagatcattaaggacggtgaacagcatgaagatctcaacgaggtagctaagctgttcaacattcatgaagactag

SEQ ID NO: 22834 - DNA, 714 bp, Artificial Sequence
  Description of Artificial Sequence: Synthetic coding sequence
atgaaggaggacgagaagcggtacaacgagcggatcagcggcctggggctgacaccagagcagaaacaaaagaaggccgccctgagtgcatccgagggagaggaggtgccccaggacaaggctcccagccacgtcccttttctgctgattgggggcgggacagctgccttcgcagccgccagaagcattcgagctagggaccctggcgcacgagttctgatcgtgagcgaggatcccgagctaccttacatgagaccgccgttgtccaaggaactatggttcagtgacgaccccaacgtgaccaagactctgcgctttaaacaatggaacggaaaagagcgtagcatctatttccagccacccagtttttacgtgtccgctcaagaccttccgcatattgaaaacggcggcgtagctgtgctcaccgggaaaaaggttgtgcaacttgatgtgcgcgataacatggtgaagctgaacgacggatcgcagattacctacgaaaaatgcttgattgccacgggtggaactcctaggagcctgagtgcaatcgaccgcgccggagccgaggtgaagtcccgaaccaccctatttcgcaaaataggggacttccggagcctcgaaaaaatctcccgcgaggtaaagtcaatcaccataataggcgggggattcttaggcagcgaattggcatgtgctctggggcggaaagatatttag

SEQ ID NO: 22835 - DNA, 1017 bp, Artificial Sequence
  Description of Artificial Sequence: Synthetic coding sequence
atggacgccaaggcccggaactgcctgctgcagcaccgggaggccctggaaaaagacataaagacatcctacatcatggatcacatgatcagcgacggctttctgacaatctcggaggaggagaaggtgcggaatgagcctacccaacagcagagagctgccatgctgatcaaaatgatcctaaaaaaagacaacgatagctacgtttcattttataatgcactgctgcacgaagggtacaaagatctagccgccctccttcatgacggcattcccgtggtttcgagttcatccggtaaggatagcgtcagcggaataactagttacgtaaggacagtcctctgtgaggggggtgtccctcagaggcctgttgtgtttgtgaccaggaagaaactggtgaatgctatccagcaaaagctcagcaagttgaagggcgagcctggatgggtgacaattcacgggatggccggttgtggcaagagcgttttggccgccgaggccgtcagagatcactctctcctggaagggtgtttccctggcggagtgcattgggtcagcgtcgggaaacaggataagtcagggttgctcatgaagctgcagaatctttgcactcggctggatcaggacgagagtttcagccagaggctgcccctcaatatcgaggaagctaaagatcgactgcggattttgatgctgcggaaacaccccaggagtctgcttattctcgacgacgtttgggactcctgggtactgaaggcctttgacagccaatgtcagattctgctgacaactagagacaagtccgttacagactccgtcatgggaccgaagtacgtggtacccgtggagagcagcctggggaaggaaaaaggcctggaaattttatcactgtttgtcaacatgaagaaggcggatctcccggaacaggcccactccatcatcaaggagtgtaaagtggtagaacgctgccattggggtatacttacggacctgcttcataagtggaaccagagttag

SEQ ID NO: 22836 - DNA, 3492 bp, Artificial Sequence
  Description of Artificial Sequence: Synthetic coding sequence
atggacgccaaggcccggaactgcctgctgcagcaccgggaggcccttgagaaggatatcaagacttcttatattatggaccatatgatcagcgacggctttctcacaatatctgaggaagagaaggtccgcaacgaacctacccagcaacagcgagccgctatgttgattaagatgattctgaagaaggacaacgattcctacgtgagcttctacaatgccttacttcacgagggatacaaagatctagctgctctgctacatgatggcatccccgtagtgagctctagctccgggaaggacagcgtctctggcataacttcttatgttcgaactgtcctttgcgagggtggggtacctcaacgcccagttgtctttgtaacacgcaagaagctcgtgaatgctatccagcagaagctgtccaagctgaagggagagcctggctgggttaccattcacgggatggctggctgtggtaagtcagtcctcgctgccgaagccgtgcgggaccactctttacttgagggctgtttcccgggaggcgttcactgggtgtctgtgggaaagcaggataagtccgggcttcttatgaagctgcagaacctgtgtactcgcctagatcaggacgaatccttctcacagcggctgcccctgaacattgaagaagctaaagaccggctcaggatcttgatgctgcgcaaacacccccggagtctgttgattcttgacgatgtgtgggatagctgggtgctaaaggcctttgactcccaatgtcagatcttgctaacaacacgcgacaagtctgtcactgatagcgtgatgggccctaaatacgtggtgcctgtggagagctcccttgggaaggagaaaggattggaaatactgtcccttttcgtgaatatgaaaaaggccgatctgcctgagcaagcacatagcatcataaaggagtgcaagggctctccacttgtagtgagcctaatcggagccctccttagagattttcccaatagatgggaatactacctgaaacagctgcaaaacaagcagttcaaaaggattcggaagagcagctcctatgattatgaggcactggatgaggcgatgagtatctccgtggagatgctccgagaggacatcaaggactactacacagatctttccatcctccagaaggacgtgaaggtcccaaccaaggttctctgtattctgtgggacatggagacggaagaagtggaggacattcttcaggagtttgtgaataaatcattacttttttgtgaccggaatggcaaatctttccgctactaccttcatgacctccaagtggattttctgactgaaaagaactgctcacagctgcaagatctacataagaagatcatcactcagttccaacgataccaccagccacatacgctgtccccggaccaggaggactgtatgtattggtataactttctcgcttaccacatggcgagcgccaagatgcacaaagagttgtgtgctttaatgttctccctcgactggattaaggctaagaccgaactagttggcccagcacatttgattcacgagttcgtggagtaccgtcacatcctcgatgagaaagactgtgccgtgtccgaaaatttccaggagtttctcagcttgaacgggcacctccttggaagacaacccttccccaacatcgtccagctgggcctgtgtgaaccagagacctccgaagtgtaccagcaagccaagcttcaagcgaagcaggaagtggacaatgggatgctttatttagagtggattaacaaaaagaacatcacaaatctctccagactagtggtgcgaccgcacaccgacgctgtgtaccatgcatgcttttcagaagatggccagcgtattgccagctgcggcgctgataagacactgcaagtgttcaaagccgagactggtgagaaactcttagagattaaggcccacgaagatgaggtgctgtgttgcgccttctctacagatgatcgatttatcgcgacatgttctgtggataagaaggtgaagatctggaactcaatgaccggtgagctggttcacacgtacgatgaacactccgaacaggtgaattgctgccactttactaattcaagccaccaccttctgctggccaccggctcgagtgactgcttccttaaattatgggacctcaatcagaaggagtgtaggaataccatgttcggtcacactaactccgttaaccattgcaggttcagcccagatgacaagcttctggcgtcttgttctgcggacggcacgctgaaactgtgggatgcaacatcagcaaatgagcgcaaaagcataaatgttaagcaattttttttaaacttggaagatccccaggaggatatggaagtgatcgtcaagtgttgcagctggagcgcagatggcgccagaattatggtggcagctaaaaacaaaatttttctgtggaacactgactccaggtcaaaagtcgctgactgcaggggccacctttcctgggtgcacggggtaatgttctctcctgacggatccagttttctgacatcctcagacgatcagactatccggttatgggaaaccaaaaaagtgtgtaagaatagcgcagttatgttgaagcaggaggtggacgtagttttccaggaaaacgaggtgatggtgctggctgtggatcacatccgcaggctgcagcttataaacgggaggaccggccagatcgattatctaacagaggcgcaagtatcctgttgttgtttatcaccacacctgcagtacatcgcgtttggtgacgagaatggagctatcgaaatattggagctggttaacaaccgcatctttcagagccgattccagcataaaaaaactgtctggcacattcagtttaccgccgacgagaaaacactgatatcttctagtgatgacgccgagatccaggtgtggaactggcagctcgataagtgtatctttctgaggggacatcaggaaactgtgaaggattttagattgctgaaaaacagtcgcctgctgagttggagtttcgatggcaccgtgaaggtgtggaacattattacgggcaataaggagaaggattttgtttgccatcagggcaccgtactcagctgcgacataagccatgatgccaccaaattctcttcgacttcggcagataagaccgctaagatctggaacgtgtccaacggagaacttcttcacctgtgcgctccacttagcgaagaaggtgccgcgacacacggggggtgggtgactgatctgtgttttagccctgatggcaagatgctgattagcgcaggtggctacattaagtggtggaacgtcgtcacaggggagagctctcagactttttacacaaatgggacaaatctgaagaagatccatgtttcccctgactttaagacttatgtgactgtggataatctggggattttgtatatccttcagacactggagtag

SEQ ID NO: 22837 - DNA, 3618 bp, Artificial Sequence
  Description of Artificial Sequence: Synthetic coding sequence
atggacgccaaggcccggaactgcctgctgcagcaccgggaggccctcgaaaaagacatcaagacgagctatattatggatcatatgatttcagacgggtttctgactatctcagaagaggagaaggttagaaacgagcccacccagcaacagcgcgcagccatgctgatcaagatgattcttaagaaggacaatgactcttatgttagcttttataacgcacttctgcacgaaggctacaaagaccttgcagccctgttgcacgatggtattcccgttgtttcaagctccagtggcaaagattccgtttctggaatcaccagctatgtgagaaccgttctctgtgaggggggtgtcccacaacgccctgttgtctttgttactaggaaaaagctcgtgaatgccatccagcagaagctgtctaaactgaagggtgagccaggatgggtgactatccacggcatggcaggctgtggcaagagtgttctcgccgctgaggctgtcagagatcactcactcctagaaggctgctttcccggaggtgttcactgggtgtcagtgggaaaacaggacaagtcggggctgcttatgaagcttcagaacctctgcacccggctggaccaggatgagtcattttctcagagattgccactgaacatcgaagaggcgaaggatcgcctgcggatcctcatgctccggaagcatcctcgatcgctgctgatcttagatgatgtgtgggacagttgggtgttaaaggcctttgattctcaatgtcagattctccttacaacaagagacaagtctgtcaccgactccgtgatgggaccaaaatatgtggtccccgtggaatcctcactggggaaggagaagggcttggagatcctgagcttattcgtgaatatgaaaaaggccgatctgcctgagcaggcgcattcaattattaaggagtgcaaagggagccccctggtcgtatcactgattggcgcccttctgagagacttccctaatagatgggagtattatcttaaacagcttcagaataagcaatttaaacgtatccggaagtctagctcatacgactatgaagcattagacgaggccatgagcatttccgtggagatgctacgagaggatataaaagactactatacagacttgagcatcctgcagaaggacgtgaaggtgcctaccaaggttctctgtattctgtgggacatggaaaccgaggaggtcgaagatatcctgcaggaattcgtgaataagtctctcctcttttgtgatcgcaacggaaagtcttttagatactatctgcacgatttacaagtcgacttcctgacagagaagaactgctcacagttgcaagacctgcacaaaaagatcatcacacagttccaacgctatcatcagcctcacactttaagtccagatcaggaggattgcatgtactggtacaatttcctagcataccatatggctagtgccaaaatgcataaagagctgtgcgcattaatgtttagcttagattggataaaggccaaaaccgagctggtaggacccgctcatttgattcatgaattcgtcgagtacagacatatcctggacgaaaaagattgtgcggtgagtgaaaactttcaggaattcctgagcctcaatggccatctccttgggagacagccttttccaaatatcgttcagctgggtctctgcgagcccgagacctcagaggtatatcagcaggcgaagctacaggcaaagcaggaggtcgacaatggaatgctgtatttggaatggattaacaagaaaaatatcactaatctgtcacgtctggtagtcagaccccacaccgatgccgtttaccacgcatgctttagcgaggacggtcagaggatcgccagctgtggggccgataagacactgcaagtattcaaagctgaaactggcgagaagctactcgaaattaaggcacacgaggacgaagtcttgtgctgcgccttttccactgatgataggttcatagctacctgctccgtagacaaaaaggtcaaaatctggaattcaatgaccggagaactcgtgcacacatacgacgaacacagtgaacaggtgaactgttgccactttaccaattcgagccaccacctgctgctggcaaccggaagctcagactgctttttgaagttatgggatctgaaccagaaagaatgccgcaacacaatgttcggacacactaatagcgtgaaccattgccggttttcaccagatgataagcttctggccagctgctctgctgacggcactctaaagctgtgggatgccacttctgccaacgaaagaaagtcgataaacgtcaaacaattctttctgaatttggaggacccccaggaggatatggaggtgatcgttaagtgctgttcttggtccgcagacggcgcaaggataatggtcgcagcaaagaataagatcttcctatggaatactgatagccggtcaaaagtggctgactgccgggggcatctgagttgggtgcatggtgtcatgttctcccccgatggatctagcttcttgaccagctcagacgatcaaacaatcaggctgtgggagactaagaaagtgtgcaaaaattccgctgtgatgctcaaacaagaagtggacgtagttttccaagaaaacgaagtcatggtccttgccgttgatcacatacgccgccttcagcttataaacgggaggaccggccagatcgattatttaacggaggcgcaggttagctgttgttgtttgtctccccatctgcagtacatcgcttttggcgatgagaatggcgctatcgaaatcctggaacttgtgaataacaggatctttcagagtcgcttccaacacaagaaaacagtttggcatatccagttcacggccgacgagaaaacactgatatcatccagcgacgacgccgaaatccaggtctggaactggcagctcgacaagtgtatttttttgcggggacatcaagaaactgtcaaagattttaggctcctgaagaatagcagattgctgtcttggtcattcgatggaaccgtaaaagtatggaacatcatcaccggaaataaggaaaaggactttgtatgtcatcaaggcacggtcctttcttgcgatatatctcatgatgccactaagttctcttctacgtcagccgacaaaaccgcaaagatctggtcattcgacctgctcctcccgcttcacgaactcagagggcataacggctgtgtacggtgttccgcgttttccgttgatagtaccctgttagccaccggtgatgacaatggcgagattagaatctggaacgtgtcaaatggcgaactgctccatctttgtgcccctctctctgaagagggcgccgctactcatggaggatgggtaacagacctgtgtttttcccctgatgggaagatgcttatctccgctggagggtacatcaaatggtggaatgtggtcactggcgaaagttcgcagacgttttatacaaacggaacgaatctgaagaagattcatgtgtctcctgactttaaaacctacgtgacagtagataatcttggcattttgtatatcttgcagaccctggagtag

SEQ ID NO: 22838 - DNA, 3585 bp, Artificial Sequence
  Description of Artificial Sequence: Synthetic coding sequence
atggacgccaaggcccggaactgcctgctgcagcaccgggaggccttagaaaaggacattaagactagctatatcatggaccacatgattagtgacggttttctgacaattagcgaggaagagaaggtcagaaatgagccgacacagcagcaaagggctgccatgctgataaagatgattctgaagaaagataatgattcttacgtttccttttataatgcacttctgcacgaaggttacaaagatctcgccgcactgctccacgatggaatacccgtggtctcatcatcttctgtccggaccgtgctttgtgaaggcggagtccctcaacggcccgtggtttttgtgactagaaaaaaactggtgaatgcaattcagcaaaaactgtcaaagcttaagggggaaccaggatgggtcaccattcatggaatggccggatgcgggaagtctgttctggccgccgaggctgtacgagaccactctcttttggagggctgtttcccaggcggtgtgcattgggtatctgtcggaaagcaagacaaatccggacttcttatgaagctgcagaatctgtgtactcgactggatcaggatgagtccttctcccagcgactgccgttaaatatcgaagaggccaaagatcgtctccggatcctgatgctacggaagcaccctaggtccctgctcatactcgatgacgtttgggatagttgggtgctgaaggcctttgactcccagtgccagattctcctgacaactagggataaaagtgttacggattcagtcatgggacctaagtatgtggtgccagtggagagttccttaggaaaggagaaaggcctagaaattctgagtttgtttgttaacatgaaaaaagctgacctaccggagcaggctcactctatcatcaaggagtgcaagggctcccctctggtggtatctttaattggagccctgctgcgcgatttccccaatagatgggaatactacttgaagcaactgcagaataagcagttcaaaaggatacgcaaaagttcgtcttacgactatgaagccctggatgaggccatgtctatctcagtcgagatgcttcgggaggacatcaaagactattatacagatctgtcaatcctgcagaaagatgtgaaggtccctactaaagttctttgcattctttgggatatggaaaccgaagaagtcgaagatatcctccaggagttcgtgaacaaaagtcttctgttctgtgaccggaatggaaaatctttccggtactacctccacgacctacaagtcgatttcctgacagaaaaaaactgcagtcagctgcaggaccttcataagaagattatcacgcagttccaaaggtaccatcagccccatacgctgagccctgaccaggaagattgcatgtactggtataattttttggcctaccatatggcatccgctaaaatgcataaagagttatgtgcccttatgttctctctggattggataaaagctaaaacagaattagtcggaccagctcatctgatccatgaattcgtcgaatatagacacatcctggatgaaaaagattgcgccgtgagcgagaattttcaagaatttctgtcccttaacgggcacctgctgggccgccagccatttccaaatattgtccaattagggctatgcgagccggagacttcagaagtgtaccaacaggctaaattgcaggccaaacaagaggtagataatggtatgctgtacttggagtggattaataaaaagaacataactaacctgtctagacttgtggtgcggccgcacacggatgccgtgtaccacgcttgtttctccgaagacggtcagaggatcgccagttgcggggccgacaaaactctgcaggtctttaaggcagagactggagagaagttgctggagataaaggctcacgaggatgaggtgttgtgttgcgcattttccactgatgacaggttcatcgctacctgttctgtggacaagaaagtgaagatatggaacagcatgacaggcgaactggtgcacacgtacgacgagcactccgagcaagtgaattgctgccatttcaccaattcttcgcatcatcttttactggcaaccggaagttctgattgctttctaaagctgtgggacttgaaccagaaggagtgtcgcaacacgatgtttgggcatacaaacagcgtgaatcactgtaggttcagccctgatgacaaactcctcgcaagttgtagtgccgacggaactttgaaactgtgggacgctacctcagctaatgagagaaaaagtataaacgtcaagcagttcttcctgaatctggaggatccccaggaggacatggaggtgattgtgaagtgctgctcttggagtgccgacggagcccgaatcatggttgctgcgaagaataaaattttcctttggaataccgactcccggagcaaagtggctgattgtcgaggtcacctgtcctgggtgcacggcgtgatgttcagtcccgatggcagctcctttctaacctccagcgatgatcagacaattaggctgtgggagaccaagaaggtttgcaagaattcggcggtcatgctgaagcaggaagtggatgttgttttccaggagaacgaagttatggtgctggccgttgaccatattaggagattacaactcataaacggccgcacaggtcagattgattatcttactgaagcacaggttagttgttgctgtctttcgccacatttgcaatatatagcatttggagatgaaaatggcgcaatcgagattttagagctggtgaataacagaatattccagtcccgctttcaacacaagaaaactgtgtggcatatacagtttacagctgacgagaaaactctgataagctcttcggacgacgcagagatccaggtatggaattggcagctggacaaatgtatattcctgaggggacaccaggaaacagtgaaggacttcaggttgttgaagaattctcggttgctgtcttggagcttcgacgggactgtcaaggtgtggaatataatcaccgggaacaaggagaaagacttcgtctgtcatcaaggaacagtgctgagttgtgatatcagccacgacgcgacgaagttttcaagcaccagcgctgacaaaacggccaaaatctggtcattcgatctgctgctgcctctgcacgagctacggggccacaatggctgtgttcgctgtagcgccttctccgtcgattcaacattgcttgcgacgggtgacgataatggagaaattaggatctggaatgtaagcaatggtgagctgctccatctctgtgcaccactgtcagaagagggcgctgcaacccacggtggctgggtgacagatttgtgtttctctcctgatggcaaaatgttaataagcgcagggggatacatcaaatggtggaatgtcgtcacgggcgaaagttcccaaaccttctataccaatggtacaaacctcaagaagattcatgtgtccccagacttcaaaacctacgttactgtcgacaacctcggcatcctgtacatattgcagaccctagagtag

SEQ ID NO: 22839 - DNA, 3618 bp, Artificial Sequence
  Description of Artificial Sequence: Synthetic coding sequence
atggacgccaaggcccggaactgcctgctgcagcaccgggaggccctggagaaagatatcaaaacctcatacatcatggatcacatgataagtgacggatttttgaccatctcagaggaggagaaggtacgtaacgaaccaacacaacagcagcgggccgcaatgctgataaagatgattctcaagaaggataatgatagctacgttagcttttacaacgccttgctacacgaaggctataaagacctggcagccttactgcacgacgggattcctgtcgtgtctagttcatccggaaaggactcagtaagcggaataacatcatacgtgcggactgtgttgtgcgaggggggtgtacctcagagacctgtggttttcgtgacccggaaaaaactcgtgaacgccatccagcaaaaactttctaagctcaaaggcgaaccgggctgggttaccatccacggcatggccggttgcggcaagtccgtgctggctgctgaagcagttagagaccactcactgttggaaggatgttttcctgggggtgtgcactgggtttccgtggggaagcaggacaaaagtgggctcttgatgaagctgcaaaacctgtgcaccagactggaccaggacgaaagcttctcccagcggctgccacttaacattgaggaggccaaggaccgactgcgcatattaatgctgcggaaacacccgagatcgcttcttattctcgacgatgtgtgggacagctgggtcctcaaggcctttgacagtcagtgccagatcctattaactacccgcgacaaatccgtgacagattccgtcatgggccccaagtatgtggtccccgtggaaagcagcctggggaaggagaaaggactggagatactatcgctgttcgttaacatgaagaaagcggacctgcccgagcaggcacacagtatcattaaagagtgtaaaggatcccctctagttgtgtcactgatcggggcactcttacgtgattttcccaatagatgggagtactatcttaaacaattgcagaataagcaattcaagcgcattaggaaatcctcaagctacgattatgaggctctcgatgaggccatgtctatcagtgttgagatgttgcgcgaggacataaaggactattataccgatctgtccattcttcagaaggacgttaaagtacccaccaaagtgctgtgtattctgtgggatatggagactgaggaggtagaagatatactccaggagttcgtgaataagtccttgctgttctgcgaccgcaatggcaagagtttccggtactacctccatgacctgcaggtggatttcctcactgaaaagaactgtagccagctgcaggatttacacaagaagatcatcacacagtttcagagataccatcagcctcatactttgagcccggaccaagaggattgtatgtattggtacaacttcctggcatatcatatggcttctgctaagatgcataaggagctctgcgcactgatgttctcgttagactggattaaagctaaaacagaattagttggccctgcccatcttatccatgagtttgtggagtacagacacatcctggatgagaaagactgcgcagtgtccgaaaactttcaggaatttctttctctcaatggtcatttactcggcaggcaaccttttcccaacatcgtgcagttaggcttatgcgaaccagagaccagcgaagtctaccaacaggccaagctgcaagcgaaacaggaggtagacaacggtatgctgtatctggagtggattaacaagaagaacataaccaacttgtcccgcctcgtagtaagaccacacacggatgccgtgtatcacgcgtgcttttccgaggacggccagagaattgcctcctgtggagccgacaagacactgcaagtgtttaaagctgagacaggggaaaaactgctcgaaattaaagcccacgaggacgaagtcctctgttgcgccttctccacagacgaccgctttatcgcgacttgctcagtggataagaaagtgaagatctggaactcaatgactggggagttagttcatacatatgacgaacactccgagcaggtcaattgctgccattttactaacagttctcatcacctgctgctggccactggttcaagcgattgcttcctaaagttgtgggacctgaatcagaaggaatgccggaataccatgttcggacacactaactcagttaaccattgtcggttttctcccgatgataagttgcttgcctcttgcagcgccgacggtaccctcaagctgtgggatgccacttccgccaatgaacgcaagtccattaacgtcaagcagtttttcctaaatttagaggatcctcaagaggatatggaggtgattgtcaaatgctgtagctggagtgccgatggtgcaaggattatggtcgctgccaaaaacaagatctttctgtggaacacagattcacgatccaaggtggcagactgccgaggccatttgtcttgggtccacggcgtgatgttttcacctgacggatcctccttcctcacctccagcgacgatcagacaattcgcctctgggagactaagaaggtgtgcaagaacagtgccgtgatgctgaagcaggaagtggatgtcgtcttccaagaaaacgaagtcatggtgctggccgttgatcacatccggcggctccaactgattaatggacgcacaggtcagattgactacctgacagaggcccaggtgagctgctgttgcttgtctccgcacttacaatacatagcatttggcgatgaaaacggcgctatcgagatcctggagctggtgaataataggatctttcaatctcggttccagcataaaaagaccgtctggcacatccaatttaccgccgatgaaaagacactcatatcgtccagtgacgacgccgaaatccaggtgtggaattggcaacttgacaagtgtatctttctcagaggtcaccaggaaacagtcaaagatttccggctgcttaaaaatagcaggctactctcatggagttttgatggtacggtgaaggtttggaacataatcaccggcaacaaggaaaaggactttgtttgtcatcagggaacagtcctgagctgcgacatttctcacgacgccacaaaattttcctccacttctgccgacaagactgctaagatttggtccttcgaccttctactgcccttacatgagctccgaggacacaatggctgtgtgaggtgctctgcttttagcgtggactccacattgttagctaccggtgatgataatggcgaaatccgcatctggaacgtgtctaatggcgagctgctccacctgtgcgctccactgtccgaagagggagctgccacacatggcggctgggtcacagacttatgtttttccccggatgggaagatgcttatatctgccggggggtacatcaagtggtggaatgtggtcacaggcgagtcttctcagaccttctacaccaatggaaccaacctcaagaagatccacgtttcaccagactttaaaacctacgtaaccgttgataatcttggaatcctttacattctgcagacactggagtag

SEQ ID NO: 22840 - DNA, 3492 bp, Artificial Sequence
  Description of Artificial Sequence: Synthetic coding sequence
atggacgccaaggcccggaactgcctgctgcagcaccgggaggccctggaaaaggacatcaaaacgtcatatattatggaccatatgatttctgacggcttcctcacaatcagtgaggaggaaaaggtgcggaacgagcctacacagcagcagcgggccgccatgctgatcaagatgatcttaaagaaggacaacgactcttacgtaagcttttataacgctctcttgcacgaaggctacaaagatcttgcggccctgctccatgacggaattccagtcgtcagcagctcaagcgggaaggacagcgtttctgggattacgtcttacgtcagaactgtgctgtgcgaaggaggtgtcccccaacgcccggtggtgtttgtgactcgtaagaaactggtcaacgccattcagcaaaagctgtcaaaacttaaaggggagcccggctgggtaacaatccacggcatggcaggttgcgggaaatccgttctggccgccgaggctgtgcgagatcactccttactggagggctgcttcccgggaggagtgcattgggtgtcggttgggaaacaggataagagtggcttgctcatgaaattgcagaatctgtgtacccggctggaccaggatgaatcatttagccaaaggctgccgctgaatatcgaggaggcgaaggatcgactgcggattctgatgctccgcaaacatccaagatcactccttattttggacgacgtctgggactcttgggtgctcaaagccttcgactcccaatgccagattctgctgacaacccgtgacaagtctgtcactgacagcgtgatgggccctaaatatgttgtcccggtggaaagctcacttggtaaagagaagggcttggagatccttagcctgttcgtgaatatgaaaaaagccgatttgcctgaacaggcgcatagtataatcaaagagtgtaaaggatctccgctggtggtcagtcttatcggcgccctcctgcgggatttcccgaacaggtgggaatattatcttaagcagctgcagaataagcagttcaaacggatcagaaaatcctcttcttatgattacgaggcactggatgaggcaatgtccatctctgtcgagatgttacgcgaagacattaaagattactacacagatttgagcatcttgcagaaggacgtgaaggtgcctaccaaggtgttgtgcatattgtgggatatggagaccgaagaagtcgaggatattctgcaggaattcgtgaataaaagcctcctgttttgcgatcgtaacggtaaaagttttagatactatttacacgatctgcaggtagactttttaaccgaaaagaactgcagtcagctccaagacctgcataagaagattatcactcaatttcagagatatcaccagccccacaccctgagccccgatcaggaggactgtatgtactggtacaacttcctcgcctatcacatggcaagtgccaagatgcataaagaactgtgcgcactgatgttcagcctcgactggattaaagcaaagactgaactggtaggacctgcccacttgatacacgagttcgtggaatacagacacattctcgacgagaaggactgcgccgtgagtgaaaactttcaggaatttctctcgcttaatggccaccttctcggaagacagccgtttcctaatatcgtgcagctgggcttgtgcgaacccgagacgagtgaagtctaccaacaggccaaactccaggcaaaacaagaggtagataatggcatgctttacctggaatggatcaataagaagaatatcactaacctctcacgacttgtggtccggccccatacagatgctgtatatcacgcctgtttctcagaagacgggcagcgcatcgcgagctgcggcgcagacaaaacgctgcaggtgtttaaggcagagactggcgaaaaactgctggaaattaaagcccatgaggacgaagtgttatgttgtgccttcagcaccgatgatagattcattgcgacttgtagtgtggataagaaggtgaagatctggaattcaatgactggcgaactggtccatacctacgacgagcactcggagcaggtgaattgctgccacttcaccaatagcagtcatcatctgttgctggcaacggggtcctccgactgtttcctgaaactgtgggacctcaaccagaaggagtgtcgcaacacaatgttcggccatacaaatagcgtgaaccattgtcgcttttctcctgacgacaaactcctagcttcatgctcagcagacggaaccctgaaactttgggatgccacatcagcaaacgaaagaaaaagtatcaatgtgaaacagttttttttaaacttagaggaccctcaggaagacatggaggtgattgtaaagtgttgttcttggtctgccgacggcgcacggattatggtggccgccaagaataagatattcctgtggaatactgattcacgatccaaagttgccgattgccgaggacatttgtcgtgggttcacggtgttatgttttccccggacggtagctcgtttctgacctcgagcgacgaccagacgattaggctatgggaaaccaaaaaagtctgcaaaaattctgctgtcatgctgaaacaggaagtagacgtggtgttccaagaaaacgaggtcatggtgttggccgtagatcacattagacgtctccagctcataaatggccgaacagggcaaatcgattacctgacagaggcccaggtgtcttgctgttgcctgagtccacatttgcagtatatcgcttttggggatgaaaacggcgcaattgaaattctcgagttagtgaataaccgcatcttccagtctcggttccaacacaaaaaaacagtttggcacatccagttcactgctgacgagaagacattgattagtagctccgacgacgcggagattcaagtgtggaattggcagctggataaatgcatatttctaaggggccaccaggagacagtcaaagatttccgtctgttgaagaactcacgactcctgtcttggtcgttcgacggcaccgttaaggtttggaatatcataactggaaacaaggagaaggattttgtctgccaccaaggaacagtgctctcctgcgatattagtcacgacgctaccaagttttcttccaccagcgctgataaaaccgctaagatttggaatgtctccaacggcgaactgcttcacttatgtgccccgctgtctgaagagggcgccgctacacatggcggttgggttacagacctctgtttctcccccgatggaaaaatgctaatctccgcaggcggctatatcaagtggtggaatgtggtcactggagaaagttcacagaccttctacacgaacgggacgaatctgaagaaaatacacgtctccccggacttcaagacctatgtcaccgttgataacctcggcattctgtatattctgcaaaccttagaatag

SEQ ID NO: 22841 - DNA, 3714 bp, Artificial Sequence
  Description of Artificial Sequence: Synthetic coding sequence
atggacgccaaggcccggaactgcctgctgcagcaccgggaggccctggaaaaagacatcaagactagctatataatggaccacatgattagtgacggatttttaacaatatccgaggaggaaaaagttagaaacgaacccacccagcagcagcgagctgctatgttgatcaaaatgatactcaaaaaagacaatgactcctacgtttcattttataacgccctgctccacgagggttataaggatctggctgcccttctgcatgacggtattccagtcgtgtcttcgtcttctgtcaggactgtgttgtgcgagggcggggtaccacaaagacccgtcgtgttcgtgacgaggaagaagttagtcaacgccattcaacagaaactgtccaaattaaaaggggagccaggttgggtgaccattcacgggatggcaggctgtgggaagtctgtgttggcagcagaagctgttcgtgatcatagcctgttagaaggttgtttccccggaggggtgcattgggtcagtgtgggaaaacaggacaagtctggactcttgatgaagctgcagaacctatgcacgaggttagatcaagatgagtcattctcccagagattgccattaaatattgaggaggccaaagataggctccgcatccttatgctgcgcaagcacccccggtcactgctcatcttagatgacgtatgggactcctgggtgctgaaagcctttgactctcaatgtcagatactcctgactacccgagacaaatccgtgactgatagtgtgatggggcccaagtacgtggtacctgtcgaatcctccctggggaaagagaagggattggaaatcttgtctttattcgtgaacatgaagaaggccgacctgcccgaacaggcgcactccattattaaagaatgcaaaggaagccccctggtcgtaagcctcataggcgctctgctgcgggatttcccaaacaggtgggagtactacctgaagcagctgcagaacaaacagtttaagaggatcagaaagagctccagttatgattatgaggcccttgacgaggccatgtccatctcagtggaaatgctgagggaggatatcaaggactattacaccgacctgagtattctgcagaaggatgttaaggtgcctaccaaggtgctgtgcattctttgggatatggagactgaggaagttgaggacatcctccaggagtttgtgaataagagtctgctcttctgtgatagaaacgggaagagctttcggtactaccttcacgatctgcaggtggactttctgacggaaaaaaactgcagccagctccaggacctccataaaaaaattataacccaattccagcgctaccatcagccgcacacactttctcccgaccaagaagattgcatgtattggtacaatttcctcgcctaccacatggcctcagccaaaatgcacaaggagctgtgtgccctgatgttttcactggactggatcaaggctaaaactgagctggttggaccggcacacctgatccatgagtttgttgagtacaggcacatccttgacgaaaaagattgcgccgttagcgagaactttcaggagttcctttctctgaacggccatcttttggggaggcagccttttccgaatatagtccagttggggctgtgtgaacccgagacgtccgaggtgtaccaacaagctaagcttcaggcgaagcaggaggtggataacggcatgctgtacctggaatggatcaataagaagaacataaccaatctgtctcggctggtggtgaggccacataccgatgccgtgtaccatgcctgtttttctgaagacggccagcggatagcctcatgcggagccgacaagaccctgcaagtgtttaaggccgaaactggggagaaacttctggaaatcaaagctcacgaagatgaggtcttgtgctgtgcattctctactgacgaccgcttcattgcgacatgttccgtcgataagaaagtgaagatctggaattcaatgaccggggagttagtgcacacttatgacgagcacagcgagcaggtcaattgctgccattttacgaattccagtcatcacctgctgcttgcaaccggaagttccgattgtttcctcaagttgtgggacctgaatcaaaaggagtgccgaaatactatgttcggacatacaaactcggtaaaccactgtaggtttagcccagacgacaagctgctggcctcctgctcagcggatgggactctgaagctatgggacgctacctccgccaatgagagaaagtcgatcaatgtgaaacagttttttttaaatctcgaagacccacaggaggacatggaagtgatcgtgaagtgctgtagctggtccgccgatggagctagaattatggtggccgctaagaacaagatcttcctgtttgatattcacacctccggcctgcttggcgagattcatacaggacaccactccacgatccagtattgtgatttcagcccccagaaccatttggcggtggtggccttatctcagtattgtgttgagctctggaacaccgactcccgatctaaggtcgccgattgccgcggacatctgtcttgggtgcatggcgtgatgttctctcctgatggctcttctttcctgacttcttccgacgatcagaccatcagactatgggaaacaaaaaaggtatgtaagaatagcgccgttatgctgaagcaggaagtcgatgtcgtcttccaggaaaacgaggtgatggtgcttgcggtggatcatatccgaaggctgcagctgattaacggtcggactgggcagattgattatctcactgaagcccaggtgtcttgctgttgcctgtcaccccacctgcagtacattgccttcggtgacgagaacggagccatcgagatcctggagctcgttaacaaccgtatcttccagtcccgcttccagcacaaaaagacagtgtggcacattcagttcaccgctgacgagaaaactctcatttcctccagcgacgacgccgaaatccaagtctggaattggcagctcgacaagtgcattttcctgcgaggacatcaggaaaccgttaaggatttcaggttattgaaaaactcccggctgctgtcgtggagcttcgacggtaccgtaaaagtgtggaacattatcaccggcaacaaagaaaaggacttcgtctgtcaccagggcacagtcttaagttgcgacatttcccacgacgcaaccaagttcagttccactagcgcagacaagactgccaaaatttggagtttcgatctcttactgccactgcacgaactgcggggacataatggttgtgttcggtgctcggctttcagcgtggacagcaccttgttagcgactggcgatgataacggcgaaattcggatttggaacgtttcaaacggggaattgctccatctgtgcgcaccattgagtgaggaaggggctgcaacgcacggcggctgggtgaccgatctttgcttctcaccagacggcaagatgctcattagtgccggcggatacattaagtggtggaacgttgttaccggtgagtcctcgcagaccttttatacaaacggaaccaacctaaaaaaaatccacgtcagtccagatttcaagacctatgttacagtggacaatcttggaattctgtacattctgcagaccctcgagtag

SEQ ID NO: 22842 - DNA, 3747 bp, Artificial Sequence
  Description of Artificial Sequence: Synthetic coding sequence
atggacgccaaggcccggaactgcctgctgcagcaccgggaggccctagaaaaggatattaagacctcctacatcatggatcacatgatttccgatggctttctgacaatctcagaggaggaaaaggtgcgcaacgagcccacccaacaacagagagcagcgatgttgattaagatgatcctaaagaaagacaacgatagctacgtgagtttctacaatgccttattacacgaaggatataaggacctagccgcgcttttgcatgacggaatcccagtggtgtccagcagtagcggcaaggattcagtgtctggcataacgtcctacgtgcgaacagtcctatgcgaggggggggtcccccagcgcccagtcgtttttgtcactcgaaaaaagttagtgaacgctattcaacagaaattaagcaagttgaagggcgaaccaggctgggtcacgatacatggtatggccgggtgtggcaaaagtgtcctagcagccgaggccgttcgggaccactcccttctcgagggatgcttccccgggggtgtccattgggtttcagtgggcaagcaggacaagtccgggctgctgatgaaactgcagaacttatgcactaggctggatcaggacgagtcatttagtcaaaggctgcccttaaacatagaggaggccaaagaccgcctgcgcattctgatgctgcggaagcacccccgctccctgctcattctcgatgacgtgtgggacagctgggtgctcaaggcattcgactcacaatgtcagatactgctaactactcgtgataagtcggttaccgattcagtgatgggacctaagtacgtggtgccagttgaatcgagtctgggaaaggaaaagggactggagattctatcattatttgtgaatatgaagaaagcggatctgccggagcaggctcatagcatcatcaaggagtgtaagggatcaccgctggttgtgtccctgatcggtgcactcctgcgggattttccaaacaggtgggaatactacctgaaacagctccagaacaaacagttcaaaaggattcgaaagagctcttcctacgattacgaggccctggatgaagcaatgagcatatccgttgaaatgctgagggaggatatcaaagattactacacggatctgagcatcctacaaaaagatgtcaaagtgcccacaaaagtgctgtgcatactgtgggatatggaaaccgaggaggtggaagacattctgcaagaattcgtgaataagtccctgctgttctgcgaccgcaatggaaagtcctttaggtattacctccacgatctacaggttgatttcttgaccgagaagaattgcagccagttacaggacctgcacaaaaagattatcactcagttccagagataccaccagccacacactctgtctccagatcaagaggactgtatgtactggtacaatttcctcgcataccatatggcttccgcaaaaatgcacaaggagctctgtgccctgatgttttccctggactggattaaggccaagaccgaactggttggcccggctcatctcatacatgaatttgtcgagtacaggcacattcttgacgaaaaggactgcgccgtcagcgagaactttcaggaattcctaagcctcaacggccacctgctaggccggcagcctttccccaatatcgtgcagctgggactctgcgaaccagaaactagcgaagtgtatcaacaagctaaattgcaggccaagcaggaagtggataacggcatgctgtacctggaatggataaacaagaagaacattacaaatcttagtagattggtggtgcgtccccacaccgatgccgtctatcatgcctgcttcagtgaggacggccagagaatcgcctcttgtggggctgacaagacactgcaagtgttcaaggccgagactggagaaaagctccttgagatcaaggcccacgaagatgaagtgctgtgctgcgcattcagtaccgacgatagatttattgcaacatgcagcgttgacaagaaggtgaagatctggaatagcatgaccggcgaactagtgcatacgtatgacgaacattcagagcaggtaaactgctgccacttcacgaacagctcccaccatttgctcctcgcaactgggtcttcagactgtttcctgaagctgtgggacctgaaccagaaagaatgtcggaacaccatgttcggccataccaactcagttaatcattgtagattctcgcccgacgataagctgctggcatcttgctctgcagacggcaccttgaagctctgggatgctacctctgccaatgaacggaagtcaatcaatgttaaacagtttttcctgaaccttgaggacccacaggaggacatggaggtgattgtgaaatgctgcagttggagtgcagacggcgctagaatcatggttgcagccaagaacaaaatatttctcttcgacatccacacctccggcctcctgggcgaaattcacactggccaccacagtaccattcagtattgtgacttctcaccgcaaaatcacttggcagtggtcgcactctcacagtattgcgtggaattgtggaatacggatagccgatccaaggtggctgattgccgtggccacctaagctgggtgcacggagttatgtttagcccagatgggagctcatttcttacaagttcggacgatcagaccataagactatgggaaacaaagaaagtatgcaaaaatagcgccgttatgctgaagcaagaagtggatgtggtgtttcaggaaaacgaggtcatggtactcgcggtcgaccatattcggcgcctccagctcattaatgggagaacaggacagatagactatctaaccgaggcccaggtcagctgctgttgtttgtctccccacctgcagtacatcgccttcggggacgaaaacggggccattgaaattttggagctggtcaataatagaattttccagagcagattccagcacaaaaagaccgtatggcatatccaatttactgcagacgagaagaccctcatctcctctagtgatgatgctgagatccaggtgtggaactggcagctcgataagtgcatcttcctgcggggacaccaggaaacagtcaaggacttcagactgctgaaaaactccaggttgttgtcctggagctttgatggtaccgtgaaagtgtggaatatcatcacgggaaacaaggaaaaggactttgtgtgtcaccagggaactgtgttatcatgtgacatctcccatgatgccactaagttcagttccacgtctgccgacaaaacagccaagatctggagcttcgacctcttgttaccgctgcacgagcttcgcggtcataacgggtgcgtcaggtgttccgccttctctgtcgatagtactcttctcgccacaggggatgataatggtgaaatccggatctggaacgtatcaaatggagaacttttacatctatgtgcccccctttccgaggagggtgccgccacccacggcggttgggttactgacttgtgcttcagccccgacggaaaaatgctgatttcggctggaggctatatcaagtggtggaacgttgtaactggcgaatcatcccagaccttttacactaacggcacaaacctgaaaaagatccatgtttctcccgactttaaaacctacgttaccgtcgacaacctgggtattttatacatcttgcagactcttgaatag

SEQ ID NO: 22843 - DNA, 1017 bp, Artificial Sequence
  Description of Artificial Sequence: Synthetic coding sequence
atggacgccaaggcccggaactgcctgctgcagcaccgggaggcccttgagaaggatattaagacatcctatatcatggaccacatgatcagcgatggatttttaaccataagcgaagaagaaaaggtcaggaatgaaccaacccagcaacaaagggcagccatgctcattaagatgatcttgaagaaggacaacgattcttacgtctccttctataatgcgttactgcatgaaggatacaaggatttagccgccctcctgcacgatggaattcctgtcgtttccagtagctccggaaaagacagcgtgtccggtataacgtcctacgtgcggactgtgctgtgtgagggtggcgtcccacagcggcccgttgtctttgtgacccggaaaaaacttgtcaatgcgatacagcaaaagctcagtaaactcaaaggtgagcctgggtgggtgacgattcatggtatggcagggtgcgggaaaagcgtactcgcggcagaagcagtacgcgaccattctcttctggaaggctgttttcctggcggtgtccattgggtgagcgtgggtaaacaggataagtctggactcctaatgaagttgcaaaatctgtgcaccagactggaccaggatgagagtttctcacaacggctgcctctgaacatcgaagaggctaaggatcgactaagaattctgatgttgcgcaagcatcctcggagcctcctgatcctggacgatgtttgggactcatgggtgctgaaggcattcgatagccaatgccaaatcctgttaaccacaagggacaagagcgtgaccgattccgtgatgggcccgaaatacgtcgtcccagtggagtcaagtctggggaaagagaaaggcctcgagatcttgtcactgtttgtaaacatgaaaaaggccgatctaccggagcaggcccattccattatcaaggaatgcaaagtggttgaacgctgtcactggggtatactgactgatctcctgcacaagtggaatcagagctag

SEQ ID NO: 22844 - DNA, 2025 bp, Artificial Sequence
  Description of Artificial Sequence: Synthetic coding sequence
atgcccagctacaccgtgaccgtggccaccggcagccagtggttcgcagggaccgatgattatatatatctgagcttggtgggatccgccggatgctccgaaaagcatctccttgataagccattctacaatgactttgaaaggggagccgtcgactcctatgacgtgacagtcgacgaagaactgggcgaaatccaactggtccgaatcgaaaagcgcaagtattggctgaatgatgattggtatctcaagtacattaccctcaagactccccatggcgattatattgaatttccgtgctatagatggattactggggacgtcgaagtagtgctgcgtgacgggcgagcaaagctcgctagggacgatcagattcacatactcaagcagcaccgcagaaaagagcttgagacaagacagaaacagtacagatggatggaatggaatccaggttttccactgagcattgatgcaaagtgccataaggaccttcctcgagacattcaattcgattccgaaaagggtgtggattttgtcttgaactacagtaaggccatggaaaatctgttcataaaccggtttatgcatatgtttcagtcctcatggaatgatttcgccgactttgaaaaaattttcgtcaagataagcaacactattagcgaaagagtgatgaatcactggcaggaggacctaatgtttggctatcagttcctgaacggatgcaatccagtgcttatccgcaggtgcaccgagctccccgagaagttgcccgtgacgaccgaaatggtggaatgctctctcgaacggcaactgagcctggagcaggaggtgcagcaaggaaatatctttatcgtggacttcgagttactagatggcatagacgccaataagacagatccatgtactttgcagtttctggctgcgcctatctgtttgttgtacaaaaatcttgctaataagattgttccgatcgcaatccagttaaaccagatccctggggatgagaacccaatattcctgcctagcgacgccaagtatgactggctgctggccaaaatttgggtcagatcttccgactttcatgtgcatcagaccattactcacctgctgaggactcacttggtgtccgaggtgtttggcattgctatgtacaggcaactacccgctgtgcacccaatttttaaacttctggtcgcacatgtcagattcacgattgctataaacaccaaagctagagagcagcttatctgtgagtgcggactatttgataaggcaaatgcgactggtggcggagggcacgtgcaaatggttcagagggccatgaaggacctgacctacgctagtttatgctttcctgaggcaattaaagcccgcggcatggaatcaaaggaggacatcccatactacttctatagggatgacggcctgctcgtttgggaggccattcggacgttcacggcagaggtcgtcgatatatactacgaaggcgaccaggtagttgaggaagatcctgagctgcaggatttcgttaatgacgtatacgtttacggcatgcggggacgaaaatccagcgggtttcctaaatcagtcaagtcccgggagcaattgtctgagtacttgaccgtagtgatctttactgcatctgcacaacatgccgcagtgaattttgggcagtatgattggtgctcatggatccccaatgctcctcctaccatgcgggcccctcccccaacagccaagggcgtggttaccatagaacagattgtagatacactgccagaccgaggtcgttcatgctggcaccttggtgcagtgtgggcactttcacagttccaggagaacgaactgttcctgggcatgtaccctgaagaacatttcatcgaaaaaccagttaaggaagcgatggctcggtttagaaagaatctggaagcgatcgtctcagttatagcagaacgtaacaagaagaaacagctcccctactactacctgagtccggatagaatccctaactccgtagcaatctag

SEQ ID NO: 22845 - DNA, 1854 bp, Artificial Sequence
  Description of Artificial Sequence: Synthetic coding sequence
atgcccagctacaccgtgaccgtggccaccggcagccagtggttcgctggcaccgatgactacatctacttgtcactggtcggcagcgctggatgcagtgaaaagcatctgcttgataagccattttacaacgatttcgagagaggtgccgtggatagctatgatgttaccgtggacgaggagctgggcgagatccagctggtccgcattgagaaacggaagtactggctcaatgacgactggtatctgaagtatatcacactcaagacgccccacggcgattatatcgagtttccctgttatagatggattaccggggacgtggaggtagtactccgcgatggtagggctaagctagcccgagacgatcaaatccatatcctgaaacagcaccgacgaaaggaattagagactagacagaaacagtatagatggatggagtggaatcccggcttccctttgtccatagacgctaagtgccacaaggatctgcctcgtgatatccagtttgattctgaaaaaggtgtcgatttcgtcctaaactactcaaaagccatggaaaacctctttatcaacaggttcatgcatatgtttcagtcctcctggaatgatttcgctgattttgagaaaatattcgtgaagattagcaacaccatttcggagagggtaatgaaccattggcaggaagacttgatgttcgggtaccagttccttaacggttgcaatcccgttctaattaggaggtgcactgaattgcccgagaagcttccagtgacaaccgagatggtggagtgctcacttgagcggcaactgtccctggagcaggaagtgcagcagggtaatatatttatagtggactttgaactgctggacggtattgatgccaacaagacagacccctgcacattgcagttcctcgcggcgcccatatgtttgctctacaagaatttagccaacaaaatcgtgcctatcgcaatccagctgaaccaaatacctggagacgagaacccaatattcttaccaagcgatgccaagtacgattggctgctagccaaaatctgggtgcggagttctgatttccacgtgcaccagaccattacacatttgctgagaacccaccttgtgagcgaggtttttggcatcgcaatgtatcgacagctcccagcagttcatccgatttttaagttactcgtggcccacgtgcggttcaccatcgccattaatactaaggctcgggaacagctgatatgtgaatgcggcctcttcgacaaagctaatgccacaggcggcggcggccatgtccagatggtccagagagctatgaaggatctgacatacgcttccctgtgctttcctgaggcaattaaggctcggggcatggaatctaaggaggatattccctattacttctaccgcgacgacggcttactggtctgggaagctattcgcaccttcacggcagaggtggtcgacatttattatgaaggagaccaggtggtggaggaagatcccgagctgcaggatttcgtgaatgatgtctacgtttacggtatgcgcggccggaagtccagtggttttcccaaatcagtgaagagtcgggagcagctgagtgaatatctcaccgtggttatttttacagcaagcgctcagcatgccgctgtgaatttcggccagctgtttttaggtatgtatccagaggagcacttcattgaaaagcctgtgaaggaagcaatggccaggttcagaaagaatttggaagcaattgtttccgtgatcgctgagcggaacaaaaagaagcagctcccctactattacctgtctccagaccgcatccctaacagtgtggcaatctag

SEQ ID NO: 22846 - DNA, 2511 bp, Artificial Sequence
  Description of Artificial Sequence: Synthetic coding sequence
atgcacgcccagcggcagttcgtggtggccgccgtgcgggccgaggtgcgtcgccacgaagtggcaaagcaggctcttaaccggttgcggaagctcgcagagcgggtggacgatcccgaactgcaggactcaatacaggctagtttggatagcattagagaagctgtcattaactcacaggaatggactctctccagaagcattcccgagctccgtctgggggtacttggggatgctcgctccgggaagtcctctcttattcacagattcttaaccggtagttatcaagtcctagaaaagacagaatccgaacagtacaagaaagaaatgctggttgatggccagacacatctcgtgctgatcagagaagaagccggagcgcctgacgctaaattttcaggctgggctgacgctgtgattttcgtgttttcgctcgaggatgaaaacagcttccaggccgtgtctcggcttcacggtcaactctcttccttaagaggggaaggccggggagggctggcactggccctggttggaacccaggacaggatcagtgcgtcctcgccaagagtggtgggcgacgcgcgcgctagagccctctgcgccgatatgaaacgctgctcttactacgagacttgtgccacttacggccttaatgtcgacagagtgtttcaggaggtggcacaaaaggttgtaacactccggaagcaacagcaactgctggcggcctgtaaaagtttgccgagcagtccgtcacactctgcggcttcgacgccagtggccgggcaggcaagtaatggcggacacacatctgactattcctcatcacttccctcttccccaaatgtgggtcacagggagctgcgcgcggaagctgcagcagtagcaggcttgtctacccctggttccctacaccgggctgcaaaaagacgcacctcactcttcgccaataggagaggctcagatagtgagaaacgctctctggattcacggggcgagacaacaggctcaggcagggcgatacccattaagcagagctttttactgaagaggagcggcaattccctcaacaaagaatggaaaaagaagtacgtcaccttgtccagtaatggatttttactgtatcacccgtcaatcaacgactatatccacagtactcacgggaaggagatggacctgctgaggaccaccgtaaaagtaccagggaagcgccccccccgggcgatttccgctttcggaccctctgcttcaattaacggccttgtaaaggacatgagcaccgtgcagatgggggaaggcttggaggccactacaccaatgcctagcccttcaccatcaccatccagtttacagcctccaccggatcagacgagtaagcacctcctaaagcctgatagaaatctggctagggctctgtccaccgactgtacaccctctggagacttatcccccctgtctcgggaaccaccccccagtccgatggttaaaaagcagcggcgtaaaaagcttactactcccagtaagaccgaaggcagcgcagggcaggctgaggaagaaaattttgaattccttatagtgagctctaccggccaaacctggcacttcgaggccgcatcgttcgaggaaagggatgcctgggttcaggctattgaatcgcagatactcgcttccctgcagtgttgcgaatcttcaaaagttaagctccggacagactcacagagcgaggccgtcgctatacaggcgatccgcaacgcaaagggcaattccatttgtgtggattgcggcgcccctaaccctacctgggcgtcattaaatctgggcgccctgatttgtatcgagtgttctgggattcacaggaatcttggtacgcatctgtcacgagtgagatcactggacctcgatgattggccccgagaactcacgctggtgttaaccgcgatagggaatgatactgcaaatagagtatgggagtcagacactcggggcagagcgaaaccgagcagggacagctctagggaggaacgcgaatcttggatccgggccaagtatgaacagctgctctttctagctcctctgagtacaagcgaggagcctttaggccgccagctttgggcagctgtacaggcacaggacgttgccacagttctactactcctggcgcacgccagacatggccctctggacacctccgtcgaggaccctcagctgcggtcacccctgcatttagccgctgaattggcccacgtggtgataacgcagctgttactatggtatggcgctgatgtcgccgctcgcgatgcacagggacgtacggccctcttttacgctcggcaggcagggtcacagctttgtgccgatatccttcttcagcacggatgccctggagaagggggatccgctgcaacaacccccagcgctgctacaactccttcaattacagccacaccatcaccccggagaagaagttccgcagcctcagttggaagggccgacgcccccgtagccctggtgtag

SEQ ID NO: 22847 - DNA, 3579 bp, Artificial Sequence
  Description of Artificial Sequence: Synthetic coding sequence
atgagccggggcgccggcgccctgcagcggcggaccaccacctaccttattagcttgacccttgtgaaattggagtctgtgccgcccccaccaccctccccttccgccgccgcagccggtgcagctggggcgagaggctccgagacaggagaccccgggagccccaggggagctgaggaacctggcaagaagcggcatgaacgtctgttccaccgtcaggacgccctgtggatctccaccagctccgctgggaccggaggggcagagcctcccgctttatctccagccccagcatcccccgcccgacctgtgtccccggcccccggaaggaggctgtcactctgggccgtcccaccaggcccacctctgtcaggggggttaagtccagatccaaaaccagggggcgcccccactagctcacggcggccgctgctatcctcaccctcatgggggggaccagagccagagggccgagccggcgggggaattcctggctcttcctcccctcacccaggtaccgggagcaggagactgaaagtggccccaccaccccccgcaccaaagccatgcaagactgtgaccaccagtggggcaaaagccggcggaggaaagggcgcagggtcaagactgtcatggccggagagtgaagggaaaccccgggtcaagggctctaagtcttcagctggaacaggcgcctccgtctccgcggctgctaccgctgccgctgcgggcggaggtggcagcaccgctagtacaagcgggggagtgggcgcaggggcgggtgctcggggcaagcttagccccagaaaaggaaaatcaaagacgctcgataacagcgatctgcaccctgggccccccgcgggctcccctccgcccctgaccctgccccccaccccatcccccgccacagctgtcaccgccgcctctgcccagccaccaggccccgctccccctataacccttgagccccctgctcctggactcaagagaggccgggaaggcggaagagccagcactagagataggaaaatgctgaagtttatcagcggcatcttcaccaagagtacgggtggcccccccggatcgggacctctgcccggccctcccagtttaagttcggggagtggaagccgggagctgctcggcgcggaactgagggcctctcctaaggcggtgattaacagccaggaatggactctcagtcgcagcatccccgagctgcgtctcggagtcctgggtgatgcgagatccggtaagagcagtctgattcatcggtttctcactggttcttaccaggtgctggaaaagacagagtcagagcagtacaagaaagagatgctagttgacggccagacacatctggtgcttattcgggaggaggccggcgcccccgatgcgaagttttctggctgggccgatgccgtcatttttgtattctcactagaagacgagaactccttccaggccgtgtctcgacttcatggacagttgtcaagccttaggggcgagggccgaggcggtctggccttggccctggtgggcacacaggacaggatatcagcttcctcccctagagtggtcggggatgcaagagcccgcgctctatgcgccgatatgaaaaggtgctcctattacgagacatgtgccacgtatggcttgaacgtagaccgtgtgtttcaggaagttgcccagaaggtcgtgactcttcggaagcagcaacaactcctggccgcctgtaaatctttgcctagttcaccatcccattccgctgcgagtaccccagttgcaggacaggccagcaatggcgggcacacatcagattacagttcatcactgccatcctcacctaatgtcgggcatagagaacttagggccgaggctgcagcagttgcaggcttatcaacgcccggctctctccacagggctgcaaagaggcgcacttccttgtttgccaaccggagaggatcagactcagaaaagaggagtcttgactcgcgaggagaaactaccggttcagggcgggcgattccgatcaaacagtcattcttgctgaaaaggtccgggaactctcttaataaggaatggaaaaagaaatacgttaccctctcctccaacggatttctactgtaccatccatccatcaacgactacatccacagcacccatggcaaagagatggatctactgcggacaactgttaaagttccgggtaaacgccctcctagggccatttccgccttcgggcctagtgcgtccataaacggcctggttaaagatatgagcacggtacagatgggagaaggtctggaggcaaccacgcccatgcctagcccctcgccttcccccagttcattgcagccaccacccgaccagacctccaagcatctccttaagcctgacagaaatctagcgagggccctgtccactgattgtacacccagtggcgatctctccccattaagcagggaacctcccccatcccccatggtcaaaaagcaacgacgcaagaagctgacaacacccagtaagactgaagggtccgccggtcaagccgaggccaagagaaaaatgtggaagctcaaatcttttggctcgctgcgaaatatttacaaagcagaggaaaatttcgagttcctgatcgtcagtagtaccggtcagacctggcactttgaggctgcatcatttgaagaacgcgatgcctgggtgcaggccatagagtcccagatcctggccagtctgcagtgttgcgaatcctcaaaagtaaagcttaggacagacagccagtctgaggctgttgccatccaggcgatcaggaacgcaaagggcaactctatatgcgtggattgcggagcgcctaacccaacatgggcatccctgaatttaggtgctctgatatgcatcgaatgttcaggcattcatcgaaatctaggcactcacttaagtcgagttaggtctctggacctggacgattggccgcgggagctcactctggtgctcaccgctatcggtaatgatacagcgaaccgggtttgggaatcagacacaagaggacgggccaaaccaagtagggattcaagtcgtgaggagagagaaagttggatccgggcaaagtacgagcagttgctttttttggcccccctgagtacgtcggaagagccgttaggcagacagttgtgggccgcagtccaggctcaggatgttgctaccgtcctgctcctgctggcccacgcacggcacggacctttagatacctcagtggaggacccgcagctgagatccccgctgcacttggcagctgaattggcgcacgttgtgataacacagctgcttttgtggtacggcgcagacgtcgcagctcgggacgcccaaggccgcacagcactgttttacgcccgccaggcagggagtcagctgtgcgccgatatcctgctacagcatggctgcccaggggaaggcggttccgcggcaacgacacctagtgccgccacaactccatcgatcacagcaactcctagccctaggcggaggtcatcagctgctagcgtggggcgtgccgacgctccggtcgctctggtatag

SEQ ID NO: 22848 - DNA, 1185 bp, Artificial Sequence
  Description of Artificial Sequence: Synthetic coding sequence
atggacagccagggccggaaggtggtggtgtgcgacaacggcaccggtttcgttaaatgtgggtacgcagggtctaatttccctgaacacatcttccccgctctggtcgggagaccaatcataagatccaccacaaaagtgggcaatatagaaattaaagacttgatggtgggcgacgaggctagcgaactgagatccatgttggaggtgaactaccctatggaaaatggaatcgtaaggaactgggacgatatgaaacacctgtgggactacacattcggacctgagaaacttaacatcgacacccgtaactgcaaaatactgctcaccgagccgcccatgaatcccaccaagaatagggagaagatcgtggaggtcatgtttgaaacataccagttcagtggagtctatgttgccattcaggccgttctgactttatacgctcagggactcctcaccggtgtcgtggtggacagcggggacggcgtgacgcacatctgccccgtgtacgaggggttttccctcccacatctgacccgaagactggacattgcgggaagggatatcaccagataccttatcaaactgctgctgctacgaggatacgctttcaatcactctgccgactttgaaacagttcgtatgattaaggagaagctgtgttatgtcggctacaacatcgaacaggagcagaagctggctctggagacaactgtgttagtggagagctacactctgcctgacggccgtatcatcaaggtaggcggtgaacggttcgaagcaccagaagcactcttccagccacatcttatcaacgtggaaggagtgggtgttgcggagcttctgttcaataccatccaggctgcagatatcgacacccggtccgaattctataagcacatcgttctctcaggcggcagtacaatgtatccagggctcccctcccgactcgaacgcgaactgaaacagctgtatctggagagagttctgaagggagatgttgaaaaattaagcaagtttaagattagaattgaagatccaccccgccggaaacacatggtttttctcgggggagccgtgctagcagacattatgaaggacaaggacaacttttggatgaccaggcaggagtatcaggagaagggcgttcgagtcttagaaaaactgggggtgaccgtcagatag

SEQ ID NO: 22849 - DNA, 1200 bp, Artificial Sequence
  Description of Artificial Sequence: Synthetic coding sequence
atggacagccagggccggaaggtggtggtgtgcgacaacggcaccgggttcgttaagtgtggctatgccggctctaattttcctgagcatatttttcctgctctcgttgggaggccgattatacgatcaactaccaaggttggaaacatagagatcaagaataataaaaagatggatcttatggtcggagatgaggccagtgagttgcgttccatgttagaagtcaattaccccatggaaaatggtatcgtgaggaattgggatgatatgaaacacctgtgggactatacattcggccccgagaaactgaatatcgacactaggaattgcaagatactcctcaccgagccaccgatgaacccgacaaaaaatagagagaagattgtggaggtgatgtttgagacttatcaattcagcggcgtgtacgttgctattcaggctgtgctaactctatacgctcagggcctgctgaccggagttgtggtggactcaggcgatggagttacgcacatatgtccagtgtacgagggattctcgctgccacatcttacacggcgactcgacattgccgggagggatataacgcggtatctaatcaagctgctactgcttaggggatatgcctttaatcatagcgccgattttgaaacagtgagaatgatcaaagagaaactgtgctatgttggttataatatagaacaggaacaaaaattggcattagaaactaccgtgttagtggaatcctacacgctgccagatgggcggataattaaggtgggcggcgaacgcttcgaagcgcctgaggcccttttccaaccccatttgattaatgtggaaggcgtgggggtggcagagctgctgtttaatacgattcaggcggccgacattgataccaggtcagagttttataagcatattgtgttgagcggcggctctaccatgtacccaggcttaccttcccggctggagagagagctcaagcagctctacttggagagagtgcttaaaggagacgttgagaagctgagcaagtttaaaatccgcatagaggaccctccccgtaggaagcacatggtgttccttgggggtgcagtactggccgacatcatgaaggacaaggataacttctggatgacgcggcaggagtatcaggagaagggagttagggtgttagaaaaacttggagtgacggtccgttag

SEQ ID NO: 22850 - DNA, 1020 bp, Artificial Sequence
  Description of Artificial Sequence: Synthetic coding sequence
atggtgggcgacgaggccagcgagctgcggagcatgctggaggtgaactatccaatggagaacggcatagtgcggaactgggatgacatgaaacatttgtgggattatactttcgggcctgaaaaactgaacatcgatactaggaattgcaaaattctactgacggagccacccatgaatcccaccaagaatagggagaaaatcgtggaggtgatgtttgagacctaccaatttagcggcgtgtatgtggcaattcaggctgtgctgactctctatgcccaggggcttttgaccggtgtggtggttgacagcggcgacggagtgacacatatttgccccgtgtatgagggttttagtctgcctcatcttacccggcgcttagacatcgccgggagagatatcacgaggtatctcatcaaactgctgctcctaagaggatatgcatttaaccactctgcagactttgagacagtgcggatgatcaaggaaaaactgtgttacgtgggttacaatatcgagcaggagcagaaactcgccctggaaaccactgttttggttgagtcatatactttgcctgacggccggatcataaaggtaggcggcgaacggtttgaagcccccgaggctctcttccaaccccacttaatcaacgtggagggagtgggcgtagccgagctgctctttaatactatccaggcagccgacatcgacaccaggagcgagttttacaagcatatcgtgctctcgggtggcagcacgatgtaccccggcctgccttctcgactggaacgcgagctcaaacagttatacctggagagagtgctgaaaggagatgtcgagaagttatcaaaattcaaaatcaggatcgaggatcctccccgcaggaaacatatggtgtttctaggaggtgcggtcttggctgacattatgaaagataaggataacttttggatgactcgacaggaataccaggagaagggtgtgcgggtccttgaaaaactgggcgtgactgtcaggtag

SEQ ID NO: 22851 - DNA, 918 bp, Artificial Sequence
  Description of Artificial Sequence: Synthetic coding sequence
atggtgggcgacgaggccagcgagctgcggagcatgctggaggtgaactaccccatggagaacggcattgtgcgtaattgggacgatatgaaacacctgtgggactacacctttggcccggaaaaactgaatattgatacccgaaattgtaagattttattgacagagcctccgatgaaccctaccaaaaatcgggaaaagatagtagaggtgatgttcgagacctaccaattctctggagtgtatgtggctatccaggccgtcctgactttgtatgcacagggattgttgacaggcgtagtagtcgactccggggacggagtgactcacatttgcccagtttacgaaggattctcacttcctcatttgacaaggcgtctagatatcgccggtagggatatcacgaggtatctcatcaaactactcttactgcgcgggtacgcatttaatcactcagccgatttcgagacagtacggatgataaaggaaaaactgtgctatgtgggctataacatcgaacaggaacagaaacttgcactggaaacaaccgtgcttgtggagtcctacactcttccggatggcagaatcattaaggtcggaggggaacgcttcgaagctcctgaagccctgttccagcctcacttgatcaatgttgagggcgtgggcgtcgccgagctgttgttcaacactatacaggccgccgacatcgatacaaggagcgagttttacaagcacatcgtcctgagcggggggtccacaatgtacccagggcttccctctaggctggaacgtgaactcaagcaactgtatttggagagagtgcttaagggcgacgtggagaaactttccgtcagcatctctaagagcacgatcactaacattttactcaaaggttacaccgtcgtatgtgaaagttag

SEQ ID NO: 22852 - DNA, 1257 bp, Artificial Sequence
  Description of Artificial Sequence: Synthetic coding sequence
atggccggccggctgcccgcctgcgtggtggactgcggcaccggctacactaagctaggatatgcaggcaataccgaaccccagttcataatcccatcatgtattgccatcaaggagagcgctaaggtgggagatcaggcccagcgtcgagtaatgaaaggtgttgatgatttggacttctttatcggggacgaagccatagagaaacctacctatgctactaaatggcctattcgccacggcattgttgaggattgggacttgatggaaagatttatggagcaggttatctttaaatacctgcgcgccgagccagaggaccactattttttacttactgagcctcccctgaacactcccgagaacagggaatacactgccgagattatgtttgaatctttcaacgtgcccggcctgtacattgcagtccaggcggtgcttgccctagctgcaagttggacctcccgccaggtgggcgagaggacattgacgggcaccgtgatcgatagcggggatggcgtcacgcacgttatacctgtggcagaaggctacgtgatcggaagctgcatcaaacacattcccattgccgggagagacattacctattttatccagcaattgctccgggatagagaggtgggtatacctccagagcagagtctggagactgccaaagctgtaaaggagagatactcatacgtttgtccagacttagttaaggaattcaacaagtacgataccgatgggtccaaatggataaagcaatacacagggatcaacgccatctctaaaaaggaattttctatagatgtcggatacgaacggttcctagggcccgaaatatttttccacccggagtttgcaaatcctgactttacccagccaatttctgaggtggtggacgaagtgattcagaactgccccatcgacgtccggagaccgctatacaagaacattgttctttccggcggctctaccatgtttcgggactttggtaggcgcctacaaagagatctgaagcgtactgtggatgcccggctgaaactctcagaggaactttccgggggtaggctgaagccaaagcccattgatgttcaggtgatcacccaccacatgcagaggtatgcagtatggttcggaggcagcatgctagcctctacccctgaattttaccaggtgtgtcacaccaagaaagactacgaagaaatcgggccaagtatttgcagacacaacccagtcttcggagtgatgtcctag

SEQ ID NO: 22853 - DNA, 1104 bp, Artificial Sequence
  Description of Artificial Sequence: Synthetic coding sequence
atgaagggcgtggacgacctggacttcttcatcggcgacgaggccattgagaaacccacgtatgctactaagtggccgataagacacggaatcgttgaagattgggacctgatggagagattcatggagcaggttatctttaaatatcttagggccgaaccagaagaccactactttctgctgacagaaccacccctgaatacacctgaaaaccgagaatacacggcggaaataatgttcgagtccttcaacgtccctggactctatattgccgtgcaggccgtgctggcacttgctgcctcctggactagcaggcaggtgggggaacgcaccttgacaggcaccgttatcgatagtggagatggggtgacccacgtgatccctgttgccgaaggctacgttatcggaagttgcattaaacacatacccattgctggtcgggacataacttattttatccagcagctgttgcgagacagggaagttgggattccacccgagcagagtttggagactgctaaagccgttaaagagcgttatagctacgtgtgtcctgacctggtcaaggaatttaataagtatgacacagatggatctaagtggataaagcaatatacaggtatcaatgccatcagcaagaaagaatttagtatcgatgtggggtacgagagattcctaggcccggagatattctttcatccagaatttgccaatcctgattttactcagcccatttccgaggtcgtcgacgaggtgatccagaattgtccaatagatgtcaggagacctctctacaagaatattgttctgagcgggggatccacaatgttcagggactttggtcggcggttgcaacgtgatttaaaacggaccgtggatgcacggctgaaactgtctgaggaactgtccggcggacggctcaagccaaaaccaattgacgtgcaggtgataactcaccatatgcagcgctatgccgtatggtttggaggctcaatgctggcgtccacacccgagttttatcaggtatgtcacacaaagaaagattacgaggaaattggccccagcatctgtagacataatcccgtgttcggcgtgatgtcatag

SEQ ID NO: 22854 - DNA, 1071 bp, Artificial Sequence
  Description of Artificial Sequence: Synthetic coding sequence
atgctggagatccagaaccacagcctgagcagcctgccctggcccatccggcacggtattgtggaagactgggacctaatggaacgatttatggaacaggtgatcttcaaataccttagggccgagcctgaagaccattactttttacttaccgagcctccattgaacactcccgagaatagagaatacaccgccgagatcatgttcgaaagctttaatgttcctggtctctatatcgcagtccaggccgttctggccctggctgccagttggacctctcgccaggttggagagagaactctcactggcaccgtgatcgactccggagacggtgtcacccatgtgatccctgtggccgagggatacgtgattggatcatgtatcaaacacatcccaatcgccgggcgggacatcacctacttcattcagcagcttttgcgcgatcgcgaggtcggcatacccccagaacagagcttggaaacagcaaaggccgtaaaggagaggtactcctatgtctgtcccgatctggtcaaggaattcaataagtacgacaccgacggaagcaaatggataaagcaatatacaggaatcaacgcgatttctaagaaagagttttctatagacgtcggctatgagaggtttttaggccccgagattttcttccatcctgaattcgccaatccagatttcacccagcctatttcagaggtcgtcgacgaagtcatccagaactgcccaatcgacgttaggaggcctctatataagaacattgtactttccggaggatccactatgttcagggatttcggtaggagattacagagggacctcaaaagaactgtagatgcccggcttaagctgagtgaagaactgagcggaggacgtctgaagcccaagcccatcgacgtgcaggtgatcacccatcacatgcaacgatacgcagtgtggtttggggggagtatgttggcatccacccctgaattttaccaggtctgtcacaccaagaaggattacgaggagattggcccctcaatttgtagacacaatcccgtgttcggcgtcatgagctag

SEQ ID NO: 22855 - DNA, 870 bp, Artificial Sequence
  Description of Artificial Sequence: Synthetic coding sequence
atgttcgagagcttcaacgtgcccggcctgtacatcgccgtgcaggctgtactggctcttgcagctagttggacctcccggcaggttggtgaaagaaccctgactgggactgtcatagacagtggtgacggtgttacgcacgtaattcctgtggctgagggctatgtcatcggctcctgtatcaaacacatcccgatagccggacgagatatcacttactttatccagcagttgctacgagacagggaagttggcatcccccccgaacagagtctggaaacagcaaaggccgttaaggagcggtattcttacgtctgtcccgacctggtaaaggaattcaacaaatacgacacagatggctctaagtggattaaacagtacacagggattaatgctatctcaaaaaaagagtttagcatcgatgtgggatatgagaggtttcttggtccagaaatcttcttccatcctgaattcgccaaccctgatttcacccagccaatctcggaagttgtggacgaggtaatccagaattgccctattgacgtgcggcgacccctgtacaagaacattgttttatcaggaggtagcactatgttccgcgattttggacggcggttacaaagggatctgaagcgtaccgtggatgcacgactgaagctgagtgaggagctgtcaggagggagactgaaacccaaaccaatcgacgtgcaggtcattacacaccatatgcagagatatgcagtgtggttcggtggatctatgcttgccagcacacccgagttctatcaggtatgtcatactaaaaaggactatgaagaaattggcccatcaatctgtagacataatcccgttttcggggttatgtcctag

SEQ ID NO: 22856 - DNA, 1749 bp, Artificial Sequence
  Description of Artificial Sequence: Synthetic coding sequence
atcgacatcgagagcatggacaccgacaaggacgacccccacggccgactggaatacacagagcaccaaggcagaatcaagaacgctagagaagcacactctcagattgaaaagaggcggagggacaagatgaatagttttattgacgagttagcatccctggtacccacgtgtaacgcgatgagccgcaagctcgataagttaacagtgttgaggatggccgtgcagcatatgaagactctgcggggcgccaccaatccgtataccgaggcaaattataagcccactttcctgtccgacgacgagctgaagcatcttattctccgtgccgccgatggcttcctgtttgtggttgggtgcgacagaggcaagatcttattcgtcagtgagagcgtgttcaagattctgaactacagccagaacgatttaatcgggcagtctctatttgactacctgcaccccaaagatatcgctaaggtcaaagagcagctatctagcagcgatacagctcctcgcgagaggctgatagatgccaaaactggactccccgtcaagactgatataacacccggaccctctaggttgtgctcaggagcccgccgtagctttttctgtagaatgaaatgtaataggccatccgtgaaggtggaggataaggacttcccctcaacatgcagcaaaaagaaggctgaccgtaaatcattttgcactatacatagtaccgggtacctcaaatcatggcctccaaccaagatggggctggatgaggacaatgaaccggacaatgaaggttgtaatctgagttgcctggtggcaattggacgcttacactcacacgtggtaccccagccggtgaacggggagatacgagtgaagagcatggagtacgtctctcgacatgcaatagatgggaagtttgtctttgttgatcagcgcgcaaccgctattctggcgtatttaccccaggagctcctgggtactagctgctatgagtatttccatcaagacgatattggccaccttgccgagtgccatcgacaagtactgcagactagagagaagatcaccacaaattgctataagttcaagattaaagatgggtcttttataactctcagatcaaggtggttcagcttcatgaacccatggactaaggaggtggaatacatagtgagtacgaatacggtcgttcttgccaatgtgctagaaggaggagaccccaccttccctcaactcacagccagcccacattccatggattcaatgctgccctccggggagggcgggcccaaaaggactcacccaaccgtgccgggaatccccgggggcacccgcgctggagccggcaaaattggtcgcatgattgcagaggagatcatggagatccaccgcattagaggctccagccctagctcatgcgggtcctcacctttgaatataaccagcacccccccgcccgatgcttcaagtcctggaggtaagaagattttaaatggcgggacaccagacattccctccagcggattgctctccggccaggcccaggaaaatcctggctatccctactctgactcgtctagcatcctaggagaaaaccctcatatcgggatcgatatgattgacaacgaccagggttcgagtagcccttctaacgacgaggcggcaatggccgttataatgtcattgctcgaagctgacgccggcctgggcggacctgttgacttctcggatctgccatggccgctttag

SEQ ID NO: 22857 - DNA, 1527 bp, Artificial Sequence
  Description of Artificial Sequence: Synthetic coding sequence
atggccgaccagcggatggacatcagcagcaccatcagcgacttcatgtctcccggtccaaccgatttgttatcctctagcctcggtacctcaggtgtggactgcaaccgaaagcgaaaaggctcttctaccgactatcaggagagtatggatacagataaggatgacccccacggcaggctggaatacaccgaacaccagggacggatcaaaaacgcccgagaagcccacagtcagattgagaaaaggcgccgggacaaaatgaacagttttatagatgaactcgcttctctagtcccaacttgcaatgccatgtcccgtaaactggataagctgactgtgctgagaatggcggtgcagcacatgaaaacactccgtggagccactaatccatacaccgaggctaactataaacccaccttcttaagcgacgatgaactcaagcacctgatccttcgggccgccgatggctttctcttcgtggtcgggtgtgatcgaggtaagatcctcttcgtttctgaatctgtgttcaagattctcaactactcccaaaacgaccttatcggccagtcactgttcgactatctccaccccaaggacatcgccaaagtcaaggagcaactgtcgagtagtgacactgccccccgggaaagacttatcgacgctaagaccgggcttccagtgaaaaccgacattacaccaggcccctctaggctgtgtagtggggcgcggcgtagttttttctgtagaatgaaatgcaatagaccatccgtcaaggtagaggataaagattttccctcaacctgctcaaagaagaaagttctgcagactcgcgagaagatcactaccaactgttacaagtttaagataaaagacgggagttttataaccttacgctcccgttggttctcctttatgaacccttggacaaaggaggttgagtatatcgtgtccaccaatacagtggtcctggccaatgtcttggagggaggagaccccaccttcccgcagctcacggctagcccccactccatggactctatgttgccttccggcgagggcggacctaagaggactcaccccacagtgcccggaatacccgggggcacaagagcaggcgctggaaaaatcggacgcatgatagcagaggaaatcatggaaatccacagaataaggggctccagcccgtcatcctgcgggtctagtcctctgaatatcacctctacccctcctcccgatgccagttccccaggcggaaaaaaaattctcaacggaggaacccccgacatcccaagttctggcctgctgtctggacaggctcaggagaaccctggctacccctactctgacagctcgagtatcctgggtgagaatccccacatcggaatagacatgatcgacaacgatcagggctcctctagtccctctaatgacgaggcagccatggctgttatcatgtctctcctggaggcggatgcgggcctgggcgggccagtggacttctcagatttaccttggccactttag

SEQ ID NO: 22858 - DNA, 1878 bp, Artificial Sequence
  Description of Artificial Sequence: Synthetic coding sequence
atggccgaccagcggatggacatcagcagcaccatcagcgacttcatgtcccctggccccacagatttattgagttcaagcctgggcacatctggggtagactgtaacaggaaacgcaagggatcctctactgattatcaagaaagtatggatactgataaagacgacccacacggccgattagaatatactgagcaccaaggtcgcataaagaatgcacgggaggcacacagccagatcgagaaacgccgccgggacaagatgaattcctttatcgacgaattggccagcctcgtgcccacgtgcaatgcaatgagtcgaaaactcgacaaattaacggtgctgcgcatggcagtccagcacatgaagacgctgaggggtgctacaaacccatataccgaggccaactacaaacctaccttccttagcgatgacgagctgaaacacttgattctgcgcgccgctgatggatttttgttcgtggtgggctgtgatcggggcaaaattctgttcgtgagcgaatccgtcttcaaaatcttgaactacagccagaacgatttaattggtcagagtctgttcgactacttacatccgaaggatatcgctaaagtaaaggagcagctctcttccagtgataccgcaccacgagagaggttgatagacgcaaaaactggactccccgtgaagacagatatcacgcccggaccgtcccggctgtgttctggtgccaggcgaagttttttttgccgcatgaagtgtaacagaccttccgtgaaggttgaggacaaagacttcccttcaacatgcagcaagaagaaggacagaaaaagtttctgtacaattcattctacgggatacctcaagagctggcctccaacaaagatgggcctcgacgaagacaacgagcctgataatgaggggtgtaacctgagctgcttggtcgctatcgggcggctgcatagccacgtagtgccacaacccgttaatggtgaaatccgtgttaaatcaatggaatatgttagccgccacgctatcgatggcaaatttgtgttcgtggaccaaagggccacggctatattggcatacctcccccaggaattgctaggcaccagttgctatgagtactttcaccaggacgacataggtcacctagccgagtgtcatagacaggtgctgcagacccgtgaaaaaatcacaactaattgttacaagttcaagatcaaggacggaagttttatcactctgcggtcaaggtggttttcctttatgaacccatggacgaaagaagtcgagtacattgtgagcacaaacactgttgtgttggcgaacgttcttgagggcggggacccgacttttccccagcttactgcctcacctcattccatggactccatgcttccgagtggggagggtgggcctaagcgaacccatcctacggtgcctgggattcctggtggcactagagctggtgcggggaaaattgggcgaatgatcgccgaagaaatcatggagattcatagaatccggggcagttcaccctcctcatgtggaagcagtcctcttaacatcacatcaacgcctcctccagatgctagtagtccaggcggtaaaaaaattctaaacggcggtaccccagacattccgtcttccggccttctttctgggcaagctcaagaaaacccgggctacccatactccgatagctccagcatcctgggagagaatccacacatcggcatcgatatgatagacaacgatcagggttccagctcccccagcaatgacgaggccgccatggctgtgatcatgtcattattggaggctgacgctggccttgggggcccagtggatttcagcgatctcccctggccgctttag

SEQ ID NO: 22859 - DNA, 1581 bp, Artificial Sequence
  Description of Artificial Sequence: Synthetic coding sequence
atggccgaccagcggatggacatcagcagcaccatcagcgacttcatgtctcctggtccaactgatcttttgtcttcaagtctggggacctccggcgtggactgtaatcgtaagcgcaaagggtccagtaccgactatcaagaaagcatggatacagacaaggatgaccctcacgggagactcgaatataccgagcaccagggcaggataaagaacgctcgtgaggctcatagtcagatcgaaaagcggagacgggacaagatgaactcattcattgatgagctggccagcttggtgcctacatgcaacgcaatgtccagaaaacttgacaagctgactgttctaaggatggcggttcagcacatgaaaactttgcggggggcaaccaatccgtacactgaagctaattacaagccaacctttctctccgacgatgagctaaagcacctaatactccgcgcagctgatggattcctgttcgtagtcggctgcgacagaggaaaaatcctatttgttagtgagtctgtatttaagatcttgaactactcacaaaatgacctcatcggtcaatccctctttgattatctgcaccctaaggatatagccaaggtcaaagaacagctgtccagcagtgacactgcccctagggagaggcttattgacgcaaagacaggacttcccgttaaaaccgacatcacacctggcccaagcaggctgtgttcaggtgctcgcagatctttcttctgtcggatgaagtgcaataggccctcagtgaaggtggaggacaaggacttcccttcaacatgctctaaaaagaaggccgataggaagtctttttgcacaattcactctacaggttatctgaagagctggccccctaccaagatgggcctcgatgaggacaatgaacccgataacgaagggtgcaacctcagctgcctcgtggctattgggaggctacatagccatgtggtcccccagcccgtgaatggcgaaatcagagtcaaatcaatggagtacgtgtcgcggcatgcgatcgacgggaagtttgtgttcgtggaccagagggctaccgcgattctcgcgtacctgcctcaggaacttctgggtacctcttgttatgagtacttccatcaggatgacattggccatctcgccgagtgccacaggcaggtgctgcagactcgggagaagataaccactaattgttataagtttaagatcaaggacggctcattcattacacttcgttcaaggtggttcagtttcatgaatccttggacaaaagaggttgaatacatagtttccacaaacaccgttgttttgtccagagttgatacagggcatttgggccaggtggaatggtgtaccgtactctcaaggccagactccaggtttctcatcgcagggatgtttacagaacccacctcctggaaagccgggacacagcccagtcatagctctcaacaccctcctaccgcctggaccgcctgctgtcccctggaaaaagtggcccaacgcggacctaccccgctgtttcaggggttccagggcgagcccggcttaggtcaggagaaatag

SEQ ID NO: 22860 - DNA, 1878 bp, Artificial Sequence
  Description of Artificial Sequence: Synthetic coding sequence
atggccgaccagcggatggacatcagcagcaccatcagcgacttcatgtcacccgggcccacagacttgctctctagcagcctggggacttctggagtggattgtaaccgtaagcgcaaggggtctagtacagattaccaggagtctatggacacagacaaggatgacccgcatggcaggctggagtacaccgaacatcagggccggatcaaaaatgcacgggaggcccatagccagatcgagaagaggaggagggacaagatgaattccttcatcgacgagctcgcctctttggtgccgacctgcaatgccatgtctagaaagctggataagctgaccgtgctccgaatggcagtccagcacatgaagacgcttaggggcgctactaacccatataccgaagctaattataaacctacgttcttaagcgatgatgagctgaagcacctgattttgagggccgctgacggttttctgttcgtggtggggtgtgatcggggtaagatcctgttcgtgtctgagtctgtgttcaagatccttaactattcccagaatgatctcattggacagagtctgttcgattatctgcaccctaaagatattgcaaaagttaaggagcagttgtcaagttctgatacagctccacgggagcgccttattgatgccaaaacgggattgccagtaaagacagatatcacccccggaccatcacgactgtgctcaggcgcacgtcggtctttcttctgccggatgaagtgtaacagaccctccgtaaaagtcgaggataaggatttcccgtcaacgtgtagtaaaaaaaaagatcgcaagtccttctgcaccatccatagtactggctacctcaaatcatggccgcctacaaagatggggctggacgaagataacgagccagacaacgaaggctgcaatctgtcttgtttggtcgcgattggacggttgcactctcatgttgtgccacagccagtcaatggagagatcagagtcaaaagcatggaatacgtgagtagacacgccatcgatggcaagttcgtgttcgtggaccagcgggcaactgccattcttgcctacctaccgcaagaattattagggacttcgtgctatgaatactttcaccaggacgacatagggcacctggctgaatgccataggcaggtgctgcagacacgcgagaagatcaccacgaactgttataagtttaaaataaaagatggcagctttatcaccctcagaagccggtggttctcatttatgaacccttggacaaaggaggtggaatacattgtgagtaccaatactgtcgttctggctaacgtgctggaggggggcgaccccacgtttcctcagctcactgccagcccacactccatggacagcatgctgccaagtggggagggcggccccaagcggactcacccgacggtgccggggatccctggcggcacgagagccggcgccggcaaaatcggtaggatgatcgcagaagagattatggagatccataggattcgagggtcatccccctcctcttgtggatcatccccattgaatatcacttcaactccaccacctgacgcatcatcccccgggggaaagaaaatacttaacgggggaacaccggacatcccttcttcgggcttgctgagcggccaagcccaggaaaaccccggctatccgtatagcgattctagcagtatcttgggggaaaaccctcatatcgggattgatatgatagataacgatcagggaagtagctccccatctaacgacgaagctgcgatggcagtgatcatgtctctcttagaggcagatgcagggctcggtggcccagtagacttctccgacctgccatggccactgtag

SEQ ID NO: 22861 - DNA, 1752 bp, Artificial Sequence
  Description of Artificial Sequence: Synthetic coding sequence
atgatcaacatcgagagcatggacaccgacaaggacgacccccacgggcggttagaatatactgagcatcaaggacggattaaaaacgcgcgcgaagcccactctcagatcgaaaagaggcggagagacaagatgaatagcttcatcgatgaactggcttctctggtgcccacctgcaatgccatgtcccgcaagctggacaaactcaccgtgcttcgcatggctgttcaacacatgaagaccttgcgaggtgcaacgaacccctacacagaggcgaattacaagcctacctttcttagcgatgatgagctcaagcatctgatcctgagggccgccgacggattcctgttcgtagtaggctgcgataggggaaagatcctgttcgtgagcgaatctgtgtttaagatcttgaactacagccagaatgatttaatagggcagagcctgtttgactacctccacccgaaggatatcgctaaggtcaaggagcaactttcttcttcagacaccgcgccgcgagaaagactgatcgacgccaaaacaggtctgccggtgaaaacggatattaccccaggcccttcgcgtctttgtagcggggcccgaaggtctttcttctgtcgaatgaagtgtaaccggccttccgtgaaagtggaagacaaggactttccatcaacatgcagcaagaaaaaggctgatcgtaaaagtttttgtactattcactccacaggatatctgaagtcatggcccccaactaaaatgggcctagatgaagataacgagcctgataatgagggttgtaacctgagttgtctcgttgcaatcgggcgcctccacagccacgtggtacctcagcccgtcaatggggagatccgcgttaaatccatggaatacgttagtcgccatgctatcgatggtaagttcgtttttgtggaccagcgcgctacagccattctagcttatctaccacaggagctgcttggcaccagttgttacgagtatttccaccaggacgatattgggcatctcgctgaatgtcacaggcaggtattgcagacacgggaaaagatcaccacaaattgctataagtttaaaatcaaggatgggtccttcataacactgaggtctcgctggttcagcttcatgaatccatggacaaaagaggtcgaatatattgtttctacgaatacagtggtactggcgaacgttctggaaggaggtgaccccaccttcccacaattgaccgcctcccctcactccatggactcgatgctgcctagcggcgagggggggccaaaacggactcatccaactgtgccaggcatcccaggcggcaccagagccggagcgggtaaaattggccgaatgattgcagaggagattatggagattcatagaataagaggatctagtccgtctagctgtggctcttctcccttgaatataacctccacaccacccccagatgcctcatcccctggaggcaaaaagattctcaatggtggaacacctgacataccgtccagtgggttattatccggacaggcccaggagaatccagggtatccatactctgacagttccagtatattgggcgagaacccccatatcggcattgatatgattgacaacgatcagggctctagctcaccctcgaacgatgaagccgccatggccgtgatcatgtcgcttctggaggccgatgccgggctggggggacctgtggattttagcgacctgccgtggcccctgtag

SEQ ID NO: 22862 - DNA, 1881 bp, Artificial Sequence
  Description of Artificial Sequence: Synthetic coding sequence
atggccgaccagcggatggacatcagcagcaccatcagcgacttcatgagtccaggacctaccgatctcctgagtagtagcctcggaacttccggggtggactgcaaccgcaagagaaaagggtccagcaccgattaccaggagagcatggatactgacaaggatgacccccatggccgtctggagtacacagagcatcaaggtagaatcaagaatgctagggaagcgcattcccagattgagaagcgcaggcgtgacaagatgaatagcttcatagacgagctggcctcactcgtccccacctgtaatgcaatgagtcgaaaactggataaattgaccgtcctccgcatggccgtccagcatatgaagaccctgcggggcgcaacaaacccctacacggaggctaattataaaccgaccttcctaagcgacgacgagctgaagcatttgattctgcgcgccgccgatggcttcctgtttgtcgtgggatgtgaccgcgggaaaatcttgttcgtgtccgagtctgtgttcaaaattcttaattactcccaaaatgacttaatcggccaaagtttatttgactacctccaccctaaggacattgccaaggtgaaagagcaactgtcgagcagtgacacagcccccagggaacggctcattgacgctaaaacaggactgccagttaaaactgatatcaccccgggaccttctagactatgttctggagcccgtagaagtttcttctgtaggatgaaatgtaataggcccagtgtgaaggttgaagacaaggactttccgtccacttgcagtaaaaagaaggctgaccgaaagagtttttgtacaatccatagcaccgggtatctaaagagctggccacccaccaagatgggcctcgacgaggataatgagcccgacaacgaagggtgtaacctatcctgcctggtcgccatcggcaggctacattctcatgttgtgccacagcctgtaaatggggaaatccgggttaaatccatggagtacgtcagtagacacgctatcgacgggaaattcgttttcgtcgatcaaagggctactgctattctggcttacctcccccaggaactcttagggaccagctgctatgagtacttccaccaagatgatatcggacatctagcagagtgccacagacaagtcctccagacccgtgagaagattaccactaattgctataagtttaaaatcaaagacggatctttcatcaccctgcgttctaggtggtttagctttatgaacccctggaccaaggaagttgagtatattgtttccacaaatactgtagtattggcgaacgtgctggagggtggcgatccgactttccctcagctcacagcgtcaccacacagcatggacagcatgcttcccagcggcgagggaggcccgaaaaggacacaccccacggttcctggaatacccgggggaacacgcgctggggctggaaagatcggccgaatgatagcagaggaaatcatggagatacaccgaatcaggggtagctccccaagttcgtgtgggagctcccccctgaacattacttctacaccacctcccgacgccagttcgcctggaggcaaaaagatactcaatgggggcacacctgatattccctcttctggcttactctctggtcaggcacaggaaaaccctggatatccttacagcgattccagctcgatcctgggcgagaatccacacattggcatcgatatgattgataacgatcagggatcttctagcccctccaacgatgaggccgccatggccgtgatcatgtccctgctggaggccgatgccggtctcgggggccccgttgacttttccgacctgccctggcccctttag

SEQ ID NO: 22863 - DNA, 1749 bp, Artificial Sequence
  Description of Artificial Sequence: Synthetic coding sequence
atgatcaacatcgagagcatggacaccgacaaggacgacccccacggtcgccttgaatataccgaacatcaaggcaggattaaaaacgctcgcgaagcccactcgcaaatagagaaacgccgaagggacaagatgaacagcttcattgacgagctcgccagcctggtacctacctgtaatgccatgtcacgtaaactcgacaagctgactgtgttgagaatggcagtgcaacatatgaagacgctgcgaggagccaccaacccatacacagaagctaattacaaaccaactttcctgtctgatgacgaattaaaacaccttattctgagagccgcagacgggtttctgttcgtcgtgggctgcgatagggggaagattctctttgtaagtgagagcgttttcaaaattttgaactatagtcagaatgacttgattggacagtccctttttgattatttgcaccccaaagacatcgcaaaggtgaaggagcagctgagcagtagtgatacagcacctagggaaaggcttattgatgccaaaaccggtctgccagtgaaaacagacattacccctggccccagtaggttgtgcagcggcgcacgacggagttttttctgcaggatgaagtgcaaccgcccctccgtgaaggtcgaggacaaagacttcccatctacctgttcaaagaaaaaagataggaaaagcttctgtactattcatagcactggctatctgaaatcgtggcctcccacaaagatgggccttgatgaggacaacgaacccgataatgagggctgtaatttgagttgcctggttgccataggacgactccactcccacgtcgtgcctcagcctgtaaacggagagatcagggtgaaaagtatggaatacgtgtccaggcatgcgattgacgggaagttcgtgttcgtggatcagcgcgcgaccgcaatattggcctacctcccccaggagcttcttggcacttcttgctatgaatactttcaccaggacgacatcggacacttagctgagtgtcaccgccaggtactgcaaaccagagaaaaaatcacaactaactgttacaagttcaaaattaaggacggcagcttcatcaccctccggtctcgatggttcagcttcatgaacccctggacaaaggaggtcgagtacatcgtgagcacaaataccgttgtcttggctaacgtgctagaaggcggagaccccaccttcccacagcttacagcttccccgcatagtatggactccatgctgccgagcggggagggcggaccaaagagaacccatcctactgttcccggcattcctgggggcaccagagcaggggccggaaagattgggaggatgatcgcagaagagattatggaaatccatcggatccgcggcagttcacccagttcgtgcggatcttctccactgaatatcacttccacgccccctcctgatgcctcgtcaccaggagggaagaagatcctgaacggcggcacccccgacataccgagttcaggcctcctgtccggtcaggcacaggagaatccaggctacccttatagtgatagtagctcaatcctaggcgagaacccccacataggcatagatatgattgataacgaccaagggtccagctcaccgtccaacgacgaagcagcgatggccgtcatcatgagtttactcgaggccgatgcgggattagggggtcccgtggatttctctgacctgccctggcctctgtag

SEQ ID NO: 22864 - DNA, 219 bp, Artificial Sequence
  Description of Artificial Sequence: Synthetic coding sequence
atgatcaacatcgagagcatggacaccgacaaggacgacccccacggtaggctggaatacacggagcaccagggccgcataaaaaacgcacgggaggcccactctcagatcgaaaagagaagaagggataagatgaactcatttatcgatgagctggcatctctggtgccgacctgcaatgccatgtcccggaagcttgacaagctcactgtgttgtag

SEQ ID NO: 22865 - DNA, 231 bp, Artificial Sequence
  Description of Artificial Sequence: Synthetic coding sequence
atggccgaccagcggatggacatcagcagcaccatcagcgacttcatgtcacctggaccaacagatctgctctcctcctcactcggtactagcggcgtcgactgtaaccgaaagcgaaagggctcttcaaccgactaccaagagagcatggatactgataaggacgaccctcatggccggttggagtataccgaacatcaagggcgtatcaaaaatgccagggaggcctag

SEQ ID NO: 22866 - DNA, 72 bp, Artificial Sequence
  Description of Artificial Sequence: Synthetic coding sequence
atggccgaccagcggatggacatcagcagcaccatcagcgacttcatgtcgccaggtccgactgacctttag

SEQ ID NO: 22867 - DNA, 408 bp, Artificial Sequence
  Description of Artificial Sequence: Synthetic coding sequence
atggccgaccagcggatggacatcagcagcaccatcagcgacttcatgagccccggaccaaccgacctgttgtccagctccctggggacaagtggagtcgattgtaatcgaaagcgcaaaggtagttcaactgattatcaggagtctatggatactgataaagacgatccccatggacgccttgaatacactgaacatcaggggaggatcaaaaacgcacgggaagctcatagccagattgaaaaacggaggcgggacaagatgaatagctttatcgatgagctggcatcactggtgccaacatgtaatgccatgagtcgtaagctggacaagctaacagtactccggatggcggtccagcatatgaagacattaaggggtgccaccaacccctatacggaggcttag

SEQ ID NO: 22868 - DNA, 141 bp, Artificial Sequence
  Description of Artificial Sequence: Synthetic coding sequence
atgatcaacatcgagagcatggacaccgacaaggacgacccccacgggagattagaatacactgagcaccagggccgaattaaaaacgcacgcgaggcacactcacagatcgaaaaacggcggagggacaagatgaattag

SEQ ID NO: 22869 - DNA, 426 bp, Artificial Sequence
  Description of Artificial Sequence: Synthetic coding sequence
atgatcaacatcgagagcatggacaccgacaaggacgacccccacggtcgtctagaatacactgagcaccagggaaggatcaaaaatgcgcgagaagcccacagccagattgagaagcgcagaagggacaagatgaacagtttcattgacgagctagcctcactggtccccacatgcaatgcaatgtctagaaaactagacaaattgaccgtcctgcgcatggctgtgcagcacatgaaaaccctcaggggcgcaactaacccatacacagaggccaattacaagccgactttcttgtcggacgacgaactgaaacatctgatcctgcgggccgctgatggattcctgtttgtggtcggatgtgatagaggaaaaatactgtttgtgtcagagagcgtgtttaagatacttaattactcacagtag

SEQ ID NO: 22870 - DNA, 306 bp, Artificial Sequence
  Description of Artificial Sequence: Synthetic coding sequence
atggccgaccagcggatggacatcagcagcaccatcagcgacttcatgtcccccgggcctacagatctgttgagttcctctttaggcacctccggcgtagactgcaataggaaacgcaaggggtcatccaccgattatcaggaaagcatggacacagacaaggatgacccacacggcagactcgagtacactgagcaccaggggaggattaaaaatgcacgggaggctcactcacagatcgagaagagacggcgtgacaaaatgaattcgtttattgatgaactagcatctctggtgccaacatag

SEQ ID NO: 22871 - DNA, 180 bp, Artificial Sequence
  Description of Artificial Sequence: Synthetic coding sequence
atggccgaccagcggatggacatcagcagcaccatcagcgacttcatgtctccgggtcctaccgatctcctcagtagcagcctcggcacctccggtgtggactgcaataggaaacgcaaagggtcctcaactgattaccaggaatccatggacacagataaggatgacccccatggttag

SEQ ID NO: 22872 - DNA, 1683 bp, Artificial Sequence
  Description of Artificial Sequence: Synthetic coding sequence
atggagcccctgcagcagcagcagcagcagcagcagcagcagcagaagcaacctcacctcgctccattacagatggacgcccgagagaagcaggggcagcagatgcgggaagcccagtttctgtacgctcagaaactcgtcacacaaccaacactgctgagcgccacggcaggaagaccttcagggtcaacccctcttgggcctttggccagggtacctcctacggccgctgtagctcaggtgtttgagcgcggaaacatgaattcagaacccgaggaggaggacggcggactagaagacgaggatggagatgacgaggtggctgaagtagctgaaaaggagactcaggctgcgtccaaatattttcacgtccagaaagtagcaagacaggatcccagagtggcacctatgtctaacctgcttccagctccagggttgccaccccacggtcaacaggccaaggaggaccacaccaaagacgcctcaaaggctagccctagcgtgagcacggccggccaaccaaattggaacctcgacgagcagttgaaacagaacggaggactggcatggtccgacgatgcggatggagggcgggggcgggagatatctcgcgatttcgctaagctgtacgaattagatggggatcctgaacgcaaagaattcctcgatgatctgttcgtctttatgcagaaaagaggcacccccataaaccgaatccccatcatggctaagcaaattctggatctgtacatgctttacaagttggtcacggagaagggaggcttagtggaaatcattaacaaaaaaatatggagggaaatcaccaaaggacttaatctccccacctccatcacaagtgccgcgttcacgctgcgaactcaatatatgaaatatctgtacgcctacgagtgcgaaaaaaaagctttaagtagtccagccgagctgcaggccgcaatcgatgggaatagacgcgaaggccggaggccatcatactcctcatcactctttggctacagtcccgcggccgctactgccgccgctgccgctggagctcctgcgttattgtctccaccgaaaatcaggttcccgatacttggccttgggtctagcagcggtacaaacacctcctcaccccgaatcagccctgcgacaacccttcgaaagggagacggggcccctgtaacaacagtgccagtccccaacagactggccgtaccagtcacactggcgtcccaacaagcaggtacgaggactgccgcattggaacaactgagagagcgtctcgagtcaggagagcctgctgagaagaaggcttcccgattgtccgaggaggagcagaggctggtgcaacaagccttccaaaggaatttcttcagtatggctcgccagctcccgatgaagatcagaattaacggtagggaggaccgcgccgaagcttcagcagccgccctcaatttaaccacctcctctatagggtccatcaatatgtccgtggacatagacgggaccacgtatgctggcgtgctgttcgctcagaagcccgtcgttcatctgattaccggctcagcacctcagagcctagggagctccgccagctcctcatcatcatcccattgtagtccaagcccaacttcctcaagggggacgccttcagctgaaccctctacctcttggagtctgtag

SEQ ID NO: 22873 - DNA, 1335 bp, Artificial Sequence
  Description of Artificial Sequence: Synthetic coding sequence
atggagcccctgcagcagcagcagcagcagcagcagcagcagcagaaacagccacatctggctcccctgcagatggacgctcgagaaaaacagggtcagcagatgagagaggcccaattcctttatgcccagaagctcgtgacccagccaactctgttgtcagctaccgcagggcggccgagtggttctacccctttagggcccctggcgagggtgccgcccactgccgcagtggcacaagtcttcgagaggggtaacatgaactctgaacccgaagaagaagacggcggactcgaggacgaagatggcgatgacgaggttgccgaggtggcggagaaggaaacacaggctgcctccaagtactttcatgtgcagaaagttgctcggcaggacccacgagtggcgcctatgagcaatctactcccagccccgggcttgccaccccatggtcaacaagcaaaagaagaccacaccaaggatgcttccaaagcatctccttccgtgagcacggctggacaacccaattggaacctggacgaacagctgaagcagaatgggggcctggcatggagcgatgatgcagacggcggaaggggcagggagatctctcgtgacttcgctaaactctacgagctggacggagacccggagcggaaggaattcctcgacgacctgttcgtgtttatgcaaaagagggggacacccataaacagaattcctatcatggccaaacagatcctggacttgtatatgttatacaaacttgtgaccgagaaaggcgggttagtggagatcatcaataaaaaaatttggcgggaaattaccaaaggcctgaacctgcctacgagcatcaccagcgctgcctttacgctgcgcacgcagtatatgaaatacctttacgcctacgagtgcgagaaaaaagcgctcagctcgcccgcggagctgcaagccgccattgatggtaatcggcgagaaggcagaagaccatcatactcatctagcttgttcggttacagccccgcagccgccactgccgccgcagctgctggcgctccagccttactgtctccccccaaaattaggttccctatcttgggcttgggcagcagttcaggtaccaacacgtccagccctcggatcagtcccgctacaacactgaggaaaggcgacggagctcctgtgaccaccgtacctgtccctaatcgactcgctgttcccgtgacactcgcctcacagcaggccgggaccaggaccgcagccttggagcaattaagagagagactggaaagtggtgaacccgccgagaaaaaagcatctggcacttggtgccagtag

SEQ ID NO: 22874 - DNA, 1413 bp, Artificial Sequence
  Description of Artificial Sequence: Synthetic coding sequence
atggagcccctgcagcagcagcagcagcagcagcagcagcagcagaaacagccgcatttggctcctctgcaaatggacgcaagagaaaagcagggccagcagatgagagaggcccagtttctgtacgcccagaaactggtgacccagcctactttgctgagtgctaccgcaggtcgaccttccggttccactcctctcggcccactggctcgcgtcccgccaaccgcagccgtagctcaggtgttcgagaggggcaatatgaacagcgaaccagaagaggaggatggggggctggaggacgaagatggggatgacgaagtggccgaagtcgctgaaaaggaaacacaagcggcttcaaagtattttcatgtccagaaggtggcacggcaggatccccgcgtcgcacccatgtctaatcttcttcctgcgccaggcctgcctccgcatggacagcaggctaaggaggatcacaccaaggatgccagtaaggcctcacccagcgtgtccaccgcaggccagccaaattggaacctcgacgaacagctgaagcagaacggcggcttggcttggtctgatgacgcggacgggggtagggggcgcgaaatcagccgtgactttgcaaaactgtacgaactagacggggaccctgaaaggaaggagtttttggatgacttgtttgttttcatgcaaaaaagagggactccaatcaatcgcattcccatcatggccaagcaaattcttgatttgtatatgctatacaagttggtgacagaaaagggggggctcgtggagatcattaataagaaaatttggagagaaattacaaaggggcttaatctacccacatccatcacttccgctgcttttaccttgcgcacgcagtatatgaaatatctttacgcttatgagtgtgagaaaaaggcgctgagtagtcctgccgagctccaggctgcaatcgacggaaatcggcgggagggacgcagacccagttattcttcatctctgttcgggtatagccctgccgcggccactgcagcagcagccgcaggggctcctgccctgttgtctccccctaagatccgcttccctatcctgggactgggcagcagttccggaactaacacttcctctcctcgtatcagtcccgccaccacgctgcgtaagggcgacggcgcaccagtaaccaccgtacccgttcccaataggctggccgtccctgtcactctagcttcacagcaggccgggaccagaactgccgccctggagcaacttcgggagagactcgagtctggggagcccgcggaaaagaaagcaagccgactgtcggaggaggagcagaggctggtccagcaggccttccagcggaatttcttttctatggccagacagctgtcaatcctctacgtgttctag

SEQ ID NO: 22875 - DNA, 7935 bp, Artificial Sequence
  Description of Artificial Sequence: Synthetic coding sequence
atgggcgagcacggcctggagctggccagcatgatccccgccctgcgggagttaggctccgcaacaccagaggagtacaatacggtggtccagaaacccaggcagatcctttgtcagttcatcgaccgcattctgaccgatgtgaatgtcgtcgctgtggagctggtgaagaagacagattctcagccgacgtccgtcatgctgctggatttcattcagcacattatgaaatcctcaccgttaatgttcgtgaacgtcagcggatcacacgaggctaagggctcttgcattgagtttagcaattggatcataactcgcttgctcaggatagctgccaccccctcctgccatctgctgcataagaagatctgcgaggtcatttgcagcttgctgtttctgttcaagtcaaagtctcctgcaattttcggcgtgttaaccaaagagcttttgcaactgtttgaggacctggtgtacttgcatcgcagaaacgttatgggtcacgccgtcgaatggccagtagtgatgagccgatttctgtcccagctagatgagcatatggggtatctgcagtcagcccctctgcagctgatgagcatgcagaacttggaatttatcgaagtgaccctgctaatggtgctcacgcggattatcgccatagttttctttagaaggcaggagttgctattgtggcaaattggatgcgtactgttagagtatggctcgccgaagatcaaaagcctcgccatcagttttcttacagaactgttccaactcggcgggctcccagcacagcccgcttctacattcttcagctcgtttctagagctcttaaagcatttagtggaaatggacaccgaccagctcaagctgtacgaggagccactctccaaactgataaagactttatttccttttgaggctgaagcctatcgaaacatcgagcccgtgtatctgaacatgcttctagagaaactttgtgtaatgtttgaggacggagtgttaatgagactaaaatctgacttacttaaggcagccctctgccacctcctccagtattttctcaagttcgtacccgccggctatgaaagtgctctccaggtacgtaaagtctatgtgcggaatatctgcaaggccctcctggatgtgttggggatcgaggttgacgccgaatatctcctggggccactgtacgctgctctgaagatggagtccatggaaattattgaagaaatacaatgccagacccaacaggaaaacctctcatcaaattccgacggcatctcaccaaagaggcggcgcctttcttcctccctaaacccaagtaagcgtgcacctaaacaaacagaagagataaagcacgtagacatgaatcagaagtccatcctgtggagcgctcttaaacaaaaggcagagagcctgcaaatatcactggaatactccgggctcaagaaccctgtgatcgaaatgctggaaggaatagcggtcgtccttcaactgacagctctgtgtacagtgcactgctctcatcagaatatgaactgtaggaccttcaaggactgtcagcacaaaagtaaaaagaaaccctctgtggtgatcacatggatgtccctcgacttctacacgaaggtactcaaatcctgcagatccctcctagaatctgttcagaagctggacctggaggccactatcgacaaagtagttaaaatctatgatgctctcatctacatgcaggttaactcaagcttcgaagatcacatactcgaggatctgtgtggaatgcttagcctgccctggatttactctcactctgatgacggctgcttgaaactcacaacctttgctgctaacctgctgacattaagctgtagaatctctgattcatattctcctcaggcccaaagcaggtgcgtcttccttttgactctttttccgcggcggatcttccttgagtggaggaccgccgtgtataactgggcactccagagctcacacgaagtgatcagggcctcttgtgtatctgggttttttatactgttacagcagcagaactcctgcaacagggttcccaagatactgattgataaggtcaaggatgactctgatattgtcaagaaagaattcgcctcaattcttggtcagttagtctgcacgttgcatgggatgttttacctcacaagctcccttaccgagccttttagcgagcacgggcatgtggacttgttctgtcgcaacctcaaagccacaagccagcatgaatgtagttctagccagctgaaagcctctgtctgtaaacccttcctgttcttgctgaagaagaagatcccctcgccagttaaactggcctttattgataacctgcaccacttgtgcaagcatctggactttagagaggacgagactgatgtgaaagccgtgcttgggaccctgctgaacctgatggaggaccctgataaggatgtgagagtggctttctccggaaacattaagcacatcctggagtccttagactctgaagatggattcattaaggagcttttcgtcctgcggatgaaggaagcttacactcatgctcaaatcagtagaaataatgaactaaaagacactctgatcttgactactggcgatatagggagagccgcaaaaggagacttggtcccctttgcgctcctgcaccttctgcattgtctcttgtccaaaagtgcctccgtgtctggcgctgcctacactgaaattagggcactagtggctgccaagtcagtcaaactgcagagctttttctcccagtacaaaaagcctatctgccagtttctcgttgaatctctccactcaagtcagatgacggcactcccgaacaccccctgccagaatgccgacgtacgaaaacaggacgtggctcatcagagagagatggcactcaataccctctctgagattgcgaacgtattcgacttcccggatcttaaccgttttttgaccagaactctgcaggtcctgctgcctgacttggctgcaaaagccagcccagctgctagcgcactcatccgcactttgggaaagcaactcaacgtcaatcgtcgcgagatactcattaacaattttaaatatattttctctcatttagtttgttcatgcagcaaagacgagctagaaagagctctgcactacctaaagaacgagacggagatcgaattggggtcacttcttcggcaagatttccaaggcctgcataatgaattactgctgcgcatcggcgaacactaccagcaggttttcaacggtctgtccattctggcctccttcgccagttcggacgatccataccagggccctcgcgacattatttcccctgagctgatggctgactacctgcagcccaaactcctggggatattggctttctttaatatgcagctcctgtcatccagcgtgggtattgaggataaaaaaatggcattgaattcactcatgtccctcatgaagctcatggggccgaaacacgtctccagtgtgcgtgtgaaaatgatgactactttgcgtacgggcctgcggtttaaagacgattttcccgaactttgctgcagagcttgggattgcttcgtgaggtgcttagaccatgcttgcctgggatcccttctctctcacgtcatcgtggcattgctgccactgatccatatccagccaaaggaaacagcagctatctttcattacctaatcatagagaatcgcgacgctgtccaggactttctgcatgagatttactttctgcccgaccacccggagttgaagaagattaaagctgtcctccaggagtatcgaaaggagacctcggaatcaactgacctgcaaactacactgcagctaagcatgaaagccattcagcatgaaaatgtggatgttcgcatccatgcattaacctctctgaaagagactttgtataaaaaccaagaaaaactgattaaatacgcaacagattcggaaacagtggaacccatcatcagccagctggtgaccgttttactcaaaggatgccaggacgccaactcacaggcgcgtttgttgtgcggagagtgtctgggagaactgggcgccattgatcccgggcgtttggactttagcacaaccgaaacacagggaaaggacttcacttttgtgacaggcgtagaagattccagtttcgcgtatgggttgcttatggagctcacgcgagcatatctcgcctatgcagataatagccgtgcccaggatagcgccgcctacgccatccaagaactgctgtctatatacgattgccgtgagatggaaaccaatggcccaggccatcagctgtggaggcgtttcccagagcacgtgcgcgagatacttgagccgcacttgaatacccggtacaaatccagtcaaaagagtactgactggagcggggtgaagaaacctatttacctctctaaattaggaagcaattttgccgagtggtctgctagctgggcaggctatttaattactaaagtcagacacgatctcgccagtaagatctttacctgctgttctatcatgatgaagcacgacttcaaagtcactatatacctactgccgcatatcctggtgtatgtactgctcggttgcaaccaggaggaccagcaggaagtctacgcagaaattatggcagtgctgaaacatgacgaccagcataccatcaatacccaggatattgccagtgatctgtgtcaactctccactcaaaccgtcttttccatgctggaccacttgacacaatgggctagacacaaattccaagctctgaaagcagagaagtgccctcatagtaagtctaatcgtaacaaagttgactccatggtctccaccgtggattatgaggactatcaatctgtgactagatttctggacctgattccacaggatactttagcagtggcttcttttcgctcaaaagcatataccagggcggtcatgcactttgagtctttcatcactgagaagaagcagaacatccaagagcatctggggttcctgcagaagctttacgctgccatgcatgaacccgacggagtggcaggggtatcagccattcgaaaagctgagccatcactcaaggaacagattctcgagcacgagtcattgggcctgttgagggatgccaccgcctgctacgaccgggcaatccagctagaaccagatcaaatcatccactatcacggggtggtcaagtctatgcttggtttgggtcagctgagcaccgtcatcacgcaggtaaatggtgtacatgccaataggagcgagtggaccgatgaactgaacacgtatagagtggaggcagcctggaagttgagtcagtgggatctggtggagaattacctcgccgctgacgggaaatcgacaacatggtcagtcagactcggacagctgctgttaagcgcaaagaagcgcgatataacagcattctacgatagtttgaagcttgttcgcgccgagcagattgttccgctgtctgcggcaagtttcgagaggggaagttatcaacgcggctatgagtacatcgtgaggctccacatgctgtgcgagctggagcactcgattaagccactcttccaacattcccctggggacagttcccaagaggattccctgaactgggtggcacggctcgagatgactcagaactcttatagggctaaagaacccatcctagctctcaggcgtgcattgttgtccctgaataagaggcccgattataacgagatggtgggtgaatgttggctgcagtctgcccgggtggcaaggaaggctggacatcaccagactgcgtataatgccctgttaaatgcgggagaatcaaggcttgccgaactgtatgtagagcgcgccaagtggctgtggtcaaaaggagatgtccaccaggctttgattgtgctccagaagggcgtcgagttatgttttcccgaaaacgagactcctcctgaagggaagaacatgctgatccatgggagagccatgctccttgtggggaggttcatggaggaaaccgccaacttcgaatccaacgccatcatgaaaaagtacaaagacgtgaccgcctgtctgcccgagtgggaggacgggcacttttacctggcaaagtattacgataagcttatgccaatggtgaccgacaacaagatggaaaaacaaggcgatctcatcaggtacatagttctgcattttggacgctcactccagtacgggaatcaatttatttaccaatcgatgccacggatgttaactttgtggctcgattatggcacaaaggcctacgaatgggaaaaagctggccggtccgatcgagtacagatgcggaacgaccttggcaaaattaataaggtcattaccgaacacaccaattacctggctccttatcagttcctcacagcattctcacaactcatcagtcgcatttgtcattcccacgatgaggtgttcgtggtgctaatggaaatcatagctaaagtgttcctagcctacccacagcaagccatgtggatgatgacggcagtgagtaaaagctcctaccccatgagggttaaccgatgcaaggagatcttgaacaaggctattcatatgaaaaagtccctggagaagttcgtgggtgacgctactcgcctgaccgataaacttttggaactgtgtaacaaacccgtggatgggagcagctcaactttgagcatgagtacacattttaaaatgctgaagaaactggtagaagaagcaaccttttccgagattctgatcccgctccagtccgtaatgatccccactttgccaagcatcctgggcactcacgcaaatcacgccagccatgaaccttttccaggtcactgggcctacattgcaggctttgatgacatggtggagatcctcgcttctctgcaaaaacctaagaaaataagcttgaagggcagtgacggaaagttctacattatgatgtgtaagccaaaggatgatctccggaaggattgtagactcatggaatttaattctctaatcaacaaatgcctgagaaaggacgccgagagccgcaggagagaactacatatccgaacttatgcagtcattccgttaaacgatgagtgcggcattattgaatgggtgaataataccgccggcctccggcccatactgaccaaattatataaagaaaagggggtgtatatgacaggaaaggaattgcgtcagtgcatgctgccaaaaagtgctgctctgtccgagaaacttaaggtttttcgagaattcctgttgccacgtcacccacccatatttcacgaatggttcctgcgaacattcccagatcccacatcctggtatagctctcgcagcgcatactgtaggtccacagccgtgatgtctatggttggttacatcctcggactcggggacagacacggggagaacatcctgtttgattctttaaccggagagtgtgtgcatgtggattttaactgcctgtttaataaaggagagacgtttgaggtgcccgaaatcgtgccatttcgcctaacccacaatatggtgaacggaatggggcccatgggcacagaggggttgtttcggcgagcatgtgaagttacaatgcggttaatgagggaccaaagggaaccactgatgtccgtcctgaaaacctttctccatgacccattggtggaatggtccaaacccgtgaagggacacagcaaggccccattgaacgagaccggagaggtggtcaacgagaaggcaaagacccatgtgttagacattgagcagcgactgcagggtgttataaagaccagaaacagagtgaccggactccctctttctattgagggacacgttcattacctaatccaggaggcaactgacgagaatctgttatgtcagatgtacctcggatggacaccttacatgtag

SEQ ID NO: 22876 - DNA, 7743 bp, Artificial Sequence
  Description of Artificial Sequence: Synthetic coding sequence
atgggcgagcacggcctggagctggccagcatgatccccgccctgcgagaactgggctccgcgacccccgaggaatacaatacggtggtgcaaaagccacggcagatcttatgtcaatttatcgaccgcatcctgacagatgtgaatgtggtggcggtcgaactggtgaagaagaccgacagccagccaacgagcgtgatgctcctggatttcattcagcacattatgaagtcttccccccttatgttcgtgaatgtcagtgggtcacacgaggcgaaggggagttgtatcgaattcagtaattggatcatcaccaggttgcttcgcatcgcagctacgcctagttgccaccttctgcataagaagatatgtgaagtcatttgtagtctcctattcttgtttaaaagcaagtctccggcaatctttggcgtgctgactaaggagctcctgcagctgtttgaggacttggtctatttgcataggcggaatgtaatgggacatgcggtcgagtggccagtggtaatgtctaggtttctgtcccaactggacgaacatatgggataccttcaatccgcaccgcttcagctcatgtccatgcagaacttagagtttattgaggtgaccttgctgatggtccttacaaggatcatcgcaatagtgttcttccggagacaggagctcttgttgtggcagattggttgcgtgctgttggaatatggcagccctaaaatcaagagcctggcaatatcgtttctcacagagctttttcagctaggggggctccccgctcagccagcttctactttttttagctcttttctagagctgttaaagcacttggtcgagatggacactgatcagttaaagctctacgaagagcctctctccaagctgatcaagacgctgttcccctttgaagccgaggcatatcgcaatattgagccagtgtatctgaacatgctcttggagaagctttgcgtcatgtttgaagatggcgtcctgatgcgcctgaaatctgaccttctgaaggccgctctttgtcacctcctccagtactttctgaaatttgtgcctgcagggtatgagtcagcactacaggtcagaaaagtgtacgttagaaatatctgcaaggctctgctcgacgtattggggatcgaggtggatgccgagtacctgctcggtccactgtacgcagcccttaagatggagagcatggaaatcattgaagagatccaatgtcaaactcaacaggagaatctttctagcaactccgatgggatcagccccaagaggcgaaggctctcatcgtcactcaacccatccaagcgggcaccaaagcagaccgaggatcgtaccttcaaagactgtcagcacaagtccaagaagaagccctcagttgtgattacctggatgtcattggatttttacacaaaagtgttgaagtcatgcagatctctcctggagtctgtccagaagttagatctggaggccaccatcgataaggtcgtgaaaatctacgacgcactgatatacatgcaagtgaactctagcttcgaagatcatatcttggaagacctgtgtgggatgctgtcactgccatggatttattctcattccgacgatggttgtctgaaactcaccacattcgctgccaacctgctaaccctgtcatgccggataagcgatagctattcccctcaggcacaaagccggtgtgtgttccttctgacccttttccctaggcggatttttctggagtggagaactgctgtgtacaattgggccctgcaatcgtcccacgaggtcattagagcttcgtgcgtgagcggattctttatcctgcttcaacagcagaacagctgtaaccgcgtccccaagatcctgattgataaggtcaaggatgatagcgatatcgttaagaaggaatttgcctcaatactcggtcagcttgtatgcacactccatggtatgttttacttaacttcaagccttacggagcctttctcagaacatggccatgtggatcttttctgccggaacctgaaagctacctcccaacacgagtgttcctcatctcaactcaaagctagtgtgtgcaaaccattcctgttcctgctcaagaaaaagattcctagtcctgtgaaactcgccttcatcgataacctccaccacctgtgtaagcatctagacttccgagaggacgagacagacgtgaaagccgtcctgggaacactgcttaacctgatggaggaccccgataaagacgttcgagtggcattcagcgggaacattaagcacattttggagagtttagactccgaggacggattcatcaaagagctgtttgtgctgcgtatgaaagaggcttatacgcatgcccagatatctcggaataatgaactcaaggataccttgattctcacaactggcgacattggtagggccgccaaaggtgatttagttcctttcgccctgctgcacctcctgcactgcctgctctcaaagtctgcatccgtgtctggggctgcctatactgagattcgagccctggtcgccgccaaatctgtgaaactgcaaagctttttttctcagtacaagaagccaatctgccagtttctggttgaaagtctgcacagctcacagatgaccgccctgccaaatacaccgtgccaaaatgcagatgttagaaaacaagacgtggctcatcagagggagatggctctaaataccttgtccgagatcgccaatgtctttgacttcccagacctcaaccggtttctgacgagaacactccaagtgctgctcccagaccttgcagccaaggctagtcccgccgcaagtgcccttatacgcactctgggaaagcagctcaatgtgaatcgcagagagatcctcattaacaattttaagtacattttcagccaccttgtgtgcagctgcagcaaagatgaactggaaagagctctgcattacttgaagaatgagaccgagatcgaactgggatcactgctgcgccaagactttcagggcttacacaatgaactactgctgaggatcggcgagcactaccagcaggtgttcaacgggctcagcatcttggctagttttgccagtagcgatgacccatatcaggggccccgtgacatcatctccccggagctaatggcagactatttgcagcctaaactgctgggcattttagcattcttcaatatgcagcttctgagtagctctgtcggtatcgaggataagaaaatggctctcaactctctgatgtcccttatgaaacttatgggaccgaagcatgtttcgtctgttagggtgaagatgatgacaactctacgcacgggcctgaggtttaaagacgattttccagaactgtgttgccgggcttgggattgctttgtccggtgcttagatcatgcgtgcctcggaagcctactgtcccatgtcatagtggccctgcttccacttattcacatccaacctaaagagacagccgccattttccactatctaattattgaaaaccgggacgccgttcaggactttttacatgaaatctactttcttcctgaccaccctgagctcaagaagatcaaggcagtactgcaggagtatagaaaggaaacttcggaaagcactgacctgcaaacaacgctgcagctctccatgaaagccatacaacacgagaacgtcgacgtcaggattcacgctctgacatccctcaaggagacactctacaagaaccaagagaagctgattaaatatgctacagacagcgagacggtcgaacctataattagccagctggtgaccgttctgttgaagggatgtcaggacgcaaactctcaagctcgattgctctgtggggaatgcctcggagagctcggagccatagatcccggcaggctagacttctctaccacggaaacccaggggaaggacttcacatttgtgaccggtgtggaggatagtagtttcgcgtacggcctcctcatggaacttacacgggcatacctcgcctacgccgacaattccagggcccaggattcagccgcctacgctatccaggagctactatcaatttatgattgtcgggagatggaaacaaatggccctggacaccagttatggcgccgcttccctgagcacgtccgcgagatattggaacctcaccttaacactcgttataagtcaagccaaaagagcactgattggtccggagtgaaaaaacccatatacttgagcaagctgggaagtaacttcgcggaatggagcgcttcctgggcaggctacctgattacgaaggtcaggcatgacctggcctcgaaaatttttacctgctgctcaataatgatgaagcacgacttcaaagttaccatctacctcttaccacacattttggtgtatgttcttctagggtgtaaccaagaggatcaacaggaggtgtatgcagagataatggcggtccttaaacatgacgaccagcacaccatcaacactcaggatatcgcttccgacttgtgccagttgtcaacgcagacagtcttttctatgctggatcatctgacacagtgggctcgacacaagtttcaggctctgaaggccgagaagtgcccacactccaagtccaaccggaataaggttgatagcatggtaagtactgtcgactacgaagattaccagtccgtgacacgctttctggatctgattcctcaggatactctggctgtcgcgtcctttaggtccaaggcttataccagggccgtcatgcatttcgagtcatttattaccgagaaaaaacagaacatccaagaacacttgggattccttcaaaagttgtatgctgcaatgcatgaacccgacggtgttgccggggtcagcgctatccgaaaggctgagccatccctaaaagagcagatcctggaacatgagtcactgggactgttgagagatgccactgcctgctatgatcgtgctatccaacttgaaccagatcagattatccactaccacggggttgtgaaatccatgctgggactcgggcagttgtcaaccgtgattactcaagtgaacggcgttcacgctaaccgctctgagtggactgacgagctgaacacatatcgggtggaggccgcctggaaattgagccagtgggatttggttgagaattacctggccgccgacggcaaaagtactacctggagtgtcaggctggggcagctgctgctgagtgcaaaaaaacgagacatcaccgctttctacgattcattgaaactcgtgagggccgaacagattgtcccgcttagcgccgcctcctttgagcgcggctcctatcaacgggggtacgagtatatagtgagactccacatgctgtgcgagctcgagcactctataaaacctctgttccagcatagccctggtgatagttcccaggaagactcattgaactgggtcgcccgtctcgagatgacccaaaattcttacagagccaaggagcctattctggcactgagacgagcgctgcttagtctgaataagaggccagactataatgagatggtcggggagtgctggttgcagtctgcccgcgtagcccgcaaggccggtcaccaccagaccgcttataacgctctgctgaatgccggggaatctcgactggcagagttatacgttgaacgggcaaagtggctgtggtccaagggcgacgttcaccaggccctaattgtgttacagaagggtgtggagttatgctttcctgagaatgagacccccccagagggaaagaacatgcttattcatggccgggctatgctgttggtgggtcgattcatggaagaaacagcaaatttcgagtcaaatgctatcatgaagaagtataaggatgtcacagcgtgcctcccagagtgggaagatggccacttttacttggccaagtattatgacaagctgatgcccatggtcaccgacaacaaaatggagaagcaaggtgatctgatcagatatatcgttctgcactttggccgttctctgcagtacggcaaccagttcatctaccagtccatgccacggatgcttacactctggcttgactacggaaccaaggcgtacgagtgggagaaggccggcaggagcgacagagtgcagatgcgaaacgacctcggcaaaattaacaaggtcattactgagcatacgaactatctggcaccatatcaattcctaaccgcttttagtcaactgatctctcggatttgccatagccatgacgaggttttcgtggttctgatggaaatcatagcaaaagtgttcttggcatacccccagcaggctatgtggatgatgaccgccgtaagtaaatcaagctaccccatgcgggtcaacaggtgtaaggagatccttaataaggcgattcacatgaagaagagtctcgagaaattcgtgggggacgccactcgtctgacagataaactactggagctgtgcaacaagcctgtcgacggatcctcgagcaccctcagcatgagcactcatttcaagatgctaaagaagctggtcgaagaagcaaccttctccgagattctaattccattgcaatccgttatgatccctacccttccctctattttggggactcacgctaaccacgcctctcacgagcccttcccagggcactgggcgtatattgcagggttcgacgacatggtggaaatcctcgcgagtctgcaaaaaccaaaaaagatttcgttgaaaggttcagatggaaagttttatatcatgatgtgtaaaccaaaggatgacctgcggaaagactgccggcttatggagttcaatagccttattaacaagtgtctccgtaaagacgctgaatcccgaagacgagagctgcacatccggacctatgcggtgatccctttaaatgacgaatgcggtataattgagtgggtcaataacaccgcaggattgcggccaatccttaccaagctgtacaaggagaagggagtgtacatgacgggcaaggaactgagacagtgcatgctgcctaagtccgccgccttaagcgaaaagctcaaggtgttcagagagttcctcctcccacgacatcccccgatcttccatgagtggtttctccggacattcccggacccaactagctggtactcctctcggagcgcatactgccgtagtactgccgtgatgtcaatggtcgggtacattcttggcctgggagatcgtcatggcgaaaatatcctgtttgactctctcaccggcgagtgtgttcacgtcgacttcaattgtctgtttaacaagggagagacttttgaagtacccgagatcgtaccctttagacttacacacaatatggtgaatggcatgggaccgatgggcacggaaggtttgttcagacgagcttgtgaagtaaccatgagacttatgcgggatcagcgcgagccactgatgagcgttctgaagaccttcctgcacgatccactcgtggaatggtccaagccagtcaaaggtcactcaaaagctccactgaatgagaccggcgaagtggttaacgagaaagcgaaaacacatgtcttggacatcgagcagcgactgcagggcgttataaaaacacggaacagagtgacggggctcccgctttccatcgaaggccacgtacattatttgatccaggaagctaccgacgagaacctattatgtcaaatgtacctcggttggacgccttacatgtag

SEQ ID NO: 22877 - DNA, 9171 bp, Artificial Sequence
  Description of Artificial Sequence: Synthetic coding sequence
atgagcctggtgctgaacgacctgctgatctgctgccggcagctggagcatgaccgggcaaccgaacgtaaaaaagaggtggagaaatttaaacgcctaattcgggatcccgagacgatcaaacacctggacaggcactcagacagcaaacagggaaagtatctgaattgggacgccgttttccgctttctgcaaaaatacatccagaaagagacagaatgtttgaggattgcaaagccaaacgtgtccgcatccacccaggcttcccgacagaagaagatgcaagagatttcaagcctcgttaagtatttcataaaatgtgccaatcgacgggcgcctcgattaaagtgccaggagctgctcaattacattatggatactgtgaaagattcttcgaacggtgcgatttatggtgctgattgcagtaacattttactcaaggatatcctgagcgtacgcaagtattggtgcgaaatttctcaacagcagtggctggagttattctcggtgtacttccggttatacctcaaaccatcccaagatgttcaccgggtactggtagcacgcatcattcatgccgtcaccaagggatgctgctcccagactgacggcctgaactcaaagttcttggattttttttccaaggctatacagtgtgcccgccaagagaaatcaagctccgggttgaaccacatcctggcagccctgacaatcttcctcaagactcttgctgtgaatttccgaattagggtttgcgagttgggcgacgagattctgcccaccctgctctatatctggacccagcaccggttgaacgactccttgaaagaagtgatcatcgagctgtttcagctgcagatttatattcaccaccccaaaggcgcaaaaacccaggagaagggggcttatgaaagcaccaagtggcggagcatcctctataacctctatgatctactagttaacgagatatcccatattggctcaaggggcaagtatagcagcgggttccgaaacatcgccgtaaaggaaaacctgattgaactgatggccgatatatgtcaccaggtttttaatgaggacactagaagcctggagatctctcaatcttatacgacaacacagagagagtctagcgactattctgtcccatgtaagcggaagaagattgagctgggttgggaggtcatcaaggaccatctgcagaagagccagaatgatttcgatttggtgccgtggctccaaatagcgacacaactcattagcaaatacccggcctctttgccgaactgcgagctttctccactccttatgatccttagccagcttctgccacagcagcgccacggagagcggaccccttacgtactgcggtgtttgaccgaagtggcattatgccaggacaaaagaagcaacttggaaagcagccagaaatctgacctgctcaagctgtggaataagatttggtgcattacattccgaggcatttcctccgaacaaattcaggctgagaatttcgggctcctgggcgccatcatccaggggtcgcttgtcgaggttgatagggaattttggaaactctttacagggtccgcatgtaggcctagttgtcccgccgtgtgctgcctgaccctagccttgaccacatccatcgtaccaggtactgtgaaaatgggtattgagcaaaatatgtgtgaggtcaatcgaagctttagcctgaaggaaagcatcatgaaatggcttttgttctatcaactcgagggcgatcttgagaacagcacagaggttccacctatacttcatagcaatttcccgcatctggttctagagaagatcctggtctcactcaccatgaagaactgtaaggcagccatgaacttttttcagtccgtgccggagtgcgaacatcaccagaaagacaaggaagagctttcctttagcgaagtggaagaactgttcctccaaacaacatttgacaagatggactttctgacaatcgtgagagaatgcggaatcgaaaagcaccagagcagtataggattcagtgtgcatcagaacctgaaagagtcactggacagatgcctgctggggctgagcgagcagctcctgaacaactattctagtgagataaccaacagcgaaactctggtgcgctgttcacgattactggtgggtgtcctaggctgttattgttacatgggggtcatcgctgaggaggaagcctataaatccgagcttttccagaaggcaaagagcttgatgcagtgcgctggcgaaagcatcactctcttcaagaacaagaccaacgaggagtttcggatcggtagcctgcgtaatatgatgcagctatgtacaaggtgcctgagtaattgcaccaaaaaatctccaaataagatcgccagcgggtttttcctgaggctccttacctctaaacttatgaatgatatcgccgacatctgtaaaagcctagcctctttcatcaaaaagccatttgaccgcggcgaggtggagtccatggaggatgacacgaatggaaatctcatggaagtcgaggatcagtcctccatgaatcttttcaacgattaccccgattcaagcgttagcgatgccaatgagccaggcgagagccagtctacaataggagctatcaatcctctagccgaggagtacctgagtaaacaggacctgctgtttttggacatgttgaagtttttatgcttgtgtgtaacgaccgcccaaacaaataccgtgtcgttccgcgcagccgacattagaaggaagctacttatgttaatcgatagcagcactttagaaccaacaaagtctttgcatctgcacatgtacctcatgttgcttaaggaactgcctggtgaagagtatccactgcctatggaagacgtgcttgagctgctcaagcccttgtcgaatgtttgttccctctacaggagggatcaggatgtgtgcaaaacgattcttaatcatgtgctgcacgttgtcaaaaatctaggacagtctaatatggactcagaaaacacacgcgacgcgcaagggcagtttctcacagtgataggcgctttttggcatctgacaaaggaacgtaagtacatcttttcagtgcggatggctctagtaaattgcttgaagactctgctcgaggccgacccctactcgaagtgggccatcctgaatgtgatgggcaaggatttccctgtgaatgaagtgttcacccagttcctggccgacaatcatcaccaggtccgtatgctcgctgccgaatctattaaccgactgtttcaggatacgaagggagattcctcccggctcctgaaagcgcttcctctcaagctgcagcagacagcctttgagaatgcatacctcaaggcgcaagaagggatgcgcgaaatgtctcacagtgctgagaaccccgaaactctggacgaaatttacaatcgcaaatccgtcctgctgaccctcattgcagtagtgttgtcgtgttctcctatatgcgaaaagcaagcactgttcgcactatgcaagagtgttaaggaaaatggcttggagcctcacctggtaaaaaaggtcctcgaaaaggtgagtgagacattcggctatcggcggctggaagattttatggcttctcacttggattatctcgtccttgaatggcttaacctgcaggacactgaatacaacctgtcttcatttcctttcatcttattgaactacacaaacatcgaggatttttaccgctcatgttacaaggtccttattcctcacttggtgatcagaagtcatttcgatgaggtcaagagtatcgctaaccaaatccaagaggattggaagtcacttctgactgactgtttcccaaagattttagttaacatcctgccttacttcgcgtacgagggaacccgcgacagcggaatggcccagcagagggagaccgcaacaaaggtgtacgatatgctgaaaagtgaaaaccttctaggtaaacagatcgatcacctgttcatttcaaatttgcccgaaattgtcgttgagctattgatgacactgcacgaacctgccaacagttccgctagccagtccacggacttgtgcgacttctccggcgatttggatccagctcccaaccccccgcacttcccaagtcacgtaatcaaggccacatttgcatacatcagcaattgtcacaagaccaaactcaagtccattctggaaattttgagcaagtcaccagactcataccagaagatcctgttagcaatctgtgaacaggcagctgagacgaacaatgtatacaaaaagcacaggatacttaagatctaccatctattcgttagtcttctcttgaaagatataaagtccggtctgggcggcgcgtgggcctttgttctgagggatgtcatctatacgctgattcactatattaaccagaggccctcatgtatcatggacgttagtctgcgctcgttctctctgtgttgcgatctgctttcccaagtatgtcaaacagccgtgacttactgcaaggatgccctcgagaaccatctgcacgttatcgtagggacactgattcccctggtgtacgaacaagtggaggtccaaaaacaggtcctagatttgctgaagtacctagtaattgataataaagataacgagaatctttatatcactattaaactgctggaccccttccctgaccacgtggtgttcaaagacttgagaatcacacagcagaaaataaagtactctagagggccatttagtctcctggaggagataaaccacttcctgtcggtgtctgtgtacgacgccttgcctctgaccagactggaaggcctcaaggacctgaggaggcagctggagctgcacaaggaccagatggtggacatcatgcgggcctcccaggacaatcctcaggatggcatcatggtgaaactcgtggtgaatcttcttcagttgagtaagatggctatcaatcacaccggtgagaaagaggtgttagaggcggtgggaagttgcctcggggaagtggggcccattgactttagtaccatcgcgatccagcacagcaaagacgctagctatacaaaggcgttaaaactctttgaagataaggagctacagtggacttttatcatgctgacatacctgaataatactcttgtggaagactgtgtgaaggtccggtccgccgccgtgacgtgccttaagaacatcctggccactaagactggccactcgttttgggagatttacaagatgactacggacccgatgcttgcttacctgcaaccttttagaactagtcgcaagaagttcctcgaggtgcccagatttgacaaagagaacccttttgagggattggacgatataaatctgtggatccccctttctgagaaccatgatatttggatcaagactttgacctgtgccttccttgattcgggcggtaccaagtgtgaaattctacagctgctgaagcctatgtgtgaggtgaagacagatttctgccaaactgtccttccttacctgatccatgacatcttactgcaggacaccaacgagagctggcgcaatctgctttcaacacacgtccaggggttctttacaagctgcctccgccacttttcgcaaacctccagatcaacgacgccagctaatcttgattcagagagcgagcacttttttcggtgctgtctggacaagaaatcacagcgcacgatgttggcggtggttgactatatgagacggcagaaacgccccagcagtggaaccattttcaacgacgccttttggctagacctgaattatctggaggtggccaaggtggcccaatcatgcgctgctcacttcaccgcattgctatacgcagagatctacgctgataagaagtccatggacgaccaggagaagcgatctctcgcattcgaggaagggtctcagaataccacaatctcttccctgagtgagaagagtaaagaggaaacgggtattagtcttcaagacctgttgcttgaaatctataggagtatcggagagccggactcgttatatggctgcggcggcgggaaaatgttgcagcctatcactcggttgcgaacgtacgagcacgaggccatgtgggggaaagcactcgtgacatatgacctcgagaccgcgattccttccagcacccggcaagccggcataattcaggccttgcagaacctgggactctgtcacatccttagcgtgtacttgaagggtctggactatgaaaataaggactggtgtcccgaattggaggaacttcactaccaggcagcctggcgcaatatgcagtgggatcattgcactagcgtgagtaaggaagtggagggaacaagttaccatgagtctctgtacaacgcgctgcagtcactgcgggatagagagttttctactttctatgagagtctgaagtacgcccgcgtaaaagaggtcgaagagatgtgcaaacgaagtctggagtcagtgtactcactgtaccccaccctgtcgaggctccaggccatcggagagctcgagagcatcggcgagttgttcagtcgaagcgtcactcaccggcaactttctgaggtatacatcaagtggcagaaacactcacagctccttaaagattccgacttttcctttcaagagcctattatggccctacggacagttatcctagaaattctgatggagaaggagatggataatagccagcgcgagtgtatcaaggatatcctcaccaaacaccttgtggagttgagcatcctggccaggacattcaaaaacacccagctgccggagagagccattttccaaatcaagcagtacaatagcgtgagctgtggcgtttccgaatggcagctggaggaggcacaggttttctgggccaaaaaagagcagtccctcgcacttagcattctcaagcagatgataaagaaactcgacgcatcctgcgctgctaacaatcctagtcttaagctgacctacacagagtgcctgcgagtctgcggaaactggctggccgagacctgcctggaaaacccagccgtcataatgcagacatacctggaaaaggccgtagaggtggccgggaactatgacggagagagttccgatgaactaaggaatggcaagatgaaggccttcctgtcgttagcacgctttagcgacacccagtaccagcgcattgaaaattacatgaagtcatccgagttcgaaaataagcaggccctcctcaagagagctaaggaggaggtgggcttattgagagaacacaagatccagaccaataggtatacagtgaaggttcagagggagctggaactagatgagctggcgcttcgtgcactgaaggaggacaggaaacgattcctttgcaaggccgtggagaactacattaattgcttattatctggggaggaacacgatatgtgggttttcaggctgtgtagtctatggctcgaaaactctggcgtgagcgaggtcaacggcatgatgaagagagacggcatgaagatacccacatataagtttctgcctctcatgtatcaattggccgcgcgcatgggaactaaaatgatgggcggattaggctttcacgaggtgctgaataatctgatttcacgtatttctatggaccacccacaccacaccctatttatcattttagcactcgcaaatgctaacagagatgaatttctgacaaaaccagaagtggctaggaggtctcgtataacaaagaatgttccaaaacagtcttctcaacttgatgaagataggactgaagccgcaaatagaattatttgcacaatccgaagccggagaccacagatggtgcgaagtgtggaagctctatgtgacgcgtacataatcctggcaaatcttgatgccacacagtggaagacccaacggaagggcatcaatatacctgccgaccagccaattacaaagctcaaaaatttagaggatgtggtagtgccgaccatggaaatcaaagtggatcacacaggtgagtatgggaacttagtgacaatccagagttttaaagccgagtttagactggccgggggtgtgaatctgccaaagattattgattgcgtggggagtgatgggaaagagaggaggcaactcgtgaagggaagagacgacctgagacaggatgcggtgatgcagcaggtttttcagatgtgcaacacactgttacaaagaaatacagagaccaggaaacggaaattaaccatttgcacgtacaaggtggttcctttaagccagcggagcggggttcttgaatggtgtacagggaccgttcctatcggggaattccttgtgaataatgaggatggagctcacaagaggtaccggcctaatgactttagcgctttccagtgccagaaaaagatgatggaagtgcagaaaaaatctttcgaggagaagtacgaggtgtttatggatgtctgccagaatttccagccggtgttccggtacttttgtatggagaaatttctggaccccgccatctggttcgagaaacggctggcatacacccggtcagtagccacttcgtccattgtcgggtatatactcgggctgggcgaccgccacgtacagaatatcctcatcaatgagcaatccgcagagctggttcacatcgacctgggcgtcgccttcgagcagggcaagattctgcctacacctgaaacagtcccgttcaggctgactcgagacatagtcgacggcatggggatcactggggtggagggtgtctttaggcgctgctgtgaaaagacaatggaggtcatgcggaactctcaggagacattactaactatcgtcgaggtcctactgtatgaccccctgtttgactggactatgaaccctcttaaggctctgtatctgcagcagcggcctgaggacgaaaccgaactgcatcccactctcaacgcggatgatcaggagtgcaaacggaatctgtccgacatcgatcagtcatttaacaaagtggctgagcgtgtgctgatgcggctacaagagaagctgaagggagtggaagagggcacagtcttatccgtgggcggacaagtaaacttgctgattcagcaggctatcgacccaaagaacctcagccgtctgttccccggttggaaagcgtgggtgtag

SEQ ID NO: 22878 - DNA, 417 bp, Artificial Sequence
  Description of Artificial Sequence: Synthetic coding sequence
atgaccctgcacgagcccgccaacagcagcgccagccagagcaccgacctgtgcgatttctcgggggacctcgatcctgcccctaatccacctcattttccaagccacgtcataaaagctacgtttgcctatatctcaaattgtcataaaaccaagctgaaatccattctcgaaattctcagcaagtctcctgattcttaccaaaagatactgctggccatctgcgagcaggccgccgagaccaacaatgtgtataagaagcacagaatcctgaagatataccaccttttcgtgtctctgctgctcaaggacatcaaatcagggctaggcggcgcttgggccttcgttttacgcgatgtaatttatacccttatccactatattaaccaaaggaaactgaccattttctcccagtag

SEQ ID NO: 22879 - DNA, 9171 bp, Artificial Sequence
  Description of Artificial Sequence: Synthetic coding sequence
atgagcctggtgctgaacgacctgctgatctgctgccggcagctggaacatgacagggccacagagagaaagaaggaagtcgagaagtttaagcgtcttattcgcgatcccgagacaatcaagcacctggaccggcattccgactccaagcagggcaagtacctgaactgggatgcagtgttccggttcctgcaaaagtatatacaaaaggagactgagtgcctgcggatagccaagcctaacgtttctgcctccactcaggcctcacggcagaagaagatgcaagaaatctcaagcttggtgaaatacttcattaaatgcgcgaatagacgggctccaagactaaaatgtcaggagctgctgaattacatcatggatactgtaaaggatagctcaaatggcgctatctacggcgcggactgcagtaatatcctactgaaagacattttatcagtgcggaagtactggtgtgagattagccaacaacagtggctggaactgttctccgtatatttccggctctatctcaaaccgagtcaggatgtgcatagggttcttgtggcaaggataatccacgccgtcacaaaagggtgctgttcacagaccgacggcctgaattcaaagtttctggatttcttcagtaaggctattcagtgcgcaagacaggagaagtccagcagtggcctcaaccacatcctcgctgctctcacaatcttcctgaagacgttagctgtgaacttcagaatcagggtttgtgaattgggggacgagattctgcccactctgctctatatctggacccaacatcgtcttaatgactccctgaaggaagttattatcgagctttttcagctgcagatctacattcatcaccctaagggcgcaaagacccaggagaagggtgcctatgagagcacaaaatggcggtctatcttatataacttgtatgacttactggtaaatgagataagtcatattgggtcgaggggtaagtacagctccggcttccgcaacatcgccgtaaaagagaaccttatcgagctgatggctgacatttgtcatcaggtctttaacgaagataccaggagtttggaaatttcccaatcctacacgaccacccagagggaatcttctgactattccgtcccatgtaagagaaagaagatcgaacttggctgggaagtgataaaagaccacctccagaagagccagaatgattttgacctcgtgccttggcttcaaatcgccacacagctgattagcaaatatccagcctcactgcctaactgtgaacttagccccctgctgatgatcttaagccagctcctgcctcagcagagacatggtgaacgcactccatacgtgcttagatgtctgacagaagtcgctctctgccaggacaaaaggtcgaatcttgaatccagccaaaaatcagatctgctgaagctgtggaataaaatatggtgtatcacatttagaggtatcagctcggaacagattcaggccgaaaacttcggcctgctgggggcgatcatccagggtagtctggtcgaggtggatcgcgagttctggaagttattcaccgggtcggcctgcaggccatcctgtccggccgtgtgttgcctcaccctagccctcaccacatccatcgtccccgggaccgtaaagatggggattgaacagaatatgtgcgaggtgaaccggtcattttctctgaaggagagtataatgaagtggctgctcttttatcagctggaaggcgatcttgagaatagcaccgaagtgccccccatcttacattctaatttcccccacctggtcctggaaaagatcctggtgtcactcaccatgaagaactgtaaagcggcaatgaacttcttccagtctgtgcccgagtgtgagcaccaccagaaggataaggaagagttgtctttctcagaggtcgaagagctgttcctgcagactacttttgacaagatggacttcctgaccatcgtgcgtgagtgtggaatagagaagcaccagtcatccatcggcttttcggtgcatcaaaatttgaaggagtcactggacaggtgcttgttaggcctgtctgagcagctcctgaataattacagcagtgagattactaacagcgagacattggtgcgctgctctaggctactggtaggcgtcctcgggtgttattgttacatgggcgtgattgccgaggaagaggcctataaatctgagctcttccagaaggccaagagccttatgcagtgcgccggagagagcataaccttatttaagaacaagactaatgaggagtttcgtataggcagtttgagaaatatgatgcagttgtgtacacgatgtctgtccaactgcaccaaaaagtcaccaaataaaatcgccagcgggttcttcctccgtctccttaccagcaagcttatgaatgacattgcggatatctgcaagtcactggcttccttcatcaagaagccctttgataggggagaagtggaatccatggaagacgatacaaacgggaacctgatggaggtcgaggaccagagttcaatgaacttgtttaatgactacccagattcaagtgtcagtgacgcaaacgagcccggagagtcacaatctacaatcggtgccattaaccccctcgctgaagaatatctgtccaaacaggatctcttgtttctggacatgcttaaattcctgtgtctgtgcgtaactactgcccaaacgaacactgttagcttcagggctgccgatatccgacgcaaactacttatgctgatcgactcatctactcttgagcccactaaaagcctccacctccacatgtatctcatgttgctgaaggaactgcctggtgaagagtatcccttgcctatggaggacgttctggaacttcttaaaccgctgagcaatgtgtgctctttgtacagacgcgaccaggatgtgtgcaagacaattttgaatcacgtgctgcatgtggtcaaaaatttgggtcaatcaaatatggactctgagaacactcgagatgcacagggccaatttctgaccgtgatcggggcattttggcacctgacgaaggagaggaaatatatttttagtgtgagaatggccttggtcaattgtcttaaaacgctgttggaggccgatccgtatagtaagtgggccatcttgaatgtgatgggcaaggattttcccgtgaacgaagtttttacgcagttcctggccgacaaccaccaccaggtccggatgcttgctgccgaatccatcaacaggctgttccaggataccaagggagacagttcgcgactattgaaggctttgccactcaaactccagcagacggcgttcgaaaacgcctaccttaaagcacaagagggcatgagagaaatgtcgcactccgccgaaaatccagagaccctcgatgaaatctataatcggaaatccgtactgctcaccctgatcgccgtggtgctgtcttgttctcctatttgcgaaaagcaggctctcttcgccctctgtaaatccgtgaaggagaacggactggagccccacttagtcaaaaaagtcttggagaaggtctccgagacgttcggctaccgcagactggaggatttcatggcctcgcacctggattatctggtgcttgagtggttgaacctccaggataccgagtacaacctatccagctttcccttcatactgttgaattatacaaacattgaggacttttataggagttgctataaggttcttattccacatttagtcatacgctctcattttgatgaggtcaagtccattgccaaccagatccaggaggactggaagagtctcctgacggactgttttcctaagatccttgttaacatactgccatatttcgcatatgaaggaacgcgagatagtgggatggcacagcagcgcgagaccgctaccaaggtatatgacatgttgaaatccgaaaacttgctcggaaaacagatcgatcacttgtttatttcaaatctgcccgagatcgtcgtggagttgctgatgaccctgcacgaaccggcaaattcaagtgcaagccaatctactgacctgtgtgacttctctggggacctcgacccagctccgaaccctcctcacttcccaagccatgtgatcaaggccacctttgcgtacattagcaattgccataagaccaaacttaagagcatcctcgaaatcctgagtaagtctcccgacagttatcagaagatcctactcgccatttgcgagcaggcagctgagacaaacaatgtctacaaaaagcataggatcctcaagatctaccatctctttgtgtccctattactgaaggatatcaaaagcgggctaggcggggcctgggctttcgtccttcgggacgtgatatacaccttgattcattatattaaccagcggcccagctgcataatggacgtatctctgcggtcttttagcctttgctgcgaccttctaagtcaggtctgccagacggccgtcacgtactgtaaagacgctttggaaaaccatctccacgtgattgtgggaacattgatccccttggtgtatgaacaagtcgaggtccagaaacaggttttggatcttctgaaatatctggttattgataacaaggacaatgagaacctatacattaccatcaagctcttggacccattccctgatcacgtggtgttcaaggacctccgaattacacagcaaaagatcaaatacagcagggggcccttttctctgctcgaggaaattaatcacttcttatccgtgagtgtgtatgatgctctgcccctgacgagactcgagggacttaaagacttgagacgccaacttgagctccacaaagaccaaatggtcgatattatgcgcgctagtcaggacaaccctcaggacgggatcatggtcaagctggtagtgaacctccttcagctgtctaagatggctattaatcatactggagaaaaggaggttctggaggccgtgggaagttgcctcggcgaggtggggcctattgactttagcaccattgccatccagcattccaaggacgcctcctacacaaaggctcttaaactgttcgaggacaaggagctccagtggacttttattatgttaacttatctgaacaatactctggttgaggactgtgtgaaggtccggtctgcagctgtgacctgcctgaagaacatcctagccacaaaaaccgggcattccttttgggagatatacaaaatgaccaccgatcctatgctggcctatctgcagccttttagaacttcacgcaagaaatttctagaggtccctaggtttgataaggagaatccattcgaaggcctcgacgacatcaacctctggattccgctttctgagaatcatgatatctggattaaaactctcacatgtgctttcctcgatagcggcggtactaagtgcgagatcctccagctgttaaagcctatgtgcgaagtgaagaccgacttttgtcagactgttcttccatatctcatccatgatatcttgctccaggacaccaatgaatcgtggaggaatctgctgtctactcacgtgcaggggttcttcacaagctgtctccggcatttctctcagacttctcgctccactacacctgcaaatctggattctgagagtgagcacttttttcggtgttgcctggataaaaagagtcaaagaactatgttggctgtggtggattacatgaggaggcagaagaggccaagcagtggtactatctttaacgacgccttttggcttgacctaaattaccttgaagtggccaaggtcgcgcaaagttgcgcggcccattttacggcccttttgtatgccgagatttacgccgacaagaaaagtatggacgatcaggagaagaggagcctggcctttgaagaagggagccaaaatacaaccatttcttcgctcagtgagaaaagcaaggaggagactggcatatccctgcaggatttgttgctggagatctatagaagcatcggcgagccagattccctttacgggtgcggaggcggcaagatgctccagccaatcactcggcttcggacttatgagcatgaagccatgtggggtaaggccctggttacatacgatttggaaactgctattccttcgagtacgcgtcaggccgggattatccaggccctacagaacttaggcctctgtcacatcctgtctgtgtacttaaaggggcttgattacgagaacaaggactggtgtccagaattggaagaactccattatcaggcagcctggcggaacatgcagtgggatcactgcaccagcgtgagcaaggaggttgaaggtactagttatcacgagtccctctacaacgccctccagtcccttcgcgacagggaattttccacattctatgaaagcttgaagtacgcccgggttaaagaggtggaagaaatgtgtaagcgcagcttggagagtgtgtactcactttatcctactctgtctaggctgcaggccatcggggagcttgagtctattggcgagctgttttcccgatccgtgacccaccgccaactatccgaagtttatattaaatggcagaagcattcccagctgctgaaagacagcgacttttcctttcaggaaccaatcatggcactgaggacagtgatacttgagatcttaatggagaaggagatggacaactcccagcgcgagtgtattaaagatatcctcacgaagcacttagtagagctatcgatcctggcacggaccttcaagaacacacagcttccggagcgggctatatttcaaattaagcaatataattcagtgtcttgcggggtaagcgaatggcaactcgaagaggcccaggttttctgggctaagaaggaacagagccttgcgctgtccattctcaaacagatgattaagaaactcgacgctagttgcgcagccaacaacccatctttaaaacttacctatactgagtgtttgagagtgtgcggcaactggctcgctgaaacctgcctagagaaccccgcagtgattatgcagacctaccttgaaaaggctgtggaggttgccggaaactatgatggtgaaagctccgatgaactcaggaatggaaaaatgaaagcatttctgtcccttgcccggttttccgatacccaatatcaacgtatcgagaattacatgaagagctctgaatttgaaaataaacaggcgttactgaaacgcgctaaggaggaggtggggctactgcgggagcacaagattcagaccaaccggtacaccgtgaaagttcagcgcgagttagagttggacgaactcgccctccgggctctgaaagaagaccgcaagagatttctgtgtaaagcagtcgagaactacatcaattgccttttgtcaggggaggagcatgacatgtgggtcttccggctctgttctctgtggttagaaaactcaggcgtcagtgaggtgaacggtatgatgaaacgggatggtatgaaaattcccacgtacaagttcctcccactaatgtaccagcttgccgctagaatgggaaccaagatgatggggggtttaggctttcacgaggtgcttaacaatctgataagcagaatttccatggaccacccgcatcacactctatttattatactcgccctggcgaacgcaaatcgggacgagttcctcaccaagcctgaggtagcgcgcaggtccagaataacgaaaaacgtgcccaagcaatcctctcagttggacgaagatcgcacggaggccgcgaaccggatcatctgtactatacggtcgcgcagacctcagatggtacgctctgttgaggccctgtgcgacgcatatattatcctcgctaacctcgacgccacacagtggaagacccagcgaaaagggatcaacatccccgcagaccagcccatcacgaaactgaagaatcttgaggacgtcgtggtccctacaatggaaattaaggttgatcacacaggtgagtacggaaaccttgtgaccatccagtcatttaaggctgagttccgactggccggcggagtcaatctcccgaagattattgactgtgtgggaagcgacggcaaggagaggagacaactagtaaaggggagggacgacctgcgccaggacgccgtcatgcagcaagtcttccagatgtgcaatactctgctccaacgaaacacagagacacggaagagaaagctgacaatctgtacatataaagtggtccctctgtcccagcgctccggcgtcctggagtggtgtaccggcactgtaccaattggcgaattcttggtgaataatgaagacggggcccacaagagatatcgtcccaacgacttttccgccttccagtgtcagaaaaagatgatggaggtccaaaagaagtccttcgaagagaagtacgaagtgtttatggacgtttgtcagaattttcagcctgtgttccggtacttctgcatggagaagttcctggatcccgccatctggttcgagaaaaggttggcttataccagatccgtggctacttctagtattgtcggttatatcctgggactcggcgacaggcacgtccaaaacattctgattaatgagcagagtgctgaactcgttcatattgacctgggtgtcgcattcgagcagggcaaaattctaccaacacctgagacggtgccattccggctgacccgggatattgttgacggcatgggcataaccggcgtagaaggggttttccgacgttgctgtgaaaaaacgatggaagttatgagaaattcacaggagacactcctcaccattgtagaagtgctgctttatgaccccttattcgactggacaatgaaccctctcaaagcattgtacttgcagcagagaccagaggacgaaacggagctacatccaaccctgaatgcagacgatcaagagtgtaaaaggaatctgagcgatatagatcaatcattcaacaaagtggctgagcgcgtactcatgcggctgcaggaaaagctaaagggggtcgaagaaggtaccgtgttgagcgtggggggacaggtgaatctgttgattcagcaagccatcgatcccaaaaacctgtcccggctgtttccaggttggaaggcctgggtgtag

SEQ ID NO: 22880 - DNA, 4110 bp, Artificial Sequence
  Description of Artificial Sequence: Synthetic coding sequence
atgagcctggtgctgaacgacctgctgatctgctgccggcagctggaacacgacagagctaccgaacgcaagaaagaggtagagaaatttaaacgcctcattcgcgatcccgaaacaatcaaacatctcgaccgccattccgactccaaacaaggcaagtatctgaactgggacgcagttttccgcttcttacagaagtatattcagaaagaaacggagtgtttaaggatagctaagcccaatgtgagtgcctccacacaagcctctcgtcagaagaagatgcaggaaatctcctctctggtgaaatatttcattaaatgcgccaaccgaagggcacccagacttaaatgtcaggagctgctgaattacattatggatacagttaaagattctagtaatggagcaatctacggtgccgattgcagtaacatcctgttgaaggatatcttgtctgtaagaaagtactggtgcgagatcagccaacaacagtggttggagctcttttcggtatattttagactttaccttaagccatcccaggatgttcaccgggtgctggtcgccagaatcatccatgccgtcacaaaaggatgttgctcccagaccgacgggttaaattccaagtttctggattttttctcaaaggccatacagtgtgcccgccaggaaaagtcttcaagtggcctgaaccatatcctggccgccttaactattttcctgaagaccctggccgtaaacttcagaattcgggtatgcgagcttggcgacgaaatactgcccacactcttgtacatttggacccagcatcgcctgaatgactctcttaaagaagttatcatagaactgttccagctgcagatttatatccaccatcccaagggagccaagacacaagagaaaggggcatatgaaagcactaagtggcgtagtatcctttataacctgtatgatctgctagtgaatgaaatctctcacatcggatcaagaggcaagtattccagtggtttcagaaacatcgctgtgaaagagaacctgatagaattgatggcggatatttgccaccaggtgtttaacgaggatacgcggtcactggagatcagccagtcttacaccaccacacaacgggagagttccgactacagcgtgccatgcaaacgtaagaaaatcgagctggggtgggaggttatcaaagaccatcttcagaagagccagaatgatttcgatttggtcccttggttgcaaatagccacccagctgatatcgaagtacccggcctcccttcctaactgtgaattgtcccctctgttgatgatcctgtctcaactcttaccgcagcaacggcatggcgaaaggacaccctacgttctgcgttgtttgacagaagtcgccctgtgtcaggacaaacgatccaacctagagtctagtcagaaaagtgacctgctgaaactgtggaataagatctggtgtataaccttccggggtataagcagcgagcaaatacaagctgaaaacttcggtcttttgggtgcgatcattcagggcagcttagtggaggtcgaccgtgagttctggaaactgttcacgggttctgcctgcaggccgtcttgcccagcggtgtgctgcctcaccttggccctcacaacaagtatcgtcccaggcaccgtgaaaatgggaatcgaacagaatatgtgtgaagtgaatcgcagcttcagcctaaaagagtccattatgaaatggttactattttatcagcttgaaggagacctggagaattctaccgaggtccctccaatattgcattcgaacttcccccatctagtgctggagaaaatcctggtaagtctgactatgaagaactgtaaagccgccatgaattttttccagagcgtgccagagtgcgagcaccaccagaaagataaggaggagttgtctttcagcgaggtagaggagttgtttctgcagaccacatttgataagatggattttctgaccatcgtgcgggagtgcgggatcgagaagcaccagagtagcatcggttttagtgtccaccaaaatctcaaggaatccctcgatcgctgtctactgggtctttctgagcaattgttgaacaattactcctccgagatcacaaattccgagacgttggtgagatgctctcgactgctcgtcggtgtactcggctgctattgttatatgggcgttattgccgaggaggaggcatataagtcagagctttttcagaaggctaaaagtttgatgcaatgtgcgggcgaatccattacgctgttcaaaaacaagacaaacgaggagtttaggatcggatcactgcgcaacatgatgcagctttgcacaagatgtctttccaattgcactaaaaaaagccccaataagatcgcatctgggtttttccttaggctcttaacatctaagctgatgaacgatatcgctgatatttgcaagtctctcgcttcatttattaaaaagccctttgatcgtggggaagtagaaagcatggaggatgataccaatggcaatctgatggaagtggaggatcagagctccatgaacctcttcaatgattacccggattcttcagtgtctgacgcaaatgaaccaggtgagtcgcagtccacaatcggcgcaattaatccacttgccgaagaatatctcagcaaacaggatttgcttttcctggacatgctgaaatttctatgtctttgcgtaaccactgctcaaaccaataccgtttccttccgggccgccgacatccgccgcaagctgcttatgcttatcgactctagtacactggaaccaacaaagtccctccatctccatatgtaccttatgctgctgaaggaattgcctggcgaagagtatccacttcccatggaggatgtcctagagctgctgaagcccttgtcaaatgtgtgttccttgtataggcgggaccaggatgtttgtaaaactattcttaaccacgtactgcacgtagttaaaaacctcgggcagagcaacatggactctgagaacacccgagacgcacaagggcagttccttaccgtgatcggagccttctggcaccttaccaaagagcgaaaatatatcttctcagtcagaatggcgctggtgaattgcctgaagacattgttagaggcagacccctattccaaatgggctattcttaatgtcatggggaaggatttccccgtgaacgaagtgttcacgcagttcctcgccgataaccatcaccaagttaggatgctggctgcagagtcaataaatagattgtttcaggacacgaagggcgatagttccagactcctcaaggcacttcctcttaaactgcagcagactgcctttgaaaacgcctacctgaaggctcaggagggtatgagagaaatgtctcacagcgccgaaaaccctgagaccctggatgagatttataatagaaagtctgtgctgttgacactaatagctgtggtgctcagttgctccccaatctgtgaaaaacaggccctctttgcgctatgtaaaagcgtcaaggagaacgggcttgagccccatcttgtgaaaaaggtgttagagaaagtaagtgagaccttcggctatcggcgactcgaggactttatggcctcacacctggattacctcgtcttggaatggctgaatttgcaggacactgaatacaacttatcatccttcccttttatccttctgaattacactaacatcgaagacttctacagaagctgttataaggttttgatcccccacctcgtgatccggtcccactttgacgaggtaaaatcgatcgccaaccagatccaggaggactggaagtccctgctgactgattgttttcctaagatactcgttaacatattgccatacttcgcctatgaaggcactcgcgattcaggaatggcccagcagagagaaacagcgacgaaggtgtatgacatgttaaaatctgaaaaccttctgggcaaacaaattgaccatctgtttatctcaaatctgccagaaatcgtcgtggaactcctgatgacccttcacgagcccgcaaatagttctgcctcacagtctaccgacctctgcgacttctcttag

SEQ ID NO: 22881 - DNA, 282 bp, Artificial Sequence
  Description of Artificial Sequence: Synthetic coding sequence
atgagcctggtgctgaacgacctgctgatctgctgccggcagctggagcatgaccgtgcaacagaacgtaaaaaggaggtagaaaagtttaaacgccttattagagatccagagacgatcaaacatctggatcggcacagtgactccaaacaaggaaagtatctcaattgggacgccgtcttcaggtttctgcagaagtacatacagaaagagaccgaatgcctgcgaatagccaagccgaacgtgagcgcgagtacacaggcaagtcggcagaaaaagtag

SEQ ID NO: 22882 - DNA, 921 bp, Artificial Sequence
  Description of Artificial Sequence: Synthetic coding sequence
atggagagcatcttccacgagaagcagcccagcggcaacatggacgactcagggtttttcagcatccaggtcatttccaacgccctaaaggtgtgggggctggaactgattctttttaactctccagaataccaacgacttagaatcgatccaattaatgagcgcagcttcatttgcaattacaaggagcactggttcacggtaagaaagctaggaaaacaatggtttaatttaaactccttgctgacagggcccgagctgatctcagatacatatctagctctattcttggcacagttgcagcaggaaggatatagcatctttgtcgtcaagggcgatctcccagactgcgaggcagaccagctgcttcagatgattagggtgcaacagatgcataggccaaaactgattggcgaagaactagcgcaactgaaagaacagcgagtgcataagaccgatttggaacgggtgcttgaagcaaatgacggatccgggatgttagacgaggacgaggaggatcttcagagggcccttgccctgtcccgtcaggagatcgacatggaagatgaggaagccgacctgcgccgcgctattcagctttccatgcagggcagctcccggaatattagccaggatatgacacagacttccggaaccaatctgactagtgaggagttgcggaagagaagggaagcatacttcgagaaacagcagcagaaacagcaacaacagcagcagcagcagcaacaaggagacctgagtggacagtcaagccatccatgcgaacggcccgccacttcatccggcgcgctgggttcagacctgggtgacgccatgagtgaagaagatatgctccaggctgctgtgaccatgtccttggaaacagtgcggaacgatttgaaaacagaaggaaagaaatag

SEQ ID NO: 22883 - DNA, 1110 bp, Artificial Sequence
  Description of Artificial Sequence: Synthetic coding sequence
atggagagcatcttccacgagaagcaggagggcagcctgtgcgcccaacactgtttgaataatttacttcagggtgaatacttcagccctgtcgagctctcttctatcgcccatcaactagacgaagaggagcgcatgaggatggctgaggggggagtcacatctgaggactataggacgtttctgcaacaaccctctggaaacatggacgacagtggcttcttttcgattcaggtgataagcaacgcacttaaggtctgggggttagagctgattctctttaacagtccagagtaccagaggctcagaatagatcccattaacgaaaggagtttcatttgcaattataaagagcactggttcaccgtccggaagctgggcaagcagtggttcaatttgaactcactcctgaccggacctgaattaatatccgacacctatctcgcactgttcctggcacaactacagcaggagggatacagcattttcgtggttaagggggatttaccagattgcgaggcagaccaactcttacagatgatcagggtgcaacagatgcaccggcctaagctgataggggaagaactggcacaactgaaagaacagagagtccataaaaccgatctggagcgcgttctcgaggcaaatgacggatctgggatgttggacgaggatgaagaggatttgcagagagctttagctcttagtcgccaggagattgacatggaagatgaggaggcggatcttcggagggcaatccagctctcaatgcagggctccagcaggaatatttctcaggacatgacccaaaccagtggaacgaacttaacctccgaggaactgaggaaacggagagaggcctacttcgagaaggatcaacactttcatattcttaagcagcaacagaagcagcagcagcagcagcagcagcagcagcagggagaccttagcggtcaaagcagccatccctgcgaacgccctgcaactagctctggcgctcttggcagtgatctgggcgatgctatgtcagaggaagacatgctccaggcagccgtcaccatgtctcttgaaactgtgcggaatgacttgaagactgaaggcaagaagtag

SEQ ID NO: 22884 - DNA, 1086 bp, Artificial Sequence
  Description of Artificial Sequence: Synthetic coding sequence
atggagagcatcttccacgagaagcaggagggcagcctgtgcgcccaacactgcctcaacaatctgttgcagggggaatatttttccccggtagagttgtcaagcattgcacatcagctggatgaggaggagcgcatgagaatggccgaaggaggtgtgacatctgaggattacaggacatttctccagcaacccagtggaaacatggacgattccgggtttttttcaatacaagtgataagcaatgccttaaaggtgtggggcttggaactgattcttttcaatagcccggaatatcagagactgcgcattgatccaatcaacgaacgctccttcatttgtaattataaggaacactggtttactgtcagaaaactgggcaaacagtggtttaacctgaatagcttgctgaccgggcctgaacttattagtgacacatatctggccctcttcctagcccaactccagcaggaggggtatagcatttttgtggttaagggcgatctccctgactgcgaggccgaccaattactccaaatgatccgtgttcaacagatgcaccgtcctaagttgatcggcgaggagctcgcacaactgaaggagcagagggttcacaagaccgatctggaacgcgttttggaagccaacgatggttccggtatgctcgatgaggatgaagaggatttgcagcgggcattagccttgtcccgacaggagattgatatggaagacgaggaagccgatctgcgcagggcaattcagttaagcatgcaaggaagctcaagaaacatctcacaggatatgactcagacgagcgggacaaatttaacttccgaagaactaagaaagcgtcgagaagcatattttgaaaagcagcaacagaagcagcaacaacagcagcaacagcaacaacaaggcgacctttcgggccaaagttcccacccctgcgagagacccgctacatcttcaggtgctttaggctcagacttgggagacgctatgagcgaagaagacatgttacaggccgctgtaactatgagtcttgagaccgtacgaaacgatttgaaaacagaaggcaaaaagtag

SEQ ID NO: 22885 - DNA, 1101 bp, Artificial Sequence
  Description of Artificial Sequence: Synthetic coding sequence
atggagagcatcttccacgagaagcaggagggcagcctgtgcgcccaacattgtttgaacaatttactgcaaggggagtactttagtccagttgagctcagcagtatagctcaccaactggatgaggaagagcgaatgagaatggcagagggcggcgtaacaagcgaagactaccggaccttcctgcagcaaccgtcaggcaacatggacgatagcggtttcttttcaatccaggtgatttcaaatgcactcaaggtgtggggcctggagctcattctgtttaactcacctgaataccagcggctaaggattgatccaataaacgaaagatccttcatatgcaattacaaagagcactggtttaccgtgcggaaacttggaaagcagtggttcaacttgaactcgctgctcactggacctgagcttatcagtgatacctatctcgccctgtttctggcacagctgcagcaagaaggctattctatattcgtagtcaagggagaccttccagattgtgaggctgaccaactcctgcagatgatcagggtgcaacaaatgcaccgtccaaaactgattggggaagaattggcacagttaaaagagcagcgagtgcacaaaactgacctggaacgcgtgctggaggccaacgatgggagtggtatgttggacgaggatgaggaggatctgcagagggctcttgcactgtccaggcaggagattgacatggaggacgaggaggctgacctaaggcgcgctattcagctatctatgcagggcagctcccggaatatttctcaggacatgactcagacatctgggacaaatttaacatccgaggagcttcgcaagagacgggaagcctactttgaaaatgattatttcgattcacagcagcagaaacagcagcaacagcaacaacagcagcagcagggagatctgagcggtcagtcatctcacccctgtgaaagaccagctacttccagcggcgctctagggagtgaccttggagacgctatgtccgaggaggacatgctacaggcagctgtgacaatgtcactggagaccgtacggaatgacctcaaaacagagggcaagaagtag

SEQ ID NO: 22886 - DNA, 1065 bp, Artificial Sequence
  Description of Artificial Sequence: Synthetic coding sequence
atggagagcatcttccacgagaagcaggagggcagcctgtgcgcccagcactgcctaaataatcttctgcagggggaatatttcagccctgtagagctgagcagtattgctcaccagctggacgaggaggagcgaatgagaatggccgaaggtggagtcacatctgaagactaccgcaccttcctacaggtcatcagcaatgcacttaaagtgtggggcctggagctcatattattcaattctcctgaataccagaggcttaggatagacccaatcaatgaaagatccttcatctgtaattacaaggagcattggtttactgtcaggaagctaggaaagcagtggttcaatctcaattctttactcaccggccctgaattgatctctgatacatatctcgccctgtttcttgcccagctgcaacaggaaggctactctatctttgtggttaaaggggatctgcctgactgcgaggctgaccaacttttgcagatgatccgagtgcagcagatgcacagacccaaactcataggcgaggagcttgcacagctgaaagagcaacgcgtgcacaagacagaccttgagagagtcctggaagccaatgacggaagcggaatgctagacgaggacgaagaggacctacagagggctctggcattaagtaggcaggagatagatatggaggacgaggaggcagatctgaggagggcaattcaactctcaatgcagggatccagtcgaaacattagccaggacatgacgcagacaagcggaaccaacctgacgtccgaagagctgaggaagaggagggaggcttattttgagaaagatcaacactttcacatcctgaagcaacagcaaaagcagcagcaacaacagcagcagcaacaacagggggatctgagcgggcaatcctcacacccgtgcgagaggccagctacttcatctggagccctgggatcggacctgggagacgcaatgtccgaagaggatatgctgcaggccgctgtgaccatgagtcttgaaactgtcagaaacgatttaaaaacagagggcaaaaagtag

SEQ ID NO: 22887 - DNA, 1113 bp, Artificial Sequence
  Description of Artificial Sequence: Synthetic coding sequence
atggagagcatcttccacgagaagcaggagggcagcctgtgcgcccaacattgtctaaataacttgctacagggcgagtacttctcacccgtcgagctgagttctatcgcgcatcaactcgatgaggaagagcggatgcggatggctgaaggaggagtcacgagcgaggattatcgcacctttctccagcagccaagcgggaacatggacgactcgggtttcttcagcattcaggtaatttcaaatgcactgaaggtgtggggacttgaacttatccttttcaattcacccgagtaccaacgcctgaggatcgatcctatcaatgagcggtcctttatttgtaactacaaggaacactggtttacagtgcgcaaattaggtaagcagtggtttaaccttaattctctgctgacagggcccgaactgatttccgatacctacttggccctgtttctggctcaattgcaacaagaggggtattccattttcgtggtgaaaggagacctccccgactgtgaggcagaccagttactccagatgattcgggtccagcagatgcaccggccaaagctgatcggagaggaactagcgcagcttaaggaacaaagggttcacaagacagatctggaacgcgttcttgaggccaacgatggatcaggtatgctggatgaggacgaagaagatctgcaaagggcactggcactgtctcgacaagaaatcgacatggaagacgaggaagcagatctgaggcgtgcaatacagctctccatgcagggctcctcccggaacatcagccaggatatgacacagactagcgggactaatctaacctctgaggagttacgaaaaaggcgggaggcctatttcgaaaaaactgagagcaggtcagtcgcccaggcccaacaacagaagcagcaacagcagcagcagcagcagcagcaaggagatcttagcggccaatcctctcatccttgcgaacggcccgccacctccagtggagcactgggcagtgacctgggcgacgcaatgagtgaggaagatatgcttcaggcagctgttaccatgtcactcgaaactgtacgaaatgatctgaaaaccgaaggaaaaaagtag

SEQ ID NO: 22888 - DNA, 1041 bp, Artificial Sequence
  Description of Artificial Sequence: Synthetic coding sequence
atggagagcatcttccacgagaagcaggagggcagcctgtgcgcccagcattgtttgaataatctcttacagggagagtattttagtccagtagaattgagctccattgctcatcaacttgacgaggaggagcgaatgagaatggctgaaggcggagtgacctccgaggactaccgaacattcctgcaggtcatcagtaatgcattaaaggtctggggactggagttaattctttttaactctcccgagtatcagcgacttaggatagaccctatcaatgagcgttcctttatttgtaactataaggaacattggttcactgtgaggaagcttgggaagcagtggtttaacttgaattcgctcctgactggcccagagttgatatctgatacttacttagcacttttcctggctcagttgcagcaggaggggtatagcatcttcgtggtgaagggagatctccccgattgtgaggccgaccagttgctgcagatgattagggtgcaacagatgcaccggcccaaactgattggagaggaacttgcacaactcaaggagcagagggtccacaaaacggatctggaaagggtcctagaggcaaatgatggttctggaatgctggacgaggatgaggaggatctgcaacgggcactagccctgtcaagacaggagatcgacatggaggacgaggaggcagacttgagacgagctattcagttaagtatgcagggatcttcgagaaacatctcacaggacatgacccagactagcggaaccaaccttacatccgaggaactgcgaaaacgacgggaggcctacttcgagaagcagcagcaaaagcagcaacagcaacaacaacaacagcagcagggcgacttatctggccagagctctcacccctgcgagcggcccgctacatcttctggcgccttaggcagcgacctcggcgacgccatgtcggaagaagatatgctgcaggccgctgtcacaatgagtctcgagaccgtgcgcaacgacttaaaaacggaaggaaagaagtag

SEQ ID NO: 22889 - DNA, 1095 bp, Artificial Sequence
  Description of Artificial Sequence: Synthetic coding sequence
atggagagcatcttccacgagaagcaggagggcagcctgtgcgcccagcattgcctgaacaatctgttacagggcgaatacttctctccagtcgagctgtcctccatcgctcaccagttggacgaggaggaacggatgcgcatggctgaaggtggagtgacaagtgaagattatcggacatttctccaacaacctagtggcaatatggacgacagcggatttttttcgatccaggtgattagtaacgccttgaaagtgtggggtttagagctgatattgtttaactctcctgagtaccagcgcctgagaattgacccaatcaatgaaagatcattcatttgcaactacaaagagcattggtttacagtcaggaagctcggaaagcagtggttcaatctgaacagtcttctcaccggaccagagctgatctcagatacatatctcgccctttttctggcacagctacagcaggagggatatagcatcttcgttgtcaagggggatctgcccgactgtgaagccgatcaactgttgcagatgatccgcgtccaacaaatgcatagaccgaagcttataggcgaggagctcgcacagctgaaagagcagcgggtacataaaactgacctggaacgggtgctggaggcaaacgatgggtccggaatgcttgatgaggatgaagaggatctgcagcgggccctcgccctatccagacaagaaattgacatggaagacgaggaggctgacttacggagagccatccagctgagtatgcagggttccagccgcaacataagccaggatatgacccagacatccggcaccaacctaacctccgaggaactgagaaaacgccgagaagcttattttgaaaaacagcagcaaaaacagcagcagcagcagcagcagcagcagcagggggatctgagcggacagagctcccatccctgcgagcggccagcaaccagcagtggcgccctgggtagcgatttaggtaaggcctgtagcccatttatcatgttcgctactttcactctctacctgacatatgaactccacgtgatctttgccttgcattactctagctttcctttgtag

SEQ ID NO: 22890 - DNA, 1119 bp, Artificial Sequence
  Description of Artificial Sequence: Synthetic coding sequence
atggagagcatcttccacgagaagcaggagggcagcctgtgcgcccagcactgtttaaacaaccttctacagggcgaatatttttctcctgtcgagctgagttctatcgcacatcagctggacgaagaggaaaggatgagaatggctgaaggaggagtaacatccgaagactacagaacatttctgcaacagccttcaggtaacatggacgactcgggctttttctcaattcaggtgatctccaatgctctcaaagtatggggcctcgaactcatactattcaactcacctgaataccagcgcctgcgcattgatcccattaatgagcggtcattcatttgtaactacaaggagcattggttcactgtgaggaagctggggaaacagtggtttaacctaaactccttactgacaggcccagagctaatctccgacacctatttagctttgtttcttgcccagttgcagcaagagggatattctatatttgtcgtcaaaggggatctgcccgactgtgaggctgatcaactgctccaaatgattcgtgtgcagcagatgcaccgacctaagctaatcggggaggagttagcgcagctcaaggaacaacgggtgcacaaaacagatctcgagagggtgctggaagcgaatgacggctctgggatgctggacgaagacgaagaagacctgcaacgcgcacttgccctgtctcggcaggagatcgacatggaagacgaagaggccgacctccggcgcgccatccagttgtctatgcaggggagctcacggaacatatcgcaggacatgacccagacctcggggaccaacctcacctcagaagaactgcgtaagcgacgcgaggcttacttcgagaagttcggtcgtcccagacgtgcagactgtctgaggcagcagcagaagcaacaacaacaacaacagcaacagcagcagggcgatctctcaggccaatcctcccacccgtgtgagcgccccgccacaagctcaggcgccttaggaagcgatctgggagacgctatgagtgaagaggatatgctgcaggccgcggtgaccatgtcccttgaaacagtgaggaatgatctgaaaacggaggggaagaagtag

SEQ ID NO: 22891 - DNA, 1128 bp, Artificial Sequence
  Description of Artificial Sequence: Synthetic coding sequence
gacagcgtgagcaagaagaagcaggagggcagcctgtgcgcccagcactgcctcaataacttgcttcaaggagagtattttagccccgtcgagctgtcttcaatcgcacaccagctcgacgaagaagaaaggatgcgaatggcagagggtggggtcacaagcgaagattacaggaccttcttgcagcagcccagcgggaatatggacgatagcggctttttcagcatccaggttatttccaacgcgcttaaggtgtggggactagagctaatcctgttcaactcacctgagtaccaaagactgaggattgaccctatcaacgagcgatcatttatatgcaattataaagagcattggtttacagtgcgaaaactgggtaaacagtggtttaatttaaacagccttctgaccggaccagagctgataagcgatacatacttagctctgttccttgcacagctgcagcaggagggatactctattttcgtggttaaaggcgatttacctgactgtgaggccgaccaattactccagatgattagagtgcaacagatgcatcgaccgaagctgatcggtgaagaacttgctcagctgaaggagcagcgcgtgcataagaccgatcttgaaagagtgctagaagctaatgatggatctggtatgctggacgaagacgaggaggatctgcagagagcccttgcactaagcaggcaggaaattgacatggaagatgaggaagctgatcttcggcgggcgattcaactaagcatgcaagggtccagccgtaacattagtcaggacatgacccagaccagcggtactaatctcacatcagaggaactgcgtaagagaagggaagcctacttcgagaaaaaattcaccgctaaccgaactgaccaacattttcacattcttaagcaacaacaaaagcagcagcagcaacagcagcagcagcagcagggggacctgtctggtcagtcaagccacccctgcgagcgacccgcaaccagtagcggggctttagggtccgatttaggagatgctatgagtgaagaggacatgctgcaggcagctgtgactatgtcacttgaaaccgttaggaatgacctcaaaaccgaaggcaagaagtag

SEQ ID NO: 22892 - DNA, 1125 bp, Artificial Sequence
  Description of Artificial Sequence: Synthetic coding sequence
atggagagcatcttccacgagaagcaggagggcagcctgtgcgcccagcactgtttgaacaacttactccagggggagtacttttcacccgtggagctttcaagcatagcgcatcagctcgatgaggaggagcgcatgcgcatggctgagggcggggttacctccgaagattacagaacctttctccagcaaccttctgggaacatggacgactcgggatttttttctattcaggtgatcagtaacgcactgaaagtgtggggcctcgagcttattctttttaattcaccagaatatcaaaggttaagaatcgatccaattaacgagcgctcatttatttgtaactacaaagaacactggttcacagtgcgcaaattgggaaagcaatggtttaacctcaatagtctccttaccggccccgagctgatctccgatacctacctcgctctttttctggcccagctgcaacaagagggctactccatatttgtggtgaagggggatctgccagattgtgaggctgaccagctgctgcagatgattcgggtacagcagatgcacagacccaagttgatcggcgaggagctggctcagctaaaggagcagcgtgtacacaaaactgacttggagagagttttggaagcgaacgatggctcaggaatgttggatgaggacgaagaggacttgcagcgggctctagccctgagccgtcaggagatcgacatggaggacgaggaggccgacctcaggagagcaatacaactgtccatgcagggctcgagccggaacatcagtcaggacatgacacagacgagtggtaccaatctgactagcgaggaattaagaaaacgacgggaggcttatttcgagaaagtgttcttcaagaacctgcaacaaatcgggagggcgcggcaacaacagaagcagcaacagcagcaacagcagcagcagcagggggatttgagcggacaatcaagccacccatgcgagaggcccgcaaccagctcaggcgccttggggagtgacttaggcgatgcgatgtccgaggaggacatgttgcaagcggctgtcacaatgagccttgagacggtcagaaatgacctcaagaccgagggcaagaaatag

SEQ ID NO: 22893 - DNA, 1113 bp, Artificial Sequence
  Description of Artificial Sequence: Synthetic coding sequence
atggagagcatcttccacgagaagcaggagggcagcctgtgcgcccagcattgcctgaacaatcttctgcagggcgaatatttttcacctgtggagctaagctctattgcccaccagctcgacgaggaggagaggatgcggatggcagaggggggcgtaacgtccgaagactacaggacctttttgcagcaacctagcggaaatatggacgactctggctttttttccatacaggtcatctctaacgcactgaaggtgtgggggctagagttaatcctgttcaactccccagaataccagcgactgcggatcgaccccattaacgaacgaagcttcatttgtaattacaaggaacactggttcacggttcggaagttgggcaagcagtggttcaacctcaattcactccttaccgggccagaactcatcagcgacacatatttggcactttttctcgctcaactccagcaggaaggctattccatattcgttgtcaagggagacctccctgactgcgaagccgaccagctgttgcagatgattagggtgcagcagatgcacagacccaaactgatcggcgaagagcttgcccagttaaaggaacagcgggtgcacaaaacggacctggagcgtgtacttgaagctaacgacggcagtgggatgctggacgaggacgaggaggacctgcagcgcgcgttggccctgtcccggcaggagattgacatggaggacgaggaggcagacctcagaagggctattcagctgtcaatgcaagggtcctctcggaatatcagccaggacatgacacagaccagcggaaccaatttgacctcggaggagctgcgcaaacgcagggaggcctactttgagaagatctactttacatttgagtgcttccggcagcagcagaagcaacagcagcaacagcaacagcagcagcaaggggacctgagtggtcagtcctcacacccgtgcgagcgccctgcaacatcttccggggcacttggttccgatctaggtgacgccatgagtgaagaagatatgctacaagctgccgtgacaatgtcgctggaaacagtgcggaatgacctgaaaaccgagggcaagaagtag

SEQ ID NO: 22894 - DNA, 1134 bp, Artificial Sequence
  Description of Artificial Sequence: Synthetic coding sequence
atggagagcatcttccacgagaagcaggagggcagcctgtgcgcccagcactgcttaaacaatctgctgcagggcgaatatttttccccagtggagctctccagcatcgctcaccaactcgacgaagaggagcgaatgcgtatggccgaaggcggggttacctctgaggattacagaacctttttgcagcagccatcaggcaatatggatgactcaggctttttcagcattcaggttatatccaatgcattaaaggtgtgggggttggaactgatcttatttaactcgcccgagtaccagcggttgagaatcgacccaatcaatgagcgctccttcatttgcaactataaagagcattggttcaccgtgaggaaactcggtaaacaatggttcaacctgaatagtttactgacagggccagaactgattagcgatacatacttggctcttttcctagcccaacttcagcaggaaggatacagcatttttgtggtaaagggggaccttcccgattgtgaggcagaccaattacttcagatgatacgggtgcaacagatgcataggcctaaacttatcggcgaggagctggcccaattaaaagagcagagagtgcataagaccgatctggagcgtgtgctcgaggccaacgatgggtctggtatgctggatgaggacgaggaagaccttcagcgcgcgctcgcgctctctaggcaggaaatagatatggaggatgaggaggccgatctgcgcagggccattcagctgagtatgcagggtagctcacgaaatatctctcaggacatgacccagacatctggaactaatctgactagcgaggagcttaggaaacggagagaggcatacttcgagaaagtcttctttaagaatcttcagcaaaaccagcacttccatattctgaaacagcagcagaagcagcagcagcagcaacagcagcagcagcagggcgacctgtctggccagagctctcatccttgcgaacgccctgcaacgagtagcggggctctgggatcagacctcggagatgccatgagtgaagaagacatgttgcaagctgcagtgactatgagtcttgaaacagtgcggaacgacctgaaaacagagggtaagaagtag

SEQ ID NO: 22895 - DNA, 549 bp, Artificial Sequence
  Description of Artificial Sequence: Synthetic coding sequence
atgatccgggtgcagcagatgcaccggcccaagctgatcggcgaggaacttgctcaattaaaggagcagagggttcataagacagacctcgagagagtgctcgaggctaacgatggcagcggcatgctcgacgaagatgaagaagacttgcagagggcactggccttatctagacaggagatcgacatggaagatgaagaggccgatttacgcagggccattcagttgtcaatgcaggggtcctcccgaaacattagtcaagacatgacacaaacatctggcacaaacttgacatcagaggagcttcgaaagaggagagaggcctatttcgaaaagcagcaacagaagcagcagcaacagcagcagcagcagcagcagggggatctctctggacagtctagtcacccttgcgagagacccgccacatccagtggagcgcttgggtctgacctgggagatgccatgagtgaggaagacatgctgcaggcagccgtgacgatgtctcttgagacagtaaggaatgatctcaagactgaagggaagaaatag

SEQ ID NO: 22896 - DNA, 3306 bp, Artificial Sequence
  Description of Artificial Sequence: Synthetic coding sequence
atgagcgccaaggccatcagcgagcagaccggcaaggagctgctgtacaagttcatctgtaccacgagcgccattcagaatcgtttcaaatacgcacgggtcacccctgacacagactgggctagactcctgcaggatcacccctggcttctgtctcagaatctggtggtgaagccagaccaactaatcaaaaggagaggcaagttaggccttgtaggtgtgaatctgaccctggatggcgtgaaaagttggctcaaacccaggctgggccaagaggctaccgtgggcaaagcaacaggtttcctcaaaaattttttaatcgagcccttcgtgcctcattctcaggcagaggagttttacgtgtgtatttatgcaacacgggaaggggactacgttttgtttcatcatgaaggaggcgttgacgtcggagacgttgatgccaaggcccagaaactgctggtgggcgtggatgaaaagttgaatcccgaagatattaagaagcaccttctggtgcatgcacccgaagataagaaggagatcctggcctccttcattagtggtctgtttaacttctatgaagacttgtatttcacgtacctggagatcaatcctctagtcgttactaaagacggggtttacgttctagacctggccgccaaggttgatgccacagccgactacatatgtaaggtgaaatggggagacattgaattcccccctcccttcggccgtgaagcttatcccgaagaggcctacatcgccgacctggacgccaaatctggggccagcttgaagctgaccttgctgaacccaaagggtcggatttggaccatggtggccggcggcggagcatcagtggtgtactctgatacaatctgcgaccttggaggggtgaatgaattggctaattacggcgagtatagcggcgctccctcagaacagcagacctacgattacgccaagacaatcctgagcctgatgaccagggaaaagcatcctgacgggaaaattctgatcatcggcggtagtatcgccaatttcaccaacgtggccgccacctttaaggggattgtgagagcaattcgagactatcagggaccccttaaggagcacgaggtgacaatcttcgtgaggcgcggcggccccaactatcaggaaggtctacgagtcatgggagaggttggtaaaacaacgggcatcccaattcatgtctttggcacagaaacccacatgaccgccatagtcgggatggccttggggcatcgtcccatacccaatcagcccccgaccgctgctcacacggcgaattttctcctgaatgcctcagggtcgacctccacccccgccccatcacggacagcctccttcagtgagtctagagctgatgaagtggcccccgccaagaaagctaaaccagccatgcctcaggatagcgtcccatccccacgaagccttcagggtaaatcaactacactcttctcacgacacacaaaagccatcgtgtggggcatgcagactagagctgtgcaggggatgctcgattttgactatgtgtgctcccgcgatgagccatccgttgctgctatggtttacccattcaccggcgaccacaaacaaaagttctattggggacataaggaaatcctgattcccgtcttcaaaaacatggcagacgccatgcggaagcaccctgaggtcgatgtgttgataaatttcgcctctctgcgaagcgcttatgacagcacaatggaaacgatgaattatgctcagatccggacaatagctataattgctgaggggatacctgaagccctcacaaggaaactgattaagaaagctgaccagaaaggagtgacaatcatcggccctgctacggttggaggtatcaaaccaggttgtttcaaaatcggcaatacaggtggtatgttagataacattctggcaagtaaactctatcggcctggcagcgttgcctacgtgagtcgaagtggggggatgtccaacgagctcaataatattatcagcaggaccactgacggcgtttacgaaggggtcgccattggaggggacagataccctggatctactttcatggaccatgttctcagatatcaagatacgcccggcgtaaagatgattgtagtgttaggggagatcggagggaccgaggagtacaagatctgtcgcggaatcaaggaagggaggctgacaaaaccgattgtctgctggtgcattggcacctgtgccacaatgttcagctctgaagtgcaattcgggcacgccggcgcctgcgcgaatcaggcgtctgaaacggcggtcgctaaaaatcaagccctgaaagaggcaggagtctttgtgccaaggagtttcgatgagctcggcgaaattattcagagtgtttatgaagaccttgtggccaacggcgtgatcgtcccggctcaagaggtgccgcctcccactgtgcccatggattatagctgggctagggagctcggcctcattcggaaaccggccagttttatgacctctatttgtgacgagagaggccaggagctgatctacgcaggtatgccaattacagaagtgttcaaggaggagatgggcataggcggtgtcctgggattgctgtggttccagaagcggctccctaaatacagctgtcagttcatcgagatgtgtctgatggtcacggccgaccacgggcctgcggtcagcggagcacacaataccataatttgtgcacgagctggcaaggatctggtgagttccctgacatcgggcctacttaccataggcgatcggttcgggggcgctctcgatgcagccgcaaaaatgtttagtaaggccttcgattcagggattatcccgatggagttcgtaaataagatgaagaaggaaggaaagctgatcatggggattgggcacagggtaaaatcgatcaacaacccagatatgagggtccagatcctgaaggactacgtgcggcagcacttccctgctacacctctgctcgactatgctctggaggttgagaaaattacaaccagcaaaaaaccgaatctcatactgaacgtggacggactgatcggggtcgcgttcgtggacatgctgcggaattgcggctccttcacccgagaagaagctgacgaatacattgacatcggtgcactgaacgggatctttgttctcggacgctccatgggcttcattggacattatctggaccagaagcggttaaagcaggggctctaccgtcacccatgggacgatatatcttatgtgctgcccgagcacatgtcgatgtag

SEQ ID NO: 22897 - DNA, 3276 bp, Artificial Sequence
  Description of Artificial Sequence: Synthetic coding sequence
atgagcgccaaggccatcagcgagcagaccggcaaggagctgctgtacaaattcatctgcacaacctccgccatacaaaacagattcaaatatgcccgagtgacacccgatacagattgggccagactcttgcaagatcacccatggcttctgtcacagaatttggtcgtcaaacctgaccagctaataaagagaagaggcaaactaggcctggtgggtgttaatttaaccctcgacggcgtgaaaagttggctgaagcctcggctcggacaagaagccacagtgggaaaagcaactgggttcctaaagaacttcctgattgagccattcgtacctcacagccaggccgaggagttctatgtgtgcatttacgcgacccgcgaaggtgattatgtactgtttcaccacgaaggaggagtggacgtcggcgacgtggacgctaaagcccaaaagctgttggttggcgtcgatgaaaagttaaaccctgaggatatcaaaaaacatcttttggtacacgcaccagaggataagaaggaaatattagcatctttcatcagcggccttttcaatttttacgaggacttgtatttcacttatttggaaattaaccctctggtcgtcaccaaggacggtgtgtacgtcttagaccttgcggcaaaggtcgatgcgactgctgactatatttgtaaggttaaatggggagatatcgaatttccccccccatttgggcgagaggcttaccccgaggaggcctacatagctgatctggatgctaagtctggcgccagcctgaagttaacactgctgaaccccaaaggccgaatctggacaatggtcgcaggggggggagccagtgtggtttattctgatacgatttgcgatttagggggggtgaacgaactggcaaactatggagaatactccggagccccaagtgagcaacagacgtatgactatgccaagactatcctttctcttatgacacgagagaaacatcccgacggaaagattctgatcataggaggatcaattgccaattttacaaacgtggcagcaactttcaaagggattgtgcgagctatacgggattatcaggggccactcaaggaacacgaagtgacaatcttcgtccgtagaggcggtccgaattaccaggagggattgcgggtcatgggggaggttggcaagaccaccggtattcccattcacgtgtttggcacagagactcacatgaccgctatagtaggcatggcgctcggccaccggccaatccctaaccagccgcccacggcagctcacacagctaactttttattaaatgcatcgggtagtacttccactcccgcgcccagccggactgcctccttttccgagtcgagagcagatgaagttgcccccgctaaaaaggccaaaccagcaatgccgcaaggaaagtccactaccctgttctccagacatacaaaggccattgtgtggggtatgcaaactcgcgctgtgcagggtatgcttgactttgattatgtgtgttcgagagatgagccgagcgtggctgctatggtttatcctttcaccggcgaccataagcaaaagttttactggggtcataaggaaatcctcatccccgtgtttaaaaatatggcggatgctatgaggaagcacccagaggtggacgtgctgattaactttgccagcctgagatcagcttacgattccaccatggaaaccatgaattacgcccagattcggacaatcgcaataatcgccgaaggcatccccgaggctctgacccggaaactgatcaaaaaagcggatcagaaaggcgtgaccatcatagggcctgccactgtgggcggcattaagcctggctgtttcaagatcgggaatactggcggaatgttagacaacatactcgcgtctaagctgtatcggccgggcagtgtggcatatgtgtccagaagcggcgggatgtccaacgagctgaataatatcatatcccgcacaacagatggagtatacgagggagtcgcaatcggaggggaccgttacccaggctccactttcatggaccacgtcctgcggtaccaggacacgcccggggttaagatgatcgtggtgctgggagagatcgggggcaccgaagagtacaagatctgtcgggggatcaaagaggggcgtctcactaagcccatcgtttgttggtgcatcggtacctgcgccactatgttcagctctgaggtacagttcggccacgcaggcgcatgcgcaaaccaggcatctgagacagctgtcgccaagaaccaggccctgaaggaagcgggggtgttcgttcctagatcatttgacgaactgggcgaaatcattcaatctgtatatgaagacctagttgccaatggggtgatcgttccggctcaggaggtgcctccaccgactgtgcccatggactatagctgggctcgggaactcggactgataagaaaacccgccagtttcatgacatccatctgcgacgagcgtggccaggaacttatttatgccggaatgcctatcactgaggtcttcaaagaggaaatgggaatcggaggagtactcggtctgctttggttccagaaaagactgcctaagtactcttgtcaatttattgagatgtgtctaatggtcacggcagaccatgggcctgctgtgtctggcgcgcataatactattatctgcgcacgcgccgggaaggacctcgtgtcttctctgactagtggcctgcttacaatcggcgaccgcttcgggggcgcacttgacgcggctgcaaagatgtttagcaaagcctttgatagcggcattatcccaatggagttcgtcaacaaaatgaagaaagagggcaagttgatcatgggcattgggcatagggtgaagagtattaacaatcctgatatgcgggtacagattttaaaggattatgtgcgccagcacttcccagcgacccctttgctcgactacgctctggaagtggagaaaatcaccacaagcaaaaagcctaatttgatactgaatgtggatggactgattggagtcgccttcgtggacatgctgcggaactgtggtagcttcactcgtgaggaagccgacgaatacatcgatatcggtgctctgaatgggatcttcgtcttgggaagatctatgggatttataggacattatctggaccagaagcggcttaagcagggcctgtaccggcatccttgggacgacatctcatacgtactccccgaacacatgtctatgtag

SEQ ID NO: 22898 - DNA, 3276 bp, Artificial Sequence
  Description of Artificial Sequence: Synthetic coding sequence
atgagcgccaaggccatcagcgagcagaccggcaaggagctgctgtataaatttatttgtactacgagtgccatccaaaaccggtttaaatatgctagggtgacgccggacacagactgggctagactgttgcaggatcatccctggctcctgtctcagaatcttgttgtgaagccggatcagttgatcaaaagaaggggcaagcttggtctagtaggcgtgaacctgacactagatggcgtcaaatcatggcttaaacctagattaggccaggaagccaccgtgggtaaagcaaccggctttctgaagaattttctaatcgaacccttcgtcccccacagccaggcggaagaattctacgtttgcatctatgccactcgcgaaggagactatgtgttattccaccacgaaggaggcgtcgacgtgggggacgttgatgccaaggcccagaagctgctggtcggcgtggacgagaaacttaatcccgaggacataaaaaaacacctgctcgtccatgcaccagaagataagaaagagattctagcgagcttcattagtggtctctttaacttttacgaagatttatatttcacttatctggaaataaaccctctagtggtgaccaaggacggtgtttatgtgctggacctcgcagcaaaagtcgacgctacagctgactacatttgtaaagtaaagtggggagacattgagtttcctccgccctttggcagggaggcttaccctgaagaggcctacatagccgatcttgacgccaaaagtggcgctagtttgaaattgacacttctgaatccgaaaggccggatctggacgatggtggctggaggcggcgcttccgttgtttactccgataccatatgtgatctggggggcgtgaacgagttagccaactacggcgaatattctggagccccatccgagcagcaaacatatgattacgcgaagaccattctttctctcatgacaagagagaagcaccccgacggtaagatactgatcatcggaggctctattgccaattttaccaatgttgccgccacctttaaggggatagtgcgcgctatacgggattatcaaggacccctgaaagagcacgaggtcacaattttcgtcagaagagggggccccaactaccaggaaggtctcagagtgatgggagaggtggggaaaactactgggatcccaatacatgtgttcggaaccgagacacatatgactgctatcgtggggatggccctgggccatcgtccaattcctaatcagccacctacagccgctcacaccgctaacttcctccttaacgcaagtggttccaccagcacgccggcgccttctaggaccgcttccttttcagagagccgtgcggatgaagtggcacccgccaagaaggcaaaaccagccatgccacagggaaaatctaccactctattctcacgtcacacaaaagccatagtctggggcatgcaaacccgtgccgtccagggtatgcttgacttcgactacgtgtgctctagagatgaaccttctgttgctgcaatggtgtatccctttaccggtgaccacaaacagaagttttattggggacacaaggaaattctgatccctgtgtttaagaatatggcagacgccatgcgcaagcaccccgaggtggatgtgctgatcaatttcgctagcctacggtccgcctatgatagtaccatggagacgatgaactacgctcagatcaggacaatcgctataattgcagaggggattcctgaggcccttacccgcaagttgattaaaaaagctgaccagaaaggagttaccatcatcggcccggccactgtagggggcataaagcccggctgcttcaagatcgggaataccggcggtatgctagataatatactcgcaagcaaattgtacagacctgggagcgtcgcttatgtgtctaggtccggcggcatgtctaacgagctgaacaatattataagcagaacaaccgatggggtctatgaaggcgtcgcaatcggaggcgaccggtacccgggttcgaccttcatggatcacgttctcaggtaccaggacaccccaggggtaaaaatgatcgtggtgctgggtgaaatcggaggaacagaagaatacaagatctgtagaggcattaaggagggcaggttaactaagcccatcgtgtgttggtgcatcggaacgtgtgcaacaatgttctcttccgaggtccagtttggacacgccggcgcttgcgctaatcaggctagtgagaccgccgtggcaaagaatcaggcgctaaaagaagctggcgtgtttgtcccaagaagttttgatgaactgggagagattatccaaagcgtctacgaggacctggttgcgaacggggtgatcgtgcccgcccaggaggtgccccctccaaccgtcccaatggactatagctgggcgcgcgagctaggacttattaggaaacccgcgtcgtttatgaccagcatctgtgacgagagaggccaggaactcatctacgcaggtatgccaataactgaggtgtttaaggaggaaatgggaatcggtggcgtcctgggtttgctgtggtttcaaaaaaggctgccaaaatatagctgccagttcatagaaatgtgcctaatggttaccgcagaccacggtcctgccgtctctggggctcacaatacaatcatctgtgccagggcaggcaaggacctggtttcctctctgacttcaggactcctgacaattggagataggttcggtggggcccttgatgcggcagcaaagatgttttccaaggctttcgactctgggatcatcccaatggaatttgttaacaaaatgaagaaagaaggcaagctcattatgggaataggacaccgggtcaagagtattaataacccggatatgcgggtccagatactaaaagattacgtgagacaacacttccctgccactcccctcctggactatgccctggaagtcgaaaagattaccacgtccaagaaacccaatctgatcctcaatgtggatggacttattggcgtcgcttttgtggacatgctgcgcaattgtggttctttcacaagagaagaggcggatgagtacatcgacatcggggctttaaacgggatctttgtgcttggaaggtcaatgggcttcattggtcattatctggatcagaaaaggctgaagcaagggctgtatagacatccctgggatgatatcagttatgtgctacccgagcacatgtcaatgtag

SEQ ID NO: 22899 - DNA, 3468 bp, Artificial Sequence
  Description of Artificial Sequence: Synthetic coding sequence
atgggcgccggcaagagccccgccggccccggccagaagcccgacccagggaagctcccggccgccggggttctgcgaatcctccgcggctcaagtgggttatggaaaaagagacgcgctcggacatccgccgaaaccgggagggctgggcttagcgccgcaatgtctgctaaagcaattagcgaacagacaggaaaggagctactttacaaattcatctgtacaaccagcgccattcagaataggttcaaatatgcaagggtgactccagatacggattgggcccgactgctccaggaccatccctggctgctcagtcagaatctggtagtgaaaccagatcagttgatcaaaaggagagggaaactaggcctggtgggagtcaaccttacgctggacggagtgaaatcctggttaaaaccgcggctgggacaggaggccacggttggtaaggccaccggtttcctgaagaacttccttatcgagccctttgtgccacacagccaagctgaggagttctacgtgtgtatttatgcgactagagaaggagattatgtcctctttcaccacgaagggggcgttgacgtgggtgatgtcgacgcaaaggctcagaaactgcttgtcggggtcgatgagaaactcaatcctgaagacattaaaaaacatttgcttgtgcacgcacctgaagataagaaagaaatactcgcctcctttatatcaggtctgttcaatttctatgaggatctgtatttcacctaccttgagattaaccctttagtcgtgaccaaggatggagtctatgttctggatttagctgcaaaagtcgatgccacggctgattatatatgcaaggtaaagtggggggacatcgaatttccgcctcctttcggacgagaggcctaccccgaggaggcttacatcgctgacctggacgccaaatccggtgcgtctctaaagctgaccctcttaaatcctaagggtcgaatttggaccatggtcgctggtggaggtgcctctgtagtgtactccgatacaatctgcgacctcggaggggtgaacgagctagcaaactacggtgaatattcaggcgcaccttctgaacagcagacctatgattatgccaaaaccattctcagcctcatgacgcgtgagaaacatcccgacggcaagatactgatcattggcggatccatcgcaaatttcaccaatgtggcagccacgtttaaaggaatcgtgcgggcgattcgggactaccagggtccactgaaggaacacgaagtgaccatcttcgtgagacgcggggggcccaactaccaagagggattgagggtgatgggagaggtggggaagacaacagggattcccatccacgtattcggcactgagactcacatgacggctatagtcggaatggccctcggccaccgtcctattcccaatcagcccccaactgccgctcataccgcgaactttctcctgaatgcttccggatcgacctcaaccccggctccctcccgcacagcctctttctccgagtcccgggccgacgaggtcgcacccgccaagaaggctaagcccgcaatgccccaggacagcgtgccttcccctagaagtctgcaaggcaagtccaccacccttttctcccggcacaccaaagctattgtttggggcatgcagaccagagcggtgcaaggaatgcttgacttcgactacgtgtgtagccgggatgagccaagcgtagcggcaatggtgtatccatttaccggcgaccacaagcagaagttttactggggtcataaagaaattctgattcctgtctttaaaaacatggctgacgctatgcggaagcacccagaagtcgatgtcctaattaacttcgctagtttacggtccgcctacgattcaaccatggagactatgaactatgcccagatcagaaccatcgccatcatcgccgaaggcatcccagaagcacttacaagaaaactaatcaagaaagccgatcagaagggtgtcactatcatcggacctgccaccgtcggcggaatcaagcccggttgttttaaaatcggcaatactggcgggatgttggacaacatcttggcatctaaactatatcgcccaggctctgtcgcatacgtgagtcgctcaggtggaatgtccaatgaattaaacaacattatttctaggactaccgacggcgtgtatgagggcgtcgcgatcgggggagataggtacccaggaagcacatttatggaccacgtgctccgctatcaagatacaccaggcgtaaaaatgattgtggttctgggcgaaattggcggaaccgaagagtacaaaatctgtcgcggaatcaaggagggcaggctgactaaacccatcgtctgctggtgcatcggaacctgcgctacgatgttctcatcagaggtccagttcgggcacgcaggtgcctgcgcaaaccaagcgtctgagaccgcagttgcaaagaaccaggcactaaaagaggccggcgtcttcgtaccacgatcatttgacgaactgggggagatcattcagagcgtctatgaggacctcgtggcaaacggagttatcgtcccggcacaggaggttccacctccaaccgtgcccatggactattcgtgggcacgtgaacttggtctgattcgtaaacctgcaagcttcatgactagcatttgtgatgagcgaggacaggaactcatctatgctgggatgcctattaccgaagtctttaaagaagagatggggatcggcggcgtgctggggctactatggttccagaagcgactcccaaagtactcctgtcagttcatcgagatgtgcctgatggtcactgctgatcatggccctgcggtgagcggcgctcataatacaataatatgtgcaagagcagggaaagatttagtatcttcactgacaagcggcctcctgaccatcggagacaggtttggcggcgctttagacgcagcagccaagatgtttagcaaggcttttgattccgggattattcctatggagtttgtcaacaaaatgaagaaggaaggcaagctgataatgggaatcggtcaccgggtcaaaagtataaataatcctgacatgcgtgtgcagattctcaaggattatgtccgccagcattttccagccacacccctgctagattatgctctcgaggtggagaagataaccacatcaaaaaaacccaatcttatcctgaatgtggatggactgattggcgtggcattcgtggatatgctaagaaactgcgggagcttcacaagggaagaagccgatgaatacatcgatatcggggccctcaacggaatcttcgtcctgggacgctcgatggggtttatcggacactacttggatcagaaaaggttaaaacaaggactgtatcgacacccttgggatgatattagctatgttttgccggaacatatgtctatgtag

SEQ ID NO: 22900 - DNA, 2493 bp, Artificial Sequence
  Description of Artificial Sequence: Synthetic coding sequence
atgagcgccaaggccatcagcgagcagaccggcaaggagctgctgtacaagtttatttgcacaacatccgcaattcagaataggtttaagtacgcgcgggtaactcctgatacagattgggctagacttctgcaagaccacccctggctgctttcgcagaatctcgttgtgaaaccagaccagttgatcaaaagacgcggcaagctgggccttgttggcgtgaacctaaccctggacggagtgaaatcgtggctaaaaccccgactaggtcaagaagcaaccggcatcgtgcgcgccattagagattaccaggggccactcaaggagcatgaagttacaattttcgtccgaaggggaggcccgaactaccaagaagggctgagggtgatgggggaagttggtaagacgaccggcatccctattcatgtttttggcaccgagacacatatgaccgccattgtggggatggccctcggacaccggcctatccccaaccagcccccgactgcggcacatactgccaactttctcctgaacgcctctggctcaacatctacgccagcccccagtaggaccgcaagctttagtgaatcgcgtgccgatgaggtggcaccggcaaagaaagccaaacccgccatgcctcagggcaagtcaacaactctcttctcaagacacactaaggccatcgtctggggcatgcagacccgcgccgtccagggcatgctggatttcgactacgtgtgtagtcgagatgagcccagcgtcgctgcgatggtctacccattcacaggtgaccataagcagaaattctattgggggcacaaagaaatcctcatcccagtcttcaagaatatggccgacgccatgcgaaaacacccagaggtggacgtcttaataaatttcgcatcactgcggagcgcctacgattcgactatggagacgatgaattatgcacagataagaacaatagccataatagccgagggcattcccgaagccctgacacgtaagctgatcaaaaaagccgaccagaaaggggtgaccattatagggccggccactgtcggcggcattaaaccaggatgtttcaagataggcaacactggcggcatgctggataatatactcgcatccaaactctacagacccggctcagtggcttacgtttcccgctccggcggcatgtctaacgagctgaacaatattatttcgcgcaccaccgatggggtttacgaaggtgtggccattggcggggaccggtatccaggctctacattcatggatcatgttctaagatatcaggatacacccggagtgaaaatgattgtggtgctgggagaaattggaggcacggaggagtacaaaatttgccggggtattaaagaaggcagacttaccaagccaattgtgtgctggtgcatcggcacatgcgcaaccatgttctcaagtgaggttcagttcggccacgccggtgcctgcgcaaatcaggcctctgaaaccgccgttgctaagaaccaagctcttaaggaagctggggtcttcgtgcccagaagtttcgatgaactgggagagataatccagtctgtgtatgaggacctggtcgccaatggcgtgattgttcctgcccaggaagtccccccgccgaccgtgcctatggattactcttgggccagggagctggggctcatcagaaagcccgcgagctttatgaccagcatctgtgacgagcgagggcaggaactgatctacgctggcatgcctattacagaagtattcaaagaagaaatggggatcgggggcgtgctcggcctactgtggtttcaaaaacgactacctaaatattcttgtcaattcatcgaaatgtgcctcatggtcaccgctgaccatggtcccgctgtgtctggcgctcacaacaccattatttgtgccagagcgggcaaggacttggtgtcatccctgacctctggactgctgacaatcggagaccgctttggtggcgctctggacgctgccgctaagatgttcagcaaagcctttgacagtggaatcatcccaatggagttcgtgaataagatgaaaaaagaaggcaagctgatcatgggcattggccacagggtgaaatcgataaacaatcctgatatgcgcgtacaaatactgaaagactatgtcagacagcattttcctgcaaccccgctcctggactacgcgttagaggttgaaaaaatcactactagcaaaaagcccaacctgatcctcaacgttgacggcttgattggcgttgcttttgttgacatgctgcgcaactgcggatcttttaccagggaagaggcagatgagtatatagacatcggcgccctaaacgggatctttgtactgggtaggtcaatgggctttattggccactacttagaccaaaaaagattaaaacagggcttatatcggcacccctgggacgatatttcttatgtacttcctgagcatatgagcatgtag

SEQ ID NO: 22901 - DNA, 1512 bp, Artificial Sequence
  Description of Artificial Sequence: Synthetic coding sequence
atgagcagcatcctggaggagcggatcctgggcgccgacaccagcgtcgacctggaagagactggccgcgtgctgagcataggagacggcattgcgcgggtacacggcctcaggaacgtgcaagctgaggaaatggttgagttctccagtggtctaaaagggatgtcactgaacttagagcccgataatgtaggagtcgttgtcttcggaaatgacaagctcattaaggaaggggacatcgtgaagcggaccggggctattgtggacgtgccagtcggcgaggagctgctaggccgtgtagtggacgctctaggtaatgccattgacggcaaagggcccatcggaagtaagacgaggcgccgggttgggctcaaagcccccggcattattccgaggatctctgttcgagaaccaatgcagacggggatcaaagccgtggacagtctggtgcctattgggcgaggccagcgcgagttgatcatcggggacaggcagaccggcaaaacgtcaatcgctatcgacacaataattaatcagaagagatttaatgacggatctgacgagaagaagaaactgtactgtatctatgtggccatcggccagaaacgctctaccgttgctcagttggtcaagcgtcttaccgatgccgacgccatgaaatacactatcgtggtgtccgcaactgctagcgatgctgctcccttgcagtacctggccccctatagcgggtgttccatgggagagtactttcgcgataatggcaagcacgcactcattatttacgatgacctgagcaaacaggccgtcgcttatcggcagatgtccctcttactgcggcggccccctgggagagaggcataccctggtgacgtgttctaccttcatagcagactgctcgagagagccgcaaagatgaatgacgcctttggaggcgggtccttaactgccctccccgtgatcgagacccaagctggggacgtttccgcctatataccgacaaatgtaatcagcattaccgacggacaaattttcctggaaacagagctcttttataagggcatcaggccagccattaacgtgggcttgtcagtgtccagagtgggcagcgccgcccagacgcgagcgatgaaacaagttgccggcaccatgaagcttgagttggcacagtaccgcgaggtagcggccttcgctcaattcggtagtgatctggacgctgcgacccagcaattactttcccgcggcgtgcgcctcacagagctcctgaagcaagggcagtactctcctatggccatagaggagcaagtggcagtcatttacgcaggcgtgcggggctatctggacaagctggaacctagtaaaatcacaaagttcgaaaatgcttttttatcccatgtggtctctcagcatcaggctttactaggcacaatccgcgcagacggcaagatttctgaacagtctgacgctaagctcaaggagatcgtcacgaatttcctggccggattcgaagcctag

SEQ ID NO: 22902 - DNA, 177 bp, Artificial Sequence
  Description of Artificial Sequence: Synthetic coding sequence
atgctgagcgtgcgggtggccgccgccgtggtgcgggccctgccccgcagagctggattggtgtctaggaacgcccttggctcttcattcattgccgcccggaattttcatgcctctaacacacacctacagaaaacgggcaaattactgtttctgtccctgcggcggacctattag

SEQ ID NO: 22903 - DNA, 1596 bp, Artificial Sequence
  Description of Artificial Sequence: Synthetic coding sequence
atgctgagcgtgcgggtggccgccgccgtggtgcgggccctgccccgcagagcagggctggtctcaagaaacgctctgggatccagcttcattgccgccagaaattttcacgcctcaaatacccacttgcagaaaactggaacagctgagatgtcgtccatactggaggagcggatcttgggcgcagatacaagcgtggaccttgaggagacaggccgagtcctgtccattggcgacggtatcgcgagagttcatggcctgcgtaatgttcaggccgaggagatggtcgagtttagcagcggtttgaagggcatgtcccttaacctggaacctgacaacgtcggggtggttgtgttcggcaatgataagctcatcaaggaaggggatatcgtgaagcggacgggtgctatcgtggacggacctattggatcgaagacgcgccgtcgcgtcgggctcaaggcacctggcatcataccgcgaatttccgtcagagagcctatgcaaactggcatcaaggctgtcgattcactggtcccaatcggtagaggacaacgggagttaatcataggggacaggcagacaggaaaaaccagcattgcgatcgatacgatcatcaatcagaagaggtttaatgacggttctgacgagaaaaaaaaactgtactgtatctacgtggctattggacagaagaggagtactgtcgcccagctagtgaaaagattaaccgatgccgatgccatgaaatatactatcgtggtgagcgccaccgcatccgatgccgctcctctgcagtacttggccccctattctgggtgtagtatgggcgagtactttagggataatggcaagcacgccctgatcatctatgatgatctttcaaagcaagcggtggcctaccggcagatgagtctcctcctgcggagacctcccggaagagaggcctaccctggtgatgtgttttacctgcactccagacttcttgagcgcgcagccaagatgaatgatgctttcggtgggggcagcctgaccgccctacccgtgattgagacccaggccggggatgtgtccgcttatatcccaaccaatgtgatcagtatcacagacggacagatctttctggaaaccgaactcttttataaaggcatcaggccggcgatcaacgtgggcctgtctgtgagcagagtcggatccgccgcccaaacgcgggctatgaagcaagttgcgggtactatgaaacttgaactcgctcagtaccgtgaggttgcggcctttgctcagttcggctccgacttggacgccgcaactcagcagctgttgagtaggggggttcgattgactgaactccttaagcaagggcagtattctcccatggccatcgaagaacaggtggcagtcatttacgccggcgtgcggggctacctcgataagttagaaccaagtaaaatcacaaaattcgagaacgcgttccttagtcatgtggtctcgcagcatcaagccttgcttggcacaattcgggctgacgggaagatatccgagcagagtgacgcaaagcttaaggaaatcgttactaacttcctcgcaggcttcgaagcctag

SEQ ID NO: 22904 - DNA, 1662 bp, Artificial Sequence
  Description of Artificial Sequence: Synthetic coding sequence
atgctgagcgtgcgggtggccgccgccgtggtgcgggccctgcccaggcgcgccgggctggtttctagaaacgcattgggatccagcttcatcgctgcaaggaatttccatgcctccaacacccatctgcagaaaaccggaactgccgaaatgagctcaatcttagaggaacgcattctgggcgccgacacctctgtggacctggaagaaacgggcagagtgctttctatcggagatggcatcgctcgggtacacggattgagaaatgtccaggcggaggaaatggtggagtttagctcagggctgaagggcatgtctctgaatctggagcccgataatgtgggtgtggtggtgtttgggaacgacaagttgattaaagaaggcgacatagtcaaacggaccggcgcaatagtcgacgtaccggtcggagaagagcttctgggcagggttgtggacgctctgggtaacgccatcgatgggaagggacccatcggcagtaagactaggaggcgggtgggactcaaagcccccggcataatcccacgaatctccgtgcgagagccgatgcagactgggattaaagctgtggactcactggtgccgattggccgggggcagagagaattaatcataggagatagacaaactggcaagacatccatcgcgattgacactattataaaccagaaaaggttcaatgacggctccgacgaaaagaagaaactatattgcatatatgttgctattggccagaagagatccaccgtggcccaactggtaaaaaggttaacagatgccgatgccatgaaatacacaatcgttgtatcggccactgcctccgatgcggcacctctgcaatatctggctccgtatagtgggtgctccatgggcgaatacttcagagataacggtaagcatgctttgattatctatgacgacctaagtaaacaggctgtggcttatagacagatgagtttactgctgcgtcgtcctcccggacgcgaagcataccccggcgacgtattttaccttcactctagactgttggaacgagcggccaaaatgaatgatgcatttggaggtgggtccctgacagcactccccgtcatcgaaacccaagctggtgacgtcagtgcctatattccaaccaatgtcattagcatcactgatgggcagattttcttggagaccgagctattctacaaagggatcaggcctgccattaatgtgggtctgtctgtgtcccgcgtgggctcggcagcacaaacacgggctatgaagcaggttgctggtaccatgaaactcgaactggctcaataccgtgaagtagcagcctttgctcagttcggctccgacctggacgctgccactcagcagctgctctccagaggcgtgcgcctcaccgagctgttaaagcagggccaatactcccctatggcgatcgaggaacaggttgctgtgatttacgctggggttcgtggctatctggacaagcttgagccgtctaaaatcacaaagttcgaaaatgcgttcctctcacacgtggtctcccaacaccaagccctcttggggacaatcagagccgatggcaagatcagcgaacagtcagatgccaagctgaaagagatcgtgaccaactttctggctgggttcgaggcctag

SEQ ID NO: 22905 - DNA, 1662 bp, Artificial Sequence
  Description of Artificial Sequence: Synthetic coding sequence
atgctgagcgtgcgggtggccgccgccgtggtgcgggccctgcccaggagagcgggcctcgtatctcgcaacgcattgggctcaagcttcatcgctgcgcgaaatttccatgcctccaacacacacctgcagaaaactggaactgccgagatgtcatcgatattggaggagcggatacttggggccgacacttccgtcgacttggaggagacagggcgagttctgtccattggagacggcattgcaagagtgcacggcctccgaaatgtgcaggccgaggagatggtcgagttctcgtccgggcttaaagggatgtcacttaatcttgagcccgacaatgtgggtgtcgtggtgttcggaaatgataagctgatcaaggagggcgatattgtgaagcgtacaggcgccatagtggatgtaccggtgggcgaagagctccttgggcgcgttgtggacgctttagggaacgctatcgacggtaagggcccaatcggttctaagacacgccgccgggttggtctcaaggcccccggtattattccacgcatctctgttagggaacccatgcagacagggattaaggctgtggacagcctcgtaccaatcggtcgcggacagcgagagctaataatcggggaccggcagaccggaaaaaccagtatcgcaattgacactatcataaaccagaagaggttcaatgacggcagcgatgaaaaaaaaaagctctactgcatctatgtggcgatagggcaaaagagatccactgttgcacagctggtgaaacggctgacggacgccgacgccatgaagtataccatcgtggtttctgcaacagcttctgacgcagccccgcttcagtatcttgcaccatacagtggctgcagcatgggcgaatatttccgcgataacggaaagcacgccctgattatttacgacgacctgtccaagcaggccgttgcttataggcaaatgagtttacttctgcgtagacctccggggcgcgaagcatacccaggcgacgtcttctaccttcattctcgactgctcgagcgggcagccaaaatgaacgatgctttcggtggtggcagcttgaccgccttaccagtgatcgagactcaagccggcgatgtttccgcttatatacctactaatgtgatttccataactgacggacagatttttctagaaacagagttgttttacaaaggtattcggccagcaatcaatgtgggcctgtccgtctcaagggtagggagcgctgctcagactcgagcaatgaagcaagtggccggaacgatgaagctagagctggctcaataccgagaggtagccgcattcgcgcaatttgggagcgatctggacgcagccactcaacaactgttgtctagaggagtccgattgacagagttacttaagcaggggcaatactccccaatggctatagaggagcaggtcgctgtcatctatgctggtgtaagagggtatctggataagctcgagccatctaagatcacaaagtttgaaaatgcttttctttctcacgtggtctcacaacatcaggccttgctggggacaatccgcgctgacggcaagattagtgagcagagtgatgccaagttgaaagaaatcgtgacaaatttcctggccgggtttgaagcctag

SEQ ID NO: 22906 - DNA, 1512 bp, Artificial Sequence
  Description of Artificial Sequence: Synthetic coding sequence
atgagcagcatcctggaggagcggatcctgggcgccgacaccagcgtcgatctggaggagacgggcagagtgctgtccatcggcgatggcatcgctcgcgtgcacggattgaggaacgttcaagctgaagagatggtcgaattttctagtggcttaaaggggatgagtctgaacctcgaacccgacaacgtgggagtggtagtgtttggcaacgataaacttattaaagagggggatatagttaagaggaccggcgccatcgtggatgtccctgtgggcgaagagcttctgggccgagtagtcgacgccttgggtaacgcgatcgacgggaaaggccctattggaagtaaaacccgcaggagagtcggcctaaaggcccccggaatcataccaagaatctccgtgagggaacccatgcaaaccggcataaaggccgtggactcattagtgcctattggcagaggtcagagggagctaatcatcggtgacagacagactggaaagacgagtatcgcaatcgataccatcattaaccagaagcgcttcaatgacgggtcagatgagaagaaaaagctatactgcatctatgtcgcaataggtcagaagaggtcgacagtggcgcagctagtcaaaagactgaccgacgcggacgctatgaaatataccatagtcgtgtcagctacagcatcagacgcggctcctctccaatacctcgccccttattcaggatgcagtatgggcgagtacttcagggataatggaaagcatgctctgattatatacgatgacttatcaaagcaagctgttgcctacaggcaaatgagcctcctgttgcgcaggccgccaggtcgagaagcttacccgggggatgtcttttatctgcattctcggctgctggaaagagcagccaaaatgaatgacgcattcggcgggggctctctcaccgcactgcctgtcatagagacccaagctggcgatgtgtctgcttacattcccaccaatgtaatctccatcaccgatggccagatcttcctcgagacagagctcttctataaggggatcaggccagcaatcaatgtgggcctgagcgtctcccgcgtgggatcagcagcgcagacccgagctatgaaacaagttgcgggaactatgaaattggaactcgctcagtatagggaagttgctgcttttgcacagttcgggagtgatttggacgccgccacacaacaactactgtccagaggggtgcggctgaccgagctgctcaaacagggccagtactcccctatggctattgaagaacaggtcgccgtgatttacgcgggagtcagggggtacctagacaagctggaacctagtaagataaccaaatttgagaacgcctttttgagtcatgtcgtgagtcaacaccaagccctgctaggcacgatcagagccgatggaaagatttctgagcagtcagacgcgaagctgaaagagattgtgaccaacttcctggccggctttgaggcttag

SEQ ID NO: 22907 - DNA, 3843 bp, Artificial Sequence
  Description of Artificial Sequence: Synthetic coding sequence
atggacctggagggcgaccggaacggcggcgccaagaagaagaacttctttaagctgaacaataaaagtgagaaagataaaaaggaaaaaaagcctacagtctccgtcttcagtatgttccgttacagcaattggctggataagctgtacatggtggtgggcaccctcgccgcaatcatccacggggcaggactgcccctcatgatgttggtcttcggtgaaatgaccgacatcttcgctaacgctggcaatcttgaggacctgatgagcaatatcaccaaccgtagcgatatcaatgataccggcttttttatgaatctggaggaggatatgaccagatacgcttactactactcagggattggggcgggggttttggtggcagcttatatccaagtcagtttctggtgcctagccgctggccggcagatccacaagattaggaagcagttcttccatgcaattatgcgtcaagagattgggtggtttgacgtccatgacgtgggagaattaaacacccgtctgacggacgacgttagtaagatcaacgaggggatcggcgataagattggaatgttcttccagtcgatggcaacattctttaccggctttattgtggggtttactcgaggatggaagttaaccttggtcatcctggccattagtcccgtgcttggattgagcgctgccgtttgggcaaaaatcctgtcctcctttactgacaaggaacttcttgcctacgccaaagccggggctgtggccgaggaggtcttagcagctatcagaacagtgatcgcttttggcggacagaagaaagaactggaaaggtacaataaaaatctcgaggaggcaaaaaggatcggaataaagaaagccattacagcaaacatctctattggcgctgcttttcttcttatctatgcctcttatgcccttgcgttctggtatggcactacccttgtcttgagtggcgagtacagcatcggtcaggtgctgacagtatttttttccgttctgataggagccttttccgtcggacaagctagccccagtatcgaagcctttgccaatgcgcggggggccgcctacgagatcttcaagatcattgataacaagcccagcatcgattcctattccaagagcggtcataagcctgataacataaagggcaacttggagtttcgcaatgttcacttttcataccctagccgcaaggaagtcaaaatcttgaaaggtttaaatcttaaggtgcagtccggtcaaacagttgcactggtcggcaactccggctgtgggaagtccaccacagtgcagctgatgcaaaggctctatgaccccacagagggcatggtttccgtggacggacaagatattcgcaccatcaatgtgaggttcctgagagagatcattggagtggtgtcgcaggagccagtgctgtttgccactaccatcgccgagaacatccgctacggtagagagaacgtgaccatggacgagatagagaaagctgtaaaggaggccaacgcctacgatttcatcatgaagctaccccacaagttcgataccctagttggagaaagaggagcgcaactgtcaggaggacagaagcagcgtatcgctatcgcgagggccctggtcaggaaccctaaaatcctgctgctggacgaggctacgagcgcactcgatacagagtctgaggctgtcgtccaggtcgcactggataaggcccgcaagggtcggaccaccatcgttattgcacaccgtctttctactgtcaggaacgccgatgtcattgccggatttgacgacggcgttattgtggagaagggtaaccacgatgagctcatgaaggaaaaaggcatatacttcaaactagtcactatgcagacggctggcaatgaggtagaactcgagaacgcagcagatgaaagcaagagcgagatcgatgcccttgaaatgagctcgaacgatagtcgctcctccctgatccgtaaaagaagtacccggcgttctgtcagaggcagccaggcccaggaccggaaactgtccacaaaagaagctctggatgagtctatccccccggtgagcttctggcggatcatgaaactgaatctgactgagtggccctactttgtagtcggtgtcttttgcgccattattaacggaggactccaaccagctttcgcgattatcttttctaagatcatcggagtgtttaccagaatagatgacccagagaccaagcgccagaattccaacctatttagtcttctcttcctggctctgggaatcatctccttcattactttctttctgcaaggcttcaccttcggcaaggccggtgagattctcacaaagaggctgagatacatggtatttagaagtatgctaagacaagacgtgtcctggtttgatgaccccaaaaacacaactggcgccctcaccacaagactggccaatgatgccgcacaagtaaagggcgcgattggctcgagacttgcagtcatcacccagaacatcgcgaacttaggtactggtattatcataagcttcatttacgggtggcagctcactctgctgctgcttgcaatagtgcctattattgctatagcgggcgtggttgaaatgaagatgctgagcgggcaggctttaaaggataagaaggagctggagggaagtgggaagatcgcaaccgaggccatagaaaactttcgaaccgtggtaagcttaactcaggagcagaaattcgagcatatgtacgcacagtcgcttcaggtgccatatcggaattctttaagaaaagcacacatttttgggattaccttcagcttcacgcaggccatgatgtatttctcttatgctggatgctttcgcttcggcgcctacctggtagctcataagctaatgtcgttcgaagacgtgcttcttgtgtttagcgctgttgtcttcggtgctatggcggttggccaagtgtcttcattcgctcccgattatgcaaaggctaaaatcagtgccgcccacatcattatgattatagaaaaaactcctctcatcgattcttacagtactgagggcttaatgccaaatactttggaaggcaacgtgacattcggagaggtggttttcaactaccctacgcgacccgatataccagtgctacaggggctgtccctagaggtgaagaaagggcagacgcttgctttggtgggttctagtggctgtgggaagtcaactgtggttcaactccttgagcgcttttacgatcccctagccggcaaagtgctactagacggaaaagaaatcaaaagactgaatgttcagtggctgagagcacacctgggcatagtttcccaggagccgatcctgtttgactgttctatcgccgagaacatagcctacggtgataactctagagtggtcagccaagaggagatcgtaagagctgccaaggaggcaaacatccacgccttcattgaatcactgcccaataagtacagcaccaaggtgggtgacaagggcacacagctgtctggcggccagaaacagcggattgctatagctagagcactggttaggcagccgcatattttactgctcgatgaggcgacctcagctcttgacacagaaagcgaaaaggtggtgcaggaggccctcgacaaggccagggaagggagaacttgtattgttatcgcgcaccgcctgagtacaatccagaatgctgatctcattgtcgtgtttcagaatggtagggtgaaagagcacgggacacaccaacagttacttgcacagaagggaatctacttctcaatggtctccgtgcaagcagggacaaagcgtcagtag

SEQ ID NO: 22908 - DNA, 69 bp, Artificial Sequence
  Description of Artificial Sequence: Synthetic coding sequence
atggacctggagggcgaccggaacggcggcgccaagaagaagaacttttttaagctgaataataagtag

SEQ ID NO: 22909 - DNA, 147 bp, Artificial Sequence
  Description of Artificial Sequence: Synthetic coding sequence
atggacctggagggcgaccggaacggcggcgccaagaagaagaactttttcaagttaaacaacaaatccgagaaagacaagaaagagaaaaagcccaccgtatccgtgttctccatgtttcgatactcaaactggctggataaatag

SEQ ID NO: 22910 - DNA, 3186 bp, Artificial Sequence
  Description of Artificial Sequence: Synthetic coding sequence
gccctgagccccgtgatgggcgtgagcgccggctactggcccaagatactgtctagttttactgataaagagttgctagcttacgccaaagccggagccgtcgctgaggaggtcctcgcagccatcagaaccgttatcgcctttgggggacagaagaaagaattggagcgttacaacaagaatctcgaggaggccaaaagaattgggattaagaaagctatcactgccaacatctccattggcgccgcatttcttcttatctacgcatcgtatgctctcgccttctggtatggcactacgctggtgttgtccggggagtacagcattgggcaggtcctgacagttttttttagcgtgctgataggtgccttcagcgtaggccaggcgtctcctagcattgaagcatttgccaacgcacgaggtgcggcgtacgagatatttaaaattatcgataataaacccagcattgactcatattccaagtcagggcataagcctgacaatattaaaggcaacctggaatttaggaatgtgcacttttcttacccctcaaggaaggaggtgaagatcttaaaggggttgaatctgaaagtgcagtccggacagactgtggctcttgtcggcaattccggctgcgggaaaagcacgacagtgcagcttatgcagcggctgtacgacccaactgaggggatggtctccgtggacggtcaggatattagaacaattaatgtcaggttcctgcgcgagattatcggcgtggtgagccaggagcccgtgctgtttgccacaacaatagccgaaaacattcgctacggaagagagaatgtgacaatggacgagatcgagaaggccgtgaaggaagctaatgcttacgattttatcatgaaattgccgcacaagtttgacacactggttggcgaaagaggagcccaactgtctggaggccagaagcagcgaatcgccatcgcgagagccttagtcaggaatcctaaaattctgctcctcgacgaagccaccagcgcactagacactgagtccgaagccgtcgttcaagtggcattggataaagctcgtaaggggagaaccacgattgttattgctcatcgactctcaaccgtgagaaacgctgatgtaatagccggctttgacgacggtgtgattgtcgagaaggggaatcacgatgagcttatgaaagagaagggcatctatttcaaactggtgactatgcagaccgcaggaaacgaagtcgagctggagaatgccgccgatgagagcaagtccgagattgacgcccttgagatgtcaagcaacgattcccggtcctctcttatccgtaagcggtctacaagacgttccgtgagggggagccaggctcaggatagaaagctgagtaccaaggaggcacttgacgaatcgatcccccccgtcagcttctggcgtattatgaagctgaacttgactgaatggccttatttcgttgtcggggtgttttgtgcaattatcaatggcggacttcagcctgcattcgcgattatcttctcaaagatcataggagtctttacccgaatagacgaccccgagaccaagcgccagaactccaacttgttctccctattgtttttggccctcggaataattagtttcattaccttctttttacagggtttcactttcggcaaagctggggagatcttaaccaaacggctcagatacatggtttttcgctcaatgttaagacaggacgttagctggttcgatgaccccaaaaacacaacaggagccctcactacccggcttgccaacgatgccgcgcaggttaagggtgccattggctcccgcttggctgtcattacccaaaatatcgctaatctgggcacaggaattattatcagcttcatatacgggtggcaactgaccctgttgttactcgccatcgtgcctattatcgctatcgctggcgtggtggagatgaaaatgctgtccggacaagccctgaaagataagaaggaactggagggctccggaaaaattgctacggaagcgatagaaaacttcaggacagtcgttagtttaactcaggaacagaagtttgaacatatgtacgctcagagcctccaggtcccataccggaatagcctgcggaaagcacacatctttggtattacgtttagtttcacccaggccatgatgtatttctcgtacgctggttgtttccggttcggcgcttatctggtcgcacataaactcatgtcctttgaagatgtgcttctcgtgttcagcgctgtggttttcggcgcgatggccgtcggccaggtttcttcttttgccccagattacgccaaggccaaaattagcgcagcccacatcatcatgatcattgaaaaaaccccacttattgatagttactcaacagaaggattgatgcccaacaccctggaaggaaatgttacttttggggaagtagttttcaactatcctaccaggcctgatatccccgtcctccaggggctgagcctcgaggtgaagaaaggccagacgctggcactggtgggctcgagtgggtgcgggaagagcacggtggtccaactacttgagcgattctacgatccacttgctgggaaagtacttctggacggaaaggaaatcaaacgactaaacgtgcagtggctcagagcccacctgggaatcgtgtcacaagaaccgatactatttgattgttccatagcagagaatatcgcatatggcgacaattctcgggtggtctcacaggaggaaatcgtacgggcggcaaaggaagctaatatccatgcctttatcgaatcccttccaaacaaatactccacaaaggtgggcgacaaaggtacccaactctctggtggccaaaaacagcgaattgcaatcgcacgggccctggtaagacagccccacatcctcctcctggatgaagctacttcagccctggacactgaatctgagaaagtggtgcaagaggcattagataaagccagagagggccggacgtgtatagttattgcacaccgtctgtcaacaattcagaatgccgacctcatcgtagtgtttcagaatggcagagtcaaagagcatgggacccaccagcagctcctcgcccagaaggggatttatttttccatggtctctgtccaggccgggaccaaaagacagtag

SEQ ID NO: 22911 - DNA, 3651 bp, Artificial Sequence
  Description of Artificial Sequence: Synthetic coding sequence
atggacctggagggcgaccggaacggcggcgccaagaagaagaactttttcaagcttaataacaagtccgagaaagacaaaaaagagaaaaagccaaccgtgagcgtcttctctatgttcaggtatagcaattggttggacaagctctatatggtggtcggaacactcgcagccatcatccacggcgccggccttcctctgatgatgttggtgttcggcgaaatgaccgatatctttgctaacgcaggaaacttagaggacttaatgtccaatattacaaatagatccgatatcaacgacaccgggttcttcatgaatcttgaagaggacatgactagtgacgtgagcaagatcaacgagggtatcggcgacaaaatcgggatgttcttccagagtatggccaccttcttcacggggttcattgttggctttacccgggggtggaagcttactttggtcatactggctatttcgcctgttttgggtctgagtgccgccgtgtgggcaaaaatcctgagcagcttcaccgataaggagctgctcgcctacgccaaagcaggggctgttgccgaagaggtgcttgccgcaatcagaaccgtcatcgctttcggcgggcagaagaaggagctcgagcgttataacaaaaacctagaggaagctaaacggatcggaatcaaaaaggcaatcaccgcaaacatatctattggggccgcatttctgttgatatacgctagctacgcgttagctttttggtacggcacgactttggtcttaagcggcgaatattccataggccaggtgcttacagtgtttttctcagtgctgattggcgcctttagcgtaggccaggcctcaccctcgatcgaggctttcgccaacgcaagaggagccgcttatgagatcttcaaaatcatcgataataaaccgtcaattgactcatactccaaatccggacacaagccagataacatcaaagggaacctcgaatttagaaacgtacatttttcatacccatcccgcaaagaagtcaagattttaaaaggcctgaacctaaaggtccagtccggccagacggtggcgctggtcggcaactcagggtgcggcaagagcactactgtgcaactgatgcagcggctgtatgaccccaccgaggggatggtgtctgttgacgggcaagatatccggacaatcaatgtcagattcttaagagagatcattggcgtcgtgtctcaggaaccagtgctgtttgctaccacgatagccgagaatataaggtatggaagggaaaacgtgacaatggatgaaatcgagaaggctgttaaggaggcgaacgcgtacgactttatcatgaagctgccacacaaatttgataccctagttggcgagcgcggcgcacaactctccgggggacaaaaacagcggatcgcaatagccagagccctcgtcagaaatcccaagatactgctcctcgatgaggccacatctgccctggataccgaaagtgaagctgtggtgcaggtggcgcttgataaggcacggaagggacgaaccaccattgtgatcgcacaccgcttaagcaccgtacgcaatgccgacgtgatcgccgggttcgacgatggcgtgatcgtagaaaagggaaaccatgatgagttaatgaaggagaaaggcatttattttaagctggtcaccatgcagacggccggtaatgaggtcgaactggagaacgccgcagacgaatctaagtcagagatcgatgccctcgagatgtcttccaatgattccagaagctcactaattaggaaacgctccactagacgttccgtgcggggtagccaggctcaggacaggaagctgtccaccaaggaagcactggatgagtcaattccacctgtgagcttctggcggatcatgaagctcaacctgaccgagtggccttactttgtggtgggcgtattttgtgcaattatcaatgggggcctgcagccagcttttgcaattatcttttctaaaataatcggcgtgttcaccaggatcgacgaccctgagactaagaggcagaactctaacttattttccctcctatttttggctctcgggataatcagttttattacattttttctgcaaggtttcacttttggcaaggcaggggaaatcctcaccaagcgcctgagatacatggtgtttcggagcatgttgagacaggatgtgtcctggtttgacgacccgaagaataccaccggcgccctgacaaccaggctggccaacgacgccgcccaggtcaagggtgcaattggctctcgcctcgcagtcataacacagaacatcgcgaacctcggtacaggcatcattatttcttttatatacgggtggcagctcaccttactattgctggccatcgtccctatcattgctatagccggagtggtggaaatgaagatgttgagcggacaagctttaaaggacaagaaggagctcgaaggttcgggaaaaatcgctaccgaagccatcgaaaacttcagaaccgtcgtatctctgactcaggagcaaaagttcgagcacatgtacgcccagagtttgcaggtgccctacagaaattccctccgcaaggctcatatctttgggatcaccttcagtttcacccaggccatgatgtatttctcatacgcagggtgcttccgtttcggtgcgtatctggtggcccacaagttgatgtccttcgaagacgtgctgctggttttttccgccgtggtgttcggagccatggccgtgggacaagtttcttccttcgcgcccgactacgcaaaagcaaagatcagcgccgctcatattattatgattattgagaagacaccgctcatcgatagctactcaacagagggcctaatgccaaacacattggaagggaacgtgacattcggagaggtagtctttaactaccccacccggccggatatccccgtcctgcagggactctcactggaagtaaagaaagggcaaacgttggcactggttgggagttctggatgtggaaagtcaaccgttgtgcagttgctcgaacggttctatgacccgttggcaggaaaagtactgctggacggcaaagagatcaagcgcctgaatgtccagtggctgagagcgcacctgggaatcgtgtcacaggaacctatactgttcgactgctcaatcgctgaaaatattgcgtatggcgataactctcgcgtggtgagtcaggaggagatcgtgagggccgctaaagaggctaatatccacgccttcatagagtcactgcccaataaatattcaactaaagtgggagacaaggggactcaattgagcggaggccagaaacagcggattgctattgccagggccctggttaggcagccgcacattctcctcctcgatgaggctaccagtgccctggacaccgagtccgaaaaagtggtgcaggaagcgctagataaggctagggaagggcggacttgcatcgtgatcgcacaccggctttcaacgatccagaacgctgatctgatcgtggtgttccagaatggcagagtcaaggagcacggcactcatcaacagttgctggcccagaaaggtatatacttcagcatggtttcagtccaggcagggacgaagcgacagtag

SEQ ID NO: 22912 - DNA, 4401 bp, Artificial Sequence
  Description of Artificial Sequence: Synthetic coding sequence
atggccctgcggggcttctgcagcgccgacggcagcgaccccctgtgggactggaatgtgacttggaacacttccaaccctgacttcacaaagtgtttccaaaatacagtactggtctgggtgccctgtttttatttatgggcttgcttccctttctactttttgtacctgtcacggcatgatagaggatatatccagatgactcctctgaacaaaacaaaaactgccctcggtttcctgctctggattgtgtgttgggccgacctgttctactcattctgggaacgcagccggggcattttcctcgcccctgtgtttctggtcagccccacactgctcggaatcaccatgttgctcgccacgtttctgatccaattagagaggagaaagggagttcaatctagcggcattatgctgacgttttggctggtggctctcgtgtgtgccctggcaattctgcgaagcaaaattatgacagcgctaaaggaggacgcacaggtggatctgttccgcgacatcacattttatgtctatttctccctactgctgattcagcttgtgctgtcatgcttcagtgaccgttctccacttttttcagagaccatccacgatcccaacccttgccctgaatcttctgcatctttcctgagtaggatcaccttttggtggattaccgggctcatcgtgcggggatatcggcagccattggagggctcagacctgtggtccttgaataaggaggacacatccgagcaggtggtgcctgtcctggtgaaaaattggaagaaagagtgcgccaagacaagaaagcagcctgttaaggtcgtatactcttccaaagatcccgctcagccaaaagagtcgtccaaagtggatgccaacgaggaggtggaggccctgatcgtcaagagcccccaaaaggaatggaacccctccctctttaaggtgctctataaaacgtttggcccttacttcctgatgagtttcttttttaaagccattcacgatctcatgatgttttctggccctcagattttgaagcttctgatcaaatttgttaacgatactaaggctcccgactggcaggggtacttctacaccgtgctcctctttgtcacagcctgtttgcagactctggtccttcatcagtactttcacatctgttttgtcagcgggatgaggattaaaaccgctgttattggagcagtatacaggaaggcactggtcataaccaacagcgcccgaaagtcctccaccgtgggcgaaatagtaaatctgatgtctgttgacgcccagcgctttatggatctggcaacctatattaacatgatctggagcgctccgctccaggtcattctggctctgtatctactgtggctgaatctgggcccgtccgttctcgcaggggtggccgtgatggtgttaatggtccccgtgaacgctgtgatggctatgaagacaaaaacctatcaggtggcccatatgaagtccaaagacaatcgcatcaaacttatgaatgaaatattaaatggtataaaagtgcttaaactctacgcatgggaactggcattcaaagataaggtgttagctattcgccaggaagaattgaaggttttgaaaaagtcagcttatctcagtgcagtgggtaccttcacttgggtgtgcactccttttctcgtagcactctgtacatttgcggtgtacgtgactatcgacgaaaacaacatcctggacgcccagactgcattcgtatccttggcgctttttaatattttgcgctttcccctgaatatattgcctatggtaatttcgtccattgtccaggcatctgtctccctaaaaagactgagaatattcctgagtcatgaagaacttgagccggatagtatcgagcggagacccgtaaaggacggcggaggcacaaattctattactgtgagaaatgcaacatttacatgggcacgctccgatccaccaacactaaatgggattaccttttcaatcccagagggtgcgctggtggctgtggtcggacaagttgggtgtggaaaatcctctctcctgtccgccctactggccgagatggacaaagtggagggtcacgtagccatcaaagggtcagtcgcatatgtgccccagcaagcgtggatccagaacgacagtttgagggaaaacatactgttcggctgccagttagaggaaccctactacaggagtgtgattcaagcgtgtgcattactgcctgatcttgagatcctgccatcgggcgatcgcaccgaaattggggaaaaaggcgtgaatctgtcaggagggcagaagcagagagtctctctcgcccgggctgtttactctaatgctgacatctatctgttcgatgaccctcttagtgccgttgacgcccatgtcgggaaacatatcttcgaaaatgtcatcggtccaaaaggtatgctgaagaacaaaactcgaatcctcgtgacccacagcatgtcctaccttccacaggtggatgtgatcatcgttatgagcgggggcaagatctcggaaatgggcagctaccaggagctgctggcgcgagatggcgcctttgccgaattcctgagaacctacgcctccaccgagcaagaacaggacgcagaagaaaatggcgtgacaggggtgtcaggcccggggaaagaggcgaagcaaatggagaatggtatgctggtgacggattctgcaggcaagcaacttcagaggcaattatcctctagttcttcctactccggggacattagcagacatcacaactcaactgcagagctgcagaaggccgaggccaagaaagaggaaacatggaaactcatggaggccgacaaggcacagaccgggcaggtgaaactatctgtatattgggactacatgaaagcaatcggcctgtttatctcgttcctttccatatttctgttcatgtgcaaccacgtttcagctctagccagcaactattggctgtccctttggaccgacgacccaattgtcaacggaacacaggagcataccaaagtcagattatccgtttacggagctctcggcatcagccagggtatcgccgtctttggatactccatggcggtctcaatcggcggcatcttagcaagccgttgtctgcacgtggatcttctccactctattctccgatctcctatgtccttctttgagaggacaccatcggggaatctggtgaatagattctccaaggagctggatacagttgatagcatgatcccggaggtaatcaagatgtttatgggctcccttttcaacgtgatcggagcctgtatcgttatccttctcgctaccccgattgctgccatcatcattccccccctcggcctgatatattttttcgtccagcggttctacgtggcgtcttctcggcagctgaagagattggagagcgttagccgctcacccgtttactcgcatttcaatgagaccctgcttggcgtctctgtgattcgcgcctttgaagagcaggagaggttcattcaccaaagcgacctaaaggtagatgaaaaccagaaggcttactacccgagtatcgtggctaatcgctggctcgctgtccgactggaatgcgtcggtaattgtatcgtcctattcgctgctcttttcgcagtgatttcccggcatagccttagcgccggcttagtaggattgtcagtctcgtattccttgcaggtcaccacatacttaaattggctcgtaaggatgtcttcggagatggagacaaatatcgtcgcggtggaacggttgaaggaatactccgagactgagaaagaggccccctggcagatacaggagaccgcccccccctcaagctggccacaagttggaagagtggagttcaggaattactgtttgaggtatcgggaggatctggacttcgtgctacggcatattaacgtaactatcaatgggggcgagaaggtgggaatcgtcggtcggaccggtgctggaaaaagctccctgacactggggctttttaggattaacgagagcgccgaaggcgagataatcattgacggtattaacatcgccaaaattggcctccacgacctgcgatttaaaataacaattattccacaagacccagtgctgttttctggaagtttgcgcatgaatctggaccctttttcccagtacagcgacgaagaggtctggacttcccttgagctcgcccacctcaaggatttcgtttctgccttacccgacaaactcgaccacgaatgcgccgaaggcggggaaaatctcagagtcattgtgctcgataaaggggagatccaggaatacggtgccccttcagatctgctacagcagaggggccttttctactccatggcaaaggatgccggactagtctag

SEQ ID NO: 22913 - DNA, 4428 bp, Artificial Sequence
  Description of Artificial Sequence: Synthetic coding sequence
atggccctgcggggcttctgcagcgccgacggcagcgaccccctgtgggactggaatgtaacttggaacacttctaatcctgacttcacaaaatgcttccaaaacactgttttagtgtgggttccatgtttctatctatgggcctgcttccccttttactttctgtatttgagccgacatgatcggggttacattcagatgacccccctcaacaaaaccaagactgccctaggctttcttctctggattgtctgctgggcagacttgttctacagtttttgggagcgatcgcgaggaatctttttagccccagtattcctggtctctcccactctgctggggatcaccatgctcttggccactttcctgattcagctggaacgaaggaagggtgtccagtcaagtggcatcatgctgacgttttggttagtcgctctagtttgtgctctggctattctgagatctaaaatcatgacggcattgaaagaagatgcacaagttgacttattccgcgacatcactttctatgtgtattttagtttactgctgatccagctggttcttagctgtttttccgatcgaagcccactgttttctgaaacaatccatgatcccaacccctgtccggagagctctgccagctttctgtcccgtatcaccttttggtggatcaccggcctcatcgtccggggttaccgccagccactggaggggagcgacctatggtctcttaacaaagaggatacatctgaacaggtggtccccgtgcttgtgaaaaattggaagaaagaatgcgcaaagaccaggaagcagcccgtgaaggtagtctactcttctaaggatccggctcaacctaaagagtcttctaaggtcgacgctaatgaagaggtagaggccctgatcgtgaagtctccccaaaaggaatggaatccttccctcttcaaggtgttatacaaaacatttggtccctatttcttaatgtctttcttcttcaaagccatccacgatctgatgatgttctcaggcccgcagatactcaaactgctgatcaagtttgtgaatgacaccaaagcaccagactggcagggatacttttacactgttcttcttttcgtgactgcatgcttgcaaaccctggtgctgcatcagtatttccacatttgcttcgtgtccggtatgcgaattaagacagccgttatcggcgcagtctatcggaaggctctcgtcatcaccaatagcgcacgcaaaagctccaccgttggagaaattgttaaccttatgtccgtggatgctcagcgatttatggatttggcgacctacatcaacatgatttggtcggcccccctacaggtaatactcgcactgtacctcctgtggctgaatttgggcccatctgtactggctggcgtagcggttatggtcttaatggtgccagtgaatgctgtaatggccatgaaaactaaaacctaccaagtggcccacatgaaatcaaaagacaatcggattaaacttatgaacgagatccttaacggcatcaaggtgctgaaactgtatgcttgggagcttgccttcaaggataaggtcttggccataaggcaggaagagctgaaggttctgaaaaagtcggcatacctatccgcagtcggtacatttacttgggtctgtactcctttcttagtggctttgtgcacctttgcggtgtatgtaacaattgacgagaacaacattctcgacgcccagactgcgttcgtgagcctcgcactgtttaatatcttgaggtttccattgaacatcctccccatggtgatttcctccatcgtacaggcttccgtgagcttgaaaaggttacggatcttcctgagtcacgaggagctggagcccgatagtattgagagacgtccagtaaaggacggtggcggaactaactccataacagtgcgcaatgccactttcacttgggctcgctccgatccccccactcttaacggtataaccttcagtatcccagagggggcgctagtcgctgtcgtcggccaggtggggtgtggtaagagctccctgctttctgcactgttggcggaaatggataaggtagaggggcacgtggcaattaaaggctccgttgcctacgtgcctcagcaagcttggatccaaaacgactcccttcgggaaaacatcctctttggctgccaattggaggagccctactatcggagcgtgatacaggcctgcgctctgctgcctgacctggaaatcctgccgtccggggaccgcaccgaaataggcgaaaagactcggattctggtcacccactcaatgagttacctcccacaggtggacgtgattatcgtgatgtcggggggaaagatctccgaaatgggctcctatcaggagttactggcacgcgacggcgcctttgcagaatttttacggacatacgctagcacagaacaggagcaggacgctgaggaaaatggagttactggcgtgtcagggccgggcaaagaggccaagcagatggaaaatggaatgctagttacagacagcgctggaaaacagcttcagagacaactgtcgtcttcatcttcgtattccggcgacataagccggcaccacaatagtacagctgagctgcagaaagccgaagctaagaaagaggagacttggaaactcatggaggccgacaaggcccaaaccggccaagtgaaacttagcgtgtattgggattacatgaaagccattggattgttcatttcatttctatcaatatttctttttatgtgcaatcacgttagcgctcttgccagtaattattggttgagcctgtggacagacgatcccatcgtgaatgggacacaggaacacactaaggtgagactgagcgtatatggtgcccttggcatctctcaaggtatcgctgtgtttggctacagcatggcagtatctattggcgggatcctcgcttcacgttgtctgcatgtggacctgctacattctattctccgctcacccatgtcattctttgaacgcaccccttcaggaaatctggtcaaccgcttttccaaggagctggataccgtcgacagcatgatccccgaagtgattaagatgtttatgggcagcttattcaacgtcatcggagcctgcatcgtaattctgctcgcaacgcctattgcagccataatcatccctccacttggcctcatttacttcttcgtgcaacggttttacgttgccagttcccggcagctgaaaagattagaatccgtatcacgctcacctgtgtacagtcattttaatgaaacactgctgggtgtgagtgtcatcagggctttcgaggagcaagaacgatttatccaccaaagcgatctaaaagtggatgagaaccagaaggcatattaccccagtatcgtcgccaacagatggctggccgttcgcctagaatgcgtgggcaactgcatcgttctctttgcggctctgtttgctgttattagtcgccactccctgagcgccgggttggttgggctgtctgtaagctacagtctgcaagtaactacctacctgaactggctggtgcggatgagttcggaaatggagactaatattgtggctgtcgagcgcctgaaggaatactcagaaacagaaaaggaggctccttggcagattcaggaaactgcgcccccatctagctggccccaggtgggacgcgtggagttcagaaattactgtttaaggtaccgcgaggacctcgattttgtgctcaggcacatcaacgtaacaataaacgggggcgagaaggtcggcatagtagggcgaaccggcgcgggaaaatcatcactgacccttggattgttccggatcaacgaatccgccgaaggcgaaatcataatcgacggaattaatattgccaagattggtctgcatgatttgagattcaagataacaatcattccccaagaccccgtcctatttagcgggagcctccgcatgaatctggatcctttttcccagtactccgacgaggaagtctggacatccctggagcttgcccatctcaaagactttgtgtcagctcttccagacaagctggaccatgaatgcgccgaaggtggcgagaacctgtccgtgggtcagcggcagttggtgtgtctggcccgcgcattgctgcgcaagaccaaaatcctggtgctggatgaggcgaccgccgccgtggaccttgaaacggatgacttaatccagagtaccatacgcactcaattcgaggactgtactgtcctgaccatcgctcaccggctcaataccattatggactacactcgcgtcatcgttcttgataagggcgagattcaggaatacggcgcaccctcggatctgttgcagcagcggggattattctactctatggctaaggacgccggcctcgtctag

SEQ ID NO: 22914 - DNA, 4251 bp, Artificial Sequence
  Description of Artificial Sequence: Synthetic coding sequence
atggccctgcggggcttctgcagcgccgacggcagcgaccccctgtgggattggaacgtgacctggaatacatccaatcccgactttactaaatgcttccaaaatactgttctcgtttgggtcccctgcttctatttatgggcttgttttcccttttacttcctatatctgagccgccatgatagggggtatatccagatgaccccactcaataaaacaaagaccgccctggggttcttgctctggattgtgtgttgggccgacctgttttattcattctgggaacgctccagaggaatttttctcgctccagtgttcctggtgtctcccaccctgctgggcatcacaatgctcctcgccacttttttaatccagcttgagcgcagaaagggggtgcagagctcaggtatcatgctcactttctggctggttgccctcgtttgtgccctggccatcctgcggagcaaaataatgaccgctctgaaggaggatgcacaggtggatttatttagggatatcacattttatgtgtacttttcattactcttgatccagcttgtgttatcgtgttttagtgatcgctcaccactgttctccgagacaatccacgatcctaacccctgccccgaatcgagcgcgtcctttcttagcaggattacgttctggtggatcaccggactcatagtgcgggggtaccgtcagcccctcgaaggctccgatctgtggtctttgaacaaggaagacacaagtgaacaggttgtcccagtgttagtgaagaattggaagaaggaatgtgcaaagacaagaaagcagcctgttaaagtggtgtacagctctaaagatcctgcccagccaaaggagagtagtaaggtcgacgctaacgaggaggtagaggctctgattgtcaagagcccccaaaaggaatggaacccgtctctcttcaaagtcctttacaagacctttgggccttatttcctgatgagcttcttctttaaagccattcatgacctcatgatgttttctggacctcagattctgaagcttctgattaagttcgttaacgacactaaagcccctgattggcagggatacttctataccgtcctgttgttcgtgaccgcctgtttgcagacactcgtcctgcatcagtacttccacatttgctttgtctctggaatgaggattaagacggccgtcatcggggccgtgtaccgcaaggccctggttattactaacagcgcccgtaagagtagcaccgtgggtgagattgtgaacctgatgagcgtcgatgcacaacgttttatggacctagctacgtatatcaacatgatctggtccgccccactgcaggtgattttggccctgtatttactgtggctgaatctcggcccaagcgtgcttgccggtgtggctgtcatggtactgatggtgcccgtgaacgctgtcatggcaatgaagacaaaaacatatcaagtggcccacatgaagtccaaggacaatagaattaagctcatgaacgagatattgaacggaatcaaggttctcaagttgtacgcatgggagctagccttcaaggacaaggtgctggcaataagacaggaggagctcaaagtgttaaaaaaaagtgcctacctctcagctgtgggcactttcacttgggtgtgcactcctttcctcgtggctttgtgcaccttcgcagtgtatgttaccatcgatgagaacaatatccttgacgcgcagactgcattcgtctctctggccttgtttaatattttgaggttccccctcaatatccttcccatggtgataagtagcattgtgcaggcctctgtgtctctgaaacggctgagaatcttcttatcccacgaggagctggagcccgatagtatcgaacgacgtcctgtgaaggatggagggggaaccaatagcatcactgtaagaaacgcaacctttacttgggcgcgcagcgacccccccactttgaatgggatcacattctccatccccgagggcgccctcgtggcagtggttggacaggtggggtgtggaaagagctctctgcttagtgcgttgttggctgagatggataaggttgaggggcatgttgcaatcaaaacccgtattctggtcacccatagtatgtcctatttgccccaggtggatgttatcatagtgatgtccgggggaaaaataagcgagatgggttcatatcaggaactgctcgctcgcgacggtgccttcgcagaatttctccggacctacgcctccactgagcaggaacaggacgccgaagaaaacggggtaaccggcgtaagcggccctgggaaagaggcgaaacaaatggagaacggcatgctggtcaccgactcagctggtaaacaactgcagcgccagttaagctctagttcctcttactcgggcgacattagcagacatcacaacagcacagccgaattacagaaagccgaagccaagaaggaggagacctggaaactcatggaagcagacaaggcacagacaggccaggttaagctgagcgtttactgggactacatgaaggcgatcgggctcttcatttcatttctgtctatttttttgtttatgtgcaatcatgtaagcgcactcgcttcgaattattggctgagcctctggactgatgaccccattgtgaatggtactcaggaacacaccaaagttcgactttctgtctacggcgccctcggtatcagccaaggtattgcggtgttcggttattcgatggccgtgtccataggcggtatactggcctcaaggtgcttgcacgtagacctgttacactccatcctgcgatctcctatgtccttttttgaaagaacccccagtggaaacttggtgaacaggttcagtaaagagctagacaccgttgattctatgatacctgaagtgataaagatgttcatggggtccttgtttaacgtgatcggcgcctgtatcgtgatcctacttgcgactccaattgccgcaatcatcatacctccactcggactcatttatttctttgtgcagcggttttatgttgcgtcctcccgacagctgaagcggctggagagcgttagtcggtcacctgtgtatagtcacttcaatgagaccctcctgggcgtgagtgttatcagagccttcgaagagcaggagagatttattcatcagagcgatctcaaggtcgatgagaatcagaaggcttattatcctagcatcgtggctaaccgatggcttgcggtcaggttggaatgtgttggcaattgcattgttctgttcgcagccttatttgctgtcatatcacggcactccctgtcggcagggctggtgggcttgtcagtgagctactccctgcaggtgacgacgtaccttaattggttagtgaggatgtccagcgagatggagaccaacattgtcgcagtggaacggttgaaggaatactcagaaacggagaaagaggcgccgtggcagatccaggaaacagctccaccatcaagttggccccaggtaggacgcgtggagtttcgcaactattgcctgaggtaccgcgaagacctggacttcgttctgcgacacatcaatgtcacaataaacgggggagagaaggtggggatcgtgggcaggaccggcgccggaaagagttccttgacactgggcctgttccggattaacgaaagtgccgagggtgagattataattgacggaatcaacattgctaaaattggtctccacgacctgagattcaaaataacgattatcccgcaagatcctgtgttattcagtgggagcctgagaatgaacctggatccattcagccagtactccgatgaggaggtttggacgtctttggaactcgcacacctgaaggatttcgtatcagcgttacccgacaaactcgatcacgagtgcgctgagggaggggagaacctgtctgtcggccagcgtcagctggtgtgcctggcgagggcactgctgagaaagacaaagatactcgtcttggacgaggctaccgctgccgtcgatctggagacagatgatctgatccagagcaccatccgcacccaattcgaagactgcaccgttctgaccattgcccatcggcttaatactattatggattatactcgggtgattgtgcttgacaagggcgaaattcaggagtatggtgcaccctccgatctactgcagcagcgtggattgttttattccatggcaaaagacgctggccttgtgtag

SEQ ID NO: 22915 - DNA, 4419 bp, Artificial Sequence
  Description of Artificial Sequence: Synthetic coding sequence
atggccctgcggggcttctgcagcgccgacggcagcgaccccctgtgggactggaacgtcacttggaataccagcaacccagatttcacaaaatgcttccagaatactgtgttagtatgggtgccatgcttttatctgtgggcctgttttcccttctattttctgtatctctcacgccatgacagagggtacatccagatgacacctctcaacaagaccaagacagcattgggtttcctcctatggatcgtctgttgggctgatctgttttattccttttgggagcgatctcgggggatcttcctggcccctgtctttctggttagccccacactactaggaattactatgcttctggctaccttcctgatccagctggaaaggcggaagggcgtccagtccagtggcattatgctcactttctggctagtggcacttgtgtgcgcattggccattctcaggagtaagattatgaccgcacttaaggaggacgcacaggtggatctgtttagagatataaccttttatgtttacttctctctactgcttatccaactggtgctaagctgtttttcggaccgctctcccctgtttagtgagaccatccacgacccgaacccttgcccggagtcatcagcctcattcctatcgcggattacattctggtggataacgggactaatcgtgcgaggctataggcagccactcgaaggttctgacctatggtctcttaacaaggaggacacgtccgaacaggtggtccccgtacttgtaaaaaattggaagaaggagtgtgccaaaacgagaaaacagcccgtgaaggtggtatactccagcaaggacccagcccagccaaaggagtcttcaaaagtggacgccaacgaagaggtcgaggcactgattgtcaagagtccacagaaagagtggaatccaagtcttttcaaagtattatacaagacctttggcccatatttcctcatgagtttctttttcaaagccattcacgacctcatgatgttctccgggcctcagattttaaagctcctgatcaagttcgtgaatgatactaaggcccccgactggcaggggtatttctacaccgtcctgctgttcgtgactgcctgcctgcagaccctggtgctgcaccaatacttccacatctgcttcgtttccggaatgcggatcaaaaccgcggtgattggcgccgtgtatagaaaggctctcgtcataactaattccgcccgcaaatcatccactgtgggagagattgtcaacctgatgagtgtagatgcccagaggtttatggacttggcaacttatatcaacatgatttggtctgctcccctgcaagttatcctcgctctgtatctactctggctcaatctcgggccttctgtcttggcgggagtagcagtgatggtgctgatggttcccgtcaacgccgtaatggccatgaaaactaaaacctaccaagtcgcacatatgaagtccaaggacaatcgcatcaagttaatgaacgagatcttaaatggcatcaaagtattaaaactgtacgcttgggaacttgcttttaaagataaggtcttggctattcgacaggaggagctgaaggtcctgaaaaaaagcgcttacctctctgcagttggtacatttacatgggtctgcacccccttcttggtggctctctgtaccttcgcagtgtacgtcacaatcgatgagaataatattcttgatgcccagaccgcttttgtgagtctggccctcttcaacatactgcggtttcccctcaacattctgccgatggtgatttccagtatcgtgcaggcctccgttagccttaagcgtttgcgtatctttctgtcacacgaggaactggaaccagattctatcgaacggcggccagtcaaggatggaggggggacaaattctattaccgttcggaatgcaacttttacttgggctaggtccgaccccccaacattaaatgggatcacattcagcataccggaaggggctctggtcgctgttgtcggccaggtgggctgtggtaaatctagtctcctatctgctcttctagcggaaatggacaaggtcgaggggcatgttgctattaagggagttaacctgtctggtggccaaaagcaaagagtgtcattggcccgcgccgtatacagcaatgccgacatctatctgtttgacgatcctctgagcgctgtcgacgcccacgtcgggaagcacatttttgaaaacgtgatcggtcccaagggcatgcttaagaataaaacgaggattcttgtcactcatagcatgtcctatctgccccaggtcgatgttatcattgttatgtcaggaggcaaaatcagtgaaatggggtcttatcaggaactccttgcccgagatggagcctttgctgaatttctccgaacgtatgcaagcactgaacaggagcaggatgctgaggagaatggagtcaccggggtgtccggtccaggtaaagaggctaagcagatggagaatggcatgctcgttactgacagcgcagggaaacagttgcaacgccaattatcttcttctagttcctattctggcgacattagtaggcaccataatagtactgctgagctgcagaaggccgaagctaaaaaagaggaaacctggaaactgatggaagccgataaagctcagacagggcaggtgaagctgtctgtgtattgggattatatgaaagccatcggtctgttcatctctttcttgtcgatcttcctgtttatgtgtaaccatgtgagcgcgctggcgagtaactattggctcagcctatggaccgacgaccctatcgtgaatgggacacaggagcacactaaagtgaggctgtcggtctacggagccctcggtattagccaagggattgctgtgttcggctattcgatggcggtgtccatagggggaatcctggcgagccgctgcctacacgtggacttactgcattcaatattgcgcagtcctatgtccttttttgagcgtaccccctccggcaatttagtcaaccgtttctctaaagagctggacacagtggattccatgatccccgaggttatcaagatgttcatgggatccttgtttaacgtcatcggagcttgcatcgtcatcctcttagcaacacccatagccgctattataattccaccactcggacttatctacttttttgttcaacgtttttacgtcgcatcttctcgccagctcaagagattagagtctgtcagccgtagcccggtgtattcacatttcaatgagacgctgctcggcgtgtcagtgattagggcattcgaggaacaggagcgcttcatccaccagtctgatcttaaagtggatgagaaccagaaggcctattaccccagcatcgtggccaatcggtggctcgccgtacgactggaatgtgtggggaattgcatcgtgctctttgctgccctctttgccgtcatcagtcggcactctttgtccgccggactggtggggctgtctgttagttacagcctgcaggttaccacctacttgaactggctagtaagaatgtcttctgaaatggaaactaatatcgttgcagtcgaaaggctaaaggagtattccgagacagaaaaagaagcaccatggcaaattcaggaaactgctcctccctcctcctggccccaggtcgggcgggtggagtttcgcaactattgcctgaggtatagagaggacctggattttgtcttaaggcacattaatgtcaccatcaacgggggtgagaaggtgggcatcgtcggaaggaccggcgctgggaagagttcattaacccttggattattcagaatcaacgaaagcgccgaaggagagattattatcgatggaataaacattgctaaaatcggcctgcacgatctccggttcaaaatcaccatcatccctcaggaccccgtattgttctccggaagcctgaggatgaatctcgacccatttagtcaatattcagacgaagaggtgtggacttccctggagctcgctcatttgaaggattttgtatccgccttaccggataaactggaccacgagtgtgccgaaggaggtgagaatctgagcgtgggacagagacagcttgtctgcttggccagagccttgctccgcaagaccaaaattctggtcctggatgaggcgaccgccgctgttgacctggaaaccgacgatctgattcagagtactattaggacacagttcgaggactgtacagtccttacaatcgcgcatcggctaaacaccataatggattatacccgggtcattgtgttggataaaggtgaaattcaggagtatggggcaccgtctgatctgctgcaacagcgcggacttttttacagcatggcaaaggacgctggactggtgtag

SEQ ID NO: 22916 - DNA, 4626 bp, Artificial Sequence
  Description of Artificial Sequence: Synthetic coding sequence
atggccctgcggggcttctgcagcgccgacggcagcgaccccctgtgggactggaacgtaacgtggaacacaagcaaccccgattttacaaagtgcttccagaacaccgttctggtttgggttccatgcttctacttgtgggcatgtttccctttttacttcctatacctgtcccgacacgatagaggatacattcagatgacacctctgaacaaaacaaagaccgccctcggcttcctcctgtggatcgtctgctgggccgacctcttctactccttttgggaaaggagccgcgggattttcctggcccctgtgtttttagtgtctccgacactcttgggcattactatgctgctggctacattcctaatccagctggaaaggagaaaaggtgttcagtcctctggcatcatgctaactttctggctggtggccctcgtctgcgctctcgccatcctccgctctaaaattatgacagccctgaaggaggatgcgcaagttgatttatttagggacattacgttttatgtttatttctctctcctcttaattcaattagtcctgagctgtttctccgatcggtcacccctgttttcagaaacaatccatgatccaaacccttgccccgaatctagcgcctcctttctctctcgaatcactttttggtggatcaccggtctcatcgtcagaggctaccgacagcctcttgaaggatctgatctatggtccctgaataaggaagacacgagcgaacaggtggttcccgttctcgtgaaaaattggaaaaaagagtgcgctaagactcgcaagcagccagtgaaggtggtatacagttcgaaggacccagcccagcctaaagagtcttcgaaggttgatgcaaatgaggaagtcgaggccctaatcgtgaagagtccgcagaaagagtggaatccatcattgtttaaggtgctatataagacttttgggccctacttcttaatgagctttttctttaaagcgatacacgacctaatgatgtttagtggaccccagattctcaaattacttataaagttcgttaacgacaccaaagcaccagactggcaggggtatttctacacagtgctccttttcgtgacagcatgcctgcagacactggttctgcaccagtacttccacatctgctttgtcagcggcatgcggataaagactgcagttattggcgcagtctaccggaaggccttagttattacaaattcggctagaaaaagcagtaccgtcggggagatcgtaaacctcatgagtgttgatgcccagaggtttatggacctggccacttatatcaacatgatctggagcgctcctctccaagtcatcttagcactgtatctgctgtggctgaacctgggcccaagtgtccttgcaggtgttgctgtcatggttctcatggtacctgttaatgctgttatggcaatgaaaacaaaaacctaccaggtagctcacatgaagtccaaagacaatcggattaagctgatgaacgaaatattgaacggtattaaagtgctgaaactgtacgcgtgggaactggctttcaaggataaagtcctcgccatccgccaggaagaactcaaagtgctgaagaagtcagcgtacctttctgccgttgggacgtttacctgggtttgtactccctttctcgtggccctctgtaccttcgccgtatacgtgaccatcgatgagaacaacatcctggatgcgcaaactgcatttgtatcgctggctctgtttaatatcttacgcttcccactcaatatactgccgatggtgatctcgagcattgttcaggccagcgttagcctgaaacggctccgaatcttcttatctcacgaagaactggagccagatagcatcgagcgtcggccagtgaaggatgggggcgggaccaattcgatcactgtccgcaacgcaacatttacctgggcccggtccgatccgcccacactgaacggaattacgtttagcatcccagagggggccctggtggccgtggtcgggcaggtaggctgcggcaagtccagtctcctctcggccctccttgccgaaatggacaaggttgagggccatgttgccattaagggctcagtcgcatatgtgccacagcaagcttggatccagaatgactccttgcgggagaacattctttttggctgccagctcgaagagccttactacaggtcagtgattcaggcttgcgccctcctgcccgacttggaaatcctgccctcgggtgataggacagagattggggagaagggagtgaatctgtcggggggacagaagcagagagtctctctggcaagggccgtgtatagtaacgccgatatttatctgttcgacgatcctctgagcgccgttgatgcccacgttggaaaacacatcttcgaaaacgtgataggcccaaaggggatgctgaaaaacaaaaccaggatactggtgacacacagcatgtcctacctcccgcaggttgatgtcatcatcgtcatgagcgggggaaagatctctgagatgggttcttaccaggaactcctggcgagagacggggcttttgccgaattcctgagaacatatgcttccacagaacaggaacaggatgctgaagaaaacggcagcactgtgatggacgaagaggaggcgggcgtcacaggggtgtcgggacctggaaaagaagccaagcagatggagaatggcatgttagtaactgacagcgccgggaagcaactccagcgacagctgagcagttcatcgtcatacagcggcgatatcagtcgccaccacaattcgacagcagagttacagaaggctgaggccaagaaggaagagacttggaagctcatggaggccgacaaggcacagactggccaagtcaagctgagcgtctattgggattacatgaaagccatcgggctgtttatttctttcttgagcatatttctttttatgtgtaaccatgtgagcgcactggctagtaactattggctgagcctgtggactgacgaccccatcgttaacggcacccaagagcacaccaaggtgcgactgagcgtttatggagccctggggattagccagggcatcgccgtgttcggttattcaatggccgtcagcatcggcggaattcttgcatctcgttgtctgcacgtagatctcttgcacagcatccttcgctctcccatgtctttttttgaacggacaccaagcggcaatctggttaataggttcagcaaagaactggacacagtggattctatgatccccgaggtcatcaaaatgtttatgggctctctgttcaacgtgattggggcttgcatcgtgatcttactggccacccccatagccgcaattatcattcctcctctcggtctcatatacttctttgtgcagcggttttacgtcgcctctagccgccaacttaaacggttggagtctgtcagccggtccccagtgtacagtcactttaacgagaccttgctgggggtctccgtgattcgggcatttgaggaacaggagaggtttattcaccagtctgatttgaaggtggacgagaaccaaaaggcttattacccttctatcgtggccaatagatggttggccgtacgccttgagtgtgtaggcaattgcatcgtcctgttcgcagcactgttcgccgttataagcagacattctctctcagctggcctggtgggtctttccgtgtcctactccctgcaagtgactacctacctcaactggctggtcaggatgagctctgagatggagacgaacattgttgctgtcgagcggctgaaagagtatagcgagactgaaaaagaggctccatggcagatccaagagactgccccacccagcagttggccgcaggtgggccgcgttgagtttaggaattactgcctgagatacagggaggatctggattttgtgttgcgtcatattaatgtcacaattaacggcggcgagaaggtcgggattgtcgggcgaaccggcgctggaaaatctagtctgactctaggcttgttccggatcaatgagagcgctgaaggtgaaattatcatcgacggtatcaatattgccaagattggtctgcatgaccttcgtttcaagataacaatcattccccaagaccctgtcctgttcagcggaagcctccggatgaatctggatccattctcccagtattctgacgaggaggtgtggacatctttagagctagcccacctgaaagacttcgttagcgccttacccgacaaacttgatcatgaatgcgccgagggcggtgaaaatctgtctgtaggacagcgtcagctggtgtgcctggccagggctctcctgcgaaaaacaaagatcctggttctggatgaggcaactgctgcagtagatctggagaccgatgatctgattcagtctactataaggacccagttcgaggactgcactgtacttacaattgcgcatagattgaataccatcatggattacacaagagttattgtgctggacaaaggtgagatccaggagtatggcgctccaagtgatctgctgcagcagcgcggcctcttttatagtatggctaaagacgccgggctggtgtag

SEQ ID NO: 22917 - DNA, 4596 bp, Artificial Sequence
  Description of Artificial Sequence: Synthetic coding sequence
atggccctgcggggcttctgcagcgccgacggcagcgaccccctgtgggactggaacgtgacatggaatactagtaatcccgactttactaagtgcttccagaatacagtcctggtctgggtcccgtgcttttatctgtgggcctgtttccccttctacttcctgtacctaagccgtcacgacaggggatacattcagatgacgccactgaacaagaccaagaccgcgctgggcttcttactatggatcgtctgctgggcggatcttttctactctttctgggagcggtcaagaggcattttcctggcgcccgtatttctggtcagccctacgctgctgggcatcactatgctgctcgccacttttctgatccaattagagcgccgcaagggagtccagtcttctggaattatgctcacattttggcttgttgcccttgtgtgtgctcttgcaatcctgaggtccaagatcatgacggcacttaaagaagacgcccaggtagatcttttccgtgatatcacgttctatgtgtatttttcactgctgctgatccagctagtgttgtcctgtttctccgaccgcagccctttatttagcgaaactatccacgaccctaatccttgtccagagagttcagccagctttttaagccgaattaccttttggtggattacggggcttattgtccggggctatcgccagccgcttgagggatctgacctgtggtcactgaataaagaggatacctcggagcaagttgtgccagttttagtgaaaaactggaagaaggaatgtgccaaaactagaaaacaacccgtgaaggtggtctacagctcaaaggatccagcccaacccaaggagagtagcaaagtggatgccaacgaggaagttgaggccttgattgtgaaatctccacaaaaagagtggaaccccagtctctttaaagtcctgtataagacgtttggcccttattttctcatgtcttttttctttaaagccatacatgacctcatgatgttttcggggcctcagattcttaagctgctgattaagttcgtgaatgataccaaagccccagactggcaaggctacttctacaccgtgttgttgtttgtgaccgcctgtctgcagacccttgtactgcatcagtatttccatatttgtttcgtgagcgggatgaggattaagacagcagtgatcggtgccgtgtaccggaaggcactagtcatcactaacagcgctagaaagagctccactgttggtgagatcgtgaacctgatgtctgtagatgcccagcgtttcatggaccttgccacctatatcaacatgatctggtcggctcctttgcaggtgatcctggcactgtacttgctgtggctgaacttaggcccatcagtgctggcgggcgtcgcagtgatggtcctgatggtaccggtgaatgcagtcatggctatgaaaactaagacctaccaggttgctcacatgaaatcaaaagataatagaattaagctgatgaacgagatcctgaacggtatcaaggtgctgaagttgtatgcctgggaactcgcttttaaagacaaggtgttggcaattcgccaggaggaactcaaggtgctgaaaaaatctgcctatctgtccgccgtgggaacctttacctgggtgtgtacccccttcttggtcgcgctgtgcacattcgctgtatacgttactatcgacgaaaataatatcttagacgctcagacggcctttgtgtccctcgccctgtttaatattctgcgcttcccactcaatatattgcccatggtgatttccagcattgtgcaggcttctgtctctctgaagcgactccgcattttcctgagtcatgaggagttggaaccagacagcatcgagcgccgtcccgtcaaagacggtggcgggacaaactcaataaccgtgagaaacgctaccttcacttgggctaggagtgaccctccaaccttaaatggtataactttcagcatcccagaaggcgccctcgtagctgtcgtgggccaggtggggtgtggcaagagttctcttctgagtgccctcttggccgagatggataaggtcgagggccacgttgcgataaagggttccgtggcgtacgtcccacaacaagcctggattcaaaatgactccctgcgggagaatatccttttcggctgccagctggaagaaccttactatcggtccgtgattcaagcctgcgcgctcctgcctgatcttgagattttgcccagcggtgaccgaacagagatcggagaaaaaggcgtgaacctcagcggaggtcaaaaacagagggtttctctggcacgggcagtgtattctaacgccgatatttacctgtttgacgatcccctctcagccgtcgacgctcacgtgggcaagcatattttcgagaatgtgatcggcccgaaaggcatgcttaagaacaagacgaggatcctggtgacccactccatgtcttatttgcctcaggttgatgtcatcatcgtaatgtctggcgggaagattagcgagatggggagttaccaggagctgctggctcgggacggcgctttcgcagagttcttaagaacctacgcgagcaccgagcaggagcaggacgcagaggaaaacggcgtgacaggcgtcagcggacccggtaaggaggcgaaacagatggaaaacggcatgctggtgactgactccgccggaaagcagctccagaggcagctcagttctagctcaagctactctggtgatatatccaggcaccacaatagcaccgcggaactccaaaaggccgaggcgaaaaaggaggagacatggaagctaatggaagcagacaaagcccaaacgggacaggtaaagctgagcgtgtactgggactacatgaaagcaatcggactctttattagttttttgtccattttcctcttcatgtgtaatcatgtgtctgccctcgctagtaactactggctttcactctggaccgacgatccgatcgtgaatggaacacaggaacacaccaaagtaaggctgtctgtgtatggcgccttggggataagccaggggattgccgtgtttgggtacagcatggcagtttccattggtggaattttggcctcccggtgtttgcacgttgacttgcttcacagcatcctcagaagccccatgtccttctttgaacggaccccaagcggaaatctcgttaacagattctccaaggagctggacactgtggacagcatgattcccgaagtgattaagatgtttatgggtagcctatttaacgtaatcggggcctgtatcgtcatcctgctggcaacacctatcgctgccatcataatacccccactcggactcatctatttctttgtgcagaggttctacgtggcatcgagccgccagttaaaacggctagaaagcgtctcgagatctccggtgtattcacactttaatgaaacgttgttaggcgtctctgtcattagagcctttgaggagcaggagcgcttcatacaccagtcagatttgaaggttgacgagaaccaaaaggcctattatccctccatcgtggcaaatcgttggctggcagtgcggctggagtgcgtggggaactgtattgtcctattcgccgccctgtttgccgtgatttctagacatagcttaagcgcgggcctcgtgggcctgtccgtttcttattcgcttcaggtgaccacctacctgaactggctggtgagaatgagctctgaaatggagaccaatatcgttgccgtggaaagattgaaagaatacagcgagaccgagaaggaagcaccctggcagattcaggagaccgcaccaccaagttcttggccccaggtcgggcgagtggaatttaggaactactgtctgaggtaccgggaggacctggatttcgttttgaggcacataaacgtaacaatcaacggaggtgagaaggtagggatcgtgggtagaacaggggccggaaagtcatcactgactctgggcttattcagaatcaacgagtcagccgaaggcgagatcatcatagacggcataaatattgctaaaattgggctgcatgatctgagattcaaaatcaccatcatcccacaggatcccgtgcttttcagcggctcacttcggatgaacctggacccattttctcaatacagtgatgaagaggtgtggacatcgctggagcttgcgcacttgaaggactttgtttccgccctgcctgacaagctggatcacgagtgcgccgagggaggtgagaatctatctgtgggccagcggcagttagtgtgcctggctagggcgttgttaaggaaaacaaagattctggtgctggacgaggcaacggcagcagtagacctcgaaacagacgacctgattcagtcaactataagaacccagtttgaggattgtaccgtcttgacaatcgcccaccgcttaaacaccatcatggattatacacgggtcatcgttttggacaaaggagagattcaagaatacggagctccgagcgacctgctgcagcagcgcgggctgttctactccatggcaaaagatgccggcctggtgtag

SEQ ID NO: 22918 - DNA, 3648 bp, Artificial Sequence
  Description of Artificial Sequence: Synthetic coding sequence
atgagcttcttcttcaaggccatccacgacctgatgatgttcagcgggccccagattttgaagcttctaatcaaatttgtgaatgataccaaggctcctgattggcaggggtacttctacaccgtactactattcgtgaccgcatgtctgcagaccttggtcttgcaccaatatttccacatctgttttgtttccggcatgagaatcaaaaccgctgtcatcggtgccgtgtaccgaaaggcactggtcattaccaatagcgcaaggaagtcctcaactgttggagagattgtgaacctgatgtctgtggatgcacaaagattcatggatctggccacctatataaacatgatctggtctgcaccactccaagtaatccttgccctctaccttctctggttgaatctgggcccatcagtgctggctggggtcgcagtgatggtgctcatggtgcctgttaacgcagtaatggctatgaagacaaagacctaccaggtggcccacatgaagtctaaggacaacagaataaagctgatgaatgagatactaaatggcatcaaggttttgaaattatatgcctgggaacttgcatttaaggacaaggtgctggccatacggcaggaggaactcaaggttcttaagaagagtgcatatctgtcagctgtgggaactttcacctgggtctgtactccgttccttgtggctctgtgtacttttgccgtgtacgttaccatcgacgaaaacaacattcttgacgctcaaaccgcctttgtgtccttagctttgtttaatattctgaggttccccctcaacatccttcctatggtgattagtagcattgtccaggcttcggtgagccttaagaggctccggatcttcctgtcacatgaggaactcgaacctgacagcatcgagcgacggccagtgaaggatggcggagggactaacagcattacagtgagaaacgcaactttcacctgggctcggtcagacccacctaccctcaacggaattacctttagtattcctgagggggctctggtagccgtagtcggacaagtgggctgcggtaagtcatctttgctgtctgcactgctggcagagatggataaggtggaagggcatgtggctatcaagggatctgtggcctacgtcccccaacaagcctggatccagaatgactctctccgggagaatatcctgttcggatgccagctggaagagccttactaccggtctgtcatacaagcatgcgcactgctgcctgaccttgaaattctgccttcaggtgatagaaccgagattggagaaaaaggcgtaaaccttagcggaggccaaaagcagcgcgtgtccctagccagggccgtttactcaaatgccgacatatacttgttcgatgacccacttagcgccgtggacgcccacgtgggtaaacatatttttgaaaacgttattggccctaaggggatgctcaagaacaagacgaggatcctggtgacgcatagtatgagttatctgcctcaagtggatgtcatcattgtgatgtctgggggcaaaatttccgaaatggggtcttatcaagagctgcttgctagagacggggcatttgcagagtttctgagaacttacgcaagcacagagcaagagcaggatgctgaggagaacggtagcacagtgatggatgaggaggaagcgggcgtgaccggcgtttctggtccagggaaggaagccaagcaaatggagaacggcatgctagtgacagacagcgctggtaagcaactgcaacgccagctttcatcttccagcagctactccggagatatttctcgacaccacaatagtactgcagaactgcagaaggccgaggctaaaaaagaagagacctggaaacttatggaagctgacaaggctcaaacgggtcaggtcaaactctcagtgtactgggactacatgaaagctattgggctgttcatctccttcctcagtattttccttttcatgtgcaaccacgtttccgcacttgcttctaactactggctgtctctctggactgatgatccaatcgttaatggcactcaagaacacaccaaagtgcgtctctccgtctacggcgccctagggatcagccaggggatagctgtttttggatactcaatggcagtctcgattggggggatcctggcctcccgctgccttcacgttgacctccttcacagcatcctcaggtctccaatgagcttttttgagaggaccccgtccggcaatctcgtgaaccgcttctccaaagagctcgataccgtggatagcatgattccggaggttataaagatgtttatgggctctctgtttaacgtcatcggggcctgtatcgtgattctgttggccacaccgattgctgcaatcattattcctcctcttgggctgatttacttcttcgtccagcgcttttatgttgcatcctcaagacagttgaaacgtttggagtccgtgtctaggtcacctgtttatagccatttcaatgaaacattactgggggtcagcgttatccgggcctttgaggagcaggaacgattcattcatcaaagcgacctgaaggtggatgagaaccagaaagcctactacccctcaattgttgccaatcggtggctcgcagttcggttagagtgcgtgggtaattgtatagttctgttcgcagctctgttcgcggtgataagcaggcatagtctgtccgcaggtttagtgggcctttccgtaagttattccttacaggttaccacctacttgaattggttggtgaggatgtctagtgagatggagacaaacattgtcgccgtggaacggctcaaagagtattctgagaccgagaaagaagcaccatggcagatccaggaaaccgccccgccttcctcctggccccaggtcgggagagtagaattccgtaactactgcctgaggtatagagaagatcttgacttcgtgttgagacacataaacgtgactatcaacgggggtgaaaaggtgggcatcgtcggtcgcaccggtgctggtaagagtagtctgacgctgggcctctttagaataaacgaatcagctgagggcgagattatcattgatggtatcaatattgcaaaaatcggactgcatgatctgcggtttaaaattacaataatcccccaagacccggtcttattctcaggctccctgcggatgaacttagacccctttagccagtacagcgatgaggaggtgtggacctctttggaactggctcatttgaaagactttgtttctgctttacccgacaagctcgaccacgagtgtgccgagggcggcgagaatctcagtgttggacaaaggcagctggtttgcctggcgcgggccctgttacgaaaaaccaagattctggtgctcgatgaagccacagccgccgtggatctcgagaccgacgatctcatccaatctaccattcgcacccagttcgaagactgcacggttcttactattgcgcaccggctcaacaccatcatggactacacacgggtcatcgtgctggataaaggggagattcaggagtacggggccccaagcgacctgctgcagcagagggggctgttctattctatggctaaagatgccggactggtgtag

SEQ ID NO: 22919 - DNA, 1968 bp, Artificial Sequence
  Description of Artificial Sequence: Synthetic coding sequence
atgagcagcagcaacgtggaggtgttcatccccgtgagccagggcaacacaaatggttttcctgcgaccgcttccaacgatctgaaagcgttcacagaaggcgctgtattgtcctttcacaacatctgctaccgtgtgaagttaaagtcagggtttctgccttgcaggaaacctgtagaaaaagaaattttgtcaaacatcaatgggattatgaagcctggactgaacgccattttggggcctaccggcggagggaaatcctccctcctagatgttctggctgcccggaaggacccctcaggcctgtctggcgatgtgctgattaatggtgcccctagaccagcgaatttcaaatgcaacagcggatacgtggtccaggacgatgtggttatgggtacactgacggtgcgggaaaatctgcagtttagcgcagcactgcggctggccacaactatgacaaatcatgaaaaaaatgagagaatcaatagggtaatacaagaactgggcctggataaggtggcagatagcaaggtcggcacccagtttatccggggcgtctcggggggtgaacgaaagagaacatcaataggcatggagcttatcactgatcctagcatactctttcttgatgagcccaccactggactggactcatccaccgcaaacgctgtcttgcttctgcttaagagaatgtctaaacaggggcgtacgattatattctctatccaccagcctcgctactctatctttaagttatttgacagtcttaccctattggcttcagggaggctgatgttccacgggccagcacaggaagcgctgggatacttcgagtctgcggggtaccattgcgaggcctacaacaatcccgccgactttttcttggacatcattaacggcgatagcactgctgtggccctgaatagggaagaggacttcaaagccaccgaaataatcgagccaagcaaacaagacaagcccctgattgaaaagctggccgagatctacgttaatagcagcttttataaggagaccaaagcggagctacatcagctgtcagggggcgagaagaagaaaaagattaccgtgtttaaggagataagctacaccacgtcattctgtcatcagctgcgctgggtaagtaaacgaagtttcaagaacctgcttggaaacccacaggcgtctatagctcagattatagtcactgtggtgcttggactggttatcggtgctatctattttgggctgaaaaatgattcgacagggattcaaaatagagccggggtacttttttttctgacgacaaatcagtgcttctctagtgtttccgccgtggaactgttcgttgtggagaagaagctctttatccacgaatacatttctggatactatagggtgagttcttactttcttggaaaactcctaagcgacttgttaccaatgcgaatgctcccttccatcatattcacatgcatcgtttactttatgctgggcctgaagccaaaagctgacgcatttttcgtgatgatgtttactttaatgatggttgcatattctgctagtagtatggccctggccatcgccgcaggccagagcgtggtgtccgttgctaccctgctgatgactatttgttttgtatttatgatgattttctctggcctcctggttaacctaacaactattgcttcatggctgagctggttgcaatatttctcaatcccaaggtatgggtttacagctctccagcataacgagtttctggggcagaatttctgccctggactcaacgctaccggaaacaacccttgtaattacgccacatgtaccggcgaggaatacctggtgaagcaggggatcgatctatcaccatggggtctctggaagaatcatgtggcgctcgcctgtatgattgtgatcttcctgaccattgcgtatctgaaattactcttcctgaagaaatacagctag

SEQ ID NO: 22920 - DNA, 1836 bp, Artificial Sequence
  Description of Artificial Sequence: Synthetic coding sequence
atgagcagcagcaacgtggaggtgttcatccccgtgagccagggcaatacgaacggcttccctgccactgcttcaaacgatctgaaggctttcactgagggagctgtgctaagtttccataatatttgctatagggtgaaactcaaaagtggcttcctgccttgtcgtaaacccgttgaaaaagaaattttatcaaacattaacggcataatgaagcccggactgaacgcaatcctcggaccaaccgggggaggaaaatcttctctgcttgacgtgctagctgccagaaaagatcccagtggcctgagcggggacgttttaatcaatggggccccgaggccagctaactttaagtgtaattccgggtacgtagttcaggatgatgtggtgatgggcactttaacagtcagagaaaatctgcagtttagtgccgccctcaggctggccaccactatgactaaccatgaaaaaaatgaacggatcaacagggtgatccaggaattaggcctagataaagtggccgacagtaaggtcgggacccaattcatccggggcgtcagcggcggagaaagaaaacggacatcgatcggaatggaactgatcacagatccttcaattctgtttcttgatgagccaactaccgggctcgattcttccaccgccaacgccgtgctgttattactgaagcgcatgtcaaagcagggaagaacgataatctttagcatacatcaacctaggtatagcatattcaagctgtttgacagcctgaccttactagcatccggtcgtctcatgttccacgggccagcacaggaggctctggggtactttgagtccgcgggctaccactgcgaggcctacaataaccccgcagactttttcctcgacatcatcaatggagattcaaccgctgttgcattgaatcgggaggaggacttcaaagctaccgagatcatcgagcccagcaagcaggacaagcctctgatagagaagttggcagaaatctacgtcaatagcagcttctataaagagactaaagccgagctgcaccaactgtccgggggcgaaaagaaaaaaaaaataacagtcttcaaagagatctcttacaccacttctttctgtcaccaactgaggtgggtttccaaacggtcctttaaaaatctgctgggcaatccacaagcgtcgattgctcagataattgtcaccgtcgtgctggggcttgttataggcgctatatatttcgggctgaaaaatgatagcacaggcattcagaatcgtgccggagtgctcttcttcctcaccactaaccagtgtttctcttctgtgagcgccgtggagctgtttgttgtggaaaaaaagcttttcatccacgagtacattagtggatattaccgcgtgtccagttatttcttgggcaaactactgagcgatctgttgcctatgagaatgctcccctccatcatatttacatgcatagtgtattttatgttgggtttgaagcccaaggcggacgcattttttgtcatgatgttcaccctgatgatggtcgcgtattcagcctcctccatggccctggcgattgcggccggccagagtgtggttagcgtcgctactctcctgatgaccatttgtttcgtcttcatgatggtctgctggagcatcagccagcccctgcacctgggatgccacggcttctccactagtgcctttcacgacatggacctgcgtctgtgctcaatcatgaatttctgggataaaacatccgcacaggacagcatgcagcaagaaaccatcctggtcaccatgcagcacgtgctagccaagaatatctggtag

SEQ ID NO: 22921 - DNA, 1212 bp, Artificial Sequence
  Description of Artificial Sequence: Synthetic coding sequence
atggaccggagcaaggagaactgcatcagcggccccgtgaaggccactgcacctgtaggcggacctaagagggtcctggtgacacaacagtttccctgccaaaaccccctccctgtgaattccggacaggcacagagagtgctctgcccatcgaacagctcgcaaaggattcctcttcaggcccagaaacttgtctctagccacaagcctgtacagaaccagaaacagaaacagttgcaggccacatcagtgccacacccagtgagcagacccttgaacaatactcagaagtcaaaacagcctctgcctagtgcaccagagaacaatccagaggaggaactggcaagcaagcagaaaaacgaggagagtaagaagcgacagtgggccctcgaagattttgagatagggcgccccttgggcaagggcaaattcggaaatgtgtaccttgcccgcgaaaagcagagtaagtttattctggccctaaaagtcttattcaaggctcagctcgaaaaggcaggagtcgaacatcaactgcgtagagaggttgaaattcagagtcacttgcgccacccaaatattctgcggctctacggttattttcatgacgctacccgcgtatacctcattctggagtacgccccattaggcactgtctacagagagctgcagaagctcagcaagttcgatgagcaaagaactgctacttacattactgagctggcgaacgccctgagctactgccatagcaagcgcgttatacatcgagacattaaacccgagaacttgctgttgggttccgccggagagctgaagatagcagattttggttggtccgtgcatgccccgagcagtagacggacaactttgtgcgggacactcgactatttacctcctgagatgatagaaggcagaatgcacgatgaaaaagtcgatttgtggtcactgggcgtactgtgttatgagttcttggtgggcaagccacccttcgaggcaaacacttatcaggagacctataaacgtatctcccgtgtggagttcaccttccccgacttcgtgaccgagggagcacgcgatctcattagcagattgctgaagcacaaccccagccagagacccatgctccgcgaagtgctggagcacccatggattaccgcgaactcctctaagccgtccaactgtcagaataaagagtccgcatctaagcagtcctag

SEQ ID NO: 22922 - DNA, 1212 bp, Artificial Sequence
  Description of Artificial Sequence: Synthetic coding sequence
atggaccggagcaaggagaactgcatcagcggccccgtgaaggccaccgcccctgttggaggacccaaaagagttcttgtgacgcaacagtttccttgccaaaatccactgcccgtcaatagtgggcaggcccaacgcgttctttgcccgtctaacagttctcagcgcatccctttacaggctcagaaactagtgtcatctcataagccggtacagaaccagaagcaaaaacagcttcaggccacgagcgtccctcaccccgtgagccgcccactcaacaacacgcaaaaatctaaacagccgctgcccagtgccccagagaacaatcctgaggaggagctagccagcaaacagaaaaacgaggagagtaaaaaacgacaatgggccctggaggacttcgagataggcagacctctgggaaagggaaaatttggcaacgtgtacttagcccgggagaaacagagtaaattcattctggctctgaaggtcctgttcaaggcacagctagagaaggcaggcgttgaacaccagctgcgtcgcgaggtggagatccagagccaccttcgacacccaaacattcttaggttgtatgggtactttcatgacgccaccagggtttacctcattctagagtacgctcctcttgggaccgtgtaccgcgaacttcagaagctgtcgaagttcgatgagcagagaactgccacgtatatcacagagctcgcgaacgccttgtcctattgccactcaaagcgcgtaatacaccgcgatattaagcccgagaacttgcttcttggcagtgccggtgaactaaagattgccgactttgggtggtctgtgcatgcgccatcctccaggcgaaccactctctgtggaacactagactacctccccccagaaatgatagaaggacggatgcacgatgagaaggttgacctgtggagtttgggagtcctgtgttatgagtttttggtgggcaagccgccatttgaggccaacacttatcaggagacatataagcggatttcaagggtggagttcacattcccggatttcgttacggagggcgcaagggatctgatctcacgcctgctgaagcacaacccctcgcagcggcctatgctgagggaagtgctggaacatccctggataactgccaattcctctaagccctctaactgtcagaacaaggaaagcgcttctaagcagtcatag

SEQ ID NO: 22923 - DNA, 1212 bp, Artificial Sequence
  Description of Artificial Sequence: Synthetic coding sequence
atggaccggagcaaggagaactgcatcagcggccccgtgaaggccacggcgcctgtgggaggaccgaagagagtgctagtcactcagcaattcccttgtcaaaatcctctgcctgtgaactcgggacaggcccagagagtcttgtgccccagcaattcttcccagaggattcccttgcaggctcagaaactcgtgtcatcacacaaaccagttcagaaccagaagcaaaaacagctgcaggcgaccagcgtgccacacccagtttctcgtcccttgaataacacgcagaagagcaaacaacccttaccgtccgcaccggagaataacccagaagaagaattggccagtaagcaaaagaacgaggagagtaaaaaacgccaatgggcactggaggacttcgagattggcagacctctaggaaagggtaaatttggcaacgtttatctggcacgcgagaaacaatctaaattcatcctggcactgaaagtcctatttaaggctcagctggaaaaggctggcgttgaacatcagcttagaagagaagtagagatccagtcccacttacggcacccgaatatcctgcggctctatggctacttccacgatgcaacccgggtgtaccttattttggagtacgctccgttgggtactgtttatcgtgagctccagaaacttagcaagtttgatgagcagaggaccgccacttatattacggagctggccaatgcactgagctactgccactcaaaacgcgtgatccatagagacattaagccagagaacctcctccttggtagtgccggggagctgaagatagccgatttcggttggagtgtacatgcacctagttctagacggactacactatgcggtactctcgattacttgccgcctgaaatgatcgaggggcgaatgcatgacgagaaggtggatctatggtcactgggtgtactttgctacgagtttttggttggaaagcccccattcgaggctaatacctatcaagaaacttacaaaagaatctcacgagtggaatttacttttcccgattttgtgactgaaggcgctcgggacttgatttctagactgctgaagcacaatccaagtcagagacctatgctccgggaagtgttagaacacccctggataaccgctaatagcagtaagccatcgaactgccagaacaaagaatccgcaagtaagcagtcatag

SEQ ID NO: 22924 - DNA, 1044 bp, Artificial Sequence
  Description of Artificial Sequence: Synthetic coding sequence
atggaccggagcaaggagaactgcatcagcggccccgtgaaggccacagccccagtgggcggccctaaacgggtgctggtgacccaacagttcccatgtcaaaatcctttacctgttaattctggtcaggcccagagggtcctctgcccttcaaattctagtcagaggattcccctacaagcacagaaattagtatcatcacataaaccggttcaaaatcaaaaacaaaagcagctgcaggctaccagcgtgcctcacccggtgtcaaggccattgaacaacacccagaagtcaaagcagccgttgccatcagctccagaaaacaaccccgaggaggagctggcttctaagcagaagaatgaagagagcaaaaagcgacaatgggctttggaggacttcgaaataggtaggcctcttggcaaaggtaaatttggcaatgtgtatctcgccagggagaagcaaagtaaattcatccttgctctgaaggtgctgtttaaagcccagttggaaaaagccggcgtggagcaccaattgcgcagagaggttgagatacagtcacatctaagacacccaaatattctcagactctatggctactttcacgatgcaacgcgggtatatctcattctcgagtacgcaccgctcggaaccgtatatagagagcttcagaaactctccaaattcgacgagcaacgcacagcaacatatatcaccgaattggctaacgctctctcttactgccacagcaagagagtgatccacagagatatcaagcctgagaatctgctgctcggtagcgccggcgagttgaaaattgccgacttcggatggtctgtgcacgccccgagcagcaggcggaccacgctgtgcggcaccctggactacttacctccagagatgatcgaagggcgcatgcacgatgaaaaggtcgacctgtggtccctgggcgttctgtgctacgagtttttggtcggcaagccgccctttgaagcaaatacctaccaggagacctataagaggatcagcagggtgcggcgaaactag

SEQ ID NO: 22925 - DNA, 1212 bp, Artificial Sequence
  Description of Artificial Sequence: Synthetic coding sequence
atggaccggagcaaggagaactgcatcagcggccccgtgaaggccactgctccagttggggggcccaaaagggtactcgtgactcagcaattcccatgtcagaaccctctccctgttaactccggccaagcacagcgtgtgttgtgcccctcgaacagcagccagaggatacctctccaggcgcagaaactcgtatcaagccataaacccgttcagaaccagaagcagaagcagttgcaggcaacttccgtgcctcaccccgtttcacggccactgaataacacccaaaaatctaagcagcctttgccaagcgccccggagaacaatcctgaagaagagttggctagtaaacagaaaaacgaggaaagcaagaaaagacagtgggccctagaggattttgaaattggccgcccacttggcaagggaaaatttggtaatgtctatctggctagggagaagcaaagcaagtttattctcgccttaaaagtattatttaaggcacagctcgaaaaagcgggagtggagcatcagctcagacgggaggtggagatccagagccatctgaggcaccctaacattcttaggctgtacggatatttccatgacgcaacccgtgtatacctgatcctggaatacgccccactgggcactgtttaccgcgagctgcagaaacttagcaagtttgacgagcagagaacggcaacatacataactgaactggcaaatgctttgtcttactgccatagtaagcgcgtgatccaccgggacatcaaacccgaaaacctactgctgggttcagcgggcgagttgaaaatcgctgattttggatggagcgttcacgcccctagctctcgtcggactaccctgtgtggcaccctggattacctgcctccagaaatgatcgaaggccggatgcatgatgaaaaagtggacttgtggagcttgggggtcctttgctatgagttcctggttggcaaaccgccattcgaagccaatacctatcaagagacatataagcggatttcgcgggtggagttcacttttccagattttgttacggagggagcaagggatctgatctctcgactgctgaagcacaatccaagtcaacgcccaatgttaagggaagtccttgagcacccatggattactgcaaatagctctaagcccagtaattgtcaaaataaggagagtgcatctaaacagtcgtag

SEQ ID NO: 22926 - DNA, 1212 bp, Artificial Sequence
  Description of Artificial Sequence: Synthetic coding sequence
atggaccggagcaaggagaactgcatcagcggccccgtgaaggccaccgcccccgtaggcggccccaaacgggtgctggttactcagcagttcccgtgtcagaaccccctgccggtaaactccggccaggcacagcgggtgctatgtccttcgaattctagtcagaggatcccactgcaagcacagaaactggtgtctagccacaagccagttcagaaccaaaagcaaaagcaactccaggctacaagtgtacctcaccccgtcagtagacctctcaataacacacagaaaagtaaacagcctcttccgtccgcacccgagaataatccagaggaagagttggccagcaagcagaaaaatgaagagagcaagaaacgccagtgggccctcgaggattttgagattggccgacccctgggtaagggcaagtttggaaatgtctatctggcacgcgagaagcaatccaaatttatcttggcacttaaggtactgttcaaggctcagttggaaaaagcaggggtggagcaccagcttagacgggaggtggaaatacaaagtcacctccggcacccaaatatcctgaggctgtacgggtactttcatgacgccacacgggtgtatctcatcctggaatatgcaccgctgggcacagtgtaccgggagctacagaagctgagtaagtttgacgaacagagaaccgcgacatatatcactgagctcgccaacgcgttaagttactgtcactctaaaagggtgatccaccgtgatatcaaaccggaaaaccttctcctgggttcggccggtgagctaaaaattgccgactttggctggagcgttcacgctccttcttcacgtcgcaccacactgtgcggaacgctggactacttaccacctgaaatgatcgagggtcgtatgcatgacgaaaaggtcgatttgtggagtctgggggtcctttgctacgagtttctggtgggcaaacccccatttgaggccaacacatatcaagaaacctacaaaaggatttctcgcgtggaattcacctttcctgatttcgtgacggagggcgcacgagacctgatttctcgcctcttaaagcacaacccatctcagagacctatgctccgcgaggtcctcgaacatccctggattactgccaattccagcaagccatccaactgccagaacaaagagtctgctagcaagcagagctag

SEQ ID NO: 22927 - DNA, 1212 bp, Artificial Sequence
  Description of Artificial Sequence: Synthetic coding sequence
atggaccggagcaaggagaactgcatcagcggccccgtgaaggccaccgctccagtcggggggcccaagagagtcctagtgacccagcaatttccctgccagaatccgctgccagtgaattccggtcaggctcagagggtgctgtgtccttcaaactccagtcagaggatccctctccaggctcagaagttggtctcctctcataagcctgttcagaaccagaagcagaagcagttgcaggccacatccgtgccccaccccgttagcaggcctctcaacaacacccagaaatcgaagcagcctttacctagcgcccccgagaacaaccctgaggaagagttagctagtaagcagaagaacgaggagagtaaaaaaagacagtgggccctggaagatttcgagattggacgcccactgggaaaaggcaaattcggaaacgtttaccttgccagagaaaagcaatctaaattcattctcgccctgaaagttctattcaaagcacaactcgaaaaggcaggagtggagcaccaactgcgacgcgaggtggaaatccaaagccacctgaggcaccccaacatcctccggctgtatggatacttccatgatgccacgagggtctacctgatcctggagtatgcacccctgggtaccgtgtatcgggagctccagaagcttagtaagtttgacgagcagcgcaccgccacatacatcactgagttggccaatgctctgtcctactgtcactccaagagggtgattcatagagatattaagcctgaaaacctgttactggggtctgctggagaactgaaaatcgccgattttgggtggagtgttcatgccccgagctcaagacgaacaacgctgtgcggaactttagattacctcccccctgaaatgatagaaggccgcatgcacgatgagaaagtagacctgtggagtctgggtgtattatgctacgaattcttagtgggcaagccaccattcgaggctaatacttatcaggaaacctataaacggatttcaagagttgaattcacgtttccagacttcgtaaccgaaggggcacgggacctgatttctcgccttttaaaacacaacccgtcccagcggcctatgcttagggaagtgctcgagcatccctggatcaccgcgaactctagcaaaccctcgaattgccagaacaaagagtcggcatccaagcagagttag

SEQ ID NO: 22928 - DNA, 1212 bp, Artificial Sequence
  Description of Artificial Sequence: Synthetic coding sequence
atggaccggagcaaggagaactgcatcagcggccccgtgaaggccacagctcctgttggaggccccaagcgggtactggtgacgcagcagtttccatgtcagaaccctctccccgttaatagcggccaggcacaacgggtgctctgtccgtcaaactcatcccaaagaatccccctgcaggcccaaaaactggtatcctctcataagcctgttcaaaaccagaaacaaaaacaactccaggccacatccgtgccacaccctgtgagcaggcccctgaataacacccagaagtccaagcagcctctgccctccgcaccggagaataaccctgaggaagagctcgccagcaaacagaaaaatgaagaatccaagaagcgacagtgggcattggaagattttgaaatcggcaggccactgggcaagggcaaattcggaaatgtgtaccttgccagagagaagcagtcaaagttcatcttagctctcaaggtgttattcaaggcacaactagagaaagccggagtggaacatcagcttaggcgcgaggtagaaatccagtcccacctcaggcacccaaatattctccggttatacggttatttccatgacgcgacccgggtctatttgatccttgaatatgcaccattgggtacagtgtaccgcgagctgcaaaaactgagcaagtttgacgaacaacggaccgcaacatacatcacagagctggccaacgctctctcgtactgtcattccaagagggtcatccaccgggacatcaaaccggagaatctcctactgggctctgccggagagcttaaaatagcagacttcggatggagcgtgcacgccccgtcttcaaggaggaccaccctttgcgggaccttagactacctaccaccagagatgatcgaagggcgcatgcacgatgagaaagtggacctgtggtctctaggcgtattatgttatgagtttcttgtggggaaacctccctttgaggctaacacttatcaggaaacctataaacgaatctcacgggtcgagttcacgtttccagatttcgtgaccgaaggcgcgcgcgatctgattagtcgcttacttaagcacaatccgtcacagagacccatgctccgggaagtgctggagcatccctggatcaccgccaacagttccaaaccctcgaactgtcagaataaggagtctgctagtaaacagtcctag

SEQ ID NO: 22929 - DNA, 1212 bp, Artificial Sequence
  Description of Artificial Sequence: Synthetic coding sequence
atggaccggagcaaggagaactgcatcagcggccccgtgaaggccacagcccccgtggggggccccaaaagagtattagttactcaacagtttccttgtcaaaacccactacctgtcaattcaggccaagcccagcgggtactgtgtccttctaacagttctcagcgcataccactgcaagctcagaagctggtgtcatcacacaagcctgtccaaaaccagaagcaaaagcagttgcaggctacatctgtccctcaccccgttagcagaccactgaataatacgcagaagtccaagcagcctctgccatctgctcctgagaacaatcctgaggaagagctggcctctaaacagaaaaacgaggagagcaagaagcgccagtgggctctagaagatttcgagattggtagaccattaggcaaagggaaatttggtaatgtctacctggctagggagaagcagtccaagttcatcctggctctcaaggtgttatttaaggcccagcttgaaaaggctggggtggaacatcagctgaggagggaggttgaaatccagtcccatttgcggcaccctaatatcttgcgattatatggctactttcacgacgctacgcgcgtgtatttaattctcgaatatgctccacttggcactgtctatcgcgagcttcagaaactctctaaattcgacgaacagcgcacagccacctatataacggagctggccaacgctctgagctactgccacagtaaaagggtcattcaccgcgacatcaaaccggagaatctgcttctggggtccgcgggtgagttgaagatcgcagatttcggctggtcagtgcatgctccatccagtagaagaacaacactgtgtgggacactggattaccttcccccagaaatgattgagggaaggatgcatgatgagaaggtcgacttgtggagcttaggcgtactctgttatgagttccttgtgggtaagcccccttttgaagcaaacacctaccaagagacctataagcgtataagtcgggttgagttcacctttccggacttcgtgactgaaggcgccagagacctgatctctcggctgcttaagcacaacccgtcacagagaccaatgctcagggaggtcctcgagcatccctggataactgccaatagctccaagccaagtaattgccagaacaaggagagtgcaagcaaacagtcatag

SEQ ID NO: 22930 - DNA, 570 bp, Artificial Sequence
  Description of Artificial Sequence: Synthetic coding sequence
atggaccggagcaaggagaactgcatcagcggccccgtgaaggccactgccccagtggggggtcccaagcgggtcctggtgacccagcaattcccttgtcagaatccactgcctgtgaacagtgggcaggcacaaagagtcctgtgccccagcaacagctcccagaggatccccttacaagcccagaagctggtgtcaagtcacaagcccgtacagaaccagaaacaaaagcagctccaagcgacctctgtcccacatcccgttagccggcctcttaataatacccagaagagcaaacagcctctgccctctgcccccgagaataacccagaagaggagctggcttcaaagcagaagaatgaggaatccaagaagcggcagtgggccctagaggattttgaaattgggcggccactcggaaaaggcaagttcgggaatgtgtacctggcgagggaaaagcagagcaaattcattctggcattaaaggtccttttcaaggcccagttggagaaagccggtgtagagcatcagctgagacgggaggtcgagatccaaagccacctgcgctag

SEQ ID NO: 22931 - DNA, 444 bp, Artificial Sequence
  Description of Artificial Sequence: Synthetic coding sequence
atggaccggagcaaggagaactgcatcagcggccccgtgaaggccaccgcgccagtgggtggaccaaaaagggtgctggtaacacagcagtttccatgccagaaccccctcccagtcaatagcggacaagctcagcgggtgctgtgtcccagcaacagtagtcagaggattcccctgcaagctcagaaactcgtgtcgtcccacaagccagtgcagaatcagaagcagaaacaattacaggctacatctgtgccccatcccgtgagcaggccacttaacaatacacaaaaatcaaagcagcccctaccatccgccccggagaataatccagaagaggaactcgcttctaagcagaagaatgaagagagcaagaagcgccagtgggccttggaagacttcgagatcgggcggcctctcggcaaaggcaagttcggaaatgtgtag

SEQ ID NO: 22932 - DNA, 816 bp, Artificial Sequence
  Description of Artificial Sequence: Synthetic coding sequence
atggaccggagcaaggagaactgcatcagcggccccgtgaaggccaccgctccagtagggggccctaagagggtcctggtcacgcagcagtttccctgccaaaaccctctccctgttaacagcggacaggcccaaagagtgctgtgtccttccaatagtagccagcgtattccgcttcaggctcagaagctggtgtcctctcacaagcccgtgcaaaaccagaaacagaagcagctgcaggccacgagcgtgcctcaccccgtcagccgccccctgaataacacccagaaatctaagcaacccctgccaagcgcccctgaaaataaccctgaagaggaattagcatccaagcagaagaatgaggagtcaaaaaagcggcaatgggccctggaagacttcgaaattggccgccccctcggaaaggggaagtttgggaatgtgtatctcgcccgggaaaagcagtccaagtttatactggctctcaaggtgctattcaaggctcagctggaaaaagctggcgtggagcaccaacttcgaagagaggtggagattcaaagtcatttaagacaccccaatatactacggctctatggttacttccacgatgccactcgagtctacctgatcctggaatacgcccccctcggaaccgtgtaccgcgagctccaaaaactctcaaagttcgatgagcaacgcaccgcaacatatatcaccgagctcgccaatgcgctcagctactgtcactcaaagcgggtgatccatcgagacatcaaacctgaaaatctgctgctgggtagcgccggggaactgaagtag

SEQ ID NO: 22933 - DNA, 240 bp, Artificial Sequence
  Description of Artificial Sequence: Synthetic coding sequence
atggaccggagcaaggagaactgcatcagcggccccgtgaaggccactgctccagttggcggaccaaaaagagtgctcgtgactcaacagtttccttgtcagaatccgcttccagtgaactctgggcaggcccagcgggtcctgtgcccttccaactccagccagcgcatccctctgcaggcgcagaagttagtctcctcacacaagcccgtacagaaccaaaagcagaaacagctctag

SEQ ID NO: 22934 - DNA, 321 bp, Artificial Sequence
  Description of Artificial Sequence: Synthetic coding sequence
atggaccggagcaaggagaactgcatcagcggccccgtgaaggccacggcaccagtgggtggcccgaagcgagtgctcgtgacgcaacagttcccctgtcagaatccactgccagtgaactccggtcaagcacagcgtgtactgtgccccagcaatagtagccaacgaatcccattgcaagctcagaagttggtttcttcacataaacctgtacagaaccaaaagcaaaagcagctgcaggccacatcggtcccgcacccggtgagtcgacccctcaataatacacaaaagtccaagcagcctctccccagcgcaccttag

SEQ ID NO: 22935 - DNA, 1035 bp, Artificial Sequence
  Description of Artificial Sequence: Synthetic coding sequence
atggcccagaaggagaacagctacccctggccctacggccggcagaccgcaccctcagggctaagcaccttgcctcaacgcgtccttagaaaggaacctgttacgcctagtgcgctggttctgatgtcgagatctaatgtacagcctaccgcggcacctggacagaaggtcatggagaattccagcgggactcctgacatactgacgcggcactttaccatagacgactttgaaattggccgaccccttggcaaaggaaaatttgggaatgtgtatttagcccgcgaaaagaaatcacacttcattgtagctctgaaagtgctgttcaaatcccagatcgaaaaggagggagttgaacaccagctgcggcgagagatcgaaatccaggcacacctgcaccacccaaacatccttagactgtacaactacttttatgatcggagacgtatctatctgatcctcgagtacgctccccgcggcgagctctataaagagctgcagaaatcttgtacctttgatgaacagaggaccgccaccattatggaggagttggcagatgctctcatgtattgtcatggaaagaaagttattcatcgtgatatcaaacctgagaaccttctgttgggcctgaaaggggagcttaaaatcgcagatttcggatggtcggtccatgctcccagtctccgcaggaaaacaatgtgcggcaccctggattacctaccacctgaaatgattgagggccgtatgcataatgaaaaggtcgatctctggtgcattggcgtcctctgttacgagctgcttgttgggaaccctccattcgaatccgccagccataacgagacatacagacgcattgtcaaggtggacctgaagtttccagcctctgtcccaatgggagcccaggatctgatttccaaactgctacggcataacccttcagagagattacccctcgctcaagtgagtgcccatccttgggtgagagccaacagccgtcgggttctgcccccctcggccctccaatcagttgcgtag

SEQ ID NO: 22936 - DNA, 912 bp, Artificial Sequence
  Description of Artificial Sequence: Synthetic coding sequence
atgagccggagcaacgtgcagcccaccgccgcccccggccagaaggtgatggaaaattcttcaggaacacctgatattcttactcgtcatttcacaattgacgactttgaaattggcaggccacttggcaagggcaaatttggaaatgtatatctcgcaagggagaaaaagagtcactttattgtcgctctgaaagtgctttttaagagccagattgagaaagagggcgtggaacatcagttgaggcgggagatagagattcaggcccaccttcaccatcccaatattctaagactgtacaactacttctacgatagacggcgtatttacctcatactggagtacgcgccaaggggagagctgtataaagagctgcagaagagctgcacattcgatgagcaacggacagcaaccattatggaagagctcgcggatgctttaatgtattgtcacggcaagaaagtgatccaccgcgacatcaagcctgaaaatctcctgcttgggctgaagggggagctgaagatagccgactttggctggagcgttcatgcgcccagtttaagacgcaaaactatgtgcgggaccttagactatctgccaccggagatgatagaaggccgcatgcataacgaaaaggtcgatttatggtgcattggcgttctgtgctatgagctgcttgtcggcaacccccccttcgaatctgcttcccataatgaaacctatcggaggatcgtgaaagtggatctcaagtttccagcctcagtacccatgggagcgcaggatttaatctccaagctgctgaggcataatccttctgagcgcctgccacttgctcaggttagtgcgcatccatgggtgagagcgaactctagaagggtactgccaccctccgccctccaatcagtggcctag

SEQ ID NO: 22937 - DNA, 1035 bp, Artificial Sequence
  Description of Artificial Sequence: Synthetic coding sequence
atggcccagaaggagaacagctacccctggccctacggccggcagacagctcctagcggcctgtcaacactccctcagcgggtcctgcgaaaggaacccgtgacaccgtcagcgctcgtgctgatgtctcgttccaacgtgcagccaacagccgcccccggccagaaggtgatggaaaacagttctggcactcccgatatattaaccaggcatttcactattgatgattttgagatcgggaggcccctcggcaaaggaaaattcggcaatgtatatcttgcaagggagaagaaatcccacttcatcgtcgcactgaaagtcctttttaaatcccaaattgaaaaagaaggcgtggaacatcagcttaggcgggagatcgagatccaggcacatctgcaccatcctaacattctgaggctgtataactatttctatgacaggagacggatatatctaatcctcgagtacgctccccggggcgaactctacaaggagctgcagaaatcttgtacatttgacgaacagcgaaccgccaccatcatggaggagcttgccgacgccctgatgtactgccacgggaagaaagttatacatcgcgacatcaagcccgagaatctgttgctggggctcaagggggaacttaagatcgccgattttggttggagcgtgcatgcacccagtctgagaaggaaaacaatgtgcgggacacttgattatctcccccccgagatgatagaggggcgaatgcataacgagaaagtggacctctggtgtataggcgtgctatgttatgagttgctggtgggcaatcctcctttcgaaagcgccagccacaatgagacttacagaaggatcgtgaaggttgacttaaaattcccagcttcagtccccatgggagcacaggatctgatcagtaagcttttgaggcacaaccccagtgagcggctgccattggctcaagtatcggcccatccttgggttagggctaactcacgcagagtcctcccaccttctgccttacaatccgttgcctag

SEQ ID NO: 22938 - DNA, 930 bp, Artificial Sequence
  Description of Artificial Sequence: Synthetic coding sequence
atgagcagcccccgggccgtggtgcagctgggcaaggcccagcccgctggtgaggagctggccactgccaaccaaactgcgcagcaaccatcatcacccgcaatgcggagacttactgtagatgacttcgaaattgggaggcccctgggcaagggtaagtttggtaacgtgtatctggctcgcctgaaagaaagccattttattgtggcactcaaggtactgttcaagagtcagattgagaaggaaggtcttgaacaccagctaaggcgcgaaattgagattcaggctcaccttcagcacccgaacatcctgcggctgtataattactttcacgacgcacggagagtttacctgatcttagagtatgctccccgcggggagctctacaaggagctgcagaaaagcgagaaattggacgaacaaaggacggctacgatcatcgaggaactggccgatgcacttacctactgtcatgacaagaaggtgattcatcgcgatatcaaacccgaaaatctcctattgggctttagaggagaagtcaagatcgccgacttcggatggagcgttcacacacccagtctcaggaggaagaccatgtgcggtacattggactacctgcctccggagatgattgaaggccgcacgtacgatgagaaggtagatctgtggtgcatcggggtcctgtgctacgagctgctggtgggctacccacctttcgagagtgcctcgcattcggagacctatcgacgaattcttaaagttgatgtgcggttcccgctcagtatgccacttggcgccagggacctaattagtaggttactgaggtatcagcccctggagcggttgcctttggcgcagatcttgaagcatccgtgggttcaggctcattccagaagggtgctgcccccctgtgctcagatggcatcatag

SEQ ID NO: 22939 - DNA, 873 bp, Artificial Sequence
  Description of Artificial Sequence: Synthetic coding sequence
atggccaccgccaaccagaccgcccagcagcccagcagccccgccatgcgacggcttacagtggacgatttcgaaatcggtcggcctttgggtaaaggaaagttcggcaacgtgtacctggcccgcctcaaagaaagccattttatcgtcgccctcaaggtactgttcaagtctcagatcgaaaaggagggactggagcatcaacttagacgcgagattgagattcaggcacatctgcaacacccaaacatccttagactgtacaattacttccacgacgcgcgaagggtgtatctgattcttgagtatgcgcctcggggcgagttgtataaagaattgcagaaatcagagaaactggacgagcagcgcacggcaaccatcatcgaggagctggcagacgctctgacttactgtcatgataaaaaggtgattcatagagatatcaagccagagaacctgcttctaggattccggggagaggtaaagatagccgactttggctggtcagtgcataccccatcccttaggcgcaaaaccatgtgcgggacgttagattacctgcctccagaaatgattgagggaaggacatacgatgagaaagttgacctctggtgtatcggggttctctgttacgaactgttggtgggatacccccctttcgaatccgcctctcactctgaaacatatcgccgcatcctgaaggtagacgtccgcttcccactgtctatgccacttggggctcgggatctcatatcgaggctcctaagatatcagcctctcgaaagactgcccttggcgcagatattgaaacacccttgggtccaggcccacagccgacgggtgctgccaccttgtgcacaaatggcatcttag

SEQ ID NO: 22940 - DNA, 828 bp, Artificial Sequence
  Description of Artificial Sequence: Synthetic coding sequence
atgcggcggctgaccgtggacgacttcgagatcggccggcccctgggcaagggaaagttcggtaatgtgtacctagctcggctgaaagagagccatttcattgtcgctttgaaagttctctttaagtctcagatcgaaaaggaagggttggagcatcagttaaggagagagatcgagatccaggcccatttacagcaccccaacatattaagactgtataactactttcacgacgcaaggagagtctacctgatcttggaatacgccccacggggagaactttacaaagagctccaaaagtctgaaaaacttgacgaacagagaactgccaccatcattgaggagctggccgacgcccttacatactgccacgacaagaaggtcatccaccgtgacatcaagcctgaaaaccttctgttaggctttagaggcgaggtaaaaatcgcagacttcggatggtcagtgcacaccccttccctgcgccgcaagacaatgtgtggcacattggattacctccctcctgagatgatagagggaagaacatacgacgaaaaagtggacctttggtgcataggagtcttatgctacgagctcctggtcggctacccccccttcgaatcagcctctcactctgaaacataccgacgaattcttaaggttgatgttcgattccccctgtccatgcctcttggggctcgggacctgattagtagacttcttcgatatcaaccgttggagagactgccactggctcagattctcaaacatccctgggtccaagctcactccagacgcgtgctacctccatgcgcgcagatggcctcctag

SEQ ID NO: 22941 - DNA, 2589 bp, Artificial Sequence
  Description of Artificial Sequence: Synthetic coding sequence
atgaacatccaggagcagggcttccccctggacctgggcgccagcttcacagaggacgccccccggcctcctgtgccaggagaggagggagagctggtatccacagatccacggcccgcttcatattcattctgttcgggtaaaggggtggggatcaaaggagaaaccagcacagccacgccacgaagatccgacctggacctgggatatgagcctgaggggtccgcctcccctacgcctccctaccttaagtgggcagaaagtctgcactcacttttagacgaccaggatgggatttctctctttcgaacttttctcaaacaggagggctgcgccgacttattagacttctggttcgcctgcacaggatttaggaaactcgaaccgtgtgattcaaatgaggaaaagcgcctgaagctggccagagcaatctaccgaaagtacatcctagacaacaacgggattgtgagccggcagactaagcccgccaccaagagcttcattaagggatgcattatgaagcagctgatcgatccagcaatgttcgaccaggctcagacggaaattcaggctacaatggaggaaaacacctatcccagtttcctgaagtccgatatctaccttgaatatacacggacaggtagcgagtcaccaaaagtatgttcagaccagtcatccggctcggggacaggaaagggtatcagcggctacctgcctactctgaatgaggacgaagagtggaagtgcgaccaagacatggatgaagatgatgggcgagacgccgccccaccaggtagactgccacagaaactcctgctggagaccgcagctcctcgggtgtcttccagtcgcagatatagtgagggccgcgaatttcgatatggatcctggagagaaccagtcaatccgtactatgtgaacgctggatacgctctggcaccggccacatcagctaacgattctgagcagcagagtctcagtagcgacgctgatactctgagtcttaccgactcatctgtggatggcatccctccctaccggataagaaagcaacatcgcagggagatgcaagaatccgtgcaagtgaacggaagggttcccctcccccatatcccacgcacctaccgcgtgcccaaggaggtgcgggtggaacctcaaaaatttgcagaggagctgatccaccgcctcgaagctgtgcaacggaccagggaagctgaggagaagctggaagaaaggcttaagcgcgttcgcatggaagaagagggcgaagacggagatccttcaagcggtccacccggaccttgtcataaactgccgcccgcccccgcctggcaccatttcccacctagatgcgtggatatgggctgcgccggcctacgcgacgcccacgaggaaaatccggaaagcatcctggacgaacatgtccagcgcgtactccgcactcctgggagacagagcccaggccccggacaccgtagcccagactcaggccacgtggcaaagatgccagtggctctaggaggcgccgcctccggacatggaaagcatgtgcccaaaagtggtgcaaaactggatgcggctggactgcatcaccaccggcacgtgcatcatcacgtgcaccacagtacggctcgaccaaaggaacaggtagaagcggaggccactaggcgggcacagagtagcttcgcctgggggctggagcctcacagtcacggcgcgcggagccgcggatactctgaatcagtgggtgcagctcctaacgctagtgacggccttgcccactctggaaaggtaggagttgcttgcaagcgtaatgccaaaaaagccgaatcggggaaaagcgcgagtaccgaagtgcctggcgcctctgaagacgccgaaaagaaccaaaaaatcatgcagtggatcattgagggtgagaaagaaatcagcaggcaccgcagaactggccacgggtctagtggtactagaaaacctcaacctcacgagaatagtagacctctgtcactggagcacccttgggctggcccacagttgcgcactagtgttcagccatcgcatctgtttatacaggaccccacgatgccacctcaccccgcacctaaccccctcactcagcttgaggaggctcgacgacggctcgaggaagaggaaaagcgggcaagccgggccccgtctaagcagcgatacgtacaggaagtgatgcgtcgtggtcgcgcttgtgtcagacccgcctgtgctcccgtcctgcacgtggtgcctgcggtgtctgacatggagcttagcgagaccgagaccagatcccaacggaaggtcggaggtgggtctgcacaaccctgcgacagtatcgtcgttgcatactacttttgcggcgaaccgatcccataccggacccttgttcgcgggcgtgctgtgaccctgggccagtttaaggagctcttgacaaagaaaggaagttatcgctactattttaaaaaagtgtccgacgaatttgactgtggggtagtcttcgaggaggtgcgcgaggacgaggccgtgttaccggtattcgaagaaaaaataatcggtaaagtagaaaaggtggactag

SEQ ID NO: 22942 - DNA, 2481 bp, Artificial Sequence
  Description of Artificial Sequence: Synthetic coding sequence
atgaacatccaggagcagggcttccccctggacctgggcgccagcttcacggaggatgcacccaggccaccagtccccggagaagaaggtgagctcgtgtccactgaccctcggccagcctcttattctttctgttctggcaagggggtgggcatcaagggggaaacttccacagcaacaccccgccgctccgatctggatctgggatatgaacctgaaggaagtgcctcacccactccaccatacctcaaatgggcagaaagccttcattccctgttggacgaccaggacggtatctctctcttcaggacattcctgaaacaggaaggttgcgcagatcttctcgacttctggttcgcttgtacaggatttcggaagctcgaaccctgcgattcgaatgaggagaagcggctgaagctcgctcgggccatctatagaaaatacatcctggacaataatgggatcgtgtcccggcaaaccaagcccgccaccaaaagctttatcaaggggtgcattatgaagcagctcatcgaccccgccatgtttgatcaggcacaaacagagattcaagcaactatggaagagaatacatatcctagcttcctcaaatccgatatctacctggagtacacccggactgggtccgaatcacctaaagtgtgttctgaccagtcctctggttccggcacaggtaaggggatatcagggtacctgcccacccttaacgaggatgaggagtggaagtgtgatcaggatatggatgaggatgacggcagagatgctgcacccccgggcaggttgccgcagaagcttctgctcgagacagccgccccccgagtttccagcagcaggaggtatagtgagggcagggagttcaggtatgggagctggcgtgaacccgtgaatccttattatgtgaatgccggatatgctctggccccagccacaagtgccaacgactccgaacagcaaagtctgtcgtccgatgcagatacactcagcctcaccgattccagcgtggacgggatcccaccatacaggattcgtaaacagcacaggagggaaatgcaagagagcgttcaggtgaacggtagggtccccctccctcacattccgcgaacataccgggtgccaaaggaggtgagagtggaaccccaaaaattcgccgaggagctgattcatcggctggaggctgtgcagcggactcgggaggctgaggaaaaactggaggagagactcaagcgcgtgagaatggaagaggagggcgaggacggagacccctcctctggccctcccggtccctgccacaagctccctcccgcgcctgcttggcaccacttccccccaagatgcgtggacatgggatgcgccggcctgcgagacgcccacgaggagaacccagaatcaatcttggacgaacacgttcaaagggtgcttcggacacctgggagacagagccccggaccagggcacaggtcaccggactctgggcatgtggctaaaatgcctgttgcactgggtggcgcggcctctggccatggtaaacacgttcccaagagtggtgcaaaactcgacgccgccgggttgcaccatcatcgccatgttcatcatcatgtccaccacagcaccgcccgacctaaggagcaggttgaggccgaagcgacccggcgagcccagtccagtttcgcttggggccttgagccacattcacacggtgcacggagtagaggctattcagagagcgtgggggccgccccaaacgcttccgatggccttgcacactccggtaaagtcggcgtcgcatgcaaacggaatgctaaaaaggcggagagcgggaagagcgcatccacagaggtgccgggcgcctctgaagacgccgagaagaatcagaaaatcatgcagtggataattgagggagagaaggagataagtcgccacaggaggaccggccatgggagcagcggaactcgtaagcctcaaccccacgagaatagccgccctctgtccctggagcacccctgggctggaccccaactgagaacatccgtccagcctagtcacctctttatccaggatcctaccatgccaccccatcccgcacccaacccgttaacacagttagaggaggctcgacgtcggctggaggaggaagagaagagagcatcccgagccccttcaaaacagcgcactaggtctcaacgaaaagtcggaggtgggtcagcccagccatgcgacagtattgtggtggcgtattacttttgcggggagcctattccttacagaaccttagtgcgcggcagggccgtgacactgggacagttcaaggaattgctgacgaagaagggatcctaccgctactactttaagaaggtgagcgatgaattcgactgtggcgttgtgttcgaagaggtgcgtgaagacgaggccgtgctgccagtattcgaagagaagatcattgggaaggttgaaaaagttgattag

SEQ ID NO: 22943 - DNA, 309 bp, Artificial Sequence
  Description of Artificial Sequence: Synthetic coding sequence
tgactggaggaggaggagaagcgggccagccgggcccccagcaagcagaggacccggtcccaacgaaaggtgggagggggtagtgcccagccttgtgattctatcgtggtggcatactatttttgcggtgaacctatcccatatcgtaccttggtgagaggcagagcggtaactttgggccaatttaaagaactgttgacaaagaagggatcctaccgccccccctcccacctccggtgctgtctgctcactgcgctgctgacgtctgtcctgcaaatcctactacaggagtccgaaagacgagtctag

SEQ ID NO: 22944 - DNA, 1824 bp, Artificial Sequence
  Description of Artificial Sequence: Synthetic coding sequence
atggtgtgcacccggaagaccaagaccctggtgagcacctgcgtgatcctttcgggaatgacgaatatcatttgccttctgtatgttgggtgggtcaccaactatattgcatccgtttatgtgcgcggccaggaaccagctccagataaaaagctcgaggaagacaagggtgacacgctgaaaattattgagcggctggaccatctggagaatgtaatcaagcagcatatccaggaggctccagcaaagccagaagaagccgaagcggagcctttcaccgactcttctctattcgcccattggggacaggaactgtctcccgaaggaaggagagttgccctaaaacagtttcaatattatggttataatgcttacttgtctgacaggcttccattggatcggcctttgcctgacctgcggccatcaggctgcagaaatctgtcttttccagacagtctccctgaagtgtccatcgtgtttatctttgtcaacgaggctcttagcgttctgctgcgtagcatccactccgctatggagcggacccccccacaccttctcaaggaaatcattttggtcgatgacaattccagcaatgaggaactcaaagaaaagctcactgaatacgtagacaaggtcaacagccaaaagcccggattcataaaggtcgtccgtcatagtaagcaggagggtctcataaggagtcgggtgagtggctggcgggcggctactgcacccgtggtggccctcttcgacgcccatgtggaattcaatgttggatgggcagagccagtactgacacgaataaaagagaataggaaaagaattatctctccatctttcgacaacatcaagtacgataactttgaaatcgaggagtatccactcgcagcccagggtttcgactgggagttatggtgcaggtacctgaatccgccaaaagcctggtggaaacttgagaattctactgcgcccatcaggtcgcccgcactgatcggttgttttattgtcgacaggcaatacttccaggagatcggactgttggacgaggggatggaggtctatggaggtgagaatgtggaactcggaatacgtgtctggcagtgcggcgggagtgtggaggtgctcccttgttcacggatagctcacatagagcgcgctcacaaaccttacactgaagatctcaccgctcatgttcgccgcaatgcgctccgggtggcagaggtgtggatggatgagttcaaaagtcacgtttacatggcctggaacatcccgcaggaggactcaggcattgacatcggtgatatcaccgcgcgcaaggcactcaggaaacagcttcagtgtaagacgttccgatggtacctagtgtcagtatatcctgagatgcggatgtatagcgatattatcgcttatggagtcctgcaaaactccttgaagaccgatctgtgcctcgaccaaggtccagataccgaaaacgtgcccataatgtacatttgtcatggcatgaccccacagaatgtgtactatacttcttcccagcagatccatgttggaattctttcacccactgtcgacgacgacgataataggtgtctcgtggacgtgaattcccgcccacgtttgatcgaatgttcatatgcgaaagccaaacgcatgaaacttcactggcagtttagtcaaggggggcccatccaaaaccgaaaatctaaaaggtgtctagaactgcaggagaattctgacctcgagtttggctttcagttggtgctccagaagtgcagtgggcagcactggagcatcaccaacgttctcagatccctagcgtcatag

SEQ ID NO: 22945 - DNA, 1710 bp, Artificial Sequence
  Description of Artificial Sequence: Synthetic coding sequence
atgagcacctacagcaccttccccgccggcgtgcccgtgagcgagagatcactggcacgcgccggtttttattatacaggcgtgaatgataaggttaaatgcttttgctgcggacttatgcttgataactggaagttgggggattctcccattcagaaacataagcaactctacccttcctgcagctttattcagaacctcgtatcagcatctctggggagcaccagtaaaaatacctctccaatgcggaactcctttgcccatagcctgtcccctaccctcgaacattctagcctcttttcggggagttattcctctttgtccccaaaccccctcaactcacgcgccgtcgaagatatttctagctctcgcaccaacccatattcatatgccatgtctactgaggaagctcgattcctaacctaccacatgtggcctcttaccttcctgtctccatccgaactcgctagagcaggtttctactatattggcccaggcgaccgcgtagcatgtttcgcatgtgggggtaagctctctaattgggaaccaaaagacgatgccatgagtgagcatcggcgccattttccgaattgcccattcttggagaactcgttagaaacccttcgttttagtatcagcaacctgtcgatgcagacacacgccgctcgcatgcgcactttcatgtactggccttcgtctgtgccggttcagccagagcagcttgctagtgctgggttctattacgtcgggcggaacgacgatgtaaagtgtttctgttgcgacggcggattgaggtgttgggagtccggggacgacccatgggtcgagcacgccaaatggttccctagatgtgaatttctgatcagaatgaagggccaagagttcgtagacgaaatccaaggacggtatccgcatttactcgaacagttgctctctacaagcgatactaccggggaagagaatgccgaccccccaattatccatttcggccctggagaatcctcctctgaagatgcagtgatgatgaacacaccggttgtgaagtcagccctggagatgggatttaatcgcgatctcgtaaagcagactgtgcaatccaagatcttaactaccggcgaaaactacaaaactgtgaatgatatcgtgtccgctctgttaaatgccgaggatgaaaagcgcgaggaggagaaagaaaagcaagctgaggaaatggcgtcagacgacctgtccctaatccgtaaaaaccgcatggcactcttccagcagctcacatgcgttctgcctatactggataatctgctgaaagccaacgtgataaataagcaggagcacgacatcatcaagcagaaaactcagatacctcttcaggcccgtgagctcatcgacacgatcctcgtgaaaggcaacgcagccgccaacatttttaaaaactgccttaaagagatagatagcaccctgtacaagaacttgtttgtggacaagaatatgaagtatatccccactgaagacgtgagcggcttgagtctagaggaacagctgagacggctgcaggaggaacggacttgtaaggtatgcatggacaaagaggtgtccgtagtgttcatcccctgcggccaccttgtggtgtgccaggagtgtgcacccagcctccgcaagtgccccatctgtagaggcattataaagggcaccgtcagaactttcctgtcctag

SEQ ID NO: 22946 - DNA, 1794 bp, Artificial Sequence
  Description of Artificial Sequence: Synthetic coding sequence
atggaggacagcaccatcctgagcgactggaccaacagcaacaagcaaaagatgaagtacgatttttcctgcgagctgtaccgaatgtcgacgtattctactttcccagccggcgtgccagtgagcgaacggagtttagcccgagctgggttttactatacaggggtcaatgataaggtcaagtgcttttgctgcggcctgatgttggacaattggaagttgggcgactcacccattcagaagcacaagcaactgtacccatcatgcagctttatccagaatctggtctccgcttctttgggctccacttctaaaaacacatctcccatgcgcaattcattcgcgcattccctgtcacctacgctggaacattcaagtctgtttagtggcagttattcctctctatctcctaacccgctgaattcaagagcagttgaggatatttccagttccagaactaatccctactcctatgcaatgtccacggaggaggcacggttcctgacgtatcacatgtggccactgactttcttgagtccatcagaactggctagggctgggttttactatatcggccctggtgatcgagtggcttgttttgcctgtgggggcaaactatcgaattgggaaccgaaagacgacgccatgtcggagcatcggcgccattttcctaattgccctttcctggaaaacagtttggagactctgcggttctccatttccaatctatctatgcagactcacgcggcaaggatgcgaacttttatgtattggccctcctcagtccccgtgcagccagaacagcttgcatcagccggcttctactacgtgggccggaatgatgatgtgaagtgtttctgctgcgacgggggcctgcgctgttgggaatccggggatgatccttgggtcgagcacgccaagtggttcccacgctgtgaatttttgattcggatgaagggtcaggaatttgtggacgaaattcagggacgatatccccatctcctggagcagttgctttctacttccgatactactggcgaggagaatgccgaccctcctatcatacactttggacctggcgagagtagctcagaggatgcagtaatgatgaacacacctgttgtgaagagcgcattggagatgggctttaatcgtgatctcgtgaaacaaacagtgcagtcgaagatcttgacaacaggcgagaactacaagaccgtaaatgacattgtgtccgccttactgaacgccgaggatgagaaacgtgaagaagaaaaggaaaagcaagccgaagaaatggcctctgatgatctcagtttgatcagaaagaatcggatggccttgttccagcagctcacttgcgtcctgcccatcctagataatttgttaaaggctaatgtcatcaacaagcaagagcacgacatcatcaagcagaaaacccagatcccactgcaggcccgggagctgatcgacacaatactggtcaagggcaacgccgcggctaacattttcaagaattgtcttaaggaaattgattctactctctataaaaacctgttcgtggacaagaacatgaagtatatccctaccgaagatgtctcgggcttgtctctcgaagagcaactcagaagactccaagaggagagaacatgcaaagtctgtatggacaaagaagtcagcgtagtctttatcccctgcggccatttagtggtctgccaagagtgcgccccatctctgagaaagtgtcccatctgtagaggcatcataaaagggacagtcagaacgtttctcagttag

SEQ ID NO: 22947 - DNA, 1605 bp, Artificial Sequence
  Description of Artificial Sequence: Synthetic coding sequence
atgcacaagaccgccagccagcggctgttccccggccccagctaccagaacataaagtcgattatggaggattcaacaatcctaagcgactggacaaactccaacaaacagaagatgaagtacgatttttcatgcgaactgtatagaatgtcaacctattcaaccttccctgctggcgtgccggtgtctgagagaagcctggctcgcgcgggattttactataccggtgttaatgacaaagttaaatgtttctgttgtggcttgatgctggacaattggaaattgggtgatagtccaatccaaaagcataaacaactctacccttcatgcagctttatccagaatctagtttccgccagcctcgggtccacatctaaaaatacaagcccgatgaggaactcctttgcccactcgctgagccccacgttagaacactcaagtctgttcagcggctcatactccagtttgtctccaaaccccctaaacagcagggccgtggaagacataagttcatcccggactaatccttattcctacgccatgtcgactgaggaagcccgttttctgacataccacatgtggccactgacatttcttagcccttctgaactggcacgggccggcttttattacattggtcccggggacagagtggcctgctttgcatgtgggggcaaactgagtaattgggagcccaaggatgatgcaatgtctgagcaccggcgccacttcccaaattgccccttccttgagaactccctggagactctgaggtttagcatttctaacctttcgatgcagactcatgctgccaggatgcggaccttcatgtattggccttccagtgttccggtgcagcccgaacagcttgcatcagctggcttctactatgtcggacgcaatgatgacgtgaagtgcttttgttgcgatggcgggctgcgctgctgggagtcaggggacgatccgtgggtcgagcacgctaagtggtttcctcgttgcgagttcctgattagaatgaaggggcaggagtttgttgatgaaatccaggggcgttacccacacctcctcgaacagctgctgtccacatccgacacaactggagaagaaaatgcagaccctccaataatccatttcggcccaggggaatcctcttcagaggatgccgtgatgatgaatactccagtcgttaagagcgcactggagatgggcttcaaccgagatctggtcaaacaaacggtccagtctaaaatcttgaccactggagagaattataagactgttaacgatattgtgtccgcattgcttaacgctgaggatgagaaacgagaagaggagaaggagaaacaggccgaggaaatggcgtccgatgacctgtccctgatcaggaaaaacaggatggctctttttcagcagctcacctgcgtgctgccgatccttgacaacctcctcaaggcaaatgtcattaacaagcaagagcatgacataataaagcaaaagacacagattccactgcaagctcgagaactgattgacactatactcgtcaaaggaaacgcagcagccaacatttttaagaattgcctgaaggtgaagcagcgattttag

SEQ ID NO: 22948 - DNA, 1815 bp, Artificial Sequence
  Description of Artificial Sequence: Synthetic coding sequence
atgaacatcgtggagaacagcatcttcctgagcaacctgatgaagagtgcaaacacattcgagctgaaatacgaccttagttgtgagctgtacaggatgtcaacatactcaacatttccagctggggtgccagtatccgagcgaagcttagcccgggccggattttactacacaggcgtcaatgacaaggtgaagtgcttctgctgtggtctcatgttggataactggaaaagaggggattcccccacagagaaacacaagaaactgtatcctagttgtcgattcgtgcaatctctgaactctgtaaataacctcgaagccacctctcaacctactttcccatcctccgtgactaactccacccactcactgctgcccggaaccgagaactccggctattttagaggcagctattctaatagcccttctaacccggtcaattccagagcaaaccaggatttttcagcacttatgcgaagcagttaccactgcgccatgaataacgagaatgccagattgctgacatttcagacatggccgctaacgttcctgtctccaacggatttagcaaaggctggattctattatatcggaccaggagatagggttgcgtgcttcgcatgtggcgggaagctctcaaattgggaacctaaagataacgctatgtccgagcacctccgacacttccctaaatgtccattcatagaaaaccaactccaggatacctcccgttacaccgtttccaacctttctatgcagacccatgccgctaggttcaaaacgttttttaactggccctcttctgttctcgtgaatcctgagcagttggctagcgcagggttttactacgtcgggaatagcgacgatgttaagtgtttctgctgcgacggcggacttagatgttgggagtccggcgacgatccctgggtgcaacacgcgaagtggtttcctcggtgcgagtatctcatccgtatcaaaggacaggagttcattaggcaggtgcaggctagttaccctcacctcctcgagcagctgctctccacatcagattctcccggagacgaaaacgctgaatcctctattatacattttgagcctggggaggaccatagtgaggacgcaatcatgatgaacactccagttattaacgccgccgtggaaatgggctttagccgatccctcgtaaagcagactgtgcagagaaaaattctggctaccggggagaattaccgcctagtgaatgacttggttctggacctgctgaatgcagaagatgaaattagagaagaggaaagagagagggccaccgaagaaaaggagtccaatgatttactcctcatcaggaaaaataggatggcactgttccaacacctgacatgtgtgatcccaatcttggattcattactgacagccgggatcattaatgagcaagagcacgacgtgattaaacaaaaaacccagacttcactgcaggcccgcgagctgatagacaccatcttggtgaagggcaatatagccgcgactgtttttaggaattccttacaggaggccgaggccgttctctatgagcatctgttcgttcagcaggacataaaatacattcccacggaagatgtctccgacctgccagtcgaggagcaactcagacgcctacaggaggagaggacatgcaaagtgtgcatggacaaagaagtgagtattgtcttcatcccatgcggccatctagtagtttgcaaggattgcgccccctccctgagaaagtgccccatatgtagatctaccataaaaggaacggtgcgcacattcctaagttag

SEQ ID NO: 22949 - DNA, 1815 bp, Artificial Sequence
  Description of Artificial Sequence: Synthetic coding sequence
atgaacatcgtggagaacagcatcttcctgagcaacctgatgaagagcgccaacacgttcgagctgaagtacgatctatcatgcgagctgtatagaatgagcacatatagcaccttcccagcaggagtgccagtgagcgagagatctctggcccgtgcaggattctattataccggcgtcaacgataaggtcaagtgtttctgctgcgggctcatgctcgacaactggaagcgcggtgactcgcctactgaaaaacataagaagctgtatccctcttgtcgcttcgtgcagtcgcttaactcggtcaataatctggaagcaacttcacagcctacatttcccagcagcgtgaccaactccactcattcactgttacctgggactgaaaactcgggatatttccggggatcatacagcaactctccctcgaatcccgtgaactcacgcgccaaccaagacttctctgcccttatgcggagctcctatcattgcgcgatgaataatgaaaacgcaagactcctaaccttccagacgtggcccttaacgtttctgtccccaacggacctcgcgaaagccgggttttattacatcgggccaggagatcgggtggcctgttttgcctgcggaggcaagctgtcaaattgggaacctaaagataacgccatgtctgagcacctgcgacatttcccaaaatgccctttcatcgagaatcaactgcaggacacgtcccgctatacggtgagtaatctttcaatgcagacccacgcagcacgtttcaagactttcttcaattggccatcctcagtcttagtgaacccagagcagctagcttctgcagggttttattacgtcggcaattccgacgacgtgaaatgtttctgctgcgacggcggactgcgttgctgggagtcaggggacgatccctgggtgcagcacgcaaagtggtttcctaggtgcgaatacctgatccgaatcaagggacaggaatttatccggcaagtgcaggcctcctatccccacctgctcgagcagctgttaagcacctcagactcaccaggtgatgagaatgctgaatcgtcaatcatccacttcgaacccggtgaagaccactctgaggatgccatcatgatgaacaccccagtgatcaatgccgcggtggagatggggttttcccgctccctcgttaagcagacagtgcagagaaaaatacttgctactggtgagaattaccggttagttaatgacctggtcctcgacctgctaaatgccgaagacgagatccgtgaagaggagagggaacgggctacagaggaaaaggagtccaacgatctcctccttattcgaaagaacaggatggcactattccaacacctcacttgtgtcatcccgatactcgacagcctgctaactgccggcatcattaatgagcaggagcacgatgtaatcaagcagaaaacacagacaagccttcaagcgcgagaacttatagatacaatcctggtgaaggggaatattgctgctaccgtgttccgtaatagcctccaggaagcagaggccgtgctgtacgagcacctgtttgtacagcaagatataaagtatattcctacagaagacgtgtcagacctgcccgtcgaggagcagcttaggagattgcaggaagaaaggacatgcaaggtctgtatggacaaagaagtgtcgatcgtgttcattccttgcggacatctcgtggtttgcaaggactgtgctccatctctccgaaaatgccctatctgtcggtctacaattaagggcacggtgaggacattcctgtcctag

SEQ ID NO: 22950 - DNA, 498 bp, Artificial Sequence
  Description of Artificial Sequence: Synthetic coding sequence
atgggcgcccccaccctgccccccgcctggcagcccttcctgaaggatcataggatctctactttcaagaattggcctttcttagagggctgcgcttgcactcccgagcgcatggccgaggctgggttcatccactgccctacagagaatgagcccgatctcgcccagtgttttttttgcttcaaagagctggaaggatgggaacccgatgatgatcctattggtccaggtactgtggcttacgcctgtaatacatctactctaggaggtcgcggaggccggatcacccgggaagagcacaagaagcactcctccgggtgcgcttttctgtcagtcaagaagcagttcgaggagcttacactgggagagttcttaaagctcgaccgagaacgagctaagaacaaaatcgctaaagagacgaataataagaaaaaggagtttgaggagaccgctgagaaagtcaggagggcaatcgagcagctcgccgcaatggattag

SEQ ID NO: 22951 - DNA, 429 bp, Artificial Sequence
  Description of Artificial Sequence: Synthetic coding sequence
atgggcgcccccaccctgccccccgcctggcagcccttcctgaaggatcataggataagtactttcaagaattggccattcctggagggatgtgcatgcactcccgagcgaatggccgaggctggatttattcattgcccaacagaaaatgaacccgacttagctcaatgctttttttgttttaaagagctggaagggtgggaacctgatgacgatcccatcgaggaacacaaaaaacattctagtgggtgcgcattcctctccgttaagaaacagtttgaagagctaactcttggggaattcctcaagctggatcgggagcgcgccaagaacaaaatcgccaaagagaccaataacaagaagaaggagtttgaggagacagcagagaaagtaaggagagctattgagcagcttgccgctatggactag

SEQ ID NO: 22952 - DNA, 414 bp, Artificial Sequence
  Description of Artificial Sequence: Synthetic coding sequence
atgggcgcccccaccctgccccccgcctggcagcccttcctgaaggatcatagaatttcgacatttaaaaattggcctttccttgaggggtgcgcatgtactcccgagagaatggctgaggcgggattcatccattgccccaccgaaaatgagcccgacctcgctcaatgtttcttctgttttaaagaactggaaggttgggaacccgatgatgatcctatgcagagaaagccaactatacgcagaaagaacctgagaaaactaaggcgcaagtgcgccgtgccatcatcaagctggctgccctggatagaagccagcggccgcagctgtctggttcccgaatggctccatcacttccaggggctatttcccggcgcgacaagtctccccgtgggacccctggccatgtcttag

SEQ ID NO: 22953 - DNA, 432 bp, Artificial Sequence
  Description of Artificial Sequence: Synthetic coding sequence
atgggcgcccccaccctgccccccgcctggcagcccttcctgaaggaccaccgaatatccacattcaaaaattggccattcctggaagggtgcgcatgcacccctgaaaggatggccgaagcaggattcattcattgccccactgagaacgagcccgacctggcccagtgtttcttttgcttcaaagagctcgagggctgggagccagatgacgatccgatcggccctggtaccgtggcctacgcctgcaacacgtccacactgggtgggagaggtgggcgcataacccgcgaagagcacaagaaacattcgtcagggtgcgccttcttgagcgtcaagaagcaattcgaagagcttacactgggcgagttccttaaacttgatcgggagcgggcgaagaataagatcgagagggcacttctggcagagtag

SEQ ID NO: 22954 - DNA, 14574 bp, Artificial Sequence
  Description of Artificial Sequence: Synthetic coding sequence
atggtgaccggcggcggcgccgccccccccggcaccgtgaccgagcctctcccatccgtcatcgtgttgagcgccgggcgaaaaatggctgccgccgcagccgccgcctcgggtccaggatgttcctcagccgctggcgctggcgctgccggggtgtcagagtggctggtcctgcgcgatggctgcatgcactgcgacgctgacggactacattctctgtcctaccaccctgccttaaatgcgattttagcagtgactagtagaggaactatcaaagtgatcgacggcacatccggcgcaaccttgcaggcatcagctctctccgcaaagcctgggggacaggtgaagtgtcaatatatttcagccgtggacaaagtgatcttcgttgatgactacgctgtgggatgccgaaaagatctgaacggaatcctgctcctcgatactgctttgcagacgccagtgagtaaacaggatgatgtggtgcagttagagctacccgtgaccgaggcccagcagttgctttccgcctgcctggagaaagtggatatttcatccacggaaggttatgacctctttataactcaattaaaggatggcctgaagaacacatctcatgagacagcagcgaaccataaagtcgcaaaatgggctaccgtcacattccatttgccccatcacgtgctgaagagcattgcatcggcaattgtcaatgaactcaagaagattaatcaaaatgtcgccgccttaccagtagccagctccgtgatggatcgtttgagttacctgctaccaagcgcccgacccgagctcggagtgggaccaggccggagcgtcgataggtccctgatgtacagtgaagccaatcggcgtgaaactttcacatcctggccacacgtggggtacaggtgggcccagcctgaccctatggcccaggcgggtttctatcaccagcccgcatcaagcggcgatgatcgggcaatgtgcttcacctgctccgtttgcctcgtttgttgggaacctaccgatgaaccatggtcagaacatgaacgtcacagtcccaattgtccctttgtgaaaggggagcacacgcagaatgtccctctatctgttactctggcaacctcccctgcgcagtttccatgtaccgacgggactgaccggatttcatgctttggttccggcagctgcccacacttcttagctgctgcaacaaaacgaggcaaaatttgtatttgggacgtgtctaagctgatgaaggtgcacctgaaatttgagattaatgcctatgatcctgcaattgtgcaacagttgatattaagcggggacccaagctctggagttgattcgcggagaccgactctggcttggctcgaggatagcagctcctgctctgatatcccaaaacttgaaggggatagtgacgatttgttggaagacagcgatagcgaggaacactcgaggtctgattccgttaccggtcacactagccagaaggaagctatggaggtttctcttgacatcaccgctctgagcatcttgcagcagcccgaaaagctgcagtgggagattgtggctaatgtgcttgaagataccgtgaaggacctggaagaactcggggcaaatccttgtctcactaattccaagtccgagaagacaaaggagaagcaccaggaacaacataatatccctttcccctgcctcctcgctggcggactcctcacatacaaatcccctgcgacatcaccaataagttctaacagccatcggagcttagacggactgagtaggactcagggagaatccatttcagagcagggcagtaccgataacgagtcctgtaccaacagtgagctaaactctccactggtaagaagaacactccccgtgcttctcctctatagcatcaaagaatctgacgaaaaggccggcaagattttctcacagatgaataatattatgtctaagagtctccatgatgacgggtttaccgtcccccaaatcatagagatggagctggattctcaggaacagctgctgctccaagaccctcctgttacctacatccagcaatttgctgatgctgccgccaacctcacttcccccgatagcgagaaatggaatagcgtgtttcctaagcccggcacgctcgtgcagtgtttacggctacccaagttcgccgaggaagagaacttgtgtatcgacagcataaccccatgcgccgacggaatccacctgctggtgggtctccgcacttgtccagtggagagcttatcagccatcaatcaggtggaggccctaaacaacttgaataaacttaacagcgccctgtgtaatagaagaaaaggagaactcgaaagcaatctcgcagtcgtcaacggagccaacatcagcgttattcaacatgaaagtcccgctgatgttcagacacctctgatcatccagcctgaacagcgtaatgtgtctggcggctacctggtgctctacaaaatgaattacgcaacgcggattgtgacactggaagaagagcctatcaaaattcagcatatcaaagacccgcaggacactatcacaagcttaattttgctgcctcccgacattctcgataatcgcgaagacgactgcgaagagcccatcgaagacatgcaactgacatccaaaaatggcttcgaaagggagaagacatcagacataagcaccttggggcacctggtgattacaacacagggtggctatgtgaagattctcgacctgtccaactttgagatcctggctaaggtggagccacccaagaaggagggtacagaggagcaagacacatttgtatccgtgatctattgctccggcacagacagactgtgtgcctgcacgaaaggtggagagctgcattttctgcagattggcggcacctgtgacgacattgacgaggccgacatcttagtggacgggtcgttatctaagggaatcgagccctcttcagagggaagcaaaccgctgtcaaatccgtcttcacccggcatatccggtgtggacttacttgttgatcagccgttcacgttagaaattctgacaagcttggtcgagttgactaggttcgagacgcttacacctaggtttagcgctaccgttcctccttgctgggtggaggttcagcaggaacaacagcaacgacggcaccctcagcacctgcatcagcagcaccacggcgatgctgcacagcatactaggacctggaaactccagacggattccaatagttgggacgaacacgtcttcgaacttgtgctccccaaggcgtgcatggtcgggcatgttgatttcaaatttgtgttaaactcaaacattacaaacattccccagatccaagtcactctactgaagaataaggccccgggtctgggcaaggtaaatgcgttgaacattgaggtggagcagaacggtaagcccagccttgtggacttgaacgaggaaatgcaacacatggacgtagaagagagccagtgcctgcgtctatgccccttcctggaggaccacaaggaagacatcctgtgcggtcccgtatggttagcaagcggcttagacctgagcggccacgctggcatgctgacccttactagtccaaagctcgtgaaaggcatggctggtgggaagtaccggtcttttttgattcacgtgaaggcggtcaatgaaagaggcaccgaggagatatgcaatggagggatgcggccagttgtcagactgccttcactcaaacaccagtcaaataagggctactccctggccagcttgctggctaaagtggcggctggaaaggaaaagtcaagtaacgttaagaatgagaacacttctggaacccgaaagagtgagaatctgcgcggatgcgatctgctacaggaggtgtccgtgacaattcgacgatttaagaaaacgtccatctctaaggagagagtccagagatgcgctatgctccagttcagtgagtttcacgagaagctggttaataccttgtgtcgaaaaacagacgacggccagattacagagcatgcccaaagtttagtgctggataccctgtgttggctggctggagttcactctaacggccccggaagctcgaaagaggggaacgaaaacttactctccaagactaggaaattcctgtcagacattgtgagagtttgctttttcgaggccggacgatccatcgcacacaagtgcgcacgattcctggcgttatgcataagtaacgggaagtgcgatccttgccagccagccttcgggcctgtgctactgaaggctctgcttgataacatgagttttctcccagctgcgacaactggaggcagcgtgtactggtattttgttctgttgaattacgttaaagacgaggaccttgccggctgctctaccgcatgcgcctcgctgctcacagccgttagccgccaactccaagacagactgactccaatggaggctcttctccagacccgttacggactatacagttctccttttgatccagtgctattcgacctagagatgagcgggtcaagctgcaagaatgtttacaatagtagtatcggagttcagagtgatgagatcgacttgtcagacgttctgtcaggcaacgggaaggtgagttcgtgtaccgcagcagaaggctcttttaccagtctgacaggcctgctggaagtggagcctttgcacttcacctgcgtgtccacgtccgatggtacacgcattgaacgggatgatgccatgtcaagctttggagtaacccccgctgtcggcggcctgtccagtggtaccgtgggggaggcctctactgcgctcagttctgccgcacaagtggctctgcagtccctgtctcatgcaatggcctcagccgaacagcagctccaagtcctccaagaaaagcagcagcaacttctgaaattgcagcagcagaaagctaagctggaggcgaagcttcatcaaaccactgccgccgctgccgcagccgcctccgccgtcgggcccgtccacaactccgtcccctctaacccagtggcagcccccggcttcttcattcatccaagcgatgtcatccctcctacaccaaaaaccacccccctgtttatgacccctccgctcacccctccgaatgaggcagtctcagtcgtcattaatgcagagttagcccagcttttcccagggagtgtaattgacccgcctgcagtcaatttagcggctcataacaaaaatagtaacaagagtaggatgaaccctctggggtctggactggcactagctatcagccacgcctcgcattttctacagccccctccacaccaatcgatcatcattgaacgcatgcatagtggggctcgcaggtttgtgactttggacttcggcaggcctatcttgttgacagatgtgctgatacccacatgcggagatctcgcctccttaagtatcgatatttggaccctcggcgaagaggtggacggacgccggctcgtcgtggccactgacattagcacccatagtctgatcctgcatgatctcattccccctcctgtctgtcggtttatgaagatcactgtcattggccggtacgggagcacaaacgctcgagccaagataccgctcggtttctattatgggcacacatatatcctgccctgggagtctgaattgaagttgatgcacgacccacttaaaggagagggcgaatcagccaaccagcctgagattgatcagcatctggctatgatggtagcactgcaagaagacatacagtgtcggtataacttggcatgccatcgccttgagactctcttgcagtccatcgacctgccaccattaaactctgcgaacaatgctcagtatttcctccgtaagcccgacaaagcagtagaggaagatagtcgggtgtttagcgcttaccaagattgcattcagctgcagctgcagttgaatctcgcccataacgcagtccaaagacttaaggtcgccctgggtgcatctcgtaagatgctgagcgagacgagcaaccctgaggatctcattcaaacgtcctccaccgaacagctccgcacgataatacgctacttactggatactctcctctccctgctccatgcatccaacggccactcagtccctgccgtcctgcagtccacctttcacgctcaggcctgcgaggagttattcaaacacctctgtatcagcgggactccgaaaatccgcttgcatactggactgctgttggtgcagctatgcggaggcgaacgatggtggggccagttcctatcaaacgtgctacaagagctctataacagcgagcagctgttgatctttcctcaggatagagtgttcatgctactatcttgtataggccagaggagcctgtcgaatagcggtgttcttgagagtctcttgaacctcctggataatctgttgagccctctgcagcctcagttacctatgcacaggaggactgagggcgtgctggatatacccatgatttcatgggtagttatgctggtgtcgcggctcctggactacgtggccactgttgaggacgaggcagctgcagccaaaaaacctctgaacggtaatcaatggtccttcatcaacaacaatctgcacacacagagcctcaaccgcagcagtaaagggtcatctagtctggatcgtctatatagccgcaaaataaggaaacaattggtgcaccacaaacagcagctgaacctgctgaaggccaagcagaaggcacttgtggaacaaatggagaaggaaaaaatccagagcaacaaaggcagcagctataaactgctggtggagcaggctaagctcaaacaggctacctccaagcactttaaggacctcatccgtctgcggcgaactgcagagtggagccgatcaaatctggacacagaggtgacaacagccaaggaaagtcctgaaattgagccattgcccttcaccctggcccacgaaaggtgtatttcagtggtccagaaacttgtgcttttcttactgtccatggacttcacatgccacgcggacctgctgcttttcgtctgcaaagtgctggcacgaattgcgaatgccaccaggccgactatccatttatgtgaaattgtgaacgaaccccaattggaaaggctgctgttgctgctggtggggaccgatttcaaccgaggcgacatcagttggggcggcgcctgggcacagtacagcttaacatgtatgttacaggacattctggctggagagctgcttgctccagtcgcggctgaggccatggaggaagggacagtgggggacgatgtcggagctacggccggagatagcgacgactctctgcagcagagcagtgttcagctgctggaaaccatcgatgagcccttgacccacgacatcactggcgctccaccattgagcagtctggaaaaggataaagagattgacctggaactgctgcaggacctcatggaagtggatatcgacccacttgacatcgacctcgaaaaagaccccctggctgctaaagtgttcaagcccatttcatccacctggtacgactattggggcgctgattatggcacttataactacaatccgtacatcgggggcctcgggatacccgtcgcaaagccaccagcgaacacagagaaaaatggatcccaaacagtgagcgtgtccgtttcacaggcgctcgacgcccgcctggaggtgggcctcgaacagcaggcagaactgatgttgaagatgatgtcaaccctggaagccgacagcatcctgcaggcacttaccaacacaagcccgaccctgtcgcagagccctacaggcaccgacgactcgctcctcgggggactacaagccgcaaatcagacatcccagctcatcattcagcttagttcagtgcccatgctcaacgtttgttttaataagctgtttagtatgctccaggtgcatcacgtgcaattagaaagcctgctccagttgtggttgacactgtctctcaattcgtcatcaactggcaacaaagagaatggagccgatatcttcctgtataacgccaataggatccccgtgatctccctgaatcaggcctcaataacctcttttctaacagtcctcgcatggtatcccaacactctcctcaggacttggtgtctagttctgcattctctgaccctgatgactaacatgcagctgaactcggggagcagtagtgccatcgggacacaggagtccactgcgcacctgctcgtgtctgaccctaacttgatccatgtacttgtgaaattcctttcaggcacgagcccacatggaacaaatcagcacagtcctcaggttggccccactgctacacaggccatgcaggaattcttgaccagactgcaggtacacctgtcctccacatgccctcagatatttagcgagttcttgctcaagctcattcacattctcagcaccgagcgaggcgccttccaaaccggacagggtccgctagacgctcaggtgaagctgctggagtttaccttagagcagaacttcgaggtggtgagtgtgtccaccatctccgcagttatcgaatctgtgaccttcctcgtacatcactatattacctgctctgacaaagtgatgtctcgatctggctctgactcatccgtcggtgctagggcgtgtttcggcggtttgtttgccaacctgatcagacctggtgatgccaaagccgtgtgcggggagatgactcgagatcagctcatgttcgatctcttgaagctagtgaatatactcgtgcagctgcccttgtctggtaatcgagagtattcagccagggttagcgtcacaaccaatacaaccgactcagtttcagatgaggaaaaggtgtccggaggaaaggatggaaatggatccagcacgagcgtgcaggggtccccagcttacgtggccgacctggtgctagccaatcagcaaatcatgtctcaaatcctctctgctcttggactgtgtaactcaagcgccatggctatgatcatcggagcaagcggtctgcacctcacaaagcacgagaattttcacggtggtctagatgctatttctgtgggtgacgggctattcaccattcttactacactgagcaagaaggcttccaccgtccacatgatgctccaaccaatactgacttacatggcttgtgggtatatggggcgacagggcagtcttgccacctgccagctttccgaacctcttctctggttcattctaagggttttggatacatcagacgccctaaaagcattccatgatatgggtggcgtccagcttatctgcaacaacatggtcactagcactagggccatagttaacactgcccggagcatggtttccactattatgaagttcctggatagtgggcctaacaaagcagtggattcgactctcaaaactcgaatcttggcttctgaacccgataacgccgagggcattcacaacttcgctcctctaggcaccataacttcctcctccccaacggcccagccagccgaagtcctcctccaggcaacgccaccacatagacgggcccgctcagcggcgtggtcatatatcttcctgcccgaggaagcttggtgcgatctgacaatccacctgcctgctgccgtgctactgaaagagattcacattcagccccatctggcctctctcgcaacatgtccatctagcgtctcggtagaagtatcagccgacggagtaaatatgctgcccttatccactccagtagtcacctccggtctcacttatattaaaatccaacttgtcaaagcggaggttgcaagtgcagtctgtctccgattgcaccgccccagagacgctagcacactggggctgtcacaaataaagttactcgggttgacagctttcggcactacctcatcagccactgtgaacaacccctttctgcccagtgaagatcaggtgtctaaaacctccatcggctggctgcggctgttacatcactgtctgactcatatctcggacctcgaaggtatgatggctagcgccgcggccccgaccgccaacctactacagacttgcgccgccctgctgatgtctccatattgtggaatgcactcacccaacatcgaagtggtcctggtcaaaatcggattgcaaagtacccggattggccttaagctcattgatattctgctgcggaactgtgccgcgtccggttccgatccaactgaccttaattcaccacttctgtttggccgcctgaatggcctgagttccgactctacaatcgacattctgtatcagctcggcaccacccaggaccctggcactaaggacaggattcaggctctgctgaaatgggtcagcgactcagccagggtggccgctatgaaaaggtcaggcagaatgaactatatgtgtcctaattcgtccactgttgaatatggcctactgatgccgtcgccgtcccatctgcattgcgtagccgccattttatggcattcctatgaacttctcgtcgagtatgacctcccagcacttctggatcaggagctttttgagctgctgtttaactggtccatgagcctcccctgcaacatggtgctgaaaaaggcagtggactctctcctctgctccatgtgccacgtgcatcctaactacttctctctgcttatgggatggatgggaatcaccccgccccccgtgcagtgtcaccatcgcttatccatgaccgacgactctaaaaaacaggatctctcatcttccctcactgatgactctaaaaatgctcaagcgcctctggctctgactgagtcccaccttgcaacactggcttcgtcgtcacagagccccgaagcgattaaacaactgctcgatagcgggctgccatctttgcttgtgaggtccctggcttctttctgcttcagccacattagcagctccgagagcatcgctcagagcattgatatttctcaagataagctgcgccggcatcacgttccacagcagtgcaataaaatgccgatcacggccgatctggtagcgccaatactgcgtttcctcactgaggtggggaattcacacatcatgaaggattggctgggaggctcggaggttaaccctctctggacagccttgctcttcttgctgtgccactctggttcaacctcagggagtcataacttgggcgcacagcagacttctgcccgatccgctagtcttagctccgccgcaacgacaggcttgaccactcagcagcgcacagccatcgagaacgcgaccgtggcattttttctgcagtgcatctcttgccaccctaacaaccagaagctgatggcccaggtcctgtgtgaattgtttcagacctccccccagcgagggaacctcccaacctccgggaacatttctggcttcataaggagactgttcttacaacttatgctggaagacgagaaggtaactatgttcctgcagtcaccatgcccactgtataagggtaggatcaacgctacctcacacgtaatccaacaccctatgtatggtgctgggcacaaatttcgaaccctgcatctgccggtgtcaacgactctatccgacgtgctagatcgcgtgtccgacacgccaagcattactgccaagctgatttccgagcagaaggacgacaaggagaagaagaaccatgaagagaaggaaaaggtcaaggcggaaaacggatttcaggataactacagcgtggttgtcgcaagcggtctgaagagccagagcaaacgcgccgtctcagccactcctccgcggcctccgagcaggagggggcggacaattcccgacaaaatcggctccacaagtggcgcagaggcggctaataaaatcatcaccgtccccgtttttcaccttttccacaagctcctcgccggccaacctttgcccgccgagatgactctcgcccagctgctaactctcctgtacgacaggaagttacctcaaggctaccgatccatcgacctgaccgtgaaattaggcagcagggtcattacagaccctagcctgtccaaaacagatagctacaaaagactgcaccctgagaaagatcacggcgatctcttggcttcatgtcctgaggacgaggccctaacccccggtgatgaatgcatggatggcattctcgacgaatctctcctggagacttgtcctattcagtcgcccctccaggtcttcgcggggatgggtgggttggccctaatcgctgagagactgccaatgttgtaccctgaggtgatccagcaggtctccgcccctgtggtgacctccaccacccaggagaagcctaaggacagcgaccagttcgaatgggttactattgagcagtcaggagagctcgtttatgaggcccctgagaccgtcgctgctgagcccccacccattaagagcgctgttcaaacaatgagccccatccctgctcattccctagccgctttcgggttgtttctgcgcttacctggctacgcagaggtcctgctcaaggaacggaaacacgcacagtgcctgctgcgacttgttctcggcgtgactgatgacggtgagggctcacacatcctccagtcacctagcgccaacgtcctccctaccttgccgttccatgtcctgaggtctctgttctccacaactcccctcaccacagatgatggcgtccttctgaggcgcatggctctggagatcggagcgctccacctgatactggtgtgcctgtctgctctctcccaccattcgccgagggtccccaacagtagcgttaatcagacagaaccccaggttagctcttcacataaccccacttctacagaggagcagcagttatactgggccaagggtactggttttgggactggctccacagcgagtggctgggatgttgagcaggccctgacaaagcaacgccttgaagaggagcatgtcacatgcctgctgcaggtgcttgcctcttacatcaatccagtgagcagcgctgtgaatggggaggcacaaagttcacatgaaactcgcggacaaaatagcaatgccctaccaagtgtgctgctggagctcttaagtcaatcatgtctgatccccgctatgagtagttatctgagaaatgacagcgtgctcgacatggccagacacgtccccctctaccgggccttgctcgaactgctccgcgccattgcctcctgcgccgctatggttcccttactgctgcctctgtctactgagaacggagaggaggaggaagaacagagtgagtgccagactagtgtgggtacactgttggctaagatgaagacctgtgtggacacctataccaaccgcctgaggtccaagagagagaatgtcaagaccggagtcaaacctgatgcctctgaccaggagcccgagggcctgactttgttagtccctgacattcagaagaccgccgagatagtctacgccgctactacgagtctgcggcaggcaaaccaggagaagaaactcggagagtattccaaaaaggctgctatgaaaccaaagccactcagcgttctgaaatccctggaggagaagtatgtggcagtgatgaagaagctgcagtttgacacattcgagatggttagcgaggatgaagatgggaagttgggcttcaaggtcaattaccactacatgagtcaggttaaaaatgctaacgacgctaactcggccgcgagggctagacggctggctcaggaagctgtgactcttagtactagtcttcctctgtcttcgtcaagctctgtattcgtgagatgcgatgaggagcgcctggatataatgaaggtgctcatcaccgggcctgccgacaccccctatgccaatgggtgctttgaattcgacgtctatttcccacaggactacccctcttccccccctcttgtaaacctggagaccaccggcggccactctgtgcgattcaatcccaatctgtacaacgacggcaaagtgtgtctctccatcctcaatacatggcacggcagacctgaagaaaaatggaaccctcagacatcatccttcctacaggtgctcgtaagtgtgcagtccctgatactggtcgccgagccttattttaatgaacctggatatgagagatctagagggaccccctctggaacacagagctccagagaatatgacggaaacattagacaggcgactgtgaagtgggcaatgctggagcagatccggaacccttctccctgctttaaagaggtgatacataaacacttctacctcaaacgcgtggagattatggcccagtgtgaggagtggatcgccgacattcagcagtattcatccgataagcgagtagggcggacgatgtctcatcatgccgccgccttgaaacgtcatacggctcagctacgcgaagaacttctgaaactcccctgccccgaaggcctcgatccagacaccgacgacgcacccgaggtgtgccgtgccactaccggtgctgaagaaaccctgatgcacgatcaggtgaaaccctcctctagtaaggagctcccctcagattttcagctgtag

SEQ ID NO: 22955 - DNA, 1566 bp, Artificial Sequence
  Description of Artificial Sequence: Synthetic coding sequence
atgagcctgagccggagcgaggagatgcaccggctgaccgagaacgtctacaagactataatggaacagttcaatccatccctccgcaatttcatagccatgggcaagaattatgagaaggcccttgctggagtcacctatgccgcgaagggttacttcgatgccctagtaaaaatgggcgagctagcatctgaatcacagggctctaaagagcttggagatgtactgttccaaatggctgaagtgcatcgtcagatacagaaccaactcgaggaaatgctcaagtcgtttcataacgagctcctcactcagctggagcagaaagtcgagcttgattctcggtatctctctgccgctcttaaaaagtatcaaactgagcagcgcagtaagggcgatgccctggacaaatgtcaggctgaactcaagaagttgcggaagaagtcccagggctcaaaaaacccccagaagtacagcgataaggagctgcagtacattgatgccatcagtaacaaacagggcgagttggagaactacgtgtcagatggttataagaccgccctaaccgaggaacgacggcgattctgtttcctggtggagaagcagtgcgccgttgccaagaatagtgccgcataccattcgaaaggaaaagagctgttagcccaaaagctgcccctgtggcaacaggcgtgcgccgatccgagcaaaatccccgagcgggcggtccagctcatgcagcaggtggcatccaacggcgccacattaccaagcgccctctctgccagtaagagcaacttagttatttctgacccaattcccggagcaaagcctctacccgtgccccccgagctcgccccatttgtcggacggatgtctgcacaggagagtacacctatcatgaatggcgtcacaggaccggacggggaagactacagcccctgggctgaccgtaaggccgcccaacccaagtccctctcccccccacagagccagtccaagctgtcggattcctactctaacaccttacctgtgcgcaaatccgttacaccaaagaatagctatgcaacaacagagaacaagacactaccccgcagcagctcaatggcagcgggtttggagcgcaacgggcggatgcgggtgaaggccatcttcagtcatgctgcgggagataattctactctacttagctttaaggaaggagatcttatcactctgttggtgcccgaggctcgagacgggtggcattatggggaaagcgaaaagacaaagatgaggggttggtttcctttcagctacacaagggttttggatagcgacggatccgatcgtcttcatatgtccctgcaacaaggcaagtcatcaagcacggggaatctcctcgataaagatgatctggccataccacccccagactacggagccgcctcaagggcttttcccgcgcagacagccagcgggttcaaacagagaccatacagcgtcgccgtccccgccttctcacagggtttggacgattatggggcccgctctatgagctctggttcaggaacgttggttagcaccgtctag

SEQ ID NO: 22956 - DNA, 1659 bp, Artificial Sequence
  Description of Artificial Sequence: Synthetic coding sequence
atgagcctgagccggagcgaggagatgcaccggctgaccgagaacgtttataagaccatcatggaacagtttaacccttctctccggaattttatcgctatggggaagaattacgagaaggctctcgctggtgtcacttatgctgctaagggatactttgatgccctagtcaaaatgggagagctcgcgtctgaatcccagggcagcaaggagctcggagatgtcctcttccaaatggctgaggtgcataggcaaatccagaaccaactggaagagatgttaaagagcttccacaatgagctccttacccaactggagcagaaggtggagctcgacagtagatacctcagcgccgccctgaaaaaataccaaacagagcagcgctcaaagggagacgctcttgacaagtgccaggcggagctgaaaaagcttcgtaaaaagtcccagggctccaagaatcctcaaaaatattccgacaaagaactccagtacatcgatgcaatcagtaataagcagggcgagctggagaattacgtgtctgacgggtataaaacggcattgacggaagaacgccgccgtttctgctttttggtggagaaacagtgcgccgtggccaaaaattccgctgcctatcactctaaaggcaaggaattactggcccagaaactcccattgtggcagcaggcctgcgccgaccccagtaaaatccccgagcgcgccgtacagcttatgcagcaggtggccagcaacggagccacacttccttccgctctgtctgcgagcaaatccaatctggtgatttccgatccaatccctggcgccaagcccctgccagtacctcctgaactggcaccctttgtggggaggatgtctgctcaggagagcactccgattatgaatggtgtgacaggccctgatggagaagattactccccttgggccgatcggaaggccgcacaacctaagtcattaagcccgccacagtcacagagtaaactcagcgactcatatagcaacacattacctgttcgtaaaagcgtgacccctaagaacagctacgcgaccactgagaataagaccctgcccagatcttccagcatggcagcgggattggagcggaacggacgaatgcgtgtcaaggctatattttcccacgcggcaggtgacaactctacgttgttgtcttttaaagagggggatttaataactctgcttgtcccagaggcccgcgacgggtggcactacggagagtccgagaagaccaagatgaggggttggtttccgtttagctatactagagtcctcgactccgatggaagtgaccgactacatatgtcacttcagcaggggaagagttctagtaccggcaaccttctggacaaggatgatctcgcaattccacccccagactacggagctgccagccgggcttttcccgctcaaactgccagtggtttcaaacagagaccgtattctgtcgccgttccggctttctcccaaggcctcgacgactatggagcaagatctatgtctagaaacccgtttgcccacgtccagctgaaacccacagtgaccaacgatcgatgcgatctgagcgctcagggccccgaagggcgtgaacatggggatgggagtgcgcggactcttgctgggaggtag

SEQ ID NO: 22957 - DNA, 1371 bp, Artificial Sequence
  Description of Artificial Sequence: Synthetic coding sequence
atggccgaggtgcaccggcagatccagaaccagctggaggagatgctaaaatcctttcacaacgagcttctgactcaactggagcagaaagtcgaactggacagtcgctacctgtccgctgccctaaagaagtatcagactgagcagagatccaaaggtgatgctctagataagtgccaggccgaactcaagaagctgcggaagaaatcccaggggagcaagaacccccagaagtacagcgataaggagttacaatatatcgacgcaatctctaataagcagggggagttggaaaactatgtttcagacgggtataaaacagctctgaccgaagaacgccggcgcttctgtttcctggtcgaaaaacaatgtgctgtcgccaagaatagcgcagcctaccactctaaaggcaaagagctgctggcccagaagctgcctctgtggcaacaagcttgtgccgatccgtcaaagattccagagagagccgttcaactgatgcaacaggtggcctcaaacggcgcaactctcccctctgccctgtccgcctctaagagcaatctcgtgatctctgaccctatccccggcgctaagccgctcccagtgccacctgagctggctccctttgttggccggatgtctgctcaggagtcgactccgatcatgaacggagttactgggccggatggcgaggactactctccttgggccgatcgcaaggcggcacaaccaaagagtctgagcccaccccaatcccaatccaagcttagcgactcttactctaacacgctacctgtcagaaagtcagtcacccccaagaacagctatgccacaaccgagaataagacactgccgaggtcaagctctatggccgcaggcctggagcgcaatggcaggatgcgcgtcaaagccattttctctcacgcggccggagataactcaactttactcagctttaaagagggagatctgattacgctgctcgtccccgaggcacgagatggctggcattatggtgaaagtgaaaagaccaagatgcgcggctggtttccattctcctacacacgcgtcctagattcagacggcagtgataggcttcacatgtctcttcagcagggtaagagctcctcaaccgggaacttacttgataaggatgacttagcaatccctcctccagactacggtgccgcttcacgggcctttccagcccagacagcctctggtttcaagcagaggccctactctgtcgcagtacctgccttcagccagggactcgacgactatggggcccggtcgatgagtagaaatccttttgcacacgtgcaactgaagcctactgtgacgaacgaccggagtgctccactgctatcgtag

SEQ ID NO: 22958 - DNA, 1128 bp, Artificial Sequence
  Description of Artificial Sequence: Synthetic coding sequence
atgctgctgcccgagggccagcggcagcgggccctgggcttcggcacggttaccagcacctattcccctgttgggcaatatattgacgctatctcgaacaagcagggggaactcgagaactacgttagtgacgggtacaagactgccctgacggaggagcggcgcagattttgtttcttagtagagaaacagtgtgctgtagctaaaaattccgcggcttaccactctaaaggcaaggaattgcttgcgcagaaactacctctctggcagcaggcgtgcgctgacccatctaaaattcccgagagggccgtgcagcttatgcaacaggtggcctccaacggggccacacttccttccgccctttccgcttccaaatctaaccttgttatttccgatcccatacccggagcaaaacccctgcccgtcccccctgaacttgcacccttcgtggggcgcatgtcagcccaggagtctacgccaattatgaatggcgtgacaggcccagacggcgaagactactctccgtgggccgatcggaaggccgcgcaacctaagagtctgagtccaccccaaagtcagagtaagcttagtgacagctactcaaacacgcttcccgttcgaaagagtgttactcctaaaaatagttatgctaccactgagaacaagacgctgccacgcagcagctctatggccgccgggttagagcggaacggtagaatgcgggtgaaggcgatcttctcccacgccgcaggggataatagcaccctgctgtcttttaaggaaggggaccttattacactgctggtcccagaggcacgggatgggtggcattacggtgaatccgaaaagactaaaatgagagggtggtttcctttttcctacacccgagtgctggacagcgatggcagtgatcggttacacatgagcctgcagcaaggaaagtcctcttcaactgggaatctgctggacaaggacgatcttgccatcccacctcctgattatggagcggccagtagagccttccccgcccagacggcaagcggcttcaagcagcgcccatatagcgttgccgtccctgcgtttagccaaggtctcgacgattacggggccaggtccatgtcacggtag

SEQ ID NO: 22959 - DNA, 1605 bp, Artificial Sequence
  Description of Artificial Sequence: Synthetic coding sequence
atgagcctgagccggagcgaggagatgcaccggctgaccgagaacgtgtataaaactattatggagcaatttaacccctccctcagaaacttcatcgcaatgggaaagaactatgagaaagctctagcaggcgtgacctacgcggccaaggggtacttcgatgccttggtcaaaatgggagagctggccagcgaatcgcagggaagcaaggagctgggggatgtcttatttcaaatggccgaggttcaccgccagatccaaaatcaattagaggaaatgctgaaaagctttcataacgagctgctgacacagttagagcagaaagtggaactcgactccagatatttatccgctgcactgaagaaataccaaacagaacagaggtctaagggtgacgccctggacaaatgccaggccgagttaaaaaaactgcgcaagaaaagccagggttcgaaaaatccccagaaatattcagataaagaattacagtacattgatgctatcagcaacaagcagggcgagctggagaactacgtgtccgatgggtacaagaccgcattaactgaagaacgccgacggttctgttttcttgtagagaaacagtgtgccgtcgccaagaactcagctgcttaccattccaaaggaaaggagctgctcgcacaaaagctacccctgtggcaacaggcctgtgcagatccaagcaaaattcccgaaagggcagtgcagcttatgcagcaggtggctagcaacggagccacccttccatccgcactgagcgcctcaaagagtaatcttgtcatctccgaccccatcccaggcgctaaaccgttacccgtgcctcctgaattggcaccattcgtgggcagaatgtcagcgcaggagtccacaccaatcatgaatggtgtcacaggtcctgatggagaagactactctccctgggccgatcggaaagccgcccagccaaaatctctgtccccgcctcagagtcagagtaaacttagcgatagttattctaacactcttcccgtgcggaaaagtgtgacccctaagaattcatacgccaccaccgagaataagacacttccccgtagttctagcatggcagcgggccttgagaggaacggacgcatgcgggtgaaggcaatcttttcccacgccgccggggataatagcaccctcctcagctttaaggaaggggatctgattactctcctggtcccggaggcccgtgatggttggcattacggggagtccgagaaaacgaaaatgagaggctggtttcctttcagctacacgcgggtgcttgacagcgacggtagtgaccgcctgcatatgagtctccagcagggcaaatctagcagtacagggaacctgttggacaaggatgatttggccatcccaccccctgactacggcgccgcttcacgggcttttcccgctcagacggcgtctggcttcaagcaaaggccttattccgtagcggtcccggccttcagtcaggggctggatgactacggggcgagaagtatgagtagaaatccattcgcccatgtgcagctaaaacccaccgtaacgaacgaccgttctgcgccactcctctcgtag

SEQ ID NO: 22960 - DNA, 1563 bp, Artificial Sequence
  Description of Artificial Sequence: Synthetic coding sequence
atgagcctgagccggagcgaggagatgcaccggctgaccgagaacgtctacaaaactattatggagcaatttaatccgtccctgaggaactttatcgccatggggaagaactacgaaaaagccctggcaggagtgacctacgccgccaagggctactttgatgcattggtcaagatgggcgagctcgcttcagagtcacaggggagtaaagagctcggtgacgtcctgttccaaatggcagaagtgcatcggcagattcagaatcagctagaggaaatgctcaagagcttccataacgagcttctgactcagctggaacaaaaggttgagctagactcccgttatctctctgcagccctgaagaagtaccagactgaacaaagaagcaagggcgatgctctcgacaaatgtcaagccgagctcaaaaaacttcgaaagaaaagccaggggtcaaaaaacccgcagaaatactccgacaaagaacttcaatatatcgacgcaatctcaaacaaacagggcgaactggagaattatgtgtccgacggctataaaacagccttgactgaggagaggcgtcgattctgcttcttggtagagaaacaatgtgctgtggccaaaaatagcgccgcttatcattctaaaggcaaggagttactggcgcaaaaactccccctgtggcagcaagcctgcgccgacccatccaagattccagagagagctgtgcagctcatgcagcaggtggcctcaaacggagctacgctgcccagcgccctgagcgcctctaagtctaacctggtgatctccgaccccattcctggtgctaagccactgcccgtgccaccagagttggccccctttgtgggtcgtatgtctgcccaggagagcactcctatcatgaatggtgtgacagggcccgacggggaagactactctccttgggcggatagaaaggctgctcaacctaagagcctcagccccccccagagccagagtaaattatccgatagttattctaacacactgcctgtgcgaaagagtgtcacacccaagaactcctacgctaccacagagaacaagacactcccgcgtagctccagtatggccgcgggcttggagaggaacgggcgcatgcgagtgaaagctatcttttcccatgccgctggcgataacagcaccctgctctcgtttaaggagggcgatctcataactctgctggtcccagaagcgcgggatggatggcactatggcgagagtgagaagaccaagatgcgcggatggtttcccttctcatatactagagtgctcgatagcgacggctctgaccgcctgcatatgagcctgcagcaggggaaatctagttctaccggcaacctattggacaaagacgacctggcgatcccgcctcccgattacggagccgcctctagagcatttccagctcagaccgcctccggctttaaacagagaccctactctgtggctgtcccagccttctcccagggactggacgactacggggctcggagcatgtcaagcgctgacgtggaggtcgcccggttctag

SEQ ID NO: 22961 - DNA, 720 bp, Artificial Sequence
  Description of Artificial Sequence: Synthetic coding sequence
atggcccacgccggccggaccggctacgacaaccgggagatcgtgatgaagtacattcattacaaactctctcagcgcggctatgaatgggacgcaggggacgtgggagccgcgccccccggagctgcgcccgcgcccggaatattcagcagccagccagggcacacaccgcatcccgccgcttcccgcgaccccgtagctagaacttcaccgctgcagacacccgccgcccctggcgcagctgcgggcccggcgctgagccctgtgcctcccgtcgtgcatttgacactgaggcaggcaggcgacgactttagcaggcgttatcggcgggattttgccgaaatgtcttcacagctacatctcaccccatttactgccaggggtaggttcgccaccgtagtcgaggagctgttcagggatggagtaaattggggtcgtatcgttgccttttttgagttcgggggcgtgatgtgcgttgaaagcgtgaacagggaaatgtccccgttggtcgacaacattgctctgtggatgacggaatatctaaacagacacttgcacacctggatccaagataacggaggctgggatgctttcgtcgaactctatggcccaagtatgaggccactttttgatttcagctggctctcactgaagacccttctgtccctcgccctagtgggggcttgtattaccttaggagcctatctcggccataagtag

SEQ ID NO: 22962 - DNA, 720 bp, Artificial Sequence
  Description of Artificial Sequence: Synthetic coding sequence
atggcccacgccggccggaccggctacgacaaccgggagatcgtgatgaaatacattcactacaaactatcacagaggggatatgagtgggatgccggcgacgttggcgccgctcctcctggcgcagcccccgctccgggcatcttttcctcccaacccggccacactccacaccctgccgcatcacgggatcctgttgccaggacctctccattgcagacacctgccgcccctggggccgcggccggcccggcattaagccctgtacctccggtggtacatctcacactacgacaggccggggacgatttcagccggcgctacaggagagacttcgccgaaatgtcctcgcaactgcacttgaccccttttacggcgcggggacggttcgccaccgtggtggaagaattgtttcgggatggcgtcaactggggacgtattgtggcgtttttcgaatttggaggagtgatgtgcgtggaatccgtgaaccgggaaatgtcgcctcttgtggataacatcgcgctgtggatgaccgagtaccttaacaggcacctgcacacatggatacaggataacggaggctgggatgcatttgtggagctatacggaccatccatgcgaccactgttcgacttctcgtggctcagtctcaaaactttattgtctttagcgttggtcggagcatgcatcaccctgggcgcttatctagggcacaagtag

SEQ ID NO: 22963 - DNA, 618 bp, Artificial Sequence
  Description of Artificial Sequence: Synthetic coding sequence
atggcccacgccggccggaccggctacgacaaccgggagatcgtgatgaaatatatacactacaagcttagccagagggggtatgaatgggatgcaggggatgtaggagccgctccaccgggagcagctcctgctcccggaatcttcagctcccagcctggccacacaccccatccagccgcctccagggaccccgtagcacgcactagtccgctgcagactccagcagcacctggagcagcagcgggccccgcactgtcccccgtgccaccagtcgtccatctgactctgagacaggcaggcgacgattttagtaggcgttaccggcgcgactttgctgagatgagctcccagctgcatctgacccccttcactgcacgaggcagattcgccacagtcgtcgaggaactatttagggatggcgtgaattgggggagaattgtggcttttttcgaatttggcggtgtcatgtgtgtggagtccgtgaatcgagagatgtctcccctagtggataacatcgcactgtggatgacagagtacctcaaccggcacctgcacacctggatccaggataacggaggttgggtaggggccttaggggatgtatcgctgggctag

SEQ ID NO: 22964 - DNA, 1578 bp, Artificial Sequence
  Description of Artificial Sequence: Synthetic coding sequence
atgaaggccctgatcgccgccctgctgctgatcaccctgcagtactcatgtgcagtttctcctacagactgttccgccgtcgagccggaagcagagaaagccctggacctgattaacaagcggcgccgagacggctacctgttccaactgctaaggatcgcggatgcgcatctggacagagtagaaaacactactgtctattatctggtcctggacgtccaggagtctgattgctccgtactttcccggaaatactggaatgactgtgagcctccagacagcaggcggccaagtgaaatagttattggccagtgtaaagtcattgccacgagacactcacacgaaagccaggatttgcgagtaattgacttcaactgcacgacatcttcagtttcttccgcacttgccaacaccaaggactcacccgtgctaatcgatttttttgaggataccgagagataccgaaagcaggccaataaagccctcgagaaatataaggaggaaaacgatgactttgcatccttcagagtggaccgaattgagcgggttgcacgcgtgagagggggagaggggaccggttactttgtggacttttcggtcaggaactgtcccagacaccatttccctaggcatcccaatgtcttcgggttttgtagggccgatctcttttacgacgtggaagcactagacctcgagtccccaaaaaacctagtgatcaattgcgaagtgtttgacccgcaagagcacgaaaatatcaatggcgtacctccccacttaggacatccattccactgggggggtcatgagcgtagttccaccaccaaaccgccatttaaaccacacgggagtcgtgatcaccaccatcctcacaagcctcatgagcatggaccaccccccccacctgatgagagagaccactcacacgggcctccactacctcaggggccgccccccctcttacctatgagctgcagcagttgccagcatgccaccttcggcacaaatggtgcccagagacactcacacaataacaatagctcagacctccaccctcataagcaccactcacacgagcagcacccccatgggcatcatcctcacgctcatcacccacacgagcatgatacccaccgccagcacccccatggacatcatccacacggacaccacccacacggccaccaccctcacgggcaccatccacacggacaccaccctcactgccacgattttcaggattacggaccctgcgacccccccccccacaaccaggggcactgttgccatggccatggcccgccgccaggccatctgcgacgcagaggaccaggtaaggggccaaggccatttcactgtcggcagatcggatctgtatatcgcttgcctcctttaagaaagggcgaggtcttgccattgccggaggccaattttccctctttccctctgccccaccacaagcatcccttaaagccagacaaccagccatttccccagtctgttagcgagtcttgcccaggcaagttcaaatcaggatttccccaggtctccatgttctttacacacacattccccaagtag

SEQ ID NO: 22965 - DNA, 2121 bp, Artificial Sequence
  Description of Artificial Sequence: Synthetic coding sequence
atggccagccccgccgacagctgcatccagttcacccggcacgcctccgacgttctgttgaatctgaatagactcagaagtagagatatactcaccgacgtagtcatagtcgtatcacgcgaacagttccgagcgcacaaaactgtactgatggcgtgcagcggactgttttactccatattcactgatcagttaaagtgcaatcttagcgtgattaatctggacccagagatcaaccccgaaggattctgtatcctcctcgattttatgtacacatctaggctgaatttacgggaaggcaacataatggccgttatggcaaccgccatgtatctgcagatggaacatgtggtcgatacctgcaggaaattcatcaaagcatccgaagccgaaatggtgagcgcgatcaagccaccacgggaagaattcctgaattctagaatgctgatgccacaggatatcatggcttatcgtgggcgggaggtcgtcgaaaataacctgcccctgcgtagtgctcccggatgcgaatctagagcttttgctccatcactttattccggcctctctaccccccctgctagctactcaatgtatagtcacctgcccgtgagctccctgttgttctcagacgaggaatttcgcgacgtcagaatgccggtagctaatccttttcctaaggagagagccctgccgtgtgattctgcacgacctgtgccaggcgagtattctagacctactttggaagtctccccgaatgtgtgccacagcaatatctattctccaaaagagacaatccccgaagaagcgagaagcgacatgcattattctgtcgcagaagggctgaagccagctgctcctagcgcccggaatgcaccttatttcccttgcgacaaagcatctaaagaggaagaacgaccatcttccgaagacgaaattgcccttcactttgagccaccaaatgcacccttgaatcgcaaggggctggtgagccctcaatcccctcagaagagcgattgccagccaaacagcccgactgagagctgcagtagtaagaacgcctgtattctccaggcctccgggtccccccccgctaagtcgcccactgaccctaaagcctgcaattggaagaaatacaagttcattgtcctgaattcgctgaatcagaacgcaaagccggagggccccgaacaggctgagctcggcagactaagcccaagagcatacacggcaccaccagcttgtcagccccccatggagccggagaacctggacctgcagagtcctactaaattgagcgcctctggcgaggacagcactataccacaggccagccggctcaacaacatcgtgaataggagcatgaccggttcccctcgctcctcctccgagtcacattctcccctgtacatgcatccacctaagtgcacaagctgcggctcacagtctccacagcacgctgaaatgtgtctgcacacagccggcccaaccttccccgaggagatgggtgaaacacagtccgaatattctgactcttcttgtgaaaatggggcattcttttgtaacgagtgtgattgtagattcagtgaagaggctagtttaaaacggcacacactccagacccattctgataagccttacaagtgcgatcggtgccaggcctcgtttaggtataagggaaatttggccagccataagactgttcacacgggcgagaaaccgtacagatgcaacatctgcggagctcagtttaaccggcctgctaatctgaaaactcacacccggatccactccggtgagaagccctacaaatgtgagacttgcggagcgagatttgtccaggtggcccatcttcgtgcccacgtgctaatccacactggcgaaaagccctacccctgtgagatttgcgggacacgatttaggcacctgcagaccctgaagagtcaccttcgcattcacacaggcgaaaagccgtaccactgcgagaagtgcaacctgcatttccgtcataagtcccagttgcggctccatttacgtcagaaacatggggccatcaccaataccaaagtacagtatcgagtcagcgctaccgatctgccgccagagctgcccaaagcctgttag

SEQ ID NO: 22966 - DNA, 369 bp, Artificial Sequence
  Description of Artificial Sequence: Synthetic coding sequence
atggccagccccgccgacagctgcatccagttcacccggcacgcctcggatgtgctgctgaatctgaatcgtctgcgcagtcgagatatcctcactgatgtagtgattgtggtatcgagagaacagttcagagcccataaaacagtattaatggcctgttcaggtctgttttattctatcttcaccgaccagcttaaatgcaatctgtcagttatcaatctggacccggaaatcaaccccgagggcttctgtatactacttgatttcatgtacaccagccggctcaacctgagagaaggcaatatcatggccgtgatggcgacagctatgtatctgcaaatggaacacgtggtggatacctgccggtag

SEQ ID NO: 22967 - DNA, 315 bp, Artificial Sequence
  Description of Artificial Sequence: Synthetic coding sequence
atggccagccccgccgacagctgcatccagttcacccggcacgccagcgacgtgcttctgaaccttaatagattaaggagtagggacatacttacagacgtcgtgattgtggtcagccgcgagcagttccgagctcacaaaactgtgctcatggcatgctctggccttttctacagtatctttaccgaccagttgaagtgcaacctttctgtcattaatcttgatccagagataaaccctgagggtttctgtatccttcttgacttcatgtacacatccagactgaatctgagggagggcaacatcatggcttag

SEQ ID NO: 22968 - DNA, 1953 bp, Artificial Sequence
  Description of Artificial Sequence: Synthetic coding sequence
atggccagccccgccgacagctgcatccagttcacccggcacgcctctgacgtcttactgaacctgaatcgcctgagaagtcgagacattctgacagacgtggtaatagttgtatcgcgcgaacagttcagggcccacaaaaccgtgctcatggcctgcagtggtttgttctacagtatattcacagatcagcttaagtgtaacttatcggtaataaacctcgaccctgagatcaacccagaggggttctgcatccttctggactttatgtacacaagccgtttgaacctgcgcgaggggaacattatggccgttatggccactgcaatgtacctccaaatggaacacgtggtggacacgtgtaggaagttcatcaaagcttcggaagctgaaatggtgagcgccataaagccaccaagggaggaatttctcaattcccgcatgctgatgcctcaggatattatggcatacagaggcagggaagtggtggaaaacaacctcccactgaggtctgccccgggttgtgagtccagagccttcgcaccttccttgtacagtggactgagcacaccccccgcctcctattctatgtattctcacctccccgtgtcatccctgcttttctccgatgaggaattccgggacgttcgaatgccagtcgctaatccattcccaaaggagagggccctgccctgtgactccgcgaggcccgtaccgggcgaatatagccgacctaccctggaggtgtcccccaatgtatgtcattccaacatctactcccctaaagagacaatccctgaggaagctcgttcggatatgcactactccgtggcagagggccttaagccagccgcccctagcgcgcgaaacgcgccctactttccatgcgacaaagcttccaaagaagaagagcggcctagtagcgaggatgaaattgccctgcattttgagccccctaacgcgcccttaaaccggaaaggtctggtgagcccacagtccccacagaagagtgactgtcagcccaattccccaactgaaagctgttcttctaagaacgcctgtatactgcaggcctcaggaagtccccccgccaaatcccctactgacccaaaggcatgcaactggaagaaatacaagttcatagtgctaaactcactaaaccagaacgcaaaacccgagggtccggagcaggccgaactgggcagattgtcccccagggcctataccgccccacctgcgtgccaacctccgatggagcccgagaatctcgacttacagtcccctaccaagttgagcgcatccggcgaggattcaactatcccgcaggccagccgtctcaataacattgtgaacagatccatgactgggtctccaagatcaagcagcgagtcacactcacccctttatatgcatcctccaaagtgtacttcatgtggcagtcagtctccccagcacgctgagatgtgtctgcatacagccggtcctacgtttcctgaggaaatgggagaaacacaatcggagtatagcgactcctcatgcggagagaaaccctaccgttgcaacatttgcggtgcccaattcaacagacccgctaatcttaagactcacacacggatccacagcggagaaaagccctataaatgtgagacatgcggcgcccgatttgtacaggttgcacaccttcgggcccacgtcctgattcacaccggagaaaaaccgtacccttgcgagatctgcgggactcggtttcggcacctgcagacactgaagagccatctccgcattcacactggagaaaagccttaccactgcgagaagtgtaaccttcattttaggcataagagtcagctgcgtttgcacctgcgccagaaacacggggctattacaaatactaaggtacagtacagagtgagtgccactgatctaccccccgagctccccaaggcctgctag

SEQ ID NO: 22969 - DNA, 306 bp, Artificial Sequence
  Description of Artificial Sequence: Synthetic coding sequence
atgaagttcggcatgggcagcgcccaggcctgcccctgccaggtgccccgtgctgcttcaaccacctgggtgccctgccagatctgcgagactaggggcgcagcagcggccccaccactgaccctggagggacctgtccagagccaccacggcacaccggcactgactcaggggcctcagagtccacgcgatggcgctcaactcggagcctgtacccgtcctgtcgacgtcagagatagcgggggacggccactgcctccgcctgacacattggcctccgccggcgattttctctgtacgatgtag

SEQ ID NO: 22970 - DNA, 396 bp, Artificial Sequence
  Description of Artificial Sequence: Synthetic coding sequence
atgaagttcggcatgggcagcgcccaggcctgcccctgccaggtgccgcgggccgcttctacaacttgggttccctgccagatttgtggaccccagccaagcctgtctctggctgagcaacacctcgagagcccagttcctagcgcccccggtgctctggccggtggcccaacccaggccgcccccggcgttcgcggcgaggaggagcagtgggcacgagagatcggcgctcagctgcgtcgaatggccgatgatttgaatgcacagtacgaaaggaggagacaagaggagcagcagaggcatcgcccatctccttggcgcgtgttgtataacttaatcatgggccttttacccctgccacgaggccacagggcccctgaaatggaacccaactag

SEQ ID NO: 22971 - DNA, 582 bp, Artificial Sequence
  Description of Artificial Sequence: Synthetic coding sequence
atggcccgggcccggcaggagggcagcagccccgagcccgtggagggacttgcgagggacgggccccgaccatttccgctgggccggcttgtgcccagcgccgtttcgtgcggtctctgcgagccgggcctggcagcggcccccgccgctccaaccttattgccggcggcgtacttgtgcgccccaacagcgccccctgctgtcactgcagcccttggaggatcacgctggcccgggggccctcgttcgcgcccacgcggtccgcgacccgatggcccacagccaagcctcagcctcgcagagcagcatcttgaatctccagttcctagtgcccccggtgctctggccgggggccccacacaagctgcacctggcgtgcggggcgaagaagaacagtgggctagggagattggggctcagctccgaaggatggcggacgatctgaatgcccaatacgaacgtcgcagacaagaggagcaacagcggcacaggccctccccctggcgtgtattgtacaatcttatcatgggcctcctcccactccctagaggccatagagccccagagatggagcccaactag

SEQ ID NO: 22972 - DNA, 786 bp, Artificial Sequence
  Description of Artificial Sequence: Synthetic coding sequence
atgaagttcggcatgggcagcgcccaggcctgcccctgccaggtgccacgggcagccagcacaacctgggtcccgtgccagatctgcggacctcgggagcgtcacggacctagaaccccaggggggcagcttccaggagcgcgtcgcggcccagggccaagaagacctgcccctctgccagcgaggcctcccggagccctcggctcagtgctgagaccgcttcgggctcgcccggggtgtcgaccacggagaccacatcctgccgcccgctgtctgcccctgcgacctcaccgacccacacgtaggcacagacggcctggcggattccctctggcttggggatcgccccaacctgcaccccggcccgcgccagggaggagtagcgccctggccctagccggaggcgccgcacctggggtagctcgcgcccagaggcctggaggttccggcgggcggagtcaccccggaggtcccggaagccccagaggtggagggactgtcgggcctggtgacagggggcccgccgctgcggatggaggtaggccccagcggactgtccgggccgccgaaacaaggggagcggcggccgctccaccattaaccctggagggaccagttcagtcacaccatggcaccccagccctgacccagggaccacagtcccctcgggatggggcccagctcggagcgtgcaccaggcctgtggacgtcagagacagtgggggccggccattgcctcctccggatacgttggctagtgctggagacttcctttgtacgatgtag

SEQ ID NO: 22973 - DNA, 1308 bp, Artificial Sequence
  Description of Artificial Sequence: Synthetic coding sequence
atgctgtgcggcttccaggaggacgccacccccccccccccccccagaccaagaaggttacatcgaagactgcccagaccggaagaagtcggcatgttatcccttccaccaggcctacttacggtgtccggtagtgcggcagccgccgacgcagttccactgagaccgggtgattgggccggtgtgtcaaccgcggacaggggcgagcgggcccctctgggaccagcattctgtgatttggcagtctcacccacttccccggcttggagaggggaagaggacgagggagcaaaagcatcatctggtgacatcgggagcttggactaccaggagtttgtagtagatattgaaagcagactgagaatggagggtgtcgagctgaaggaggagtggcaggatgaagactttcccattccactgcccgaggacgattccattgaagctgacatccttgccatcacaggccccgaagatcagcctggtagcctggaggtgaacggcaataaagtgcgtaagaaactgatggcccctgatatctctctgactttggaccctagcgacggcagtgtgcttagcgatgaccttgacgaatctggagagattgatctagatgggttagatactccgtctgagaattcaaacgagttcgagtgggaagatgacttaccaaagcccaagactactgaggtgattcggaagggttccattactgagtacacagctgcagaggagaaagaggatggccgtaggtggagaatgtttcgcataggagagcaggaccacagggtggacatgaaggcaatcgagccttacaagaaagtcatctctcacggaggttactacggggatggtctcaatgccatcgtggtttttgccgtgtgctttatgcctgagtctagccaacccaattaccgctacctaatggacaacttgttcaagtatgtgattgggactcttgagctgctcgtcgccgagaactacatgattgtttatcttaatggtgccactacacgacgcaaaatgcctagcctgggctggttgcggaagtgctaccagcagatcgataggagactgaggaaaaacctgaaatccttgataattgtgcatcctagctggttcattagaaccctgctggccgtgacgcggccgtttatttcttcaaaattttcgcagaagattcgctatgtttttaacctggcggaacttgccgagctggtgccaatggaatatgttgggatcccagagtgtattaaacaggtggatcaagagctgaatggcaagcaagacgagccaaaaaacgaacaatag

SEQ ID NO: 22974 - DNA, 1131 bp, Artificial Sequence
  Description of Artificial Sequence: Synthetic coding sequence
atggagccctgccccagcagcgcccccccccccttctaccccggcgtgggcgaggtcgcaggactgagatggttttccatctacgatcagagaccaagttggtaccgtactaaaaagctaggcttgttggatatcggaagcctcgactaccaagagtttgttgtggacatagaatcacggcttaggatggagggtgtggagttaaaggaggagtggcaggatgaggatttcccaatcccgctgccagaagatgactctatagaggccgacattctagcaattactggcccggaggaccaaccaggatctctcgaagtgaatggcaacaaggtccggaagaaactgatggctccggatatctccttgaccctcgatcctagtgatggctcggtactgtcagatgaccttgatgagtccggcgagattgacctggatggtttggacacgcccagcgagaattctaacgagttcgagtgggaagatgatttaccaaagccaaagaccaccgaggtgatcaggaaaggttctataacggagtacacagccgctgaagaaaaggaagatggcaggagatggagaatgtttcgcattggcgagcaagatcacagggtggacatgaaagcaattgaaccatacaagaaagttatctctcacggaggatattatggtgacgggcttaatgcgatcgtcgtgtttgccgtgtgcttcatgcctgagagtagtcaaccaaactatcggtacctgatggacaatttgttcaaatacgtgatcggaactctcgagctgctcgttgcagagaattacatgattgtgtaccttaacggcgctacgacacgcagaaagatgcccagtctgggatggctgcggaaatgctaccagcagatcgatcgcagactacgaaagaatctcaagagcttgatcattgtgcacccgtcctggtttatccgaacattgctggctgtcacgcgccccttcatctctagcaagttttctcaaaaaataagatacgtctttaacttagctgagttggcagaactggtgccaatggaatatgtgggaatacctgaatgtattaaacaggtagatcaagagctgaacgggaagcaggatgagcctaagaacgagcaatag

SEQ ID NO: 22975 - DNA, 939 bp, Artificial Sequence
  Description of Artificial Sequence: Synthetic coding sequence
atggccaaggtgttcagcttcatcctggtgaccaccgccctgaccatgggccgagagatatccgcccttgaggactgcgcacaggaacagatgaggctgcgggctcaggtcaggctcctagagaccagagtgaagcaacaacaggttaaaataaagcagctcctccaggaaaatgaagtgcagttcctggacaagggcgacgagaacactgtgatcgacctgggttccaagcggcaatacgccgactgtagtgagatctttaatgatggttataaactgtccgggttctacaaaattaagcctctacagagcccagctgagtttagtgtgtactgcgatatgagtgatggggggggatggacagtgattcagcgcaggagcgatggttcggagaattttaatagggggtggaaagattatgagaatggcttcgggaacttcgttcagaagcacggcgaatattggcttgggaataagaatctccattttctgaccacccaagaggactatacactaaaaatcgatctggctgactttgaaaagaatagtagatatgcccagtacaagaattttaaggtcggtgacgagaagaacttttatgagctgaacattggggaatacagcgggacggcaggggacagcctggcaggtaatttccaccctgaggtgcagtggtgggcttcccaccagcggatgaaattctctacatgggatcgagatcacgataattatgaaggaaattgcgctgaagaagaccaatcaggctggtggtttaatcgctgtcactccgcaaacctcaatggcgtgtattactcaggcccctacaccgccaaaactgataacggtatcgtgtggtacacctggcacgggtggtggtacagcttaaaatcggtcgtgatgaagatcaggcctaacgactttattccgaacgtgatctag

SEQ ID NO: 22976 - DNA, 660 bp, Artificial Sequence
  Description of Artificial Sequence: Synthetic coding sequence
atgagcagccacctggtggagccccccccccccctgcacaacaacaacaataattgcgaggaaaacgaacagtccctgccccctccagccggactgaattcgtcctgggttgagctgccaatgaacagctctaacggcaacgataatgggaacggtaaaaatggcggactagaacatgtgccctccagcagctctattcacaacggtgacatggaaaaaatcctgttggacgcccaacatgagagtggtcagtcctcaagccgcgggtcatcccattgtgacagtccttctccccaggaagacgggcagatcatgttcgacgtcgaaatgcatacgagccgcgatcacagttctcagtccgaagaggaggtagtggaaggagagaaggaggtggaagccctgaaaaagtccgcagattgggtgagcgactggtcgtccaggcctgagaatattcctcctaaagaatttcacttcagacacccaaagagatctgtttcgctgagcatgaggaagtccggagctatgaagaaaggtggtattttttcggccgaattcttgaaggtgtttattccatccctttttcttagccacgttctggctctggggttgggaatctatattggaaaacggctcagtacaccctctgcctcgacatactag

SEQ ID NO: 22977 - DNA, 540 bp, Artificial Sequence
  Description of Artificial Sequence: Synthetic coding sequence
atgaacagcagcaacggcaacgacaacggcaacggcaagaacggcggtctagagcatgtgccctccagctcctccattcacaatggcgacatggagaaaatactgcttgacgcgcagcacgaatctggtcaatcttcctctcgcggcagtagccattgcgactccccatctccacaagaagacggtcagatcatgtttgacgtggaaatgcacactagccgcgaccattccagtcagagcgaggaggaggtggtcgagggagaaaaggaagtagaggccttgaagaaatcagccgactgggtctctgactggtctagtcgccctgaaaacatcccccctaaggaattccatttccggcaccccaagcgtagcgtgtcgcttagcatgagaaagtccggtgccatgaagaagggcggcatttttagcgccgaatttcttaaggtcttcatccccagccttttcttgagccacgtgctggccctggggctcgggatttatattggcaaaagacttagtacaccctcagctagtacttactag

SEQ ID NO: 22978 - DNA, 540 bp, Artificial Sequence
  Description of Artificial Sequence: Synthetic coding sequence
atgaacagcagcaacggcaacgacaacggcaacggcaagaacggcggcctggagcacgtcccgtccagttcctctattcacaatggtgatatggaaaaaatccttctggatgcccagcatgaaagcgggcagtctagttctaggggatctagtcattgtgatagtccttcgccccaggaagacgggcaaatcatgtttgacgtggagatgcacacctcccgggaccactcctcacaatctgaagaagaagttgtagaaggagaaaaggaagtggaagccctgaaaaagagtgccgattgggtttcagactggagctctcgcccagagaacatcccccctaaggaattccatttccgccacccaaaaagaagcgtgagcttatccatgagaaaaagcggagcgatgaaaaaggggggcatattcagcgctgagttccttaaggttttcattccgtcactttttctttcacatgttctggctctaggactggggatatatattggcaaaaggttgagcacgcctagtgcttctacctattag

SEQ ID NO: 22979 - DNA, 540 bp, Artificial Sequence
  Description of Artificial Sequence: Synthetic coding sequence
atgaacagcagcaacggcaacgacaacggcaacggcaagaacggcggcctggagcatgtcccaagcagtagctctatccacaacggagatatggaaaagattctcttggatgcgcagcatgaaagtggtcagtcctcctcccgagggtcgtcccattgcgattctccctcgccccaagaagacggacagatcatgttcgacgtggagatgcacacatctcgcgatcactccagccagagtgaggaggaagttgtcgaaggcgagaaggaggtggaggccttgaagaagagcgctgactgggtgtcagattggtcgtcaaggcctgaaaatattccaccaaaagagttccacttcaggcaccccaagaggagtgtatccctcagcatgcggaaaagtggcgctatgaagaaaggcggaatcttttccgcagaattcctcaaagttttcatacccagcctatttctctctcacgtgttggcactaggattaggaatctacatcgggaaaaggttatcaacgccatcagcctccacttattag

SEQ ID NO: 22980 - DNA, 636 bp, Artificial Sequence
  Description of Artificial Sequence: Synthetic coding sequence
atggccagcggccagggccccggccccccccggcaggagtgcggcgaacccgcattgccttccgccagcgaagaacaggtagctcaagataccgaagaggtttttagatcgtacgtattctacaggcaccagcaggaacaggaagctgaaggcgttgccgcgcctgctgacccagagatggttacgctgccacttcagccttcatcaacgatgggccaggtcggtcgccaactcgctatcatcggggacgacatcaataggcgctatgattccgagttccaaacgatgcttcagcatctgcagcccaccgcggagaatgcctacgagtacttcacaaaaatagccaccagcctcttcgagtcgggtataaactggggcagagtcgtggctttattaggctttggataccgattggccctgcacgtttaccagcatggcctgacaggctttcttggccaggtcacacgcttcgtggttgacttcatgttgcatcactgcatagccagatggattgcacagagaggcgggtgggtagcggctctgaatctgggtaacggcccaatcctcaacgtactcgttgtgctgggcgtcgtgttgcttggccagttcgtggtccggcgattcttcaagtcctag

SEQ ID NO: 22981 - DNA, 576 bp, Artificial Sequence
  Description of Artificial Sequence: Synthetic coding sequence
atggccagcggccagggccccggccccccccggcaggagtgcggcgagccagcactgcctagcgctagcgaggagcaagtagcccaagatactgaagaagtgtttaggtcctatgtgttctaccgccaccagcagcagccttcatctaccatgggccaggtgggacggcaattagccatcattggtgacgacatcaatcggcggtatgactccgaattccagactatgctgcaacatttgcagcccaccgccgagaacgcatacgagtattttactaaaattgctacaagcctgtttgaatccggaataaactggggacgagtggtggctctgctgggcttcggctaccggctggcgcttcatgtgtaccaacacggcttgaccggctttctgggccaggtgacgcgtttcgtcgtggattttatgttgcatcactgtattgcgaggtggatcgcccaaagaggcggatgggtcgctgctctgaacctgggaaatggaccgattctcaacgtgttggtggtgcttggggttgttttgctgggacagttcgtagtccggcgcttcttcaagtcctag

SEQ ID NO: 22982 - DNA, 636 bp, Artificial Sequence
  Description of Artificial Sequence: Synthetic coding sequence
atggccagcggccagggccccggccccccccggcaggagtgcggcgaaccggcccttccaagcgcctcagaggagcaggtcgcccaggataccgaggaagtttttcggtcgtacgtgttctacaggcaccagcaggagcaagaagccgaaggcgtggccgcaccagctgatcccgagatggttaccctgccgttacagcctagtagtacgatggggcaggtcgggcgccagctcgccataatcggggatgatatcaaccggcgttatgattctgaattccagaccatgctgcagcatttgcaaccaaccgccgaaaatgcctacgagtacttcaccaaaatagctacctcactgttcgaatcgggcatcaattggggacgtgtggtagctttacttgggttcggttaccggttggctctccacgtctatcagcacggcctcacaggcttcctggggcaagtaacgcgattcgttgtggacttcatgcttcaccactgcatcgctcgctggatcgcacagagaggtgggtgggtggccgcactgaatctgggcaacgggcctatcctaaatgtgttagtggtcctcggcgttgtcctcttgggccagttcgtggtgcggcggttcttcaaatcatag

SEQ ID NO: 22983 - DNA, 462 bp, Artificial Sequence
  Description of Artificial Sequence: Synthetic coding sequence
atggccagcggccagggccccggccccccccggcaggagtgcggcgaacccgccctacccagcgcgtccgaagaacaggtggctcaggacacagaagaagtgttccgatcctacgtgttttatcggcaccaacaagaacaagaagccgaaggcgtggcagcccctgcggacccagaaatggtcactttgcctctccagccgagtagtaccatgggccaagtcggccggcaactcgccataattggggatgatataaacagaagatacgattccgaattccaaacaatgctacagcacctgcagcccactgcggaaaatgcgtatgagtatttcaccaagattgcgactcgtcccgccgccactcctaccgcctgtcttagggtcgcctcaatcggagctgtatggtggctgttctgggccagtgctactgtgtggccatatacatcaacaagcatggcatag

SEQ ID NO: 22984 - DNA, 507 bp, Artificial Sequence
  Description of Artificial Sequence: Synthetic coding sequence
atgttccagatccccgagttcgagcccagcgagcaggaggacagctccagcgcggaaaggggactcggaccgagtcctgccggcgatgggcccagcggcagcggaaagcaccaccgccaggctccaggcctgctgtgggacgccagccaccagcaagagcagccaacatcctcttctcaccacggcggagcgggggccgtagagattagaagccgtcatagttcctaccctgctgggactgaagacgacgagggaatgggcgaagagccttcccccttccggggcagaagccgctccgccccacccaacctgtgggcagctcagcgctatggccgcgagttgagacggatgagcgacgaatttgtagacagttttaaaaaggggctacccaggccaaagagcgctggcactgcaactcaaatgcgacagagttcctcgtggactagagtgtttcagtcttggtgggataggaaccttggccgaggttcaagtgcgcctagccagtag

SEQ ID NO: 22985 - DNA, 507 bp, Artificial Sequence
  Description of Artificial Sequence: Synthetic coding sequence
atgttccagatccccgagttcgagcccagcgagcaggaggacagcagctcagcagagcgaggcctcggcccatcaccagctggcgacggcccaagtggatccggcaagcaccacagacaggcccccggtctgctctgggacgcttcgcatcagcaggagcagcctaccagcagctctcaccacggaggggccggcgctgtggagattcgaagtcgccattccagctacccggccggcactgaagatgatgagggtatgggggaagagcctagccctttcagagggagatccagatccgctcccccgaacttgtgggcggctcagcgttacggtcgggaactgaggcggatgtccgacgagtttgtggatagcttcaaaaagggcctgccccgccccaagtctgctggaaccgcaactcaaatgcggcagtctagcagctggactcgagtctttcagagttggtgggacaggaatctcggacgcggtagttcagccccctcccagtag

SEQ ID NO: 22986 - DNA, 450 bp, Artificial Sequence
  Description of Artificial Sequence: Synthetic coding sequence
atgttccagatccccgagttcgagcccagcgagcaggaggacagcagctcagctgagagggggctcggcccaagccccgcgggcgacgggccttctggcagcggaaagcatcatcggcaagcacctggtcttctgtgggatgcctcacaccagcaggaacagcctacttcatcaagccaccacggaggagctggcgccgtagagatccgttctagacacagcagttacccagcgggaactgaagacgacgagggcatgggagaagagccctctcctttcagaggaaggtcaagatcagcccctcccaatctgtgggcagcacagcggtatgggagagagctccgaagaatgtccgatgagttcgtcgactcttttaagaaaggcttacccagacccaagagcgcaggcactgccacacaaatgcgtcaaagttccaggaggctacggtag

SEQ ID NO: 22987 - DNA, 591 bp, Artificial Sequence
  Description of Artificial Sequence: Synthetic coding sequence
atgaaccggagccaggaggtgacccgggacgaggagagcacccggtccgaagaggtcactcgcgaggagatggccgctgccgggttaactgttactgtgacccactcaaacgagaaacacgatctacatgttacctcgcagcagggttcctccgagcccgtggtacaggaccttgctcaggtggttgaggaggtgatcggcgttcctcagagttttcaaaagcttatttttaagggtaagtcactgaaggagatggaaacacctctcagcgcactaggaatccaggatggatgtcgcgtgatgcttattggcaagaaaaatagtcctcaagaagaggtggagcttaagaagttaaagcacctagagaagtctgtggaaaaaattgccgatcagctggaggaacttaacaaagaactgaccggaattcaacaaggctttcttcccaaagatcttcaagccgaagccctttgtaagttggatcggagagtaaaggcgacgatcgagcagttcatgaagatacttgaggagattgatacactcatcctgcccgagaactttccaactctcaccttggtgctgaatgagaagtag

SEQ ID NO: 22988 - DNA, 693 bp, Artificial Sequence
  Description of Artificial Sequence: Synthetic coding sequence
atgaaccggagccaggaggtgacccgggacgaggagagcacccggagcgaggaagtcactcgggaagaaatggccgccgccggtcttactgtgacggtaacgcatagcaacgagaaacacgatctacacgtgacttcccagcaaggaagctccgaacccgttgttcaggatttagcccaggtcgttgaagaagtcattggagttccacagtcgttccaaaaactcatcttcaaaggaaagagtttgaaagagatggagacaccactgtctgcactgggtatacaggatggctgtcgcgtgatgctgatcggaaaaaagaactccccccaggaagaagtggagctcaagaagctcaagcaccttgagaagtcagtggagaagatcgccgatcagctggaagaactgaataaggagctgacagggattcaacaggggttcctgcccaaggacctccaggctgaagcgctttgtaaattagaccggagagtgaaggcaacaatcgagcagttcatgaaaatcctcgaggagattgatacgctgattcttcctgaaaattttaaggatagcaggctcaaaaggaagggactggttaagaaagtgcaggcctttctggccgaatgtgataccgttgagcagaacatttgtcaggagaccgaacgcctgcagagtaccaacttcgcactggccgaatag

SEQ ID NO: 22989 - DNA, 1038 bp, Artificial Sequence
  Description of Artificial Sequence: Synthetic coding sequence
ctggcccagcggggcggcgcccggcggccccggggcgaccgggagcggctggggtcccgattgagggctctgaggcctggtcgcgagccccgacaatcggagcccccagctcagcgcggacctccaccttctgggaggccccccgctcgatccactgcatccggacatgataggcccacacgcggggcagctgctggggcccgacggccgagaatgaagaagaagactaggcggcggagcactaggagcgaagagttgacccgttcagaagagctcaccctgtccgaagaggcaacatggagcgaagaggcaacccagtcagaggaggccactcagggggaggaaatgaaccggtctcaggaggtgacacgcgacgaagaaagcactaggagcgaggaagtgacccgggaagagatggctgctgcaggcctaaccgtgaccgttacgcatagtaacgagaaacacgacttacacgtgacatcccagcagggttccagcgagcctgtcgtgcaggatcttgctcaagtggttgaagaagttattggcgtgcctcagtctttccaaaagctgatttttaaggggaagagtctgaaggagatggagaccccgctgtctgccttgggcatccaggacggttgccgcgtgatgctgatcggaaaaaagaacagtccacaagaggaggtggaactgaaaaaactcaaacacctcgagaaaagcgtggagaaaatagccgatcagttggaggagctgaataaagagctgaccggtatccagcagggattcctgcctaaggatcttcaggcagaggctctgtgtaagctcgaccgacgggtgaaggctactatcgaacagttcatgaagatcctggaggagatagacacactgattttgcctgagaatttcaaagactcacgcctgaaaaggaagggactggtcaagaaagtgcaggcgttccttgctgaatgcgataccgtagaacagaacatttgtcaagagactgagcgcttacaatcgaccaattttgccctggccgagtag

SEQ ID NO: 22990 - DNA, 1728 bp, Artificial Sequence
  Description of Artificial Sequence: Synthetic coding sequence
atgagcgccgccacccacagccccatgatgcaggtggccagcggcaacggagatagggatcctctccctccagggtgggaaatcaagatcgatcctcagaccggttggccctttttcgttgatcacaactcccggacgactacctggaacgaccccagagtaccgagtgaagggcccaaagagaccccctcttccgctaatggtccctcccgcgaaggaagtagactcccccctgcaagggagggtcaccctgtgtatcctcagctgcggcctggctatatccccatcccagtcctacacgagggagctgagaacagacaggttcatccctttcacgtgtatccgcagcctggaatgcaacgattccgtacagaggcagcagccgcagcaccacaacgcagccaaagccctttacgcggcatgcctgagacaacacagccagacaagcagtgcggccaggtcgctgctgccgctgcagcccagccccctgcaagtcacggcccagagcgctcccagagccccgcggcatccgactgtagctcatccagcagctccgcttctctgcccagcagcggccgcagttccctaggctcacaccagctaccccggggatacattagcatccccgtgattcatgaacaaaacgttacccggccggctgcacagccaagcttccatcaagctcagaaaactcattatccggcacagcaaggagaataccagacccatcagcctgtttaccacaagatccagggggatgattgggagccccgtccgctgagagccgcctcaccctttcgcagtagtgtccagggggcttcttcacgagaggggtcaccagcccgtagttccacccctctgcacagtccaagccctatacgcgttcacaccgtggtcgaccgcccccagcagccgatgacacacagggagacagcccccgtatcccaacctgagaacaaaccggagtctaagcctggccctgttgggcccgagcttcctcccggacacattccaatccaggttatcagaaaagaagtggactcaaaaccagtctctcagaaacccccacccccctccgaaaaggtggaagtgaaggtcccacctgctcccgtaccttgccctccaccttctcccggaccatcagctgtcccttccagcccaaagtcagttgcgacagaggagagagcggcaccgagcaccgctccggcagaagccacccccccgaaacctggcgaggccgaggctccgcccaaacatcccggagtactaaaggtggaggccatcctggagaaggtgcagggcttggagcaggccgtggacaacttcgaggggaagaagactgacaagaaatacctaatgatcgaggaatatctgactaaagagctcttggcccttgatagcgtggaccccgagggacgcgcggacgtaagacaggctaggagggacggtgtcaggaaggtccagacgatccttgaaaagctggagcagaaggctatcgacgtgcccgggcaggttcaggtttacgagcttcagccgtctaatcttgaagcagatcagccattgcaagcaataatggaaatgggcgctgtagcagcagataagggcaaaaaaaatgccggtaatgcagaggacccccacacagagacgcaacagcccgaggcaacagccgctgcaacaagcaatccatctagtatgacagacacccctggtaaccctgctgccccgtag

SEQ ID NO: 22991 - DNA, 978 bp, Artificial Sequence
  Description of Artificial Sequence: Synthetic coding sequence
atgcaggagacccccagcagcgccaacggccccagccgggagggctctcgcctacccccagcaagagaaggtcatccagtatacccccaactgagacccggctatatcccaattcccgtgttgcatgagggcgccgaaaacagacaagtgcatcctttccacgtttatccacaaccaggaatgcagcggtttcggactgaggcagcagccgcagccccgcagagaagccagtcacccttgcgtggtatgcccgagactacacaacccgacaaacaatgtggccaggtggctgccgccgctgctgcccagccacccgctagccacggtccagagagaagtcagagccccgccgcatctgactgttcctcatcctcttcctctgcctccttaccaagcagtgggcggtcaagcctcggatctcaccagctgcccagagggtacatttcaatccctgtaatccatgagcaaaacgtcacaaggcctgctgcgcagccttcgtttcatcaggcacagaaaacacactaccccgcacaacagggcgagtatcagacccaccagcccgtgtaccacaagattcagggagacgactgggagccacggcctctgcgcgcagccagccccttccggtcttccgtgcagggtgcatctagtcgcgaagggagcccggcccggtcaagcacccctctgcattcaccaagccccatcagagtgcatacggttgtggaccgcccccagccgatgacgcacagggaaactgccccagtgtctcagcccgaaaataaacccgagagcaaaccggggccggtaggaccagagctgcctcccggccatatacccatccaggtgatcagaaaagaggtcgatagcaagcccgtgagccaaaaacccccaccgccttcagaaaaggtcgaagtgaaggttccccccgcccccgtgccatgccctcccccaagccccggccctagcgctgtcccgtag

SEQ ID NO: 22992 - DNA, 657 bp, Artificial Sequence
  Description of Artificial Sequence: Synthetic coding sequence
atggacggcagcggcgagcagccccggggcggcggccccaccagcagcgagcagatcatgaagacgggcgccttgctgcttcaaggtttcattcaggaccgcgccggaagaatgggaggtgaggccccagagctggcactcgatcccgtgccacaggacgcatctacgaaaaaactcagtgaatgtctgaagagaattggcgacgagctggattcaaacatggagttacagcgcatgatcgccgccgtcgacaccgactctcctcgggaggtgttcttccgcgtggcagcggatatgtttagcgatggaaattttaactggggcagggtggtcgcacttttctacttcgccagcaaacttgtcttgaaagcattgtgcaccaaggtgccagagttgatccgtacaataatgggctggaccttggactttctgagagaacgtctcctcggctggattcaggatcagggcggttgggtacggctcctgaagcctccacatcctcatcaccgggcacttactacagccccggcaccccccagcctgcctccagcaacaccattggggccttgggccttctggtcacgtagccagtggtgccccctgcctatcttcaggtcctcagacgtggtctacaatgccttttctctgcgcgtatag

SEQ ID NO: 22993 - DNA, 579 bp, Artificial Sequence
  Description of Artificial Sequence: Synthetic coding sequence
atggacggcagcggcgagcagccccggggcggcggccccaccagctccgagcaaatcatgaagactggggctctcctgcttcagggattcatccaggacagagcaggccgaatgggaggtgaagctcctgaactggccttggacccggtgcctcaggacgcaagtacaaaaaaactttcagagtgtctgaagaggatcggtgatgagctagactctaacatggagctgcaaagaatgatcgctgccgtggacacagactcccctagagaagtcttcttccgggtagcagccgacatgttctcagatggtaacttcaattggggcagagttgtggccctcttctattttgcctcgaaactggtattaaaagcgctgtgcacgaaagtgccggaactaattagaaccattatgggatggaccctggattttctgagagaaagattactgggctggatccaggaccagggcggctgggacgggctcctgagctacttcgggacacctacctggcagacagtgaccatctttgtggccggcgtgctaacagctagcttgaccatatggaaaaagatgggctag

SEQ ID NO: 22994 - DNA, 432 bp, Artificial Sequence
  Description of Artificial Sequence: Synthetic coding sequence
atggacggcagcggcgagcagccccggggcggcggccccaccagctccgaacagattatgaagacaggcgctttgctgttgcaaggaatgatcgcagccgttgacaccgactccccaagggaggtattctttcgggtggccgcggatatgttctcagatggcaatttcaactggggcagggtcgtcgccctgttttattttgcttcaaagctggttttgaaagccctgtgtacaaaggtaccagaactgatccggactattatgggatggaccctggactttctgagggagcggctgctgggttggatccaagaccagggcggctgggatggtctgctgagttattttggtacccccacgtggcagacggttaccatattcgtggccggtgttttgactgccagtctgaccatctggaagaaaatgggatag

SEQ ID NO: 22995 - DNA, 126 bp, Artificial Sequence
  Description of Artificial Sequence: Synthetic coding sequence
atggacggcagcggcgagcagccccggggcggcgtgagcagccggatcgaacagggcgagtggggaggccgccacccaagctggccctggacccgctgcctgagaatgcgcccacccagaagttag

SEQ ID NO: 22996 - DNA, 540 bp, Artificial Sequence
  Description of Artificial Sequence: Synthetic coding sequence
atggacggcagcggcgagcagccccggggcggcggccccaccagcagcgagcagatcatgaagactggtgctcttttgctacaggggttcatccaagatagggcaggcagaatggggggtgaggcgcctgagctcgcactggatccggtgccccaagatgcatcaacgaagaaattgtctgagtgtctgaaaagaatcggggatgaactagactcaaatatggaactacagcgaatgatcgcagctgttgacacagattctccacgcgaggtcttttttcgagtcgcagcggatatgttctccgacggcaacttcaattggggccgggtagtggctctattttacttcgcaagcaagttggtgctaaaggctttgtgtaccaaggtgcccgagttgattaggacaattatgggatggacgctagatttcctgagagagaggttgctgggctggatccaggaccagggtgggtggaccgtgaccatttttgtcgctggagtccttaccgcctccctgactatttggaaaaagatggggtag

SEQ ID NO: 22997 - DNA, 495 bp, Artificial Sequence
  Description of Artificial Sequence: Synthetic coding sequence
atggacggcagcggcgagcagccccggggcggcggccccaccagctcggagcagataatgaagacaggtgcattgctgctgcagggatttattcaggatagggcaggcagaatgggaggtgaagcccctgagctggctctggatccagtcccccaagacgcatctacaaagaagctgagtgaatgcctgaaaaggattggtgacgaactagatagcaatatggagttgcagcggatgatagcagctgtggatactgatagccccagggaagtgtttttccgggtggcggctgatatgtttagcgacggcaactttaactggggtagagttgtcgctctcttctattttgccagtaagctggtgctgaaagcgggtgttaagtggcgagatttaggaagtttgcagcctctgccaccgggctttaaacgcttcacatgcctgagcatcccgagatcttgggactacaggccttgcgcaccccgttgtaggaactag

SEQ ID NO: 22998 - DNA, 1806 bp, Artificial Sequence
  Description of Artificial Sequence: Synthetic coding sequence
atggcctacgacgacagcgtgaagaaggaggactgcttcgacggcgatcacaccttcgaggacatcggccttgcagcaggaagatcgcaaagggagaaaaagaggtcttacaaggacttcttgagggaggaggaggagattgccgcccaggtgagaaattcatccaaaaagaagttgaaggatagcgagctgtatttcctgggtaccgatacccataaaaagaagagaaagcattcctccgacgactattattatggtgacatttcgagcctagaatcgtcacagaaaaaaaaaaagaaatcaagtcctcagtccacagacacagccatggacctcctcaaagctatcacctctccacttgcggccggtagcaagccatctaagaaaacgggagagaaatccagcggcagcagttctcatagcgaatcgaagaaggagcatcaccgtaagaaggtgtcaggaagttctggagagctgccccttgaggacggtggatctcacaaatccaaaaaaatgaaacccctgtacgtgaataccgaaacgctgactctaagggagccagacggccttaaaatgaagctcattctatcccctaaggaaaaagggtcgtcttccgtagatgaggaaagtttccaatatcccagccaacaggccacagttaagaaaagttctaagaagagcgcccgcgatgaacagggggcgctgttgcttggacatgagctccagtccttcctcaagacggccagaaagaagcacaaatcctcctctgatgcccattctagtccaggaccagagggctgcggttccgacgcgtcacagttcgccgagtcgcatagcgctaacctggacttgtccggactggaacctatccttgtcgagtccgactcaagctccggaggtgaactggaggcaggcgagctagtgatcgacgatagttatagggagataaaaaaaaagaaaaagtctaaaaaatcgaagaagaagaaggacaaggagaaacataaagagaagcgacacagcaagagtaaaaggagtctcgggttgtctgccgtgcccgtgggtgaagttactgtgacgtcaggccctcctccctccataccatacgcgggagccgcagcccctccattaccattacccggtctccacacagacggccattccgagaaaaagaaaaagaaagaggagaaggataaagagcgcgaacgtggcgagaagcccaaaaaaaagaacatgtctgcttaccaggtattttgtaaagagtacagggtgaccatcgtcgcagaccatccgggcatcgatttcggtgagttaagcaagaaactggcggaggtgtggaaacagctcccagaaaaagacaagttgatctggaaacagaaagcacaatatttgcagcacaaacagaacaaggccgaagcaactactgttaaacggaaagcgtcttcttccgaagggtctatgaaggtgaaagcaagcagtgtcggagtgctgtcacctcaaaaaaaatcgcctcctacaacgatgctgctcccagcctcgcccgccaaagcccccgagactgaacccatcgatgtggcagctcatttgcagctcttgggagagtcactgagtcttataggccatcgattgcaggagacagaaggcatggtggccgtctccggctccctgtccgtactcctcgattctataatttgtgcactcgggcccctggcctgtctgactacccagttaccagaattaaatggctgcccgaagcaggtgctcagtaataccttggataatatcgcctatattatgccaggcctttag

SEQ ID NO: 22999 - DNA, 702 bp, Artificial Sequence
  Description of Artificial Sequence: Synthetic coding sequence
atgagccagagcaaccgggagctggtggtggacttcctgagctacaaactgagccagaaagggtattcttggagtcaatttagcgacgtagaagaaaatagaaccgaggcgcctgaaggcacagagtccgaaatggaaacccctagcgctatcaacgggaacccgtcctggcacttggctgattctcccgccgtgaatggcgcaacaggacactcttcatctctcgatgcccgcgaagtgatacccatggcggcggttaagcaggctctgcgggaagcaggggatgaatttgaactgagatacagacgggcgttcagtgatttaacatcgcagctgcatataaccccagggaccgcttatcagtcttttgagcaagtagttaacgagctgtttcgcgacggcgtaaactggggccgcatagtagccttcttctcatttggaggcgctctctgtgtggagtctgttgacaaagaaatgcaggtcctggtgtcaagaattgccgcatggatggcgacgtacctgaatgaccacctggagccttggatacaagagaacggcggatgggacacatttgttgagctttacggtaacaacgctgcagctgagagtagaaaaggtcaggaacgattcaatcggtggtttctgaccgggatgaccgtagcaggggtggtgttactgggatccctgttctcccggaaatag

SEQ ID NO: 23000 - DNA, 513 bp, Artificial Sequence
  Description of Artificial Sequence: Synthetic coding sequence
atgagccagagcaaccgggagctggtggtggacttcctgagctacaagcttagccagaagggctacagctggtcccagttttctgatgtggaagaaaaccgcactgaggcacctgagggcaccgaatctgagatggaaacgcctagcgccattaacgggaacccttcatggcatttggccgattcgccggccgtgaatggggccacggggcattcaagctctttggacgccagagaagtgattcctatggccgcagtaaagcaggccctgcgggaggcaggcgacgagttcgagctacgttatcgaagagctttctctgacctgactagtcaactgcacattactccaggcaccgcctatcagagcttcgagcaagacacgttcgtcgaactctacggcaacaacgcagcagcagagtcccgtaaaggccaagaacgctttaatcggtggtttttgaccggtatgacggttgccggggtggtcttgctcggctccctgttttcgcgaaagtag

SEQ ID NO: 23001 - DNA, 702 bp, Artificial Sequence
  Description of Artificial Sequence: Synthetic coding sequence
atgagccagagcaaccgggagctggtggtggacttcctgagctacaaactttcacagaagggatactcatggagccagttctcagacgtcgaagaaaatcgcactgaggcgcccgagggaaccgagagcgagatggaaaccccaagcgcaatcaatggtaacccctcatggcatctcgccgactcacctgccgtgaacggggcaaccggccattcctcatcattagacgcacgggaagtgattcccatggctgcagtgaaacaggccctcagagaggcaggcgacgagtttgaactacggtaccgtagggccttctccgatctcacatcacaactacatattactcctggcaccgcttaccaaagctttgagcaggtagtaaatgagctgtttcgggatggtgtgaactggggacgcattgtggcctttttttcctttgggggcgcactctgcgtagaatctgtggataaggagatgcaggtgctggtgagcagaatcgctgcctggatggcaacctatctgaatgaccaccttgagccttggatccaggaaaatgggggctgggataccttcgttgaactctatggcaataatgcggctgccgaatcccgtaagggtcaggagcggtttaatcgctggtttctgacagggatgaccgtggccggggtcgtgctcctgggatccctgttttctcgaaagtag

SEQ ID NO: 23002 - DNA, 567 bp, Artificial Sequence
  Description of Artificial Sequence: Synthetic coding sequence
atgagccagagcaaccgggagctggtggtggacttcctgagctacaaattaagccagaagggctacagctggtcacagtttagtgacgtcgaggaaaacaggactgaggcgccagaaggcacagaatctgaaatggagaccccgagcgccataaacggcaacccttcctggcacctcgccgactcccccgccgtgaacggcgcaacggggcattcctctagcttagatgcgcgagaagtaattccaatggcagccgtcaagcaagcactgagagaggcaggtgatgagttcgaactgaggtacaggcgtgcattttccgaccttacatcacaactgcatatcacccctggtaccgcttatcaaagctttgagcaggttgtgaatgagctttttcgtgacggtgtgaactggggaagaatagtggctttcttctcattcgggggagcgctgtgtgtagaaagcgtggacaaggaaatgcaggtcctggtgtctcgcatagccgcttggatggcgacatatttgaatgaccacctcgaaccttggattcaagaaaacggaggctggtag

SEQ ID NO: 23003 - DNA, 702 bp, Artificial Sequence
  Description of Artificial Sequence: Synthetic coding sequence
atgagccagagcaaccgggagctggtggtggacttcctgagctacaagctgtcacagaaagggtattcttggtcgcagttctccgatgtggaagagaatcgcaccgaagctccagaagggacagaatcagagatggaaacaccatcagcaattaacggcaatccctcttggcacttggctgattcccccgcagtgaatggagccaccggacacagtagttctctcgatgcacgggaagttatcccaatggccgctgtgaagcaggcactcagagaggcgggggacgagtttgagcttcgttacagacgagctttctctgacctaactagccagttacacatcacgcctggcacagcataccagagtttcgaacaagtcgtgaacgagctatttcgagacggcgtgaactggggacgaatcgtagcctttttttctttcgggggcgcactctgtgtcgagagtgtggacaaggagatgcaggtgctcgtgtcccggattgcggcctggatggctacttacctgaatgatcatctggaaccatggatccaagagaatggaggatgggacacattcgtcgagttgtacgggaacaacgccgcagcagagagtcgaaagggccaggagcgctttaaccggtggtttctgacgggaatgacggtggctggcgtggtcctgttggggagcctgttttcacgaaaatag

SEQ ID NO: 23004 - DNA, 567 bp, Artificial Sequence
  Description of Artificial Sequence: Synthetic coding sequence
atgagccagagcaaccgggagctggtggtggacttcctgagctacaagctaagtcagaaagggtacagctggtcccagttttccgatgtcgaggagaatagaactgaggcaccagagggtacagaatccgaaatggaaactcctagcgcgattaacggaaaccctagttggcacttggccgactcaccggctgtgaacggagcgactggccattcttcgagcttggatgccagagaggtaatcccaatggccgccgtgaagcaggcactgagagaggcaggtgatgagttcgagctaagataccgtagagccttttcagaccttacctcgcagctgcacatcacacctggtaccgcctaccaaagtttcgaacaggtggttaatgaactctttcgagatggagtcaattggggcagaatcgtggccttctttagcttcggaggtgccttgtgtgttgagtcggttgataaggagatgcaagttctcgtgagtagaatcgcagcctggatggcaacatatctgaatgaccacctggagccttggattcaagaaaacgggggctggtag

SEQ ID NO: 23005 - DNA, 147 bp, Artificial Sequence
  Description of Artificial Sequence: Synthetic coding sequence
atgagccagagcaaccgggagctggtggtggacttcctgagctacaaactgtcacagaagggctattcttggtcccaattcagcgatgtagaggagaacagaaccgaggcgcctgaggggacagagtctgaaatggaaactccctag

SEQ ID NO: 23006 - DNA, 546 bp, Artificial Sequence
  Description of Artificial Sequence: Synthetic coding sequence
atgagccagagcaaccgggagctggtggtggacttcctgagctacaagctttcccaaaagggctatagctggagtcagttcagcgacgtcgaggagaatagaacggaggcccccgaggggaccgagtcggagatggagaccccatctgccattaatggcaacccttcttggcacttggccgactcgcccgcagtgaatggcgccactgggcactcaagctcgctggatgccagagaagtgattccgatggccgcagtcaaacaagcgctgcgcgaagccggtgacgagtttgagctaaggtataggagggcctttagtgatcttacaagtcagcttcatattactccaggcacagcatatcagtcttttgagcaggtggtgaatgagttgtttagggacggcgtcaactgggggcgaatcgttgcgttctttagcttcggcggtgctctctgcgttgagtctgtcgacaaggagatgcaggtgcttgtgtctcggattgccgcttggatggccacatatctaaatgatcatctggaaccctggtag

SEQ ID NO: 23007 - DNA, 618 bp, Artificial Sequence
  Description of Artificial Sequence: Synthetic coding sequence
atgagccagagcaaccgggagctggtggtggacttcctgagctacaaactgtcacagaagggctactcatggtcacaatttagcgacgtggaggaaaacaggacggaggctcctgaaggcactgagtcggagatggagaccccaagtgctattaatgggaatccatcctggcacctggccgacagtccagcagtgaacggagcaacagggcacagcagcagcctcgatgcccgtgaggtgatacctatggctgcggtgaagcaggctttaagggaggccggtgatgaatttgagctgcggtacagaagggcattttctgatctgacttcccagctgcacattacaccgggaactgcgtaccaatccttcgagcaggtggtgaatgagttgtttagggatggggtgaactggggacgaatcgttgcattcttcagcttcgggggtgccctgtgcgtggagagcgtggacaaagagatgcaagtactggtatctaggatcgcagcctggatggcaacctacctgaatgaccacctcgagccatggattcaggagaacgggggctgggatacgttcgtcgagctatacgggaacaatgctgccgcggaatcccgcaagtag

SEQ ID NO: 23008 - DNA, 567 bp, Artificial Sequence
  Description of Artificial Sequence: Synthetic coding sequence
atgagccagagcaaccgggagctggtggtggacttcctgagctacaagctcagccagaaaggatattcttggtctcaattttccgatgttgaggaaaatcggaccgaagccccagagggaacagaaagtgaaatggagactccttcagccattaatggaaatccaagttggcacttagcggatagcccagccgtcaatggggcgaccggccactcctccagtttagacgctcgggaagtcattcccatggccgcggtgaaacaggccttgagagaggctggggacgagttcgaactgagataccggagggccttttccgacctgacgagtcagctgcatatcacacccgggacagcctatcagagtttcgaacaggtggtcaacgagcttttccgggatggtgtcaactggggaagaatagtggccttttttagctttgggggtgctttgtgtgtcgagtccgtagataaagagatgcaagtgctggtgtcccgaatcgcggcatggatggccacctaccttaatgaccacctcgaaccatggatccaggagaatggagggtggtag

SEQ ID NO: 23009 - DNA, 615 bp, Artificial Sequence
  Description of Artificial Sequence: Synthetic coding sequence
atggtggaccagctgcgggagcggaccaccatggccgaccccctgagagagaggactgaactgcttcttgctgattacctaggttactgtgccagggagcccggcacgcccgagcccgccccgtccactcctgaggctgccgtgttacggtccgcagccgcacgtctgaggcaaattcacagatctttctttagtgcctatttgggctatcctggcaacaggtttgagctggtagcactgatggccgactccgttctctctgactctcccggcccaacctggggccgggtggtcacactggtgaccttcgccgggacgttactggaacgcggtcccctggtcactgctagatggaagaagtggggattccagccgaggttaaaggaacaagagggagatgtggcaagggactgtcagagactggtagccctgctgagtagcaggctaatgggacaacacagagcatggctccaggctcagggagggtgggacggtttctgtcatttttttagaacgccatttcctctcgccttctggagaaagcagctcgtgcaggcttttctgtcatgtctcttaacaacagcctttatctacctgtggactcgactgttgtag

SEQ ID NO: 23010 - DNA, 417 bp, Artificial Sequence
  Description of Artificial Sequence: Synthetic coding sequence
atggccaagcagcccagcgacgtgagcagcgagtgcgaccgggaggggcggcagctgcagccagcggaacgacctcctcagctcaggcctggcgccccaactagtctgcagaccgaaccccaggacagatctcccgcccctatgagctgtgacaagagcacccagacaccttcccctccatgtcaggcattcaaccactatctctcagccatggcctccatgaggcaggccgagccagcagatatgagacccgaaatctggatagcccaggaactgcgccgcattggagatgagtttaatgcctattacgctaggagggtatttctgaataactaccaggccgcagaggaccaccccagaatggtgatcttgcgcctgctgcgatatatcgtccggctcgtgtggagaatgcattag

SEQ ID NO: 23011 - DNA, 339 bp, Artificial Sequence
  Description of Artificial Sequence: Synthetic coding sequence
atggccaagcagcccagcgacgtgagcagcgagtgcgaccgggagggaagacagctgcaacctgccgaaagacctccgcagttgcgccccggggccccaacctccctccagacggaaccgcaggatcggtctccagctcctatgagctgcgacaagtccactcagaccccatcaccaccgtgccaggcctttaatcactatctaagcgcaatggtggtgattctcgaagacataggcgacctgagtctttgttttggcttcatcttcactggactagacctgtatggacatcatcatagccaggacaccgaacagctcaaccacaaagatttctcctag

SEQ ID NO: 23012 - DNA, 519 bp, Artificial Sequence
  Description of Artificial Sequence: Synthetic coding sequence
atggccaagcagcccagcgacgtgagcagcgagtgcgaccgggaggggcgccagctgcagccggccgaacgcccccctcagctgcgcccaggtgcgcccacctctcttcaaacggagccccaagggaatcccgagggtaatcatggcggagagggggactcttgcccacacggcagcccgcagggccctctggctccccctgccagtccaggcccttttgccactcgctcccccctgtttatcttcatgcgacgttctagtctgctgtcgaggagcagttcaggttacttcagtttcgatactgaccggtcccccgcccccatgtcatgtgataaatccacacagacgccttcccccccttgccaggctttcaaccattatctcagcgcgatggcgtccatgcgtcaggccgaacctgcagatatgaggccagagatttggatagcacaggagctaaggcgtatcggggatgagtttaacgcctactacgcaaggcgcatgcccctcccgcccgactag

SEQ ID NO: 23013 - DNA, 219 bp, Artificial Sequence
  Description of Artificial Sequence: Synthetic coding sequence
atggccaagcagcccagcgacgtgagcagcgagtgcgaccgggagggccgccaattgcaacctgctgagcgccctccacaactacgcccaggggccccgaccagtttgcagactgagccccagggcaaccctgaaggtaaccatggcggagagggagattcttgcccacatggtagcccccagggacctctggcgccacctgcctcgcccggcccatag

SEQ ID NO: 23014 - DNA, 258 bp, Artificial Sequence
  Description of Artificial Sequence: Synthetic coding sequence
atggccaagcagcccagcgacgtgagcagcgagtgcgaccgggagggaagacaactgcagccagctgaaagaccccctcagttaagaccgggcgcccccacgagtctccagacagaaccacaggccagcatgcgtcaggccgagcccgcagacatgcgccctgaaatctggattgcgcaggaacttcgaagaatcggtgacgagttcaatgcctattatgctcggcggctggccaagctgctcgcatccagtacttag

SEQ ID NO: 23015 - DNA, 597 bp, Artificial Sequence
  Description of Artificial Sequence: Synthetic coding sequence
atggccaagcagcccagcgacgtgagcagcgagtgcgaccgggagggaaggcagctgcagccggccgagcgtcctccccagctacggcccggcgccccaacttcacttcagactgagccgcagggcaatcccgaaggtaaccatggaggggaaggcgatagttgcccacatgggagtccacaaggacctttggcaccacccgccagtcccgggccctttgctactcgctctccattattcatcttcatgaggaggtcttccctcttaagccggtcgtcaagcggctatttttctttcgacacagatagaagcccggcacctatgagctgcgacaaatccactcagaccccgtcacctccctgtcaggcctttaaccactatctctctgcaatggcttctatgagacaggccgagccagcagatatgaggcctgagatctggattgcccaggaactgcggagaatcggcgatgagtttaacgcctactatgcccggagggtgtttctgaataactaccaggccgccgaggaccacccaagaatggtgattctgcggctgttgcgctacatcgtgagactggtgtggcgtatgcactag

SEQ ID NO: 23016 - DNA, 369 bp, Artificial Sequence
  Description of Artificial Sequence: Synthetic coding sequence
atggccaagcagcccagcgacgtgagcagcgagtgcgaccgggaggggaggcagctgcagccggctgaaaggcctccacagctgcgtcccggcgctcctacttctcttcagacagaaccacaaggcaaccccgagggcaaccatgggggcgagggcgacagctgtccacatgggtccccacagggtccactagcgcctcctgccagtcctggcccctttgcaactagatctcccctgttcatcttcatgcgcaggagcagcctgttgtctcggtccagttccggatattttagttttgacacagataggtcacctgcacctatgtcttgtgataaatctactcagaccccatcaccgccttgtcagtag

SEQ ID NO: 23017 - DNA, 222 bp, Artificial Sequence
  Description of Artificial Sequence: Synthetic coding sequence
atgcggcaggccgagcccgccgacatgcggcccgagatctggatcgcccaggaactccggcgaatcggggatgagttcaacgcctactatgcccgaagagtgatgatgtttagcttgcctgctttcctgctgacaccctcaccttccacgttgtatttcttcaagaagactgttacatcatgtaattatatgctgatcctcgagatgattacagtggcttag

SEQ ID NO: 23018 - DNA, 243 bp, Artificial Sequence
  Description of Artificial Sequence: Synthetic coding sequence
atggccaagcagcccagcgacgtgagcagcgagtgcgaccgggagggccggcagcttcagcctgccgagaggccgccccagcttcggccaggggcccctacgagcctccaaaccgagccgcaggataggtcgccagcacccatgtcctgcgacaagtcaacccaaacaccctctcccccgtgtcaggcttttaatcattacctgagcgctatggtgagagaaattgaggaagtggtggtctag

SEQ ID NO: 23019 - DNA, 408 bp, Artificial Sequence
  Description of Artificial Sequence: Synthetic coding sequence
atggccaagcagcccagcgacgtgagcagcgagtgcgaccgggagggcaggcaactgcagcccgccgaaagaccaccgcagctgcgaccaggagcacctacttcccttcaaaccgagcctcagggaaaccctgaaggaaaccatgggggggagggagattcttgcccacacgggtccccacagggacctttagcaccacctgcgtcccccggtccttttgcaactaggagccctttatttatctttatgaggaggagcagtctgctgtcccggagcagcagcgggtatttttcatttgatactgataggagccccgcccccatgtcttgtgacaaatccacccaaacaccatcgccaccttgccaggccttcaaccactatttgagtgcaatggccaattgggactag

SEQ ID NO: 23020 - DNA, 423 bp, Artificial Sequence
  Description of Artificial Sequence: Synthetic coding sequence
atggccaagcagcccagcgacgtgagcagcgagtgcgaccgggaggggcgccagctgcagccagccgagcgcccccctcaacttcgacccggtgcacccacgagcctgcaaactgagccacaaggcaatcctgaagggaaccatggaggcgagggtgactcctgcccccatgggagcccgcaggggcccctggcacccccggccagccccgggccctttgctacaaggtcacctttgttcattttcatgcgcaggagctcgctattaagtaggagcagtagtggttatttctcctttgacaccgatcgctcacctgctcccatgagttgtgataagtctactcaaactcccagcccaccttgtcaggcctttaaccactacttatccgcaatggtgcgcgagattgaggaagtagttgtctag

SEQ ID NO: 23021 - DNA, 291 bp, Artificial Sequence
  Description of Artificial Sequence: Synthetic coding sequence
aagcagcccagcgacgtgagcagcgagtgcgaccgggagggccggcagctgcagccagctgagcgaccacctcaactgagaccaggggccccaacgtctctgcagactgagccccaggacagaagccccgcacccatgtcatgtgataagtcaacccagactcccagtccaccttgccaagcctttaaccattatctctccgcaatggatgacagcgcaggcagctctctaaggattgcgcttcatcgcgaggtacagtggcctttgaagtggttggcaaagtcatcctag

SEQ ID NO: 23022 - DNA, 249 bp, Artificial Sequence
  Description of Artificial Sequence: Synthetic coding sequence
atggccaagcagcccagcgacgtgagcagcgagtgcgaccgggaggggcggcagctgcagccagcagagaggcctccacagttgaggcctggcgccccaacctccctgcaaactgagcctcaggcctcaatgagacaggccgaacctgctgacatgaggcccgaaatctggattgctcaggaacttcggagaatcggtgacgaatttaatgcatactacgccagaaggatgcctctacccccagactag

SEQ ID NO: 23023 - DNA, 582 bp, Artificial Sequence
  Description of Artificial Sequence: Synthetic coding sequence
atggccacccccgccagcgcccccgacacccgggccctggtggccgattttgtggggtataagctgcggcagaaggggtacgtgtgcggtgctggtcccggagagggtcccgctgctgaccccctgcaccaggcaatgcgagccgcaggtgatgaattcgagactcgattccgccgcactttctctgacttagccgcacaacttcacgtgacgccaggcagcgcccagcaacgctttacccaggtgagcgacgagctgttccaagggggacctaactggggaagactagttgccttttttgtgttcggtgccgctttgtgtgctgagtccgtaaataaagagatggagccattggtgggacaagtccaggaatggatggtggcttatcttgagacccagctggccgattggatccactcgagtggcggctgggctgaatttacagcgctttatggtgacggtgccctggaggaagcccgacggctcagggaggggaattgggcctctgttagaacagtactcaccggggccgtcgccctgggcgcacttgttactgtgggagccttcttcgcttcgaagtag

SEQ ID NO: 23024 - DNA, 156 bp, Artificial Sequence
  Description of Artificial Sequence: Synthetic coding sequence
atggccacccccgccagcgcccccgacacccgggccctggtggccgatttcgtcggctacaagctcaggcagaagggatacgtgtgtggggcagggccaggagaagggcctgccgctgatccattgcaccaggctatgcgagccgccggagactag

SEQ ID NO: 23025 - DNA, 219 bp, Artificial Sequence
  Description of Artificial Sequence: Synthetic coding sequence
atggccacccccgccagcgcccccgacacccgggccctggtggccgactttgttggatacaagttgagacagaagggttacgtgtgtggtgccggccctggagaaggcccggcggccgatcccctgcatcaggctatgcgggcggccggagatgagttcgagacccgcttccgtcggacatttagcgatcttgcggcccagctgcacgttaccccctag

SEQ ID NO: 23026 - DNA, 450 bp, Artificial Sequence
  Description of Artificial Sequence: Synthetic coding sequence
atggccacccccgccagcgcccccgacacccgggccctggtggccgactttgtggggtataaacttcggcagaaagggtacgtatgcggggccggccccggcgaaggtccagccgcggaccctctccaccaggccatgagagccgccggcgacgaattcgagacccgattcagacggaccttttcagacttagctgcgcagcttcacgttaccccaggctcagcacagcaacgatttacgcaagtcagtgacgagctttttcagggcggccctaactggggtagactggttgcatttttcgtgttcggcgcagccctgtgcgctgaaagcgtgaacaaggagatggaaccccttgtaggccaggtgcaggagtggatggtcgcatatctcgagactcagctggccgactggatccacagctctggggggtgggctgagtttacagcatag

SEQ ID NO: 23027 - DNA, 435 bp, Artificial Sequence
  Description of Artificial Sequence: Synthetic coding sequence
atggccacccccgccagcgcccccgacacccgggccctggtggccgatttcgtaggatacaagctgcggcagaagggttatgtctgtggcgcgggacccggagagggccccgctgccgatcccctgcatcaggcaatgcgcgccgccggagatgagtttgagacccgcttccggcgcactttttctgatctggctgcccaactgcacgtcacccccgggagtgctcaacagaggtttactcaggtttctgacgagttattccagggcggacccaactggggacgcctagtggcgttcttcgtgtttggcgccgcattatgtgccgagtccgtgaacaaggaaatggaaccactcgtgggtcaagtccaggagtggatggtggcctaccttgagactcagcttgccgactggattcactctagtggcggctggtag

SEQ ID NO: 23028 - DNA, 528 bp, Artificial Sequence
  Description of Artificial Sequence: Synthetic coding sequence
atgaccgactgcgagttcggctacatctaccggctggcccaggactacttgcagtgtgtgctacagatcccacaacctgggtctgggccttccaagaccagtcgcgttctccaaaatgtggctttctctgtgcaaaaggaggtcgaaaagaacctaaagtcatgcttggacaatgtaaatgttgtgtctgtggataccgcccgtacgctgtttaaccaagtgatggagaaagagttcgaagacggaattattaattggggtaggattgttacaatcttcgcctttgagggtattctcatcaagaaattgctgaggcagcaaatcgcacctgatgttgacacgtataaagagatctcctattttgtggccgaatttatcatgaataatactggagaatggatccgccagaatggaggatgggaaaatggctttgtaaagaagtttgaaccaaagagcggctggatgaccttccttgaagtcacagggaagatctgtgaaatgctctctctcctgaagcagtactgctag

SEQ ID NO: 23029 - DNA, 492 bp, Artificial Sequence
  Description of Artificial Sequence: Synthetic coding sequence
atgaccgactgcgagttcggctacatctaccggctggcccaggactatctgcagtgtgttctgcaaatccctcagcccggttctggtccatctaaaacgagtagggtcctgcagaatgttgcgttctctgtccagaaggaggtcgaaaagaatctcaagagctgtttggacaatgtgaatgtagtctccgttgatacagctaggacactctttaaccaggtgatggagaaggagttcgaagacggtattattaactggggccggatcgttacaattttcgccttcgagggaattctcattaagaagctcctccgacagcagatagcccctgacgttgacacgtacaaagagatatcatacttcgtggcggagtttataatgaataatacaggagaatggatcagacagaacggtggctgggggaaatggcacaatcacacacccatgttagtggaatctgtcgctcataagaaacggaagatggccttatag

SEQ ID NO: 23030 - DNA, 726 bp, Artificial Sequence
  Description of Artificial Sequence: Synthetic coding sequence
atgtgcagcggcgccggcgtgatgatggcccggtgggccgcccgggggcgcgccggttggagatcaactgttagaatcctgagtcccctgggccattgcgagcccggtgtgagccgttcctgccgtgccgcccaggctatggactgcgaggtcaataacggatccagcttaagagatgagtgtattacaaacctcctggtctttggcttcctccagtcgtgttcagacaattcatttcgacgcgaacttgatgcgttaggccacgagcttcccgtccttgcgccacaatgggagggatatgatgagctgcagacagatggaaatagatcttctcattcccggcttggaaggatcgaggcagactctgagtcgcaggaagatatcataagaaacattgccagacatctggctcaagtaggtgattctatggatagatcaattcctcccggtctggtcaatggcctggccctgcagcttcgtaacacctccagaagcgaggaggataggaatcgtgatctcgccacagcattagaacagctcctccaggcctacccacgggacatggaaaaggagaagaccatgcttgtccttgctctgctgctggccaagaaggtcgccagccacaccccgtcattgttaagagatgtgtttcataccacagtgaactttatcaaccaaaatcttagaacttatgtcaggtctctggccagaaacgggatggattag

SEQ ID NO: 23031 - DNA, 414 bp, Artificial Sequence
  Description of Artificial Sequence: Synthetic coding sequence
atggactgcgaggtgaacaacggcagcagcctgcgggacgagtgcataaccaacttattggtgttcggttttctgcagagttgtagcgataacagcttccgcagagagctagacgcccttgggcatgagctgcccgtgctggccccccagtgggagggctacgatgagctccagaccgatggcaacaggtcatctcattctcgcctgggcagaatagaggctggagcctcagacaacaacacagcctccgccgaggaggaaacagaagcagcaggcagcgtcgcggtcgagcgtggactgcacggggccgctactgttattttgaaggtcaagaagacctctagcggaattctgcctggaacttccccaaggagtgggacagcttggacagttgccagcctgagggcctggtag

SEQ ID NO: 23032 - DNA, 300 bp, Artificial Sequence
  Description of Artificial Sequence: Synthetic coding sequence
atggaccggagcatcccccccggcctggtgaacggcctggccctgcaactgcggaatacttcaaggtcagaagaggacagaaaccgcgacctcgctacagccctcgagcaactgctccaggcgtacccccgcgatatggagaaagaaaagaccatgcttgttctggccttgttgttggccaagaaggtggcatcccatactccttctttgctgcgcgatgtgttccacaccacggtcaattttattaatcagaacctacgcacttatgtgaggtcgctggcaagaaatggcatggattag

SEQ ID NO: 23033 - DNA, 300 bp, Artificial Sequence
  Description of Artificial Sequence: Synthetic coding sequence
atggaccggagcatcccccccggcctggtgaacggcctggccctgcaactgcgaaatacctccagaagcgaagaagacaggaatagagacttagccacagccctcgaacagctgctccaggcctaccctcgggacatggaaaaagagaaaaccatgctggtgctcgccttactgctggcaaaaaaagtcgcgtcccacaccccttccctcttaagggatgtcttccatactactgtgaactttatcaaccaaaacttaaggacgtacgtgaggtcccttgccagaaacggaatggattag

SEQ ID NO: 23034 - DNA, 588 bp, Artificial Sequence
  Description of Artificial Sequence: Synthetic coding sequence
atggactgcgaggtgaacaacggcagcagcctgcgggacgagtgcatcacaaacctgctagttttcggcttcctccagagctgctccgacaactcattcaggagagagctggatgccctggggcacgagctccccgtgttagccccgcaatgggagggatatgacgagctccagactgacggcaatcgcagctctcattctcgactgggtagaattgaagctgactcagaaagtcaggaggatattataagaaatatagcccgccatttggcccaggtgggggattcaatggatcgcagtatcccacccggtctggtgaatggactcgccctccagttgagaaacacttctagaagtgaggaggatcgaaatcgtgacctggccacggccctggagcagctcctccaggcttaccctagggacatggagaaagagaaaacgatgttagtgctcgccctgctactagccaagaaggtcgcctctcacacccctagtctgctgagagacgtgtttcataccacggtgaatttcataaaccagaatttgcgcacttatgtacgttcccttgcaaggaacggtatggactag

SEQ ID NO: 23035 - DNA, 588 bp, Artificial Sequence
  Description of Artificial Sequence: Synthetic coding sequence
atggactgcgaggtgaacaacggcagcagcctgcgggacgagtgcatcacaaacctgctggtcttcggatttcttcaaagttgcagtgataattcctttagaagagagcttgacgcactagggcatgagctccccgtcctggcaccccagtgggaaggctatgacgagctgcagacggacggaaaccgtagctcacatagcagactcggtaggattgaggcggatagcgagagtcaggaggacattattcgcaacatcgccaggcacctggcccaagtcggagacagcatggataggtctatcccacctggattggtcaacgggctcgcccttcagctgcgaaatacttccaggtccgaagaagaccgaaatcgcgacctcgcgaccgctcttgaacagttgctccaagcatacccgcgcgatatggagaaggaaaaaacaatgctggtgcttgctttacttctggccaaaaaagtggcgtcacacactccctctttattaagggatgtgttccatacgacggtgaactttattaatcagaatctcaggacatacgtccggtccttagcaagaaatggcatggattag

SEQ ID NO: 23036 - DNA, 1353 bp, Artificial Sequence
  Description of Artificial Sequence: Synthetic coding sequence
atggaggagccccagaagagctacgtgaacaccatggacctggagcgcgacgagcccttaaaatcaacaggcccgcagatttccgtctcagagtttagctgccactgctgttacgacatcctggtcaatcctaccaccctgaactgcggtcatagcttttgcagacactgcctcgccctgtggtgggcatctagtaaaaagaccgagtgccccgagtgtagggaaaagtgggaagggtttcccaaggtttctatactcctgcgtgatgcaattgaaaaattgttccctgacgccatcagactgagatttgaggacattcagcagaataatgacatcgttcaatctctggccgctttccaaaagtacggtaatgatcaaatcccacttgctcccaacacagggagagctaatcagcagatgggcggaggcttcttttcgggcgttcttaccgccctcactggagtggccgtggtgttgctggtgtaccactggtcaagtcgcgagtcagagcacgatctcttggttcataaggccgtggctaagtggacggccgaggaggtggtcttgtggctcgagcagctaggtccatgggcctccctgtaccgggagagatttttgtcagaacgagtgaatggtcggctgctgcttacgctgaccgaagaagagttctccaagacgccgtacacaatcgaaaatagttcccaccgcagggctattctaatggagctggaacgcgttaaagccttaggggttaaacctcctcagaacctgtgggagtacaaagcagtcaaccctggcaggagcctatttctgttgtatgccctcaagtcatcacccaggctaagtctgttatatttgtacttattcgattatacagatacatttttaccatttattcacactatatgtcctctgcaagaggacagctccggggaggatattgttaccaagcttctcgaccttaaagaaccgacctggaaacagtggcgtgagtttttggtcaagtattcattcttgccatatcagctgatcgctgagttcgcgtgggattggctggaagtgcactactggaccagccgtttccttatcatcaatgccatgcttctgtcagtgctcgagctgttcagcttctggcggatttggtcaagaagtgagctaaagacagtgcctcagcgcatgtggtcgcacttctggaaagtgtccacccagggtctgtttgttgcaatgttttggcccctcattccacagttcgtttgtaactgcctgttctattgggctttgtactttaaccctatcattaacattgacttagtcgttaaggagctccgtcgactggagactcaagtcctctag

SEQ ID NO: 23037 - DNA, 969 bp, Artificial Sequence
  Description of Artificial Sequence: Synthetic coding sequence
atggtgggcatcttcaaggagaaccggatgagccggatgcagcggaaaatgggacggtttccgcagtcgcagtactccccacaagttgttttgctagtgtatcactggtcgagccgggagtccgaacacgacctccttgtgcacaaagccgtcgcaaaatggactgcagaagaagtggtgctgtggttagagcagctcggaccgtgggcctcactgtaccgtgagaggtttctctccgagcgagtgaatgggaggcttcttctcacactgaccgaggaggaattctctaagactccctacacgatcgagaactcctcccacagacgggccatcctgatggagcttgaacgcgtgaaggctttgggggtgaagccaccccagaacctttgggagtacaaggccgtcaaccctggtagaagcctgtttctgctttacgcactgaaatcttccccgcgtcttagtcttctctatctttatctatttgactataccgatacatttctgccattcattcacacgatctgcccccttcaggaagattcaagtggtgaggatatcgtcaccaaattgttggacctaaaggagcccacctggaaacaatggcgcgaatttctcgtgaagtattcctttctgccgtaccaactaattgctgagttcgcttgggactggcttgaggttcactattggacctcacgttttttgatcattaatgccatgctcctgtctgtcctggagctcttttccttttggcgaatctggtcccgatccgagcttaaaacagtccctcagaggatgtggagccacttttggaaagtcagcactcaggggctttttgtggcgatgttctggcctttgatccctcaatttgtgtgtaactgcttgttttattgggctctgtacttcaatccaatcatcaacattgacctcgtggtcaaagagctgagaaggctcgaaacccaggtgctgtag

SEQ ID NO: 23038 - DNA, 4254 bp, Artificial Sequence
  Description of Artificial Sequence: Synthetic coding sequence
atggccgccgtgccccagaacaacctgcaggagcagctggagcggcacagcgcacgcacactgaataacaaactctccctcagcaagccaaaattttctgggttcacattcaagaagaagacctcatccgacaataacgttagcgttaccaatgtctctgtggccaaaacacccgtgctaaggaacaaagatgtgaatgtcaccgaagacttttccttttcggagcctctccctaacacaactaatcagcagagggtgaaggacttctttaagaatgcgcccgccgggcaggagacgcagcgaggcggctctaaaagcctgctccctgattttctgcagactcctaaggaggtcgtatgtacaacacagaatacccccactgtgaagaaatctcgcgacaccgccttgaagaagctcgagttttctagctctccagactccctgtcaaccatcaatgattgggatgacatggatgacttcgatacctccgagacatcaaagtcgttcgtgacccccccccagtctcattttgtgcgggtgagcactgctcagaaaagcaaaaagggtaaacgcaattttttcaaggctcagctgtacactacaaatacagtaaaaaccgacctacccccccccagtagcgaaagcgagcagatcgatttaaccgaagaacagaaggatgattctgagtggctaagctctgatgtcatatgcatcgacgatggtccgatagccgaggttcacatcaacgaggacgcccaggagagtgatagcctgaagacgcatctggaggacgaacgagataattcagagaagaagaagaacctcgaggaggccgaactccacagcaccgaaaaggtgccgtgcatagagttcgacgatgatgactacgatacagattttgtgccaccatctccagaagaaataattagcgctagtagctcatcctctaaatgtctttctaccctaaaggatttagacacctctgatagaaaggaggatgtgctctccaccagcaaagatctactgtccaagccagagaaaatgagcatgcaggaactgaacccagaaacttcaactgactgtgacgcaagacaaatctctctccagcagcaacttattcacgtgatggagcacatctgtaaactgatcgacacaattccagacgataaactgaaattgcttgactgtggaaatgagcttttgcagcagcgaaacatcagaagaaagctgctaacagaggtcgattttaacaagagtgacgcttcactgcttggttcattatggcgttaccgaccagattcccttgacggcccgatggaaggcgacagttgccccactggcaattctatgaaagaattgaacttcagccacctcccatccaacagcgtttctcctggagactgtctcctcaccaccacccttggtaagactggatttagcgctacgaggaagaacctatttgagagacctcttttcaacactcaccttcaaaagtcctttgtctctagcaattgggccgagactccacgtctgggaaagaagaatgagagctcatatttccctggcaatgtcctgactagtacagctgtgaaggaccagaacaagcacactgcatctatcaatgatctggagcgggagacccagcccagttatgatatcgataactttgacatcgacgactttgacgatgatgacgattgggaggatataatgcataatctggcggcctccaagtcttcgacagccgcttaccagcctataaaggagggccgcccaatcaaaagtgtctcagagagactgtcatcagcaaagacagactgtctgccagtgtcaagtacggcccagaacatcaatttttccgagtctattcagaactatactgacaagtcggcgcagaacctcgcctctcgaaacctgaagcacgaaaggtttcagagcctgagttttccgcatacaaaggaaatgatgaagatttttcacaagaagtttggattacacaatttcaggaccaaccagttggaagccatcaacgccgcactcctgggcgaggattgcttcatcctcatgccaaccggcggggggaagtcactttgctaccaacttcccgcatgcgtgtctccaggagtgaccgtagtgatctccccccttcgctcccttatcgtggaccaggttcagaagctaacctctcttgacattccggccacgtacttgactggcgacaagactgattccgaggctaccaatatctatctgcagttatccaaaaaagatcccatcatcaaactactttatgtcactcccgaaaagatatgtgccagtaataggttgatctcaaccctggagaacctctatgaacggaaactattggcaaggttcgttattgatgaggctcactgtgtgtcgcagtgggggcacgacttccgtcaggactataaacgcatgaatatgctgagacaaaagtttccgtctgtccccgtgatggctttgactgccaccgccaatccacgagtccagaaagatatcttgacccagcttaagatactgagacctcaagtatttagtatgagtttcaatcgtcataatctaaagtattacgtcttgcctaaaaaaccaaagaaagttgctttcgactgtctcgaatggattagaaagcaccacccatatgactctggaatcatctactgtctgagcaggcgggaatgcgacacaatggccgacaccttacagcgtgacggcttggccgccttggcctatcacgccggtttgagcgattctgcacgggatgaggtccagcaaaagtggattaatcaggacggctgccaggtcatctgcgccacaatcgcattcgggatggggatcgataaacctgacgtaaggtttgtgatacacgccagtctcccgaagagcgtggagggatactaccaggagagcgggcgagccggccgggacggcgagatcagtcactgcttgttgttctacacctaccacgatgttacaaggcttaagcgcttaattatgatggaaaaggatgggaaccaccacactcgagagacccactttaacaacctgtattcgatggtacactactgcgagaatataaccgagtgtaggagaattcaactgctggcctacttcggcgaaaacgggtttaacccagacttctgtaagaagcaccctgatgtgtcatgtgataactgctgtaagacaaaagactacaagacccgcgatgttaccgacgacgtgaagagtattgtgcggtttgtgcaggagcattcatcttcccagggaatgagaaacattaaacacgtcggaccaagtggaagattcaccatgaacatgttggttgacatattcttaggctctaaaagtgctaagatccaaagtggaatcttcggcaagggatcagcttactcgcgacacaatgcagagcgcctgtttaagaagctaatactagacaaaattctggatgaggacctttatattaacgccaatgatcaggcaattgcgtatgtgatgctagggaataaagctcaaaccgttctgaacgggaatcttaaagtcgatttcatggagactgagaactcaagttcagtcaagaagcagaaagctttggttgcaaaggtgtcccagagggaagagatggtgaaaaagtgtttgggcgagctgactgaggtctgcaagagtcttggaaaagtgttcggggtgcactatttcaacattttcaacaccgtcactctaaagaagctggcagaatctctcagctccgacccagaggtgcttcttcagattgacggggtcacagaggataaactcgagaaatacggagctgaagtgattagcgtactgcaaaagtactctgagtggaccagcccggccgaggattcttctcccggaataagcttgtcctcatctcgcggtcccggccgttccgcagctgaagagcttgacgaggagatccctgtgagcagtcattacttcgcttccaaaactcggaacgagcgaaaaagaaaaaagatgcccgcctcgcagcgaagcaagcggaggaaaaccgccagttccggcagtaaggcaaaggggggttccgctacgtgccggaagatctcctcaaagaccaagtcttcgtcgataatcgggtcttcgtctgcaagtcacacatcccaggccacctccggagccaactcaaaactgggaatcatggctcctccgaaacctattaataggccctttctgaagccaagttacgcattctcctag

SEQ ID NO: 23039 - DNA, 3144 bp, Artificial Sequence
  Description of Artificial Sequence: Synthetic coding sequence
atgagcatgcaggagctgaaccccgagaccagcaccgactgcgacgcccggcaaataagtctccagcaacagttgatacacgtgatggaacacatctgtaaacttatagacacgatccctgatgacaagttgaaactgctggactgtggaaatgagctactacagcagagaaacatcaggaggaagctccttacagaagtcgactttaataagagcgacgcctctcttctggggagcctgtggagataccggccagacagccttgacggtcctatggaaggcgacagttgtcctacggggaattccatgaaagaattaaattttagccacctcccctctaacagtgtatctcctggcgactgtctgctgacgactacgctaggcaagacaggcttctccgccacgcgcaagaatctgtttgagagacccctgtttaatacacatctgcagaagtctttcgtttcaagtaactgggctgagaccccaagactgggaaaaaaaaatgaaagcagctactttccagggaatgttctgacctcgacagcggtaaaagaccagaataaacatactgcctcaataaatgacctggaaagagagacccagccatcctacgacatagacaactttgacatagatgatttcgacgatgacgacgactgggaagatatcatgcataatctcgcggcctcaaagtcaagtaccgccgcataccagcccattaaggaagggaggcctatcaagagtgtctccgaacgcctgtcgtcagcaaagacagactgcttgcccgtgagcagtactgcccagaacataaacttctctgagtctatccagaactataccgacaagagcgctcaaaatctcgccagcaggaacctgaaacacgagaggtttcaaagcctgtcatttccccacaccaaagagatgatgaagatctttcataaaaagtttggtctgcacaatttcaggaccaaccagctcgaagcgatcaacgcagccttactcggggaagattgttttatcctgatgccaactggcggcgggaagagtctgtgctatcagcttcccgcatgtgtgtcccccggggtaactgtggttatcagcccgctgcgaagtcttatcgttgatcaggtacaaaaactgacctccctggatatccctgccacctatctcacaggggacaaaacggattccgaagctaccaatatctacctgcaactgtctaagaaggacccaatcatcaagctactatacgtcacccccgaaaaaatctgcgcatccaaccgcctgatcagcactttagaaaatctgtatgagcggaagctgctcgccagattcgttattgatgaagcacactgcgtgtcacaatggggccacgacttccggcaagattataaaagaatgaatatgctcagacagaagttcccttccgtacctgtcatggccctgaccgccacggccaatcccagggtgcaaaaggacattttgacccagctgaaaattctgagaccccaggtgttttccatgtcctttaatagacacaacttgaagtactacgtcctacccaaaaaacctaaaaaggtggcattcgactgtctagagtggatcaggaagcatcatccttacgattccgggattatctattgtttgagtaggcgcgaatgcgacacaatggcagacacattgcagaaatggattaaccaggacgggtgtcaagttatatgcgctaccatcgccttcggcatgggcattgacaagcccgatgtgaggttcgtgatccacgccagtctccccaaaagcgtcgagggatattaccaagagagcggcagagcaggacgcgacggcgaaattagccactgtctcctgttctatacttaccatgacgtgacgcggctgaagcggctgattatgatggagaaagacggcaaccatcatacccgggaaacccacttcaataatctgtactccatggtgcactactgcgaaaacatcacggaatgccgtcgtatccagctgctcgcatacttcggagagaacggcttcaaccccgatttctgcaagaaacaccctgatgtgagttgcgacaactgttgtaagaccaaggattacaaaacccgtgatgtcaccgacgatgttaaaagcatagtcagatttgtccaagagcactcatcatcacagggtatgcggaacataaaacacgtgggcccttcagggaggtttacaatgaacatgctggtggatattttcttaggctcaaagagtgccaagattcaatcagggatattcggcaaaggttctgcctactcaagacataatgcggagagacttttcaagaagttaatcctggacaagattcttgacgaagacctctatatcaatgccaatgatcaggcaatcgcctatgttatgctgggcaataaagcccagacagtcctcaacgggaatcttaaggtggacttcatggagacagagaattcctcctccgtgaagaagcagaaagccttagtggctaaagtgtctcagcgcgaggagatggtcaaaaaatgtctgggtgagttgacggaggtatgtaagagcctggggaaagtcttcggtgttcattattttaatatctttaacaccgtcactcttaagaagttagctgagtcactgtcctcagatccagaggtgctgctgcagattgacggcgtgacagaagataaacttgaaaagtacggggccgaggtcatctccgttcttcaaaaatacagcgaatggacgagccctgcagaggacagttcccccggaattagcctatcctcctctagaggtccaggccgctctgctgctgaagagcttgatgaggaaatacctgtgagcagccattatttcgcgtccaagaccagaaacgaacggaaacggaaaaagatgcctgcttcacaaaggagcaaacgaagaaagaccgcctcttccggatctaaggccaaaggtggcagcgcaacctgccggaagatctcttctaaaactaaatcaagtagcattattgggagttcatcagcatctcatacgtcacaggccactagtggcgctaactccaaacttggcattatggctccaccaaagcccattaatcggccgttcttaaaacccagctatgccttctcttag

SEQ ID NO: 23040 - DNA, 1560 bp, Artificial Sequence
  Description of Artificial Sequence: Synthetic coding sequence
atgaacatgctgcggcagaagttccccagcgtgcccgtgatggccctcaccgctacagctaacccccgcgttcagaaggacattctcacgcagttgaagatcctccgacctcaggtgttcagcatgtcttttaataggcataatctgaaatattacgtgttgccaaaaaaacctaagaaggtcgcctttgattgtctggaatggataaggaagcatcacccttacgacagtgggattatatactgtctgagcaggagagagtgcgacacaatggctgatactttgcagagggatggcttggcagccctagcttatcatgccgggctgtcagactccgcaagggacgaggtgcagcagaagtggatcaatcaggatggttgccaggtaatttgcgctactattgcctttggtatgggtattgacaagccagatgtcagattcgtcatacacgccagtcttcctaagagcgtggaagggtactatcaagagtcagggagggcaggtagagacggggagatttctcattgcctgctgttctacacatatcacgacgtcacccgactgaagaggctgatcatgatggaaaaagatggcaatcatcatactagagagacgcacttcaacaatctgtattctatggtgcactactgtgagaatatcacagaatgcaggaggatccagttactggcctacttcggggagaacggattcaatcccgatttttgtaagaaacatcccgatgtgtcatgtgacaactgttgtaagaccaaggattacaaaacacgggacgtgaccgacgatgtgaagtccatcgttagattcgtgcaagagcattcttcctcacaaggcatgcggaatataaaacatgtgggaccctccggccgcttcacaatgaatatgcttgtggacatcttcttggggagcaaatctgctaagatccaatccggtatcttcggtaagggctccgcttactcccggcacaacgctgagcggttatttaagaagttgattttggataaaatcctggacgaggatctctatatcaatgctaatgatcaggccattgcttatgtcatgcttggaaacaaagcccagactgtgcttaatggcaacctgaaagtggacttcatggagaccgagaacagctcctctgtcaagaagcagaaggccctcgtggccaaggtctcgcaacgggaagaaatggtgaagaaatgtctcggcgagctcaccgaggtgtgtaaaagtctagggaaggttttcggtgttcattactttaacatctttaatacagtgacgctgaaaaaattggctgagagcttgtcgtcggatcccgaggtcctgctgcagattgacggagtcaccgaagataaactcgagaaatacggcgccgaggttatcagtgttttgcagaaatattctgaatggacttcacctgcagaggattcctcaccaggcatatcactctcttcctcacgaggccctgggcggagcgctgccgaagaactggacgaagaaatcccagtttccagccactacttcgccagcaaaactcgaaactag

SEQ ID NO: 23041 - DNA, 981 bp, Artificial Sequence
  Description of Artificial Sequence: Synthetic coding sequence
atgcaccggaccacccggatcaagatcaccgagctgaacccccacctcatgtgcgtgctctgcggggggtactttatagacgccactaccatcatcgaatgcctacactcattctgtaagacatgcatcgtgcggtacttggaaacaagcaaatattgccccatatgcgatgtccaggtccataagacaagaccattgctgaatatacgcagtgacaaaacactccaggatatagtgtacaagctggtgcctgggcttttcaaaaatgagatgaagagacggcgtgatttttacgcagcacatccttcagccgatgcagctaatgggtctaatgaggatagaggcgaagtggccgacgaagacaagagaatcataaccgacgacgagatcatcagcctcagcattgaattcttcgatcagaatcggctggatcggaaggtgaacaaagacaaagagaaatccaaggaagaagtaaatgacaagcgatacctgcggtgccctgctgctatgaccgtcatgcatctgcggaaatttcttcgatccaaaatggacattccgaataccttccagatcgatgtgatgtacgaggaggaacctctcaaagactactatacgctcatggacattgcctacatatacacctggagacgtaacgggccccttcccctcaagtatagagtgcgacccacatgtaagcggatgaaaatcagccaccagagggatggtctgactaacgccggagaattggaatctgattctgggagtgacaaggccaattcccctgcgggcgggatcccaagcacctctagctgtctcccttcacctagcacccccgttcagtctccacacccacagttcccgcatatttcatcgacgatgaacggcacctcaaatagcccttcggggaatcaccaatcttcctttgcaaatcggccccgtaagagcagtgtaaatggttcttctgctacttcctctgggtag

SEQ ID NO: 23042 - DNA, 717 bp, Artificial Sequence
  Description of Artificial Sequence: Synthetic coding sequence
atgtgcgtgctgtgcggcggctacttcatcgacgccaccaccatcatcgaatgccttcactccttctgcaaaacttgtattgttagatatcttgaaaccagcaaatattgccctatttgtgatgtgcaggtgcacaagactagacctttgctcaatatccgcctggaccggaaggttaacaaggacaaggagaaaagcaaggaagaagtaaacgataagaggtacctgcggtgtcctgctgctatgacggtgatgcacctcaggaagtttctccgttccaagatggatattcccaatacgttccaaattgatgtcatgtacgaggaggaaccacttaaggactactatacgctgatggatatagcatacatctacacttggaggagaaatggtcccctcccactgaaataccgagtgaggcctacatgcaagagaatgaaaatcagtcatcagcgcgacggactgacaaacgctggtgaactggagtctgacagcggaagcgacaaggcaaacagtcctgcaggggggatacctagcacaagttcctgtcttccctccccctccacccccgtgcagtccccacatccacagtttccgcacatatcctcaactatgaacggaaccagtaactccccctcaggtaaccaccagagcagtttcgctaatagacctaggaaaagtagtgtcaatggctcttccgcgactagcagcggttag

SEQ ID NO: 23043 - DNA, 318 bp, Artificial Sequence
  Description of Artificial Sequence: Synthetic coding sequence
atgcaccggaccacccggatcaagatcaccgagctgaacccccacctaatgtgtgtgctttgcggcggatacttcattgatgctacaacaatcattgaatgcttgcattcattctgtaagacttgtatcgttcggtatctggaaacctcaaagtactgccccatttgtgatgtacaggtgcacaaaactaggcccctgctcaatattcgtagcgacaaaaccttgcaggacatcgtttacaaactggtccccggtctgttcaagaatgagatgaaaaggcgccgcgacttctacgcagcacacccttctgctgactag

SEQ ID NO: 23044 - DNA, 624 bp, Artificial Sequence
  Description of Artificial Sequence: Synthetic coding sequence
atgcaccggaccacccggatcaagatcaccgagctgaacccccacctgatgtgtgtgctgtgcggcggatacttcattgatgccactacaataattgagtgcctgcattctttctgcaagacatgtatagtgaggtacctggagacttcaaaatattgccccatctgtgatgttcaggtacacaaaacacggccactgctcaatattaggtccgacaaaaccctgcaagacattgtctacaaattagtcccgggcctatttaagaatgagatgaagcgtcggcgggatttttacgctgcgcacccttcagctgacgccgcaaacgggagcaatgaagaccgcggggaagtggcagatgaagataagagaatcattacagacgacgagattatcagcctgtctatagaattcttcgaccagaatcggttggacaggaaggtgaacaaggacaaggaaaaatccaaagaggaagtcaacgataagcgatatctgcgctgtcccgctgccatgactgtgatgcacctgaggaagttcctacggtccaagatggacattccaaatacgtttcagatagatgtcatgtacgaagaggagccccttaaggactactacaccctgatgtag

SEQ ID NO: 23045 - DNA, 453 bp, Artificial Sequence
  Description of Artificial Sequence: Synthetic coding sequence
atgcaccggaccacccggatcaagatcaccgagctgaacccccacctcatgtgtgtattatgtggaggctactttattgacgccaccaccattatcgagtgtctgcactctttttgtaagacgtgtattgtgcgctacctcgaaacttcaaaatactgccccatctgtgacgtgcaagtgcataaaacacgtcctttgctgaacattcggtcagacaagactctccaggacatcgtgtataaactggtccccggtctgtttaaaaacgaaatgaaaagaagaagagacttctatgccgcccatccaagcgccgatgcagccaatgggtctaatgaagatcggggggaggttgctgacgaagacaaacgcattatcacagacgatgaaatcattagcttgtcaattgagtttttcgaccagaataggcttgatcgcaaggtgaataaagactag

SEQ ID NO: 23046 - DNA, 555 bp, Artificial Sequence
  Description of Artificial Sequence: Synthetic coding sequence
tacttcatcgacgccaccaccatcatcgagtgcctgcacagcttctgtaaaacttgcattgtaagatatctggagacctctaagtattgtccgatttgcgacgtacaggttcataaaactcggcccctgctcaacattcggctggacagaaaagtgaacaaggataaggagaaaagtaaagaagaggtgaacgacaagaggtatctgcggtgtccagcagccatgactgtgatgcaccttaggaaatttctgcgctcaaaaatggatatacccaacacatttcagatcgacgtcatgtacgaagaggagcctttgaaggactactacacactgatggacattgcatacatctacacctggcgcaggaatggacccctgcccttgaagtaccgggtgcggcccacctgtaaaaggatgaaaatttcgcatcagcgggatggcttgacaaacgcgggtgaacttgagagcgactctggctccgacaaggccaatagtcctgccggaggtatccccagcacaagcagttgcctgccgtcccccagtacccccgtgtag

SEQ ID NO: 23047 - DNA, 279 bp, Artificial Sequence
  Description of Artificial Sequence: Synthetic coding sequence
atgcaccggaccacccggatcaagatcaccgagctgaacccccacctgatgtgtgttctctgtggtgggtattttattgatgcaaccacaattatcgagtgccttcatagcttttgtaaaacttgtattgttcggtatctcgagacctcaaaatattgccccatctgtgacgtgcaggtccacaaaacccgccctttgctgaatattaggagcgataagacactccaggacatcgtgtacaagctcgtccctggactgttcaccgcaaatggctcttag

SEQ ID NO: 23048 - DNA, 2193 bp, Artificial Sequence
  Description of Artificial Sequence: Synthetic coding sequence
atgcccggcgtggcccggctgcccctgctgctgggcctgctgctgctgccgcggccgggacggcccctggacctggctgattatacttacgacctggctgaggaggatgattctgaaccactgaactacaaggacccctgtaaagcagccgcttttttgggcgatatagcactcgatgaggaggacctaagggctttccaggtccaacaggccgtggatcttcgtcgccacaccgccagaaaatcttctatcaaggcagccgttccggggaataccagtactcccagctgccagagtaccaacgggcaaccccagcgaggcgcctgtggccgatggagaggtcgcagccgatctaggagggccgcgacatcacggccagagagagtttggcctgacggagttataccatttgtcatcggcggcaacttcacgggcagccaaagggctgtctttcgacaggccatgcgacactgggagaagcacacctgtgtcacatttctggagcggaccgatgaggacagctacattgtattcacttaccgcccctgtggttgctgtagctacgtggggagacgcgggggcggaccccaggctatctccataggaaagaactgtgacaagtttgggatcgttgtccacgaactaggccacgttgtcggattctggcatgaacatacgcgcccggatcgcgacagacatgtcagtattgtgcgtgagaacattcagcctgggcaggaatacaacttcctaaagatggagccacaggaagtggagtcgctgggggagacctatgatttcgactctatcatgcactatgctcgtaatacttttagccgaggcatctttctggataccatagtgcctaagtatgaagtcaacggcgtgaagcccccaatcggacagaggacacgtctcagtaaaggagacatcgcacaagctaggaaactgtacaagtgcccagcttgcggggagactctccaggacagcaccggtaatttcagctcgcccgaatatcccaatgggtactctgcccatatgcactgcgtttggcgcatttccgtgacacccggcgagaagatcattcttaactttactagccttgacctgtacaggtcccgcctgtgctggtacgactatgtcgaggtgagggacggtttctggagaaaagcccccctcaggggaaggttctgtggctccaaattgcccgagcctatcgtgtccaccgactctcggctgtgggtggagttcagatcatctagcaattgggttggaaaaggtttcttcgccgtttatgaggcaatctgtggaggagacgttaagaaagactacgggcacatccagagcccaaattaccctgatgactacagaccctccaaggtttgcatttggaggatccaggtgagcgaggggttccacgtcgggttaacattccaaagttttgagatagaacgacacgactcatgcgcttatgattacctggaggtacgagatggccactctgagtcttccactctgatcggaaggtattgtgggtacgagaagccggacgacatcaaatctacaagttcgcggttgtggttgaagttcgtttccgacggctccattaataaggcagggtttgcggtgaactttttcaaagaggtcgatgaatgctctcgcccaaatcggggcggatgcgagcaacgctgtttaaatactttaggatcctataagtgcagctgtgatccaggatacgagttggctccggataaacgccggtgtgaggcagcatgcggtggctttctaaccaagctcaacgggtctatcacctctccagggtggccaaaggagtaccccccaaataagaattgcatctggcaactggttgccccgacccagtatagaataagcctgcaattcgattttttcgagaccgagggcaacgacgtgtgcaagtacgattttgttgaagtgagaagtggccttactgcggacagcaagctgcacggcaagttttgtgggtcagagaagccggaagtgatcacctcccagtataataatatgcgggtggagtttaaatcagacaatacggtctccaaaaaaggcttcaaggcacatttctttagcgaaaagcgccccgctttgcagcccccccgcggtcgaccacatcagctgaagttccgcgtgcaaaagcgaaaccgcacaccccagtag

SEQ ID NO: 23049 - DNA, 2961 bp, Artificial Sequence
  Description of Artificial Sequence: Synthetic coding sequence
atgcccggcgtggcccggctgcccctgctgctgggcctgctgctgttgcccaggccaggccgacctctggacctcgccgattatacctatgacctggccgaagaagacgactccgagccacttaattacaaggatccttgtaaggcagcggcattcttgggtgatatcgctctggacgaggaagacctgcgggcattccaggtgcaacaggctgtggacctccgacggcacactgcccgaaagagcagcattaaagccgctgtgccgggaaacacgtccacaccttcctgccagagcacgaacggccagcctcagagaggtgcctgcggcagatggaggggacggtcccgaagccggcgggccgctacatctcggccagagcgagtgtggccagatggagtgatcccgttcgtcattggagggaatttcacaggctctcagcgcgctgtgttcagacaagctatgagacattgggagaagcacacgtgtgtgactttcctcgagagaacggacgaagacagttatatcgtcttcacttacagaccgtgcggctgctgtagctacgtcggacgccggggaggtggaccacaggcaatttctattgggaagaactgcgataaattcggcatagtcgtgcacgagctgggacacgtagtgggcttctggcatgagcatacccggccggatagagaccggcacgtgtcaattgtgcgggaaaacatccagcccggtcaggaatacaactttctgaagatggaaccacaggaggtcgagtcactgggcgaaacctacgactttgacagtatcatgcattacgcccgcaataccttcagtcgaggcatatttctggataccattgtgcccaagtatgaggtcaatggtgtaaagcctcccatcgggcagcgaacgcggctgtccaagggagatattgcccaagcaaggaagctctacaaatgtcctgcatgcggcgaaaccctccaggactctactggtaacttctctagccctgagtacccaaatgggtactctgctcatatgcactgtgtttggcggatctccgtgacccccggtgagaaaatcatattgaacttcacctcgctggacctttaccgttcccgcctgtgctggtatgattacgttgaggtgcgcgatggcttctggcgaaaagctccgctaaggggacgcttctgcggtagcaagttgcctgaaccaattgtgtcaaccgattcccgactatgggtggagttcagatctagctcgaactgggtgggcaagggattcttcgccgtatacgaggctatttgcgggggggacgtgaaaaaagattacggccacattcagagtccaaactaccctgatgactaccgaccatctaaggtttgcatttggcggatacaggtgagcgagggcttccacgtcggactgaccttccagtccttcgagattgagcgtcacgattcatgcgcatacgactacctcgaggttcgagatggtcactccgagtcctccacactgattgggcgctattgtgggtacgaaaaacccgacgacatcaaaagtacatccagccgcctgtggctcaagtttgtgagcgacggttcaatcaataaagccggatttgctgtaaacttcttcaaggaggtggatgagtgttctcgcccaaatagaggtgggtgtgaacagagatgtctgaacaccctcggttcgtataagtgtagttgtgaccctgggtacgaattagcaccagacaaacgacgctgcgaggccgcctgtggcgggtttttgaccaaactgaacggctcaattactagcccaggctggcctaaagaataccctccaaataagaactgtatctggcagctggttgcaccaacccagtacagaatatcactacagttcgatttctttgaaacagagggcaatgatgtgtgcaaatacgacttcgtggaggtacgtagcgggctcaccgctgattctaaactgcacggcaaattctgcggctctgaaaagcccgaagtgatcactagtcaatataataacatgcgggttgagtttaagagtgataacaccgtgagcaaaaaaggctttaaagctcattttttctctgacaaggacgaatgcagtaaggacaatggtgggtgccagcaggactgtgttaatacgtttggctcatacgagtgccagtgtcgttccggattcgttcttcatgataataagcatgattgtaaggaagcgggttgtgatcacaaagtaaccagcacctccggcaccattacctctccaaattggcccgataagtatcccagtaaaaaagaatgtacctgggctattagttcgacacctgggcacagagtcaagctgactttcatggagatggacatagagagtcagcccgagtgtgcctacgatcatctagaggtttttgacggccgcgacgccaaggcgccagtgcttgggagattttgcgggtccaaaaagccggagcctgtcctagcaactggtagccgaatgttcctgagattctactctgataactctgtccagagaaaggggttccaggctagccacgctacagagtgtggcgggcaagtgagggccgatgtgaagaccaaggatctatacagtcatgcccagttcggcgacaacaattaccctggtggggtggattgcgaatgggtaatcgtagccgaggaaggctatggcgtggagctggtctttcagaccttcgaagttgaggaggagactgactgcggctatgattacatggaactgttcgacggatatgatagcaccgcaccgagattggggcggtactgtggtagtggtcctcctgaggaggtgtatagtgcaggggattcagtgctggtaaaattccattccgatgataccattactaaaaaagggtttcaccttcgctatacatccacaaaatttcaagataccctccacagtcgcaaatag

SEQ ID NO: 23050 - DNA, 909 bp, Artificial Sequence
  Description of Artificial Sequence: Synthetic coding sequence
atgcccggcgtggcccggctgcccctgctgctgggcctgctgctgttgcccaggccaggaaggccgttggatcttgccgattacacgtacgaccttgctgaagaggatgactccgaaccgctaaactataaagacccttgtaaagccgctgcttttctgggagatattgcacttgacgaggaggacctgagggcttttcaggttcagcaagctgttgacctgcggcggcatacagcgcgcaagagtagcatcaaggcagccgtcccagggaacacgtccactccatcctgtcagagtacaaatggccagccacaacggggggcctgcggaaggtggcgaggtcgctcacggtctcgccgggctgccacctctcgtccagagcgtgtatggcccgatggtgtcatcccatttgttattggcggcaactttactgggagtcagcgcgcggtctttaggcaggcgatgcggcactgggagaagcacacatgtgtcacttttctggagcgcacggatgaagactcgtacatcgtatttacctatagaccttgcggctgctgctcgtacgttggacggcgcggcggagggccccaagccatttccatcggaaagaactgcgacaaattcggcatcgtagttcacgagcttggccacgtagtcggattttggcatgaacacacacgcccagatagagacagacacgtatcaattgtgagggagaacattcagcccggggtgttgcactcgtcattgcttctgctgtcctgcggatcccggaacggagctagttttccgtgctcgctcgagagcagcattcaccaggctctctgctggacagggctgttccttcgtccctctccctttccccggctgcctctggccgcaccaaggaccctcagagccggggtttag

SEQ ID NO: 23051 - DNA, 1869 bp, Artificial Sequence
  Description of Artificial Sequence: Synthetic coding sequence
atgcccggcgtggcccggctgcccctgctgctgggcctgctgctgcttcctcgcccaggtcgccccctcgacttagcggactatacttatgacctcgccgaagaggatgacagcgagcccctcaattacaaagatccctgcaaggccgccgcgttccttggcgacatcgctcttgacgaagaagatctgagggcctttcaggttcagcaggccgtcgatctgcggaggcataccgcccgaaaatcgagcatcaaggccgcagtgccaggcaacacatccaccccatcttgtcagtccacaaatgggcaaccccagcgcggcgcgtgtgggcgctggcgcggaaggtcgcgctccagacgtgctgctaccagtcgaccagagcgggtgtggcccgacggagtgatcccttttgtgatcggcgggaattttactggatcacagcgtgccgtcttcagacaagctatgaggcactgggagaaacacacctgcgtcacttttctcgaacggactgatgaagatagctacattgtgtttacttatcggccttgcgggtgctgcagctacgtgggcagaagaggaggcgggcctcaggccatttccattggcaagaactgtgacaagttcggcattgtcgtccacgagcttggccatgtggttggcttttggcacgaacacactaggccagatagagatcggcacgttagcattgtccgcgaaaatattcaacccggacaggaatacaacttcctgaagatggaaccacaagaggttgaaagtcttggtgagacttacgattttgattcaattatgcattatgccaggaacactttctccaggggaatcttcctagacaccattgtgcctaaatatgaagtgaacggtgtcaagcctcctatcgggcagagaaccaggctgagtaagggtgatatcgcgcaggctcgaaaactatataagtgtcccgcgtgcggtgaaaccctgcaggactctaccgggaatttttcttcgccagagtacccgaatggttacagcgcacatatgcactgcgtctggcggatctcggttacccctggcgagaagatcatcctgaattttactagcctggacttataccgatcccggctttgttggtatgattacgtggaagtgagggacggattctggaggaaagcacctctgcggggcagattctgcggttctaagctgcctgaaccaatcgtcagtacggacagtcggctgtgggtagagtttcgctccagttccaactgggttggaaaaggatttttcgcagtctatgaagccatctgtggcggagacgtgaaaaaggactacggtcacatccaaagcccaaattatcccgacgattatcgaccatccaaagtgtgcatttggcggatccaggtgtctgaagggttccatgtgggactcactttccagagttttgagattgagaggcacgacagctgtgcttatgactacctggaggtgagggacgggcatagcgagagcagtaccctgatcggcagatattgcggctacgagaaacctgacgatatcaaatccacctcatccagactgtggctgaaatttgtcagcgacggaagtattaacaaagccgggtttgcagttaacttcttcaaggaggtggatgagtgttcccggcccaatagggggggctgtgagcagcggtgcctcaacactctcggctcatacaaatgcagctgtgacccgggatacgaactagccccagacaagaggcgatgtgaaggatgctacgatctgcaggtgggcaaaccactgctttgggatcgccattgcttcagactatctacccatggacctgaaatgctgggcacagccttaagagggtag

SEQ ID NO: 23052 - DNA, 2472 bp, Artificial Sequence
  Description of Artificial Sequence: Synthetic coding sequence
atgcccggcgtggcccggctgcccctgctgctgggcctgctgctgttaccgaggccaggacggccgctggaccttgccgactacacttacgatcttgcggaggaagacgattccgagcctctgaactataaggatccatgcaaagcagctgctttccttggggacattgccctggatgaggaggacttacgggcattccaggtgcagcaggctgtcgatctacgcaggcatactgccaggaagtcctctatcaaagccgccgtgccaggcaacacgagcactccttcatgtcaaagcactaacgggcagcctcagagaggtgcttgcggtagatggcgtggcagatctagaagtcggagggccgccacatcgcgccctgagcgcgtgtggcctgacggtgtgataccttttgtaattggcggtaattttactggctcacagagagcggtttttagacaagccatgaggcactgggaaaagcatacctgcgtgaccttcctggagcggactgatgaagacagttatatagtgttcacatatcgcccgtgtgggtgttgcagctatgttggtcgaagaggtggtggccctcaggctatctcaatcggcaagaactgtgataagttcggaatagtggtgcatgagcttgggcacgtggtaggcttttggcacgagcatactagaccagatcgcgacagacatgtgtcaatagtcagagaaaatattcagcccgggcaagagtacaattttctgaagatggaaccccaggaggtggagtctctgggagagacctacgacttcgatagcattatgcactacgcccgtaacaccttttcccggggcatctttttggataccatcgtgccgaagtatgaggttaacggagtcaagcccccaatcgggcaaagaactagactctctaaaggggatatcgcccaggcgagaaagttgtataagtgtccagcatgcggagagacactgcaggacagcacggggaatttttcatctccagaatatcctaatgggtattcggctcatatgcactgcgtttggcgcattagcgtaactcccggagagaagatcatcctgaattttacctctctggatctgtaccgctcacgcttatgctggtatgactacgttgaagtgagagacggtttttggagaaaggctcctctcagggggagattttgtgggtccaagctcccggagcccattgtgagtacggactccaggctctgggtagagttcaggagttccagcaactgggtaggaaaagggttttttgccgtgtacgaggctatatgcggcggagacgtcaagaaagactacggacacatccagtctcccaactatcccgacgattaccgcccttccaaggtgtgtatctggcggatacaggtttctgaaggcttccacgtgggcctgactttccagtctttcgaaatcgagcgtcatgacagctgtgcctacgattatctggaagttagggacggacacagtgaatcctcaacactgattggtaggtactgcgggtacgaaaagcctgatgacattaaatccactagttcaaggctttggctgaagttcgtttctgacggaagcatcaacaaggccggcttcgccgttaactttttcaaagaagtggacgagtgctcaagacctaaccggggggggtgcgaacagcgctgtcttaacacccttggaagttataagtgctcctgcgacccaggctatgagcttgcacctgacaagagacggtgtgaggcggcctgtggcggctttctgacaaagcttaatggcagcatcacatccccggggtggcccaaggagtaccctcccaacaaaaattgcatctggcagctggtggcgcccacccaatatcgcatatcattgcaattcgattttttcgagacagagggcaacgacgtatgtaaatatgacttcgtcgaagtaaggagtgggcttacagccgatagcaagcttcacgggaagttctgcgggtcggagaaacctgaagtgattacctcacagtacaataatatgagagtcgagttcaagagcgacaataccgtgagcaagaaaggttttaaagctcactttttctctgtcctggaaggagccggcgatagacacagtcatctgtcaggacttgagttgttgctgtgtccccatgccctcgttgacacagtcccagcacccccaagtgctctgcacggggacactcatgcacacacacacacccacgtgcatacacactgtcccattgctcaggaaacatgccgcggcccccccctcggagccagccgactctccccccaaggcccaggccacttgactctggcccctcaggaggggagttaccttgatttttgggatactcacaggggggatcctaagccacggagaagacggaagtccctaaagacattttccttgacaccggccacatttagaggaatatgggctctctag

SEQ ID NO: 23053 - DNA, 2193 bp, Artificial Sequence
  Description of Artificial Sequence: Synthetic coding sequence
atgcccggcgtggcccggctgcccctgctgctgggcctgctgctgctcccaaggcccggccgtcccctggatctggcagactatacgtatgatctcgccgaagaggatgacagcgagcccctgaactataaagatccttgtaaagccgcagccttccttggagatattgccctagatgaggaagatttgcgtgcgtttcaggtgcaacaggccgtggatctgaggaggcacaccgcccgcaagagctccatcaaagcagcagtgcccgggaatacttcgaccccttcttgccaatccaccaatgggcagcctcagcgtggtgcttgcgggaggtggaggggccgctccaggagccgccgggcggcaacgagccggcccgagcgggtgtggccagacggcgttattccgttcgtgatcggaggcaatttcactggtagtcaacgagccgtctttaggcaggccatgagacattgggaaaagcatacatgcgtgacatttctcgaacgtacagatgaagactcctacatcgtgttcacatatcggccatgcggttgctgctcttatgttggtagacgggggggcggcccacaggctatctctattggcaagaattgtgacaagttcggaatcgtggtgcacgagctagggcacgtggttggattctggcatgagcatacccggcccgacagggatcgtcatgtgtcgatcgttagggaaaacattcagccaggccaagaatacaattttctcaagatggagccccaggaagtggagtctttgggagagacctatgacttcgattcaataatgcactacgcaagaaacacctttagtcggggcatcttcttagacactatagtgccaaaatatgaggttaatggagtaaagccacccatcggccagcgcacacggctctcaaaaggcgacatcgctcaagcccggaagttatataaatgtcccgcttgcggcgaaacactccaggattcaaccggtaacttcagctcacccgaatatcccaacggttactctgctcatatgcattgcgtgtggaggatttctgtgacccccggcgagaaaattattctgaacttcaccagtctcgatctataccgctctagactgtgctggtacgattacgtcgaggtgcgggatggcttttggcgaaaggcccccctcagaggacgcttctgtggatccaaattgccagagcccatcgtgagtactgattcaaggctttgggtggagttccggagtagtagtaactgggtcgggaaaggttttttcgcagtctacgaagccatctgtgggggtgacgtgaaaaaagactacggacacatccagtcccctaactaccctgacgactatagaccgagcaaagtgtgcatttggcgcatccaagttagtgagggatttcacgtcggcctcaccttccagtccttcgagattgagaggcacgattcatgtgcgtatgattacctagaagtccgcgacgggcactcagaatccagtacacttattgggcgttactgtgggtatgaaaaacctgatgacatcaagtccacaagtagccggctgtggctgaaattcgtttctgacggcagtatcaataaagccggttttgccgtgaactttttcaaggaagtggacgagtgcagtagaccaaaccgcgggggatgcgaacagcggtgcctcaataccctgggttcctacaagtgctcctgcgaccctggttatgagctggcccccgacaagcggaggtgcgaggccgcctgtgggggctttcttactaaactgaacggctcgatcacatccccaggctggccgaaggagtatccccctaacaaaaattgcatttggcagctggttgccccgactcagtacaggattagtcttcagtttgatttctttgagactgaggggaatgacgtttgcaagtatgactttgtcgaggtccgctctggcctgacagcagactccaagttgcacggaaagttttgtggcagtgagaaacccgaagtcataacttcacaatataacaatatgagggttgagtttaaatcagataacactgtatccaagaaagggttcaaggcacactttttcagcgagaaaagacccgcactccaacccccaaggggcaggcctcaccagctcaagtttagagtgcagaaacgtaaccgtaccccacagtag

SEQ ID NO: 23054 - DNA, 1509 bp, Artificial Sequence
  Description of Artificial Sequence: Synthetic coding sequence
atgctgctgcggagcgccggcaagctgaacgtgggcaccaagaaggaagacggcgaaagcacagctccgacacccagaccaaaggttcttaggtgtaagtgccaccatcattgccccgaagactcagtgaataatatctgctctactgacggatattgttttacaatgatcgaagaggacgattcagggctcccagtggtcactagcggttgtctcggtctcgagggttccgattttcagtgcagagacacccccattccacatcaaaggagaagcattgagtgctgcactgagcggaatgagtgtaacaaagacctgcaccctacgcttccacctctcaagaatcgcgacttcgttgacggtccaattcaccaccgagcactcttaattagcgttacagtttgtagcctgcttctggtgctcatcattttattctgttacttccgatataagcgccaggaaacacggccgagatactccatcggcttagaacaagatgagacctatattccacccggggaaagtctacgtgacctcatcgagcagagccagtcttcgggctctggaagcggtttacccttgctggtgcagaggacaatcgccaagcagatccagatggttaaacagatagggaagggccgctacggtgaggtgtggatgggaaagtggaggggcgaaaaagtggctgtcaaagtgttctttactacagaggaggcctcctggtttcgcgaaaccgaaatttaccagacagtccttatgaggcacgaaaatatattgggattcatcgccgcagacattaagggaaccggcagctggactcaattgtacctgattactgattatcatgagaacggttcgctttatgactacttaaagtccactacattggacgcgaaatcaatgttgaagcttgcttacagcagtgtatctggcctgtgtcacttgcatactgaaatcttcagcacacaaggaaagcctgcgatcgcgcaccgggatctgaagtctaagaacatcttggtgaagaagaacgggacgtgctgcattgccgatttagggctggcggttaagtttatcagtgatactaacgaggtcgatataccacccaacacccgggttggcacaaaaagatatatgccccccgaagtcctggatgaatcactaaatagaaatcatttccagagttacataatggcagacatgtattccttcggactaattctttgggaagttgcaagacgatgcgtgagcggaggcatcgtggaggagtatcagctgccgtatcacgacctagttccatctgacccatcttatgaggacatgagggagatagtgtgcatcaaaaagctccggccaagcttccccaatcgatggtcatctgatgagtgtcttagacagatggggaaactgatgaccgagtgttgggctcacaatcctgccagtcggcttacggcgctgagggtcaaaaaaacgctggccaagatgagtgaaagccaggacataaagttgtag

SEQ ID NO: 23055 - DNA, 1509 bp, Artificial Sequence
  Description of Artificial Sequence: Synthetic coding sequence
atgctgctgcggagcgccggcaagctgaacgtgggcaccaagaaggaggatggagaaagtacagctccgacacccaggcctaaggtgttgagatgtaaatgtcatcatcattgccccgaggacagcgtaaataatatctgtagcacggacgggtactgctttactatgatagaggaggatgacagtggcctcccagtggtaacaagcggctgtctgggcttggagggatccgacttccagtgccgggataccccaatacctcaccagaggcggtcaatagagtgctgtaccgagaggaatgagtgcaataaggacctgcaccctacgctcccccctcttaaaaaccgggactttgttgacggcccaattcaccacagggcccttctgatctcagtgactgtctgctcgctgcttctggttctcataatactgttctgctatttccgatacaaaaggcaagaaacccgacctcggtactcgattggccttgagcaggatgagacatatattcccccgggagagagtctgagagacctgattgagcagtcccaatcgtccggcagcggaagcggcctgcccctgttggtgcaacgaaccatcgctaagcaaattcagatggttaagcaaatcgggaaaggccgatatggagaggtctggatgggaaagtggagaggagaaaaagtggcggtaaaggtcttttttaccacagaagaggcatcctggttcagagagactgaaatctaccagaccgtgcttatgcgccacgaaaatatcctgggcttcattgcagctgatattaagggtacaggatcgtggacacagctttacttaatcacggattaccatgagaacggatccctctacgattatctgaaatcaacgacactcgatgcaaaatcaatgttgaagctagcctatagcagcgtaagcggactgtgccatctgcatacagagatattttccacccaggggaaacccgcaattgcccatcgtgatctcaagagcaagaacattttggtgaagaagaatgggacttgctgtatcgcggacctgggacttgcagttaaattcatctctgataccaacgaggtggatattccacccaatactcgggtaggcacgaaacgctacatgcccccagaggtactcgatgagtcattgaaccgcaaccactttcaaagctacatcatggccgacatgtacagcttcgggctgatcctgtgggaagtggctcggcggtgtgtatccggtggaattgtggaggagtatcagctgccataccacgatctggtcccttccgatccaagctacgaagatatgagggagattgtttgcattaaaaagcttcggccatcttttccgaaccgttggtcttctgacgagtgtttacgccagatggggaagctgatgaccgagtgttgggctcataaccctgcgtcccgacttacggcgctccgcgtgaagaagacgctggccaagatgagtgaaagccaggacattaagctgtag

SEQ ID NO: 23056 - DNA, 1599 bp, Artificial Sequence
  Description of Artificial Sequence: Synthetic coding sequence
atgggctggctggaggagctgaactggcagctgcacatcttcctgttaatcctgttgagcatgcatacgcgggccaactttctggacaatatgctattgcggtctgcaggaaaacttaacgtgggaactaagaaagaggatggtgagtccacagcccctacaccgcggcccaaggttctcaggtgcaaatgtcatcaccattgtcctgaggattctgttaacaatatctgtagcacggacggctattgctttacaatgatcgaagaggatgatagtggactgcctgtggtgacatccggctgcctgggcctcgaaggatccgacttccaatgccgcgataccccgatcccccaccaacggcggagcattgaatgttgtaccgagaggaatgagtgtaacaaggatttgcatcctactttaccacccctaaaaaatagggatttcgtggatggccccattcaccatagggccctgttgatcagtgtcaccgtctgcagtctcctgctcgtactcattatcctgttctgctactttcgctacaaaagacaggagaccagaccccgctactctataggacttgagcaggatgagacatatatcccaccaggggagtctcttcgcgacttgattgagcagagccaaagcagtgggtccggaagcggtttacctctgctggtgcagcgaactatcgccaaacaaattcaaatggttaaacagatcgggaaggggcgctatggcgaggtttggatgggtaaatggcggggggagaaagtggctgtaaaggtgttttttacaaccgaagaggcatcttggttcagagagaccgagatttaccagaccgtattgatgaggcatgagaacattcttggtttcatagcagctgatatcaaaggaaccggaagttggactcagctttacctcataacggactaccacgagaacggatcattatacgattacctgaagtctaccacactcgatgctaagtccatgttaaagctggcctactcatctgtgagtggattatgccacctgcacactgaaatctttagtactcagggcaaacccgctatcgcgcacagagatctgaaatctaagaacatcctggttaagaaaaacggaacttgttgcattgcagatctgggcctggccgtaaaatttatttctgacacaaatgaggtggatataccccccaacaccagggttggtaccaagaggtacatgccaccggaggttctggacgagtctctgaatagaaaccactttcagtcttatatcatggctgacatgtatagctttggcctcattctatgggaggtggctcgtcgctgtgtgtcaggcggcattgtggaagaataccaactgccctatcacgacctggttccttccgatccctcttatgaggacatgcgggagatagtttgtatcaagaaactgagaccctcattccccaatcgatggtcaagtgacgagtgtctcaggcagatgggcaaactcatgaccgagtgctgggcccacaaccctgcttcacgactgacagctcttagggttaagaagactctggctaaaatgtctgagagtcaggatatcaaactatag

SEQ ID NO: 23057 - DNA, 345 bp, Artificial Sequence
  Description of Artificial Sequence: Synthetic coding sequence
atgctgctgcggagcgccggcaagctgaacgtgggcaccaagaaggaagatggtgaatccacagcccccacgcccaggccgaaggttttgagatgtaagtgccaccaccactgtcccgaggactccgtgaacaacatctgctccactgacggatattgtttcaccatgatcgaggaggatgactccgggcttccagtggtaactagtggctgtctagggctggagggcagtgactttcagtgtagggtccgaaccctgccttttctgattaaggaagaccagctgaatgccgcacagaagggcactaatgtcatcaaaacctacaccctgcattgtttgcattag

SEQ ID NO: 23058 - DNA, 378 bp, Artificial Sequence
  Description of Artificial Sequence: Synthetic coding sequence
atgctgctgcggagcgccggcaagctgaacgtgggcaccaagaaggaggacggggaatcaacagctcctactcccagacccaaagttctgcggtgtaaatgtcaccatcactgtcccgaggatagtgtaaataatatctgttctactgatgggtactgtttcacaatgatcgaagaagatgatagtggtttgccagtcgtcacctcaggatgtctgggcctcgaaggaagcgatttccaatgcagagatacaccaatcccacatcagcgtcggtcgatcgagtgttgtacagagagaaatgagtgcaacaaggacctgcaccctacattgccacccctcaaaaatagggatttcgtagacgggccgatacatcactag

SEQ ID NO: 23059 - DNA, 1509 bp, Artificial Sequence
  Description of Artificial Sequence: Synthetic coding sequence
atgctgctgcggagcgccggcaagctgaacgtgggcaccaagaaggaggacggggagagcacggcccccacaccacggccaaaggtgctgcggtgtaagtgccatcatcattgcccagaagattctgttaacaatatttgttccactgacgggtactgcttcaccatgatcgaggaagacgatagcgggctgcccgtggtcactagcggatgtcttggacttgagggctcagatttccagtgtcgggatacgccaattcctcatcagcggaggagcattgagtgttgtaccgaacgcaatgaatgcaacaaagatctgcatcctaccttacctcctctcaagaaccgggacttcgttgatggccctatccatcatcgcgctctgttgattagtgtcacagtctgttcccttctcctggtgctgattattctgttctgctacttccggtataaacgccaggaaaccagacccaggtatagcattgggctcgaacaagacgaaacatatatcccccctggggagtcgctgcgggacctaatcgaacagtcacagtcatccggtagtggaagtggtctgcctttactggtccaaagaactatcgctaaacaaattcagatggtgaaacagatcggtaagggccgctacggcgaagtgtggatgggcaaatggcggggcgaaaaggtggctgtaaaggtttttttcacaactgaagaggcatcatggttcagagagacagaaatttatcagacagtgctcatgcgccatgagaacattttgggtttcatagccgcggatataaaaggcacaggctcctggactcagctgtacctgataactgattaccatgaaaatggctctctgtacgattacctcaaatcaactaccctggatgccaaatccatgttgaagctcgcatactccagcgtgagcggattgtgtcacctgcatactgagattttcagcacccagggtaaacccgccatcgcacaccgtgatttgaagagtaagaatatcttagtgaagaaaaacggtacgtgctgtatcgccgatctgggtttggccgtcaagttcatatcagacacgaacgaggtagatatcccccccaacacccgagtgggaacaaaaagatatatgccaccagaagtgctggacgaatcactaaatcggaaccattttcagtcctacatcatggctgatatgtacagtttcggcctcatactgtgggaagttgccagacgctgtgtctcgggcggcattgtcgaggagtaccagctgccctaccacgacctggttccctccgatcccagttacgaggacatgcgggaaatcgtgtgtatcaagaagttgagaccgtctttccccaacaggtggtcaagtgatgagtgcctgcggcaaatgggcaagctgatgacggagtgttgggcacacaacccagctagtcggcttactgccctgcgcgtcaagaagacattggcaaaaatgagcgaatctcaagatattaaactatag

SEQ ID NO: 23060 - DNA, 1509 bp, Artificial Sequence
  Description of Artificial Sequence: Synthetic coding sequence
atgctgctgcggagcgccggcaagctgaacgtgggcaccaagaaggaggacggagagagcacggctcctaccccaagacctaaggtccttcggtgtaaatgtcaccaccattgtcccgaggactccgtgaacaatatttgctcaacagacggctactgcttcacaatgatcgaagaggatgacagcgggctgcccgttgtaacgagcggctgtctgggattggagggatcagatttccagtgcagagatactccaataccccatcagcgcaggtcaatcgagtgctgcactgagcggaacgagtgcaacaaagacctgcatcccactttgcccccgctgaagaatcgggacttcgtggatggtcccatccaccaccgtgccctgcttatttccgtcacagtgtgctctcttcttctggtcctgataatactgttttgttactttcgatacaagcgtcaggagacacgccccagatactccatcggtctggagcaggacgaaacgtacattcccccgggggaatcgctgagggatctgattgagcaatctcagtccagcggctctggctccgggttgcccctattggtgcagaggaccattgccaagcaaatccagatggttaagcagattgggaagggaaggtacggcgaagtctggatgggcaagtggcgaggggaaaaggttgcggtgaaggttttcttcactaccgaggaagcaagctggttccgggagaccgaaatctaccagacagtgttaatgagacatgaaaacattcttggctttatcgccgcagatattaagggaactggatcttggacacagctctacctgatcacagactatcatgaaaatgggtctctctacgattacttgaagtccactaccctcgatgccaagagcatgttgaagttagcttacagcagcgtgagcggcctttgccacctgcataccgaaatcttttccactcaggggaagcccgccattgcccacagggacttgaaatctaaaaatattctcgtgaaaaagaacggaacctgttgtattgccgatttagggctggcagtgaagtttatctccgatactaacgaggtcgacatcccacctaatacaagggttggtaccaaacgctatatgcctcccgaagtgcttgacgaaagtctaaaccggaaccattttcaaagctacattatggctgacatgtattcatttggactaatactctgggaggtcgcccggcgctgtgtctctggaggtattgtggaagagtatcagcttccttaccatgatttggtcccatccgatcccagttatgaggacatgcgagagattgtgtgtataaaaaaactccgtcccagctttccaaaccggtggtcttccgatgagtgccttaggcagatggggaagctcatgactgagtgttgggctcacaaccccgcttcgaggctgacagccctgagggtgaaaaagaccctggccaagatgtcagagagccaggacatcaaactgtag

SEQ ID NO: 23061 - DNA, 1509 bp, Artificial Sequence
  Description of Artificial Sequence: Synthetic coding sequence
atgctgctgcggagcgccggcaagctgaacgtgggcaccaagaaggaggacggcgagagcacagctcccaccccgcgtccgaaagtcctgaggtgcaagtgtcaccaccactgcccagaggattcagtgaacaatatctgttcaactgacggatactgtttcacaatgattgaggaggacgacagtggactacctgttgttacttctggttgtctgggactggaaggcagtgactttcaatgtagggacacaccaatccctcatcagcgacggtccattgagtgttgcactgagcgaaatgagtgcaacaaagacctccatccgaccctacctccgctcaagaacagagattttgtcgacgggccaattcatcaccgggcgctgttgatcagtgttactgtctgctccctactgctggtgctcattatcttattctgctactttcgctataaacgccaggagactcgccccaggtatagtataggccttgaacaggacgaaacgtacatccctccaggtgagagtttgcgggacttaattgaacagtcgcagtctagcggtagcgggtctggcctgcccttgttagttcagagaactatcgccaaacagatccagatggtgaaacagattggcaaaggacgctacggagaggtgtggatgggcaagtggcgcggcgagaaagtggccgtgaaagtattctttacgaccgaggaggcatcctggttcagggaaactgagatttaccagactgttctgatgagacacgaaaacatcctaggtttcatagcagccgacatcaaaggtacagggtcatggacccaactgtacctgattaccgattatcatgagaatggctccctgtacgactacctgaaatctactacactggacgccaagtctatgttgaagctggcctattcgagcgtgagtgggctctgtcacctccatacagaaatcttcagcactcagggaaagcccgctatagcccatagggatctcaagtccaagaatattctcgtgaagaaaaacggaacctgctgtattgccgaccttggactagccgtcaagttcatttctgataccaatgaggttgatattccaccgaacacccgggtcgggacaaagagatacatgccacctgaagtgttggatgagtccctgaacagaaatcatttccagtcatacataatggcggatatgtacagtttcggcctcatactctgggaagtggcccgacgctgtgtcagcggaggtattgtggaagagtaccaactgccttaccatgacctcgtaccttccgacccgagctatgaggacatgagagagatcgtgtgtatcaaaaaactccgcccgtcctttcccaaccggtggtccagcgatgagtgcctgcggcagatgggaaagctgatgacagagtgctgggcacataatccagccagtcggttaactgccctcagggtgaaaaagaccctcgccaagatgtctgagtcccaggatatcaaattatag

SEQ ID NO: 23062 - DNA, 4755 bp, Artificial Sequence
  Description of Artificial Sequence: Synthetic coding sequence
atgcggggccaggccgccgcccccggccccgtgtggatcctggccccgctgcttcttttgctgttgttgttggggcgaagggcaagagcagccgccggagcggatgccgggcctggtcccgagccttgcgccaccctggtccaaggaaaattcttcggttatttttctgctgctgccgtctttcccgcaaacgccagcaggtgttcctggaccttgagaaaccccgaccctagaagatacactctgtacatgaaagtcgccaaggcacccgtcccctgtagtggccccggccgtgtccgaacatatcagtttgacagcttcctcgagagtactcgaacctacctgggagtggaaagcttcgatgaggtgctgagactgtgcgaccccagtgctcctcttgcttttctccaggcttccaagcagttcttacagatgcggcgccagcaacccccgcagcatgacgggctgagaccaagagcaggtccaccaggccccacagacgacttcagcgtcgagtacctagtcgtcggcaatagaaatccctctagggccgcctgccagatgctgtgccgctggctggacgcctgtttagctggcagcagatcttcccacccatgcgggattatgcaaacaccttgcgcctgtctcgggggagaggcgggaggaccggctgctggccctctagcacctcggggcgatgtgtgcttaagagacgccgttgctggcgggccagaaaactgtctcacctcgctgacgcaagatcgtggaggccacggagccactggagggtggaagctgtggtcactctggggagagtgcactcgggattgtggcggtggactgcaaacccggactcgcacatgcctccccgcacctggagtggagggcggtggatgtgaaggggtgcttgaagaggggaggcagtgtaatagagaagcctgcggccccgcggggaggacctcctctagaagtcagtccctcagatctaccgacgcccggagaagggaggaactgggcgatgagctgcagcagtttggatttcctgccccgcagaccggggaccccgctgccgaggaatggagtccatggtctgtctgttcttctacatgtggagaagggtggcagactaggactaggttttgtgttagtagcagctactcaacccagtgctctggcccactgcgggagcagagactctgtaataatagtgccgtttgccccgtgcacggtgcctgggacgaatggagcccctggtctctgtgcagtagcacatgcggccgaggtttccgcgaccgtacacgaacctgtcggcccccacaatttggaggcaatccatgcgagggccctgagaaacaaaccaagttttgcaatatcgccttatgtcccggccgcgccgtggatggaaactggaacgagtggtcctcatggtccgcctgctcagcgtcatgtagtcaagggcggcaacagagaacgcgagaatgcaatggaccctcatacggaggcgctgaatgccaggggcattgggtggagacccgagactgcttcttgcagcagtgccccgtggacgggaagtggcaggcctgggccagctggggctcttgctccgtgacctgcggcgccgggtcccagcgaagagagcgtgtttgctctggaccgttcttcggtggagcagcgtgtcaagggccacaagacgaatataggcagtgcggcacacagcgttgcccagagccccacgagatatgcgatgaagataactttggcgccgtgatttggaaagaaacacccgctggcgaggtggctgctgtaagatgccctaggaacgccactggccttatcctccgccgatgcgagctagacgaagagggaattgcatactgggaaccaccaacatatatcaggtgcgtgagcatcgactatcgcaacattcagatgatgacgcgcgaacacttggccaaagcccagagaggacttcctggcgaaggcgtctcagaagtcattcagacgttggtcgagatctctcaggatggaaccagctactcgggggatctgctgtcaacaattgacgtgctgcggaacatgaccgagattttccgaagagcgtattactcccccacccccggagacgtgcaaaactttgtgcagatactgagtaatttgctggccgaggaaaatagggacaaatgggaagaggcacaacttgctgggcccaatgccaaggaactgtttcgcctggtcgaagatttcgtggacgtcatcggtttcaggatgaaggacctgcgagatgcataccaagtcactgacaacctggtgctatccatccacaaactccccgccagtggagccaccgacatatcctttccaatgaaaggttggcgggccacaggcgactgggcgaaggtgccagaagatagagtgaccgtaagcaaaagcgtgtttagcacaggtctgactgaggccgacgaagcttccgttttcgtggtgggaactgtcctgtatcggaacttgggcagtttcttggctctgcagcgcaatactactgtactaaacagcaaggtgatcagcgtcacagttaaacctcccccccgatctctgcggacgccactggagatcgaattcgcccacatgtacaacggaaccacaaaccagacgtgtatcctctgggacgagaccgatgtgccgagctctagcgctccgcctcagttaggcccctggtcctggagaggttgtcggacagttccactcgacgccttacgcactaggtgcctctgcgatcgactgtctactttcgccatccttgcccagctcagtgcagacgccaatatggaaaaggcgacgctgccttccgtcacactgatcgtaggctgtggcgtgagttctcttacattgctgatgctggtcattatctacgtttccgtgtggcgttacatccgctctgagcgatccgttatcttaatcaatttttgcctgtctattatctcatccaacgctttgatacttatcggccagacgcagacccgtaacaaggtggtctgtacactggttgctgctttccttcactttttctttctgtcctctttttgctgggtgctgaccgaggcctggcagtcctatatggcagtcacaggccatctgcggaacaggttgatcaggaaacgatttctttgtctcggatggggattaccagccctggtggtggcaattagcgtggggttcactaaggctaaggggtacagcactatgaactactgttggttgtccctcgagggcggattattgtacgcgtttgttgggccagccgctgccgtcgttttggtgaacatggtgatcggcatactggtctttaataaactggtgtctaaggacgggattaccgataaaaagttgaaggagagggccggtgcctcactgtggagctcctgtgtcgtccttcccctgttagctcttacctggatgagcgcagtgttagccgttaccgaccgaaggagcgcactgtttcaaatactgtttgccgtttttgactctttggaggggttcgttatcgtgatggtgcactgtatccttcggcgagaggttcaggatgctgtaaaatgcagggtagtggataggcaggaggaggggaatggcgactccgggggctcatttcaaaatggacacgctcagctgatgactgactttgagaaagacgtcgacctcgcgtgccgaagcgttttgaacaaagacattgcagcgtgccggaccgctacaatcaccggaaccctaaagcgcccatccttgcctgaggaggaaaagttgaaactggcccatgcaaagggcccaccaaccaattttaactcgctacccgcgaacgtttcaaaactgcacctgcacggatctcccagatacccgggagggccactgcccgactttcctaaccatagtctgacgctgaagcgcgataaggcgccaaaaagcagcttcgtgggcgatggagatattttcaaaaaactggactctgagctctccagagctcaggagaaagccttggacaccagctacgtgattctccccaccgccactgccacactcaggccaaagcccaaagaggaacccaaatattctatccatatcgaccagatgccccagacccggctgatacacctgagcaccgcacctgaggcctcccttccagctcggtcgcctccctctcggcagcccccaagcggcggcccccctgaggcgccgcccgcgcagccccctccacctcctccccctccgcccccgcccccacagcagcctctaccccctccccccaatctggagcccgctccccctagcctgggcgaccctggagagccagccgcccaccccggtccaagcacgggaccaagcaccaagaatgagaatgtcgccactctctctgtcagctccctggagagacgcaagagccgttatgccgagcttgatttcgagaaaattatgcacaccaggaaacgccaccaggacatgttccaagatctgaatcggaagcttcagcatgcagcagaaaaagataaggaagttctaggaccagactctaagccagaaaagcagcagacacctaataagcgcccttgggagagcttgagaaaggctcatgggactcccacctgggtcaagaaggagctggaaccactgcaacccagtcccctggagctgaggagtgtggaatgggagcgctctggagccacgatacctttggtgggccaggatatcatagacctgcagactgaagtctag

SEQ ID NO: 23063 - DNA, 4755 bp, Artificial Sequence
  Description of Artificial Sequence: Synthetic coding sequence
atgcggggccaggccgccgcccccggccccgtgtggatcctggccccactccttctcctgctactgctcctcggacgcagagcgcgagctgccgcgggtgccgatgcaggacccggtcctgaaccctgcgctactcttgtccagggcaaattctttggctacttctccgcggctgctgtttttccagccaacgcttctcgctgttcttggaccttgaggaacccggatcctcgccgttacacattgtatatgaaggtagctaaggctcccgtgccttgtagcggaccagggcgagtccggacatatcaatttgattctttcctggagtccactcgtacctatctgggtgtggaaagtttcgatgaggtgctccgcctctgtgacccttccgctcctctggccttccttcaggccagcaagcagtttctgcaaatgcgaagacaacaacctccgcagcacgacgggctacgcccccgcgccggtccacctggaccaacagatgatttcagcgtggagtacctggtcgtgggtaacaggaacccttctagagctgcctgtcaaatgctatgtcggtggctcgatgcctgcctggccggctcccggtcatctcacccatgtggtataatgcaaactccttgtgcatgtcttggtggagaggcgggtggccctgcagcaggcccgctcgcaccccggggggacgtgtgcctgcgagacgcagtggccggcggtccagagaattgcctgacaagccttactcaggaccgaggaggtcacggcgccactggcgggtggaagttgtggtccctctggggtgagtgcacacgtgactgtggcggcggcctccagacccggacccggacctgtctgcctgcaccaggtgtggagggcggcgggtgcgaaggcgttctggaggaaggtagacagtgcaatagggaggcttgtgggccggcggggaggacatcgtcacgatctcaaagcctgaggtcaacagatgcacgaaggagggaggaactcggtgatgaactgcaacagttcggctttcctgctccgcaaaccggcgaccctgctgctgaagaatggtctccgtggtctgtctgttcctcaacctgtggtgaggggtggcagacacgcaccagattctgtgtgtcaagcagttactctacacagtgctccggcccgttgcgggagcagcgactctgtaataactctgcggtgtgcccggtccacggcgcgtgggatgagtggtctccctggagcctttgcagctctacatgtgggagggggtttagagatcgcaccagaacatgtcgtccacctcagtttgggggcaatccctgcgaaggtcctgagaaacagactaagttctgcaacatcgccctatgtccgggtcgtgccgtggatggcaattggaacgagtggtccagttggagcgcctgttcagctagctgtagtcagggacggcagcaacgcacccgcgagtgtaatggaccttcttacggcggggccgaatgccaaggccactgggtggagacccgagactgtttccttcaacagtgtcccgtggacggcaagtggcaggcttgggcgtcgtgggggagttgctcagtgacgtgcggcgcgggaagccaaagaagggagagagtttgctccggccccttcttcggaggagctgcctgccagggtcctcaggacgagtaccgacagtgcggtacccaaagatgtccagaaccacatgagatttgcgatgaggacaacttcggcgctgtgatctggaaggagaccccagccggcgaagtcgccgccgtcagatgtccccgcaacgccactggattaatcctgagaaggtgcgaactggacgaagagggaatcgcttactgggaaccgcccacctacatccggtgcgtgtccatcgactaccggaacatccagatgatgacaagggagcatctcgccaaagcccagcgtggcctcccgggagagggcgttagtgaagtgattcagactctggtggagatctcccaggatggtacctcttactccggcgatctactctctacgattgacgtgctgagaaatatgacggagatctttaggagagcatactactcgcccaccccgggcgacgtccagaactttgtccaaatcttgagcaaccttctggcggaggaaaatcgggacaaatgggaggaggctcaactcgctggaccgaatgcaaaggaactcttcaggctggtggaggattttgtcgacgtgataggattccggatgaaagatcttcgggacgcttatcaggtgaccgataatctcgtgctgagcatccacaagctgcccgcctctggagccaccgacatctcctttcctatgaaggggtggagagcaacaggggactgggccaaagtgcccgaggatcgcgtgaccgtaagcaagtccgtgtttagcaccggacttaccgaggctgacgaagcttccgtgtttgttgtcggaacagtgttatatcggaacctgggaagtttcctggccctacagagaaacaccacggttctgaatagcaaagtcatttcggtgacagtgaaacctcctccacgttctcttcgtacgcctctggagatcgaatttgcacacatgtataacggaaccaccaatcagacctgtattctctgggacgagacagatgttccttcatcatccgctccgccccagctgggcccatggagctggagaggttgccgaaccgtgcctctagacgctctaagaacgcgatgcctctgtgatcggctcagtacttttgcgatcttggcacagctgtcagccgacgcgaatatggagaaggctaccctccccagtgttaccctgattgtggggtgcggggttagcagtttgacactgctaatgttggtgataatttacgtgtccgtgtggcgttacatccgctcagagaggagtgtcattctgataaatttctgtctgtccatcatcagttccaatgctttgattcttatcggccaaactcagactcgcaacaaagtggtctgcacccttgtggctgcctttctccatttcttctttctgtcgtcattctgttgggtcctgaccgaggcctggcagtcctacatggctgtcaccggacatctgaggaatcgactgatacggaagagattcctctgcctcgggtggggcctgccagccctggtcgttgctatatctgtaggcttcaccaaagcgaaagggtactccactatgaactactgctggctctcactggaaggcggtctgctgtatgcttttgtggggcctgctgcagcggtggtcctcgtaaacatggtcatcggcatcttggtctttaataagctggtgtctaaagacgggattaccgacaaaaagctgaaggagcgggccggtgcttctctgtggtcctcctgtgtcgtcctgcctctcttagctcttacttggatgtctgccgtgctggctgtgacagatagacgaagcgctttgttccagattttgtttgcggtctttgacagtttagaaggatttgtcattgtgatggtgcattgtatcctcagaagagaagtccaggacgccgtcaaatgtagagtcgtggatcgacaagaagagggaaacggtgattctggtgggagtttccagaatggccatgcgcagcttatgacagacttcgagaaggatgtggatctggcctgcaggtcagtcttaaataaagacattgccgcctgtcgcactgcaacaatcaccgggacattgaagaggccaagcttgccagaggaggagaagctgaaactcgctcacgcaaaagggccgcccaccaattttaactcactgcccgccaacgtgagtaagctgcacttgcacgggtcccctcgctaccctggaggacccctgccagacttcccaaatcattccttgaccctcaaacgggataaggcacctaagtcaagttttgtgggagacggagatatctttaaaaagcttgacagcgaacttagtcgcgcccaagagaaagctctcgacacttcatacgtgattttaccaacggccacagcgacacttcgccctaaaccaaaggaggagccaaagtactcgatacatattgatcaaatgccccagacgcgacttatccatcttagcacggctcccgaggcaagtttgcctgccaggtccccacccagccgccagccacctagcggaggccctccggaggctccccctgctcagcctcccccccccccccccccacctcctccacctcctcagcaacctctacctcctccccccaacctcgagcccgcccccccatcactgggagaccctggagagcctgccgctcacccaggcccttctaccggcccttctacgaagaatgagaatgtagcgacactgtccgtgtcctcgctggaaaggagaaaaagccgctacgcggagctggacttcgagaagatcatgcatacccgcaagcggcaccaagatatgtttcaagatctgaaccgcaaactccagcacgccgccgaaaaagacaaagaggtcttgggaccagactccaaaccagagaagcaacagacccctaataaaaggccatgggagagcctacggaaggctcacggtacgcccacttgggtgaaaaaagaactggaacctctgcagccatctcctctagaattgcgctcggtcgaatgggagcgtagcggggcaaccatccccctcgtcggtcaagacattattgatttgcagactgaggtttag

SEQ ID NO: 23064 - DNA, 2334 bp, Artificial Sequence
  Description of Artificial Sequence: Synthetic coding sequence
atgcccgacaaccggcagccccggaaccggcagccccggatccggtccggtaatgaacctcgatccgcccctgcgatggagcctgacgggcgcggagcttgggcacatagcagagctgcattggacagattagagaagctgcttaggtgttctcgctgtacgaatattctaagagaacctgtctgcctcggcggatgcgaacacattttctgcagcaattgtgtgtcagactgcatcggaacaggatgcccagtatgctatactcctgcgtggattcaggatctcaaaattaaccggcagctggacagtatgattcagttatgttccaagttaagaaatctgctacacgacaacgagttaagtgatttaaaagaggacaagccacgtaagagtctgtttaatgatgctggtaataagaagaactcaatcaagatgtggttttcaccacgctctaagaaggtcaggtacgtggtgtccaaagcttctgtgcaaactcagcccgctataaagaaagatgcctcagcgcagcaagacagctatgagttcgtgtctccatctcctcccgctgacgtttcggagcgagccaaaaaagcatctgcacggagcggaaagaagcagaagaagaagacccttgccgaaatcaatcagaaatggaacttagaggccgagaaggaagatggcgaatttgatagcaaggaggagtccaagcagaaactggtcagtttctgttcccaaccaagtgtcatcagctcgccccagatcaacggagagatcgatctcttagctagcggcagcttgacggagagcgagtgttttggctcacttaccgaagtgagccttccactggccgagcagatcgagagccctgatactaagtctagaaatgaagtcgtaacccccgagaaggtttgtaagaattatctgaccagcaagaaatctctcccgctggaaaataacggaaaacgcggacaccacaatcgcctctctagccctatatctaagagatgccgcacatcaatcctcagcacatccggagacttcgttaagcaaaccgtgccctctgagaatatccctctcccggagtgctcatcccccccatcatgtaagcgcaaggtgggaggaacttctgggcgtaaaaactcgaacatgtccgatgagttcatttctctgtcccctgggacccccccatctacgctgtcatcaagtagctaccgccgggttatgtccagtcccagcgctatgaagctgcttccaaacatggctgtaaaaagaaatcatagaggcgaaacacttctgcacattgcctctattaagggagacattccttccgtagagtaccttctgcagaatggcagcgatccaaacgtgaaagatcacgctggatggacgcctcttcatgaggcttgcaatcacggtcacttgaaggtagttgagctgctcctccagcataaagccctggtgaatacaacgggctatcagaacgatagcccactccatgatgccgcaaaaaacgggcacgtagacattgtcaagctcttgctcagctacggcgccagcagaaacgctgttaacattttcggactccgcccagtggactataccgatgacgagagtatgaaaagccttttactgctgcccgagaagaacgaaagttccagcgcatcacactgcagcgtgatgaacaccggacagcgaagggatggacccctcgtgctgattggtagtggactgtctagcgaacaacagaagatgctgtctgaactcgctgtcattctcaaggccaagaagtataccgagtttgactccaccgtcacccacgtcgtggtccccggtgacgctgtccaaagcacattaaagtgtatgcttggcattctcaatggctgttggatcctgaaatttgaatgggtcaaagcctgcctcaggaggaaagtctgtgagcaagaggaaaagtatgagatcccagagggtccaagacgttccagactaaaccgggaacagctcttgcccaaactgttcgatggttgttacttctacctgtggggtacattcaaacaccaccccaaggacaatctcattaaactcgtcaccgcgggaggcggccaaattctttcgcgaaagcccaaacccgatagtgacgttacgcagacgataaatacggtcgcctatcacgcaaggcctgattcagaccagcgcttttgcacacaatatatcatttatgaagacctgtgtaactaccaccccgagcgtgtgcggcagggcaaagtgtggaaggcaccttcctcttggtttatagactgtgtcatgtccttcgaactactgcccctggacagctag

SEQ ID NO: 23065 - DNA, 1704 bp, Artificial Sequence
  Description of Artificial Sequence: Synthetic coding sequence
atgtggttcagcccccggagcaagaaggtgcggtacgtggtgagcaaagcatcagtgcaaacacagcccgccattaaaaaagacgcctctgcccaacaggattcctatgaatttgtctccccatctcctccagccgatgtgtccgagcgagccaagaaggccagcgcaaggtccggcaagaaacaaaaaaagaagaccctggcggagattaaccagaaatggaatctcgaggctgaaaaagaagatggggagtttgactcaaaagaggaaagcaagcagaagctcgttagcttttgcagtcagcctagcgtcattagcagtccacagattaatggtgagatcgatctgctcgcaagtggctccttgaccgaatccgaatgctttggatccctgaccgaggtgagtctgcccctggcagagcagatagagtctcccgatactaaatctcggaacgaggttgttactcccgaaaaggtctgcaagaactatcttaccagtaaaaagtccctccctttggaaaataatggaaaaagaggccaccacaatcggctgtcgtctccaattagtaagaggtgtcgtacttctatactctctacatccggagacttcgtcaagcagactgtaccttcagagaacatccccctcccggaatgctcctcaccaccctcttgcaaacggaaagtgggcggaacgagcgggaggaagaattccaatatgtccgatgagttcatatccctctctccaggaaccccaccttctacgttaagtagtagctcttatcgccgtgttatgtccagccccagtgcaatgaaactcctacctaacatggccgttaaacgaaatcacaggggagagaccctcctccatattgcatctataaaaggtgatattccctccgtggagtacttgctacagaacggatccgaccctaacgttaaggaccacgcgggctggaccccactgcatgaagcttgtaatcacggacacttaaaagtcgtggaactgttgctccaacataaagccctggtgaacacgacagggtatcagaatgattctccactacatgacgccgcaaagaatggccacgtggatatcgtgaagctgctgctttcttatggagcttcccgcaacgctgttaatatttttggtctcagacctgtggactacaccgacgacgagtccatgaaaagtttattactgctgccagaaaagaacgaaagctcctccgcgagccattgcagcgtgatgaacaccggccaacggcgcgatggacctttagtgctcatcgggtcggggctgagcagtgaacaacaaaagatgttatccgagctcgccgttatcttgaaggcgaaaaaatacactgagtttgatagcacagtgacgcacgttgtagtgccaggggacgccgtgcaaagcacccttaaatgcatgctaggtattctgaacggatgttggatcctgaaattcgagtgggtgaaagcttgcctacgcaggaaagtgtgtgagcaagaggaaaagtacgagatccccgaagggccgcgcaggagtagactgaatcgggagcattgccaatcttgcctgatggatgcaacatcaatctgcggcgagccctccaataccatccagcgtactaccttgttatcttcctcgctacaggtcggagctcgctcatcagtggaaagcccatctcaaacagtcacatag

SEQ ID NO: 23066 - DNA, 3750 bp, Artificial Sequence
  Description of Artificial Sequence: Synthetic coding sequence
atgagcagcatgtggagcgagtacaccatcggcggcgtgaagatctatttcccttataaagcctatcccagtcagcttgccatgatgaattcgattctgcgaggcttgaattcgaagcagcattgccttcttgagagcccaaccggctcaggcaagagtttagccctgctgtgctctgctcttgcctggcagcaatccctgagcggtaagcctgccgatgaaggtgtatcagaaaaggccgaagtgcagctctcctgttgctgcgcctgccactctaaggacttcaccaacaatgatatgaatcaaggcacatccaggcatttcaactacccctctaccccaccgagtgagaggaatggcacaagcagtacgtgccaggattcccccgagaaaaccacattagcagccaaactgtccgcaaagaaacaggctagtatttatcgggacgagaacgatgactttcaggttgaaaagaaacgtatccggccattggagacaacccagcagatacgcaagaggcactgcttcggaaccgaggtgcataatctagacgccaaagtggactctgggaaaaccgtgaagctgaactccccactggaaaagattaattcgttctcacctcagaaaccgcctggccattgcagccgctgttgctgctccacgaaacaggggaattcccaagagagctcaaatacaattaaaaaggaccacactggaaagtcaaagataccaaagatttattttggaactcgaacacacaagcagattgcacagatcactcgggagctccgcagaactgcgtactccggagtgcctatgacaattttgagctcacgtgatcacacctgcgtgcatcctgaagttgtgggaaattttaaccggaatgagaagtgcatggagctgttggacgggaagaatggcaagtcctgttatttttaccacggagtgcacaaaatctctgaccagcatacactgcagacatttcaaggaatgtgcaaagcttgggacatcgaagagttggtgagtcttggcaagaagttgaaagcctgcccttattataccgcgcgagaactcattcaagatgccgacattatcttttgcccgtataattacctgttggatgctcaaatccgggaatccatggacctgaacctgaaagagcaggtggtcatcctggatgaggcccataacattgaggattgtgccagagaaagcgccagctacagcgtgacagaggtgcagctccgcttcgccagagacgaattggactccatggtcaataataatattcgcaaaaaagaccatgaacctctgcgagccgtgtgctgttcactcataaactggcttgaagccaatgcagagtacttggtagagcgtgactacgagagcgcctgcaagatttggtcaggaaacgaaatgctactgaccttgcacaagatggggatcacaacagcaactttccccattctccaaggccatttcagcgctgtgttgcagaaggaggagaaaatttctcccatatacggaaaggaggaggcgagagaggttcccgttatctcagcctctacacaaattatgcttaaggggctgtttatggttctcgattatttgtttagacaaaactctcggttcgcagatgactacaagatcgcaattcagcagacatactcttggactaaccaaatcgatatcagcgacaaaaacgggctcctggtgcttccgaagaacaagaaaagaagccgacaaaagacagccgtacatgtcctcaatttttggtgtctcaatcctgcggtggctttctctgacatcaacggaaaggtgcagactatcgtgcttaccagtggcactctgagccccatgaagtcctttagttctgagctgggcgtcacgttcactatccagctggaggccaaccatattattaagaattcccaggtgtgggtaggcacaattggatccggtcctaaaggccgtaatctgtgcgctacgtttcaaaacaccgaaacctttgaatttcaggacgaggttggcgcactactgttgtccgtgtgtcaaacagtgagccaggggattctgtgttttcttccaagctacaagctgttggaaaaattgaaggagagatggctttccaccggtctgtggcataatctggagcttgtgaaaaccgtcatcgtagaaccccagggcggggagaagacaaactttgacgagctcctgcaggtgtactacgatgcaattaagtacaagggtgagaaggatggggcgctgttagtggcggtgtgtagaggaaaggtgtccgaggggctggacttttcagatgataacgcccgagcagtcatcacgataggtattcctttccccaacgtgaaagatctgcaggtggagctgaagcgccagtataatgaccatcacagcaaacttcgaggtttactccccgggcggcagtggtacgaaatccaggcctacagagcgctcaatcaggccttaggaaggtgtatcagacaccgaaatgactggggggctctgatcttagttgacgatcgatttagaaacaaccctagtcggtatatctcagggcttagcaagtgggtccgacaacagattcagcaccacagtaccttcgagagcgctttagaatctctagccgagttcagtaaaaagcatcaaaaagtgcttaatgtatctatcaaggatcggaccaacattcaagataacgagagcacccttgaggtgaccagtctcaaatattcgaccagcccgtatctgctggaggccgcatcccatttgagccctgagaacttcgtagaggatgaggctaaaatatgtgtgcaagagctccagtgccctaagattattacaaaaaactcacccctaccaagctctatcatcagcaggaaggaaaaaaacgatcccgtgtttctagaagaggccgggaaagccgagaagatagtcatttctaggagtacttcacctacctttaataagcagactaagcgggtgagctggagttccttcaactcactgggacagtacttcacaggaaagatcccgaaagccacacccgagcttggcagctcagaaaactcagcttccagcccgccaaggtttaagacagagaagatggaaagcaagacggtgctgccatttacggataaatgtgagtcatcgaatctaacagtgaacacttcctttggctcctgccctcaatccgagacaatcatctccagcctgaagattgatgcaacccttaccagaaaaaaccacagtgaacaccccctgtgctcggaagaggcacttgatccagatattgagttaagcctggtaagtgaagaggataaacagagcactagcaatcgcgacttcgagacggaggccgaggacgagtccatttactttacaccagaattgtatgatccggaagacaccgacgaagaaaagaatgatctcgcagagaccgataggggcaacaggctagctaacaacagtgactgcattctcgctaaagacctgtttgagattagaactattaaggaggttgacagcgcacgagaagtgaaagcagaggattgtatcgacacaaaactaaacggcatcctgcacatagaagagagcaaaatcgacgatattgacgggaatgtgaaaaccacctggattaatgaactcgagctgggcaagacccatgaaatcgaaattaagaatttcaaaccgtcgccttctaaaaacaagggcatgttcccaggcttcaagtag

SEQ ID NO: 23067 - DNA, 945 bp, Artificial Sequence
  Description of Artificial Sequence: Synthetic coding sequence
atggccagccggagcaagcggcgggccgtggagagcggcgtgccccaacctccagatcccccagtgcagagggacgaggaggaagaaaaagaagtggagaatgaagatgaagacgacgatgatagtgacaaggaaaaggacgaggaagatgaggtaatcgatgaagaagtgaatattgagttcgaagcctactccctcagtgataatgactacgatggtatcaaaaaactcctgcaacagcttttcctcaaggcacccgtcaacaccgctgaactcacagatctcctcatccaacaaaaccacattggatccgtgatcaagcaaacagacgtctccgaagatagcaacgatgacatggacgaagacgaggtctttggcttcatcagcttgctcaacctcactgaaaggaaggggacccagtgtgtagaacagatccaggagcttgtgctgaggttctgtgagaagaactgtgagaagtctatggtggagcagctggataagtttctgaacgacacaaccaaaccggtcgggctgctgctgtccgaacgattcattaacgtccccccccagattgccctccccatgtatcagcagcttcagaaggaattggcgggagcccaccggaccaacaaaccctgtgggaaatgttacttctacctgctcatctccaagacatttgttgaggcaggcaagaacaacagcaaaaaaaagccttccaacaagaagaaggccgccttgatgttcgctaacgctgaggaggaattcttctatgaaaaggccattcttaaatttaattactccgtgcaggaggagagcgatacctgcctcggcggaaaatggtctttcgatgatgtgcctatgacccccctcaggacggtgatgttgatcccgggcgacaagatgaatgaaattatggacaaacttaaggaatacctatctgtttag

SEQ ID NO: 23068 - DNA, 879 bp, Artificial Sequence
  Description of Artificial Sequence: Synthetic coding sequence
atggccagccggagcaagcggcgggccgtggagagcggcgtgccccaacccccagaccccccagtccagcgagatgaggaagaagagaaggaggtggaaaacgaagacgaggatgatgacgattcggacaaggaaaaggacgaagaggatgaggtgatcgacgaggaagtaaacatagaatttgaagcgtactctctgtcagacaatgattacgacggcataaaaaagttgctgcagcagctctttctgaaagcccctgtgaacaccgcagaactgaccgacctactaatccagcagaaccacatcgggagcgtcattaaacagaccgatgtgtctgaagatagcaacgatgatatggacgaagatgaagtgttcggctttatcagcctgttaaacctgactgaaaggaagggcacgcagtgcgttgagcaaatacaggaactagtgcttcgcttctgtgaaaagaattgtgagaaatcgatggtggagcagttggacaaattcctgaatgacacaacaaagcctgtaggccttcttctaagcgagaggttcataaatgttccaccacagatcgccctccccatgtatcagcaactgcaaaaggaactcgcgggggcccacaggaccaataaaccctgtgggaaatgttacttctacctgctgattagcaaaacttttgtggaggcaggaaagaacaatagtaaaaagaaaccatcaaataagaaaaaagctgcccttatgttcgcaaacgccgaagaagagttcttttatgaggaacaaggaaaaccggaagtgcttggaggacctgatacgcgtagggggctcgagcctgtcccaatacagcataatggctggagcgtgccccctgtcctggagtag

SEQ ID NO: 23069 - DNA, 969 bp, Artificial Sequence
  Description of Artificial Sequence: Synthetic coding sequence
atggccagccggagcaagcggcgggccgtggagagcggcgtgccccagcctccagaccctcccgttcagagggacgaggaggaagagaaagaggtggagaacgaagatgaggacgacgacgatagcgataaagagaaggacgaggaggacgaggtcatcgatgaagaggtcaacatcgagttcgaggcctactctctgagcgacaatgactacgacggtataaagaaactgctgcagcagctctttctcaaggccccagttaatactgcagaacttaccgacctgttgatacagcagaaccacatcggtagcgttatcaaacagactgatgtttcagaagattctaatgacgacatggatgaggacgaggtttttgggtttatcagtttgctgaacctcacagaacgaaagggtactcagtgtgtggagcagatccaggagctggtcttgagattctgcgaaaagaattgcgagaaaagtatggtggagcaactcgacaaattcttaaacgataccaccaagcctgtcggactcttattaagtgaacgatttattaatgtcccacctcagattgccctccctatgtatcaacagcttcaaaaggagttagccggagcccatagaaccaataaaccatgtgggaaatgctatttctatctgctcataagcaaaacattcgtcgaagccggcaagaataactcgaagaagaaaccttctaacaagaaaaaggcggccctgatgtttgctaacgccgaggaggagttcttttacgaagagcagggaaagcccgaggtgctgggcggcccggacacgagacgaggcctagagcctgttcctatccagcataatggtggcagccgcggacaggtcaccgccttggtatccctaaaggcgggcctgatccagagtagatcgactttaagcgattttcaggggaccttcatgactgtgggtattgcactcagctag

SEQ ID NO: 23070 - DNA, 879 bp, Artificial Sequence
  Description of Artificial Sequence: Synthetic coding sequence
atggccagccggagcaagcggcgggccgtggagagcggcgtgccccagcctccagaccctccagttcagagggatgaggaggaggagaaggaggtcgagaacgaagatgaagacgacgatgattccgacaaggagaaagacgaagaggatgaggtgattgatgaagaggtaaacattgagtttgaagcctattccttaagcgataacgactacgatgggatcaaaaaactgctgcagcagctgtttctgaaggcccccgtgaatacagccgagttgactgatctgcttatccaacaaaatcatatcgggagcgtaatcaagcagaccgatgtgagcgaggattccaacgatgacatggacgaggacgaggtgttcggcttcatctccctgctaaacctaacggaacggaagggaactcaatgtgtggaacaaattcaggagctcgtactgaggttctgtgagaagaactgcgaaaagtctatggtcgagcagctggataaatttctgaatgatacgactaaaccagtcggtcttttgttgtcagagcggtttattaatgtcccacctcagatcgctctgcctatgtatcagcagctccaaaaggaattagcaggagcccaccgtaccaacaaaccctgcggaaaatgttacttctacttgctgatatccaaaacatttgtggaagcagggaaaaacaacagcaagaagaagccctcaaacaagaaaaaggcggcactcatgttcgcaaatgccgaagaagagtttttctacgagaaggctatcctaaagtttaactattctgtgcaggaggaaagtgatacttgcctgggtggaaagtggtctttcgatgactggtccgtgccgcctgtcctggagtag

SEQ ID NO: 23071 - DNA, 789 bp, Artificial Sequence
  Description of Artificial Sequence: Synthetic coding sequence
atggccagccggagcaagcggcgggccgtggagagcggcgtgccccagccgccagatccaccggtgcagagggatgaagaggaggaaaaagaagttgagaatgaggatgaggacgatgatgactcggacaaggagaaggacgaagaagatgaagtaatcgatgaagaagtcaacatcgaatttgaagcatactccctcagcgacaacgactatgatggtatcaagaagttgcttcagcagctttttttaaaggcaccagttaacaccgccgaactgacagatctcctgatccagcagaaccatatagggtccgtcatcaagggcacgcagtgcgttgagcaaatccaggaattggtcctccgattctgcgagaagaactgtgaaaagtccatggtggaacaattggacaaattcctgaatgatacaacaaagccagtaggcttgctactgtccgagagatttataaacgtcccaccacagatagccttacccatgtaccagcaactgcagaaggaactggctggtgcccatcggacaaataagccgtgtgggaagtgttatttctaccttcttatctctaagaccttcgttgaagccggaaaaaacaactctaagaagaaaccttctaataagaaaaaagctgccctcatgtttgcgaatgctgaagaggaatttttttatgaggaacagggaaagccggaggttcttggaggcccagatacacgtcggggccttgagccggtcccaattcaacataatggttggtccgtgcctcctgtgttggagtag

SEQ ID NO: 23072 - DNA, 1398 bp, Artificial Sequence
  Description of Artificial Sequence: Synthetic coding sequence
atggtggaccccgtgggcttcgccgaggcctggaaggcccagttccctgattctgaacctccaagaatggagctgcgaagcgtcggtgatatcgaacaggaactggagcgttgtaaagccagcattcgacggcttgaacaagaagtcaatcaagaacgatttcgaatgatttacctccagactctgttggcaaaagaaaagaagagctacgataggcagaggtggggattcaggagggctgcacaggctcccgacggagcctctgagccccgcgccagcgcctctcgcccacaacctgccccggccgacggggccgatcctccccccgccgaagaacccgaggcacgcccagacggagaggggtctcccggaaaggcacggccgggaactgcgcggagacccggggccgccgcaagtggcgagcgggacgacagaggaccccccgcctccgtggccgccctgcgctctaactttgaacgcatacgaaaggggcacggtcagcctggcgcagacgcagagaagcccttctatgtgaatgtggaattccaccatgagcgtgggcttgtaaaggtgaatgacaaagaggtgagcgatagaatttcgagtctgggtagccaggcaatgcagatggaaagaaaaaaaagccagcatggtgcagggtcttcagtgggagacgcaagtaggcccccatatcggggaaggtctagcgaatcttcatgtggagtggacggtgactatgaggacgctgaactcaatccccgctttctcaaggataatctaatagacgccaacggcggatctcgtccgccgtggccacccctggagtatcagccttaccaatctatctacgtcggtggaatgatggagggggagggaaaaggtcctctcttgaggagtcagtctacctccgagcaagagaaacggctgacatggccccgtcgtagctactcccccaggtcatttgaggactgtgggggcggttacacacctgactgttcatccaatgagaacctgacttcttctgaggaagatttctcctccggtcagtcctcgagggtgtcaccaagtcctaccacgtacaggatgtttcgggataaaagccgaagccccagccagaactcccagcagagctttgacagttcttctcctccaactccccaatgccacaagcggcatcgccactgccccgtcgttgtctctgaagctacgattgttggcgtgcggaagacaggacagatctggcccaacgacggggaaggcgcattccatggagagcatcctggggcagcagaagaggtttttcagaagctcctgccagacatcaggggcgccgccgacgccgaccaacttgtctgcgaaacacccgactgccctcagcacagtgcagaccatcaatag

SEQ ID NO: 23073 - DNA, 1377 bp, Artificial Sequence
  Description of Artificial Sequence: Synthetic coding sequence
atggtggaccccgtgggcttcgccgaggcctggaaggcccagttcccagacagcgagccacccaggatggagcttagatctgtgggtgatatcgaacaggagttggaacgctgcaaagctagtatccggaggcttgaacaagaggtgaaccaggaaaggttcaggatgatttacctgcagaccttgctggcgaaggagaaaaaaagctacgaccgtcagaggtggggctttagacgggcagcccaggcccccgacggcgcttctgaaccaagagcctctgcctcaaggccacagcctgcccccgccgacggcgcagacccaccccccgccgaggaacccgaggctcgcccagacggagaggggtctcctggaaaagctaggcccggcacagccagacgcccaggcgcagctgcatctggcgagagggacgatcggggcccacccgcctcagtggccgccctccgatccaacttcgaaaggattcgcaaagggcacggccagcctggggcagacgcggagaagcccttctatgtcaacgttgagttccatcatgagcgcggactggtaaaggtcaacgacaaagaggtttctgaccgaatctctagcctcggatctcaggctatgcaaatggagaggaaaaagagccaacatggtgctggcagctctgtaggggatgcctcccgccccccataccggggcagaagcagtgagagcagttgtggtgtcgatggcgattacgaagatgctgaacttaacccccgattcttgaaggacaatctgatcgatgccaacggtggaagccgccccccatggcctcctctcgagtatcagccttaccagagtatctacgttgggggcatgatggaaggagagggaaaagggcccctgctgaggagtcaaagtacaagtgagcaagagaagcgcttgacctggccaaggaggagctattctccaagaagtttcgaggactgcgggggaggatatacacctgactgcagttctaacgaaaacctcacatcttcagaagaggacttttcttccgggcagtcctcaagagttagcccttcccctaccacatatcgcatgttcagagacaaatcccggtcccccagtcagaattctcagcagagttttgactcctcttcaccgcccactccgcagtgccacaaacggcatcggcactgtcccgtggtggttagtgaggcaactatcgtgggcgtacggaaaaccggtcagatatggcctaacgatggggagggcgcctttcacggagacgcagacggatcatttggtacccctcctggctacggttgtctctgtcttcctgcctggccatctggctgtaccgctgctactgccagggtcaccaggtcttag

SEQ ID NO: 23074 - DNA, 3816 bp, Artificial Sequence
  Description of Artificial Sequence: Synthetic coding sequence
atggtggaccccgtgggcttcgccgaggcctggaaggcccagttcccagatagcgaacccccacgcatggagcttagatctgtaggcgacattgagcaggaactagagcggtgtaaagcctccattaggcggctcgaacaagaagtgaaccaggagcgctttcgcatgatttacctgcaaacgcttctggccaaggaaaagaaatcttatgaccggcagcgctggggattcaggcgagctgcccaggcccccgacggtgcttccgaaccacgagcatctgccagccgtcctcagccggcaccagcagatggcgctgatccaccccccgccgaggaacctgaagctcggcctgacggcgaaggatccccaggaaaggccaggccgggaactgcacgaaggccaggcgctgccgcgtctggtgagcgggatgatcgcggtccacccgcaagtgtggcagcgcttagaagtaattttgagcgaatcaggaaaggccacgggcagcccggcgcggatgcagaaaagccattctacgtaaatgtcgagtttcaccacgagagaggacttgtaaaggtgaacgacaaagaagtgagcgacagaatcagctcccttggaagccaggccatgcagatggagcgaaaaaaatcacaacatggggcgggttcatcagtgggggacgctagtaggccaccctataggggccggtcttctgaatcatcatgtggcgtggatggcgactatgaagacgctgagctaaaccctcgatttcttaaagacaatctgattgacgctaatggcgggtcaaggccgccatggccacccctggagtaccaaccttatcaaagcatttacgttgggggaatgatggagggtgaagggaaggggcctttgctacggtcccagtcaacctcagagcaggagaaaaggctgacgtggcctaggcgctcgtacagccccagatccttcgaagactgcggtggaggttatactccagactgctcgagtaatgagaatctgactagttctgaggaggactttagctccgggcagtcgagtagagtatcaccaagtcccaccacttaccgaatgttcagggacaaaagccggtcgcctagccagaacagtcagcaaagtttcgattcttcttcacccccaacgccacagtgtcacaagagacatcgccactgtccagtagtcgtatcagaagccacaattgtgggcgtcaggaagacaggccagatctggcccaatgatggagaaggagccttccacggggatgcggacggctcatttggcacccctccagggtacggctgtgccgcagacagagcggaagaacaacgtagacaccaggatggcttgccctatattgatgactcccccagttcatcccctcatctgtcttctaaaggtagaggttcacgtgacgccctagtgtcgggagccctagagtcaacgaaggcatccgaattggatctagaaaagggactcgaaatgaggaaatgggttttatccggaatcctcgctagtgaagagacctatctctcccacctggaggccctgttacttcctatgaaaccactgaaagctgccgcaaccacttcccagccagtgctcacttcacagcaaattgagacaatctttttcaaggtaccagagctgtatgaaattcacaaagagttttacgatggcctgttcccaagagttcagcagtggtcacatcagcagagagtcggcgatcttttccagaagttggccagtcagttaggcgtatatcgcgcgtttgtggacaattacggagtcgcaatggaaatggccgagaagtgttgccaggccaacgctcagtttgcagaaatatcagagaatttacgagcacggtctaataaagatgctaaggacccaacgacaaaaaattcactcgagacattgctttataaaccggtggatagagtaactcgctccactcttgtcttgcatgacctcttaaagcatacaccagcttctcacccagatcaccccctgttgcaagacgctctgcgtattagtcagaattttttgtcctcaatcaacgaagagattacgcctaggcgtcagtctatgaccgtcaaaaaaggtgaacaccgtcaactgctgaaagacagcttcatggtggagctcgtggaaggcgcgaggaaactccgacacgtgtttttgtttactgacctcttgctgtgcaccaagcttaagaaacaatcaggcggaaagacccaacagtacgactgtaagtggtacataccactgacggatttatcttttcaaatggtggatgaactggaagcggtgcctaacatccctttagtacctgacgaggaactggatgctctgaagatcaaaatctcacaaatcaaaaatgatattcagcgcgagaaacgggctaataagggatccaaagctaccgagagattaaaaaaaaagttatctgagcaggagtccctcctcctgctgatgtccccatccatggcatttcgagtccattcacggaacggtaagtcgtatacattccttatttcaagtgactatgaacgcgctgagtggcgagagaatattcgtgaacaacagaaaaagtgctttcgtagcttttcactcacctctgtcgagttacagatgttaaccaatagttgcgtgaaactgcaaacggtgcatagcatacccctgaccatcaacaaagaagacgacgagagcccgggcctgtatggatttttgaacgttattgtccacagcgccactgggtttaaacagtccagcaatctttactgtaccctggaagttgatagttttgggtatttcgtaaataaagctaagaccagagtgtacagggataccgccgagcccaactggaacgaagagttcgaaatcgagctcgagggctcccaaacgctgagaatcctttgttatgaaaaatgctataacaagactaaaatcccgaaagaagatggggaatcgaccgatagactgatgggaaaggggcaggtccaacttgatcctcaggccctgcaggaccgagattggcagcgcactgttattgctatgaatgggatagaggtgaagctgtctgtgaaatttaattcgagggagttcagtttaaagagaatgcccagcagaaagcaaacaggagtcttcggtgtgaagatcgcggttgtgactaagcgcgaacgcagtaaagtgccctacatcgtacgtcaatgtgtcgaagaaatcgagagacgcggtatggaggaagtcggaatctatagagtgtcaggggtggcgaccgatatacaggcactcaaagccgcatttgacgttaacaataaggacgtgtctgtgatgatgtccgagatggacgtgaacgctatagcaggtactctcaaactctactttcgagagttgccagaacctctgttcaccgatgagttttacccaaactttgcagaaggtattgctctgagcgaccccgtcgcaaaagaatcctgtatgctgaatttgctgctcagtctgccggaggcaaatctcctcaccttcctctttctgctggaccatctgaagagggtggctgaaaaggaggccgtcaacaagatgtctttgcacaatctggccacagtctttggccccacattgctgaggccttccgagaaggagagcaagcttcccgccaatccgtcgcagccgatcactatgacagactcttggagtctcgaggtcatgagtcaagtccaggtcctgctgtatttcctccagttggaggccattccggctcccgactccaagcgccagtcaattctgtttagcactgaagtttag

SEQ ID NO: 23075 - DNA, 2811 bp, Artificial Sequence
  Description of Artificial Sequence: Synthetic coding sequence
cccagcgccccccgggtgagcaccgtgggcctgctgtgcagcggcgcggggccgcatctctgcccgtgcgcagaagagggaacagggggactggagtctcagggcgagatcatcccctctcgcggcagcaggaaacccgatggcgtctctggttccagaaggctgttctccagcctgtgcaaatcccaggaaggtagtaggaaggaatgcctgcggaaacatcggcgccttggccccgctatgcccgtttccagtccagggttccccggaccgttggcccgcagcgagcaccatctagacaccgccgccttgcagaccggtcagcgctcctctgctggcaccaagatgggctgtcctaccctcatgacccggccgcctcatcgccctacctccgcagctcgtgccggtgctgcgggaatgaggtggagcagggaaccctggagccccctgaaacggtccgaactggacctggaaaaaggcctcgagatgcggaaatgggtgttgtctggcattttagcctcggaggagacttacttgtctcatctggaagccctattattgccgatgaaaccactcaaggccgctgctacaaccagccagcccgttctgacttcccagcagatcgagacaatcttttttaaagtgcccgaactgtacgagatccacaaggagttttatgacggcttgtttccacgggttcagcagtggtcacaccaacagagagtgggggacctgtttcaaaagctggcgagtcagctgggggtttatcgagcttttgttgacaattacggcgtagccatggaaatggctgaaaaatgttgccaggccaacgcgcagttcgcagaaatctctgagaatctcagagcacgcagcaataaagacgcaaaagacccaacaaccaaaaacagtctggagacgttgctctataaacccgtagatcgtgtgacccgttccaccctggtgcttcacgatctcctgaagcacacacccgcttcccaccctgatcaccccttactgcaggacgctctgcggatatcccagaacttcctttcttcgattaacgaggagataactccacgccggcagtccatgaccgtaaagaagggtgagcaccgacagttactgaaagactccttcatggtggagctcgtcgagggcgcacgcaaactgaggcacgtcttcctgttcactgacctgctcttatgcaccaaactaaagaaacagagtggtggaaaaactcagcagtatgactgtaaatggtatattccactgacagacttgagttttcaaatggtggacgaactcgaggccgtccccaacattcctctagtcccagacgaggagctcgacgcgctcaagattaaaatctctcagatcaagaatgacattcagcgcgagaaacgggcaaacaagggcagtaaggccactgagagacttaaaaagaagctgagtgaacaggaaagcttgctacttttgatgtccccctctatggctttcagggtgcactctagaaatgggaaaagttataccttcttgatcagcagtgactatgaacgtgcagagtggcgggaaaacatccgcgaacaacagaaaaagtgtttccgatccttcagcctcacctctgtggagctccagatgttgacaaatagctgtgtcaagttacaaacggtgcatagcataccgctgaccatcaataaagaagacgatgagtctcccgggctgtacggcttcctgaacgtaatcgtgcacagtgctactggcttcaaacagagtagcaatctttactgtaccctggaagtggacagctttggctactttgtaaacaaggccaagactagggtgtacagagacactgccgaaccaaattggaatgaggagttcgagatcgaacttgaaggcagccagaccctacggatcctctgctatgagaaatgttacaataaaaccaagatcccaaaggaagacggtgagagcacagataggctcatggggaagggacaggttcagttggatcctcaagccctccaagaccgcgattggcaaaggaccgtcatcgcgatgaatgggattgaggtcaaactgagcgtaaaattcaactcccgggaattctcattgaagcgcatgccgtcgcggaagcagacaggagtctttggagtgaaaatcgccgtggtcactaagcgagagaggagcaaggtgccctacatcgtgcgccagtgcgtcgaggaaattgagcgccggggaatggaggaggtgggtatatacagagtgtcaggggtggctaccgatatacaagctcttaaggccgcgtttgacgtgaataataaggacgtttctgtgatgatgtccgaaatggacgttaacgctatcgcaggcacactaaaattgtatttcagggaattgccagaacccctgttcaccgacgagttctaccccaatttcgccgagggcattgcactgtctgaccccgtcgccaaggaatcctgtatgctgaacctgctcctcagtttgcctgaggctaatctgctaacattcctgtttctgctggaccatctgaagcgagtggccgagaaagaggccgtaaacaaaatgtcactgcacaacctggcaactgtcttcggtcccacgctactacgtccgtcagagaaggagtctaaactgcccgcaaatccttcacagccgatcaccatgacagacagttggagtcttgaagtgatgtcacaagtgcaagtcctgctctacttcctacagctcgaggccatccctgctcccgatagcaaacgacagtccatacttttctccactgaagtgtag

SEQ ID NO: 23076 - DNA, 3684 bp, Artificial Sequence
  Description of Artificial Sequence: Synthetic coding sequence
atggtggaccccgtgggcttcgccgaggcctggaaggcccagttcccagattccgagccacctaggatggagctgaggtccgtgggtgacatcgaacaggagctggaacggtgcaaggcgtccattcggcgcctggaacaggaggtgaaccaggaaagattccgaatgatatatttacagacactgctggccaaagagaagaagagctacgaccgccaacggtggggcttcagaagagcggcgcaagcccctgacggcgccagcgaaccgagggccagtgcgagcagaccccaacccgccccggccgacggagccgatccaccccctgcggaggagcctgaggctcgcccagacggggaaggctcccccggaaaggctaggcctgggaccgcccgacggcccggcgccgccgcctctggggaacgggatgataggggacctccagctagcgtggctgcgctgaggagcaatttcgagaggattcggaagggtcacgggcagcctggggctgacgcagaaaagccgttttatgttaacgttgagttccaccacgagagagggttggttaaggtaaatgacaaggaggtgagcgacaggatatctagcctcggcagtcaagctatgcagatggagcgcaagaaaagtcagcacggcgccggctcttctgtgggcgatgcctcgaggcccccatacagggggcggagttcggagtcatcgtgcggggtagacggagactatgaggatgccgaacttaatcctagattccttaaagacaatcttatcgacgctaacggaggttctagacccccctggccccccttagagtatcagccttatcagtccatatatgtcggtggtatgatggaaggagagggtaaaggtcctctcctgcggagccagtctacatccgaacaggaaaagcgcttgacttggcctcgtcgcagttatagcccacgcagcttcgaggattgtggggggggttatacaccagactgtagctccaacgaaaatctgactagctctgaggaggacttctcgtccgggcagtcttcaagggtgtcaccaagccccaccacctatcgcatgtttcgagacaagagccgcagtccaagccagaacagccagcaaagctttgactcatcctcccctcccacaccacagtgtcacaagcgtcaccggcactgccccgtcgtagtgtcagaggcaacaatcgtgggagtgcgcaaaaccggccagatctggccgaatgacggggagggcgctttccacggagatgctgatggatcctttggcacgccgcctggctacggctgcgctgccgatcgtgccgaggaacagaggagacaccaggatggcctgccttacatcgacgactcccccagcagttcaccacacctgtcatcaaaaggacgggggtccagggacgcactggtcagcggtgccctggagagcacgaaagcaagcgaactggacctcgagaaggggttagaaatgagaaagtgggtgctttccggtattctggcatcggaagagacctatcttagccatttggaggccctattgttgcctatgaagcctttgaaggccgctgccacgacatcgcagcctgtcctaacatcccaacaaatcgagactatctttttcaaggtacctgaattatacgagattcacaaagaattctatgatggcctgttcccacgcgtacagcaatggtctcatcagcagagggttggagacctcttccagaaactggcctctcagctgggcgtatacagagccttcgtcgataactacggagtggcaatggaaatggcggaaaagtgttgccaagcaaatgcccagttcgcggaaatttctgaaaatctgcgggctcgaagtaataaagacgctaaagatccaacaacgaaaaatagcttggagactctactgtataagccagttgacagagtcacgcgaagcacccttgttctccacgacctgctgaaacacacccctgcctctcacccagaccaccctctcctacaggatgctttaagaattagtcaaaattttctgagttctatcaacgaagagattaccccacggagacagtcgatgactgtgaagaagggagagcatagacagctcttaaaggattctttcatggtagaattggtggagggagccaggaagttgaggcatgtctttctctttacggatcttctgctatgcaccaagctgaaaaaacagtctgggggaaagacgcaacaatacgattgcaaatggtacattcccctaaccgacctcagcttccagatggtcgatgagcttgaagcggtcccaaatatccctcttgttccggacgaagagctggatgccctcaagatcaaaatttcccagatcaagaacgacatccagagggagaaacgagccaacaaggggtccaaggctacagaaaggcttaaaaagaagctatcagaacaggaatctctcctgctgctgatgtctccatcaatggctttcagagtccatagcagaaatggcaaatcttacactttcctcatcagctctgattatgaacgggcagagtggcgggaaaatattcgtgaacagcagaaaaagtgtttcaggagcttcagtttgaccagcgttgaactgcaaatgctcacgaactcttgcgtgaaacttcaaactgttcacagcatccctttgaccattaacaaagaagatgacgagtcgcccggtttgtatggtttccttaatgttattgttcacagcgccaccggttttaaacagagctctaatctatactgcaccctggaggtggacagttttggttactttgtcaataaggccaagacccgggtgtaccgggacacggccgaacctaactggaacgagctcgatccccaggccctccaggaccgcgactggcagagaacggtgatcgctatgaacgggattgaggtgaagttgagtgtgaaattcaactcgcgggaatttagtctgaaacgcatgccatcacggaagcaaaccggcgtgttcggagtgaaaattgcagtggtcaccaagcgagagcgctctaaagttccctacatagtgcggcagtgtgtcgaagagatagagagaagagggatggaagaagtgggtatttatagagtgtcgggagtggctaccgacatccaggctttaaaagcagctttcgacgtaaataacaaggacgtgtccgtgatgatgtccgagatggatgtgaatgccatcgctggcactttaaagttgtactttcgggaattgcctgagccgctgttcactgatgagttttacccgaattttgccgagggcatagctttgtccgacccagtagcaaaggaatcgtgcatgctaaatttacttctgagtttgcctgaggccaacttactgacgtttcttttcctcctcgaccatctgaaacgggttgcagagaaagaagccgtaaacaaaatgtccctacacaatctggccaccgtgttcgggcccaccctgctgcgcccttctgagaaagagtctaagctgcctgcgaaccctagccagcccatcacaatgacggattcctggtctctcgaagtaatgagccaggttcaggtgttactgtatttcctgcagcttgaagccattccagctccagacagtaagcgacaatctatacttttttcgaccgaagtttag

SEQ ID NO: 23077 - DNA, 1404 bp, Artificial Sequence
  Description of Artificial Sequence: Synthetic coding sequence
atggtggaccccgtgggcttcgccgaggcctggaaggcccagttcccagattcggaaccccccaggatggaacttagaagtgtgggcgatatcgaacaggagctggagcgctgcaaagcaagcatccgtcgccttgagcaggaggtaaatcaggagcggttccgaatgatatacctgcagactctgctcgccaaggaaaagaagtcatacgatcgacaacgctggggcttccgtagggctgcccaagcaccagatggtgcctcagagccccgcgcctccgcaagccggccgcagccggcccctgccgatggagcagacccacctccagccgaggagccagaggctagaccagacggggaagggtcgcccggcaaggcacgtcccggcacggcacgacggcctggcgctgccgcttctggagagcgggacgatcgcggcccacccgcctcggtggccgccctgcgctcaaactttgagcgaattagaaaaggccatggccagcccggcgccgacgccgagaaacctttctacgtcaacgtcgaattccaccacgaacggggcctggttaaagtgaacgacaaggaagtgtctgaccggattagctcactgggttctcaggctatgcaaatggagcggaagaaaagccaacacggcgccggtagttctgtgggggatgcttctcgcccgccgtatagggggcggtctagcgaatcgagttgcggcgtggacggtgattacgaggacgcagagctgaaccctaggtttctaaaagataatcttatcgacgcaaacggcggctcaagacccccctggccccccttagagtaccaaccgtaccagtccatctatgttggtggcatgatggaaggggaaggaaaggggccacttttgaggagtcaatcaacttcggaacaagagaaaaggctcacctggccacggagaagctacagcccacgttcgtttgaggattgcggcggtggatacactcctgactgcagctctaacgagaatttaactagttcagaggaggatttctcaagcggccagagctctcgcgtctcaccctccccaaccacgtatcggatgtttcgggacaaaagccggagcccgagtcagaattctcagcagtcttttgactcatcgagccctcctacccctcaatgccacaagcggcatcggcactgtccagtcgtggtctccgaggcaacaattgtaggtgtgaggaagacgggtcagatttggccaaacgacggcgagggcgcctttcacggggatgcagtgctaaaaacagaggtgccacatcaaggtgtgcggcgtgctagactttccttagaggcattaggagaggatccgtcattcctgttcccagcctctgatggaccaaggcatagctccacctggtag

SEQ ID NO: 23078 - DNA, 1365 bp, Artificial Sequence
  Description of Artificial Sequence: Synthetic coding sequence
atggtggaccccgtgggcttcgccgaggcctggaaggcccagttcccggatagcgaacccccacgtatggagctgagaagcgtgggggacatcgagcaggagttagaaaggtgcaaggcctcaatccggcgacttgagcaggaagttaaccaggagcggtttcgcatgatctacctccagaccctcctggccaaagaaaaaaaatcatatgaccgccaacgttggggtttccggagagcagctcaggcacccgatggagccagtgagcctcgcgcgtcagcaagtagacctcagcctgctcctgcagatggcgcagatcctcctccggccgaggaacccgaagcccgccccgatggcgaaggtagtcctggcaaagccagacccgggacagcacgacggcctggcgcagccgcctctggcgagcgagatgatcgcggccctcctgcgagcgtcgccgccttacgctctaattttgaacgaatccggaagggccatgggcagcctggggctgacgccgaaaaacccttttatgttaatgtcgaatttcaccacgagagaggtctcgttaaagtcaacgacaaagaggtgtctgatcgaatttcctctcttgggagtcaggctatgcagatggaaagaaaaaagtcccaacatggcgctggctcttccgtgggggatgctagccgtcccccttacagaggtcggtcatccgagtcctcttgcggagtggacggcgattatgaagatgctgaactgaatcctagatttcttaaggataatttgatagacgcaaatggcggatcaaggccgccctggcctccgctcgaatatcaaccatatcagagcatctatgtgggagggatgatggaaggagaggggaaggggccgctgttgaggagtcagtccacctctgagcaggagaaaaggttaacctggccaaggaggagttatagcccgagatcatttgaagattgcgggggaggctacacaccggactgcagtagcaacgagaatttgacctcatctgaagaagacttctcatccggccagagttcccgcgtgtctccttcgccaaccacctacaggatgttcagagataaaagccgctccccttctcagaacagccagcagagcttcgattctagctcaccaccgactccacagtgtcataagcgccaccggcactgccctgttgtggtgtctgaggctaccattgttggcgtacgtaagaccgggcagatttggccaaacgacggagagggagcattccacggcgatgcagacggttccttcgggactccaccaggctacgggtgtgcagccgggagacccccgcacctgacggagctgcctgttcaacaccagtag

SEQ ID NO: 23079 - DNA, 4704 bp, Artificial Sequence
  Description of Artificial Sequence: Synthetic coding sequence
atgaacgtggagaaggccgagttctgcaacaagagcaagcagcccggactggccagatcacagcataatcgatgggctggtagcaaagagacctgcaatgaccggcgcaccccttcaactgagaagaaagtagatctcaacgccgacccgctgtgcgagcgcaaggagtggaataagcaaaaactcccctgcagcgagaatcccagagatacagaagatgtcccttggattacactcaactcgtctatccagaaggtgaacgagtggttttctagatctgatgagctgctcggatctgatgattcacatgacggtgaaagcgaaagcaatgccaaagttgctgacgttctggacgtgctcaatgaagtggacgaatacagcggatctagcgagaagatagatttgttagcctctgaccctcatgaggccctgatatgtaagagcgaacgagtgcatagcaaaagcgtggaatctaatatcgaggacaagatcttcggtaaaacataccgcaaaaaagcatcactgccaaacctttcccacgtcacagaaaatcttataatcggtgcttttgtcacggagcctcaaataatccaagaacgaccactgaccaacaagcttaaacgtaagcgaagacccactagcggcctgcaccccgaagacttcattaaaaaagccgacctagctgtgcagaagacacctgaaatgatcaatcaaggcactaaccagaccgagcaaaatgggcaagtgatgaacatcacaaacagtgggcacgagaacaagacaaagggcgattcaatccagaatgaaaagaatcctaaccctatcgagagcttagaaaaggagtcggcctttaagacaaaagctgagcccattagcagtagtatttcgaatatggaattggaattaaacatccacaacagcaaagcacccaaaaaaaaccgtttgaggcgaaaaagttcgactcgccatatccacgctctggaattggtcgtgagccgcaacctgtccccacccaactgcaccgaactgcaaatcgacagctgttcaagtagcgaggagatcaaaaagaaaaagtataatcaaatgccagtgcggcacagccggaatttgcagctgatggaaggcaaagagccagctactggcgctaaaaaatccaacaagccaaacgagcagacgagcaagagacatgactccgacacattcccggagctaaaactgacaaatgcaccgggcagctttacgaagtgctccaatacaagcgaactcaaagagtttgttaatccttccttacctagggaagaaaaagaggagaaattagaaaccgtaaaagtgtcaaataatgctgaggatcccaaagacctgatgctatcaggggagagggtgcttcagaccgaacggtcggtagagtcttccagcatcagcctcgtccccgggactgactacggaacccaagagagtatctctctgcttgaagtcagcaccctcggcaaggcgaaaaccgaaccaaataaatgcgtttctcaatgtgccgccttcgaaaacccgaaaggtctgatacacggctgcagcaaggataaccgaaacgacactgaagggtttaagtacccactggggcatgaggttaatcactctagagaaacgtcaatcgagatggaagagtctgaactggacgcccagtatctgcagaacacgttcaaagtgtccaagcggcaaagctttgctccgttctcaaaccccgggaatgccgaggaagagtgtgccaccttcagcgctcattctggatcgctgaagaagcagagccccaaagtgaccttcgagtgtgagcagaaggaagaaaatcagggcaagaatgagagcaacatcaagcctgtgcagacggtcaacattacagctggcttcccagtggttggccagaaggacaagcccgtcgataacgccaaatgtagcatcaaaggcgggtcgcgattctgcttaagctctcagtttcgcggaaacgagactgggctcattacgccgaacaagcatgggcttctgcagaatccttacaggattcctccactgtttcccattaagagcttcgtgaagaccaaatgtaagaagaatctgttagaggaaaactttgaagagcacagtatgagcccagaacgtgagatgggcaatgagaacatcccttctaccgtgagtaccattagccggaataatataagagagaatgtattcaaggaggcttctagctccaatattaacgaggtaggttccagcactaacgaagtgggttcttctattaacgaaatcggctcctccgatgagaacatccaggcggagctgggacggaatcgaggtcctaagttgaacgctatgctgcggcttggtgtcctgcagcctgaggtctacaagcagtcactcccagggtccaattgtaagcaccccgagatcaaaaagcaagagtacgaggaggtcgtccagaccgtgaatacagactttagtccatatctgataagcgacaatttggagcaacctatgggctctagtcacgcaagtcaagtctgcagcgagaccccagacgaccttttggacgatggggagattaaagaggacaccagcttcgcggaaaacgatattaaagaatcaagcgctgtgttcagcaaaagcgtgcaaaagggggagctctctaggtctccgtcccctttcacccatacccacttagctcagggctaccgccgtggggcaaaaaaacttgagtcttcagaagagaacttaagtagtgaggacgaggagctcccctgcttccagcacttactgtttggcaaggtgaacaatattccatctcaatccaccaggcattctacggttgcaaccgaatgcctatcaaaaaatacagaggagaatttgcttagccttaaaaactcgctgaacgattgctccaatcaagtcattctcgcaaaggcctcccaggagcaccacctcagtgaggagactaagtgttcagcttccttgtttagtagccagtgtagtgagttagaagacctgactgctaacaccaatacccaggatcctttcctgatcggaagctctaagcaaatgcggcatcaaagtgaatcccaaggcgtggggctgtcggataaagagttagtgtcagatgacgaggaaagggggacaggactggaagagaacaatcaggaagagcagtctatggatagcaacctaggagaggccgcctcgggatgtgaaagcgagacctctgtcagtgaggactgctccggcctgagcagccagtccgacatacttactactcagcagcgagacactatgcagcacaacctgatcaagctccaacaggagatggctgagctggaagccgttctcgagcagcacgggagtcagccatctaactcttacccctctatcatctctgacagctccgctctggaagatctgcgaaatcccgaacagtctacatctgagaaggctgtcctcacttcacagaaaagctctgagtaccccatttcccagaatccagagggcctgtcagccgacaaattcgaggtaagtgcagactcttccacaagcaagaacaaggagcccggtgtggaacgaagtagcccttctaaatgtcctagccttgacgatcgctggtacatgcattcctgcagcggcagcctacaaaatcggaattacccctctcaggaagagctgatcaaggtggttgacgtggaagaacagcaactggaagagagcggtcctcacgatctcacagaaacctcctatttgcccaggcaggacttagaaggcacaccttatctggagtcaggaatctctctgttttctgatgaccccgagtcagacccaagtgaggatcgcgcccccgagtccgcaagagtgggcaatatcccaagttctacaagtgcactcaaggtgcctcagctgaaggtagcagagagcgctcaaagccctgctgctgcacacacaaccgataccgcaggttataacgccatggaggagagcgtgagtcgagaaaagccagaactcacggcctccaccgagagggtgaacaaacgtatgagcatggtggtctccggcctgactcccgaggagttcatgcttgtgtacaagtttgcaaggaaacatcacatcaccctgactaacctgattacagaagaaaccacccacgtcgtgatgaaaaccgacgcagagttcgtctgtgaacgaaccctcaaatatttcctaggcatcgcaggcgggaagtgggttgttagttatttttgggttacacagtctattaaggagcgcaagatgctgaacgaacacgacttcgaggttcggggcgatgtggtgaatgggaggaatcaccaggggcccaagagggcaagggagtcacaggacagaaagatcttccgaggtctggaaatctgttgttatggcccgtttactaatatgcccaccgatcaacttgagtggatggtacagttgtgcggggcttcagtggtaaaggagctgagcagcttcactctgggaactggcgtacatcctattgtggtggtgcagcccgacgcatggacggaagataacggctttcacgcaatcggtcagatgtgtgaggcgcccgttgtcacaagggagtgggtcctggactcagtggcgctttaccagtgccaagaactagacacctatttgatccctcagatcccccatagtcactattag

SEQ ID NO: 23080 - DNA, 4875 bp, Artificial Sequence
  Description of Artificial Sequence: Synthetic coding sequence
atggacctgagcgccctgcgggtggaggaggtgcagaacgtgatcaatgctatgcagaagatactcgagtgcccaatctgcttggaacttatcaaagaacctgtgtcaacaaaatgcgaccacatcttctgcaagttttgcatgcttaagctgcttaaccagaagaaagggcctagccagtgtccgctatgtaagaatgacatcaccaagaggtccctgcaggaatctactcgatttagtcagctggtggaggagcttctcaagatcatttgtgcgttccagctggataccggcttggagtatgccaattcctataatttcgcaaagaaagagaacaactcgcccgagcacctgaaagatgaggtttccatcattcagagcatggggtacagaaatagagcgaaacgactcctgcagtccgagcccgagaatccctcgcttcaggaaacttccctgagcgttcaactgtccaaccttggaacagtaaggacactgagaactaaacagaggatccagcctcagaagaccagtgtctacatcgagttagggtctgacagttccgaggacactgtgaacaaagctacgtattgtagtgtgggcgaccaggagttgctccaaataaccccgcagggtacaagagacgaaataagccttgattccgcaaagaaggcagcttgtgaattttccgaaacagatgtaaccaacaccgagcaccaccagccatcaaataacgatctgaacacaacagaaaaaagagcggctgagcggcatcccgaaaagtaccaaggctccagtgtctctaaccttcatgttgagccctgcggcactaacacgcacgcgtcttctttgcagcacgagaattccagcctattgctgacgaaagatcgcatgaatgtggagaaagccgaattctgtaataagtccaagcagcctggtctggcccgctcccagcataatagatgggcagggagcaaggaaacctgcaacgaccggaggacgccttctacagaaaaaaaggttgacctgaacgcggatccattgtgcgagaggaaggaatggaataaacagaagttgccttgcagcgagaatccccgggataccgaagacgtgccctggattaccctaaacagttccatccagaaagtgaacgaatggttcagcaggtctgacgagctgttgggaagcgatgacagccacgacggcgaatcggagtccaatgcaaaagtggccgacgtacttgacgtgctcaatgaagttgacgagtattctggaagctcggagaagattgacctgttggctagcgatccccatgaagctctgatatgtaagagcgagagagtgcattccaagagtgtagaatctaacatcgaggataaaatcttcggcaaaacctacaggaagaaggcatcactcccgaacttatctcatgtgactgagaacctgatcattggcgccttcgttacagagccacagatcattcaggagagacccctgaccaacaaacttaaaagaaagcggaggcctaccagcgggctccaccccgaagattttattaagaaggcagacttggccgtccagaagacccctgaaatgataaaccaggggaccaatcagaccgagcaaaacggccaggtgatgaatatcactaacagcgggcatgagaataaaactaaaggcgactcaatacaaaatgagaaaaatcctaatcctatcgagagtctggagaaggagtccgctttcaaaaccaaggcagaaccaatcagctcttctatctcgaacatggagctggaacttaacattcacaattccaaagcccccaaaaaaaatcggttgcgacggaaaagcagcacccgccacatacacgccctggagctggtggtgtcgagaaatctcagccctcctaactgcaccgaactgcagatcgactcttgctcctcttctgaggaaatcaaaaagaagaagtacaatcagatgccagtccgtcactcacggaatctacagctgatggaaggcaaggaacccgcaactggagccaagaagtccaataagcccaacgagcagacttcgaagcggcacgatagtgacacgtttccagagctgaagctaactaacgcccctggttcgtttactaagtgcagcaatacgtctgaattgaaagaattcgttaacccttctctgccgcgtgaagagaaggaagagaagctcgagacagtaaaggtgagcaacaacgcggaagatcctaaggacttgatgctctctggagagcgagtgttacagactgagcgttccgtcgagtcaagttcaatctctttggtcccagggaccgattatgggacccaggaaagcatctctctgctggaagtcagcaccctcggcaaggccaaaactgagcctaacaaatgcgtctcccagtgcgcagcctttgaaaatcccaagggcctgatccatggttgcagtaaggataacagaaacgacacagaggggttcaagtatcccctcggacacgaggttaaccactctagagagacatccatcgagatggaggagtccgagctcgacgcgcaataccttcagaacactttcaaagtgtccaagcgccagtcctttgcacccttctcaaatcccggtaacgcagaagaagagtgtgccaccttcagtgcacacagtggtagcctgaagaaacaaagcccaaaagtgacattcgagtgtgagcaaaaagaggagaaccagggaaaaaacgagagcaacattaaacctgttcaaaccgtcaatatcaccgctggatttcccgttgtcggtcagaaagacaagcccgtcgacaatgccaagtgcagcatcaagggcggtagcagattctgtctgtcttctcagttccgtggcaacgaaacaggtttgatcacccctaataagcatgggctgcttcaaaacccgtacaggatccccccactcttccctatcaagtcttttgtcaagaccaagtgtaaaaagaatttgctggaggagaactttgaggagcattcgatgtctcctgagcgtgagatgggcaatgagaacatcccctctacagtatccaccatctctcggaataacattcgtgagaacgtattcaaggaagcctcatcatccaacatcaacgaggttggttcctctaccaatgaagtggggtcctccatcaacgagataggatcttctgacgagaacatacaggctgagttgggaagaaaccgaggcccgaagttaaatgcgatgcttcgcctgggggtattgcagcccgaagtttataaacagtccctgccaggctccaactgtaaacatcccgaaatcaagaaacaggagtacgaggaggtcgttcaaaccgtgaacacagacttctccccctaccttatcagcgacaacctcgagcagcccatgggatccagccatgcttcccaggtttgtagtgagactccggatgacttgttggatgacggcgagattaaggaagacacatcttttgccgagaatgacatcaaagaatcttcggccgtgttcagcaaatcagttcagaaaggagagctgtccaggtcaccttctccttttactcacacgcacctagcccagggttatcggaggggtgcaaaaaagcttgagtctagcgaggagaacctgagttccgaggacgaggaattaccttgtttccagcatttattatttggaaaagtgaataacatccctagtcagtctacgagacactcaacagtagcgacagagtgcctgtcaaagaacactgaggagaacctgctgtccctgaaaaactcactgaatgactgcagtaaccaggttatattagccaaggcctcgcaagagcatcacctgagtgaggaaactaaatgtagcgcctccctcttctcctcccagtgctcggagctggaggatctgactgctaatactaacacgcaggatccatttctgataggttcgtcaaaacagatgcgacaccagtcagagtcacaaggggtcggattgagcgataaagaactggtgtccgatgacgaggagcggggtaccggcttagaggaaaataaccaggaggagcaatccatggatagcaatctaggcgaagctgcaagcgggtgcgaatcagagacgtctgtcagtgaagattgctccggcttatcctctcagagcgatattcttacaacccagcagagagatacgatgcaacataatctgattaaactgcagcaggaaatggcagaactagaagcagttctggagcagcatgggtcgcagccttctaattcctacccctcgattatatcggattcttctgccttggaggacctgagaaaccctgagcaatctacttcagagaaagacgccgagtttgtttgtgagaggactttgaagtactttctggggattgcaggaggcaagtgggttgtgtcatatttttgggtgacccagtccatcaaggagcgtaaaatgctcaacgagcacgacttcgaagtgcgaggtgatgtggtgaatggcaggaatcaccagggacccaaacgcgctagggagtcacaagatcgaaagatattccgggggctagaaatatgctgttatggcccatttacgaacatgccaacagaccagttggagtggatggttcagctgtgcggagccagcgtggtgaaggaactgtcaagttttacactcggaactggtgtgcaccccatagtcgtcgtccagcctgatgcgtggaccgaagacaatggctttcatgctatcggccagatgtgtgaggcccccgttgttactagggaatgggtgcttgactctgtagctctataccagtgccaagaactcgatacttatctgataccgcaaataccgcactcccattactag

SEQ ID NO: 23081 - DNA, 2043 bp, Artificial Sequence
  Description of Artificial Sequence: Synthetic coding sequence
atggacctgagcgccctgcgggtggaggaggtgcagaacgtgatcaatgccatgcagaaaattttggaatgccctatttgcttagaactcataaaagaacccgtgtcaacaaaatgcgatcatatattttgtaagttctgtatgcttaagctgctgaatcaaaaaaagggccccagtcagtgtccactgtgtaagaacgacataaccaagcggtcccttcaggagagcacacggttctcgcaacttgtcgaggagttgttgaagatcatctgtgcctttcagcttgatacaggccttgaatacgctaattcgtataactttgctaagaaggaaaacaactcccccgaacatctcaaggacgaagtctcaatcatacagtcaatgggctaccgcaatagggccaaacgactccttcaatcggagccagagaacccttccctgcaggagacttctttgtccgtgcagctcagcaatctgggaactgtccgcacgctgcgtaccaagcaaaggatccagccacagaaaacctccgtttacattgagctgggagaggcagcttccggatgcgaaagtgaaaccagcgtgtctgaagactgtagcggcctgtcaagtcagtcagacattctcacgacccagcagagggacacaatgcagcataacctcattaaactacagcaggagatggccgagctggaagcagttctcgaacaacacggttcacagccaagtaattcctacccatccatcataagtgatagtagtgctttagaggacctgagaaaccccgagcaatcaacttcagagaaggccgtgctcaccagtcaaaaaagcagtgagtacccgatctcacagaatcctgagggcctgtccgctgacaaatttgaggtatcggccgacagctcaaccagcaagaataaagagccgggtgtcgagagaagctccccttcaaagtgtcctagtctagacgacaggtggtacatgcactcctgttctggcagtcttcagaacagaaattatccaagccaggaagagctcattaaggtcgtggatgtggaagagcagcagctggaagagtctgggccacacgatctcaccgagacatcttaccttccaaggcaggatctggaaggcacaccatacctggaatcagggatctcccttttttccgatgaccctgagtcggacccttccgaggatcgcgccccagaatcagctagagtcggcaatattccaagctcgacaagcgcccttaaggtgcctcagttgaaagtggcggaaagcgcccaatctcctgcagcggctcacaccactgacaccgctggctacaacgcgatggaggaatccgtgtcacgcgaaaagcctgagctcaccgcctcaactgagagggtaaacaagaggatgtctatggtcgtgagtggacttactccagaagaattcatgcttgtgtacaagttcgccaggaaacaccacatcaccctcacaaatcttatcaccgaggagacaacccacgtggtgatgaagaccgacgccgaattcgtttgcgaaagaaccctgaagtacttcctaggcatcgccggcggtaaatgggtggtttcttacttctgggtgacacagtccattaaagaacgaaaaatgttgaacgagcacgatttcgaagttagaggggatgttgtcaacggtcgaaaccatcagggcccgaagcgcgcccgcgaatcacaagaccggaaaatctttcgtgggctcgagatttgttgctacgggccttttacgaatatgcccactgaccaactggagtggatggttcagttgtgtggcgcttcagttgtgaaagagctcagctcatttacactgggaaccggagttcatccaatagtcgttgtgcagccagacgcatggacagaagataacgggtttcacgccatcggccagatgtgtgaggcccctgtcgttaccagagagtgggtactggattccgtggcgctgtatcaatgccaggaacttgatacatacctgattcctcaaatccctcactcgcactactag

SEQ ID NO: 23082 - DNA, 2166 bp, Artificial Sequence
  Description of Artificial Sequence: Synthetic coding sequence
atggacctgagcgccctgcgggtggaggaggtgcagaacgtgatcaacgccatgcagaagattctagagtgtccaatttgtcttgaattgataaaagagcctgtatccactaaatgcgaccatatcttttgtaaattctgtatgctgaagttgctcaaccagaagaaaggcccatctcagtgtcccctgtgtaaaaacgatattacgaaaaggagcttgcaggagtctactagattttcacagttggtagaagagctgctgaaaattatctgtgcctttcagctcgataccggcctcgagtatgcgaactcatataatttcgccaagaaagagaataattctcccgaacatctgaaggatgaggtatccatcatccagagcatggggtatcgcaatcgcgcaaaaaggctcctgcagtctgagcccgaaaatccctccctacaggagacatcactgagtgtgcagctgagcaatttaggcactgtccggaccttgcgaacaaagcagagaatccagccccagaaaactagcgtgtacattgaactgggcagcgactcttcggaagatacagtcaataaggcaacctactgctccgtgggggatcaggagctcctacagattacaccacaggggacacgcgatgaaatctccttggattcagcgaagaaaggtgaagctgccagtgggtgcgaatcagaaacatccgtgtcagaggattgttcgggcctctcttctcagagcgacattttgaccactcagcagcgagatactatgcagcacaacctcattaagcttcagcaagaaatggcagaacttgaggctgttctggagcagcacggtagtcagcccagcaacagctatccctcaatcatcagcgatagtagcgccctagaggacctcaggaatcccgagcagagtacgtcagagaaggccgtgctgacatctcagaagtcaagcgagtaccctattagccagaacccagaaggactctcggccgataaattcgaagtgagcgcggacagcagcacctccaagaacaaagaaccaggcgtggagcggtcttcgccgagcaaatgccctagcctcgatgacagatggtatatgcattcttgcagtggttctctccaaaaccggaactacccgtcacaggaagagctgattaaggtggtggacgtcgaggagcagcaactggaggaaagtgggccacatgatttgactgaaacatcctacctgccaagacaagatctggaggggaccccatatttggagtccggcataagtctgttctctgatgatcccgaatctgatccctcggaggaccgggctcccgaatccgctagggttggcaatatcccctcttccacatccgccctcaaggtgccccagctgaaggtcgctgagtctgcccagtctcccgccgccgctcataccactgacaccgccggatataacgccatggaggagtccgtatctcgcgagaagcctgaactgacagcctccaccgaaagagttaacaagcggatgtctatggtggtcagcggcctgacaccggaagaattcatgctggtgtataagttcgctcgaaagcatcatatcacccttaccaacttgatcaccgaagaaacgacgcacgtcgtgatgaaaactgacgctgagttcgtctgcgagcggaccctgaagtactttctgggaatcgccggcggcaagtgggtcgtttcatatttttgggtgacccagtcgattaaggaaaggaagatgttgaacgaacatgattttgaggtcaggggcgatgtggtcaatggcaggaatcaccagggtccaaagagggctcgtgaatcacaggacaggaagatatttagaggcctcgaaatatgttgttatggtccttttacaaatatgcccacagaccagttagaatggatggtgcaactgtgcggcgcaagcgtcgtcaaggaactaagctccttcaccctcggcaccggcgtacaccccatcgtcgtggtacagccagacgcctggacagaagataatggcttccacgcaatcgggcagatgtgtgaagcccccgtggtcacccgggaatgggtgttggacagtgtggcgttgtaccagtgccaagaactggatacatatctgatccctcaaatccctcactcccattactag

SEQ ID NO: 23083 - DNA, 4797 bp, Artificial Sequence
  Description of Artificial Sequence: Synthetic coding sequence
atggacctgagcgccctgcgggtggaggaggtgcagaacgtgatcaatgcaatgcaaaaaatactggaatgtcccatctgtctcgagttgatcaaagaaccagtcagcacaaaatgtgatcacatcttttgtaagttttgcatgttaaagctgcttaaccaaaaaaagggtccgtctcagtgtcctctgtgtaagaatgatatcacgaaacgctctctccaagagagcacacgcttcagtcagctggtggaagagttgctgaaaatcatatgcgccttccaattagataccgggctggagtatgccaactcctacaacttcgccaagaaagaaaacaacagtcctgaacacctgaaggatgaagtttccatcatacagagcatggggtacagaaaccgggcaaaacgattgttgcagtctgagcccgaaaatcctagcctgcaggagacttcactgtccgtgcaactgtctaacctcgggacggtacggacgctcagaacaaaacagaggatacaaccgcagaagacgagcgtttacatcgagctgggctcagactccagcgaagataccgtcaacaaagccacttactgcagcgtgggagatcaggagcttcttcagatcactccgcaaggcacacgggacgagatctctctcgacagtgcaaagaaggccgcatgcgaattttcagaaacagatgtgaccaacacggagcatcaccaaccctccaacaacgatctgaataccaccgagaagagagcagcagagagacatcccgagaagtaccaaggcagttctgtctctaatctacacgtggagccctgtggaacgaacacgcatgcatcctctctgcagcacgagaacagcagtctcctgctcactaaggataggatgaatgtggagaaagcagaattctgtaacaaaagtaagcagcctggcctagcccggagccagcacaacaggtgggccggcagtaaagagacgtgtaatgacaggcggaccccctccacagagaaaaaggtagatctgaatgcagacccgctgtgcgaaagaaaagagtggaataagcaaaagctgccttgctcggagaaccctagggacactgaggatgtgccgtggatcactctcaattcctccatccaaaaagtaaacgagtggttttctagaagcgatgaactcttgggatcagacgattcccacgatggtgaatccgaaagcaacgcaaaggtggccgacgtgctggacgtgttgaatgaggtcgacgagtatagcgggtcctcggaaaaaatcgatctcctggcaagcgacccccacgaagccctgatttgcaaatctgaacgcgtgcacagtaagtccgttgagagtaatattgaagataagattttcggcaagacatatagaaagaaagcaagtctgcctaacttgagtcatgttaccgaaaatctgatcatcggggcattcgttacggagccgcagatcattcaggagcgcccgctgaccaacaaactgaaacgaaagcggcgccccacgagcggtctccatccggaggatttcattaagaaagctgatttagctgtgcagaagacccctgaaatgatcaatcaagggaccaaccagactgagcagaatgggcaagtgatgaatattaccaactcaggccatgagaacaaaaccaagggggactccattcagaacgagaaaaaccccaaccctattgaaagcctcgagaaggaaagcgcatttaagacaaaggcagagcctataagttcttcaattagcaacatggagcttgaactcaacattcataatagtaaggcgccaaaaaagaacaggcttaggagaaaatcttcaacaagacatatccatgcgctcgagctcgtggttagtcggaatctctcaccacctaattgcactgaactgcaaatagattcttgctctagcagcgaagagataaaaaagaaaaagtacaaccagatgcccgtgcggcactcacggaacctgcagctcatggaaggcaaggagcctgctactggcgctaaaaagtccaataagcctaacgaacagactagtaaacggcacgacagcgacactttccccgaactcaagctcacgaatgcccctggcagcttcaccaagtgctcaaacacttctgaactcaaggagtttgtgaatccatccctgcccagggaagagaaagaagagaagttggaaactgtgaaggtttctaataacgccgaggacccgaaagatctgatgttgtctggggagcgcgtgctgcagactgagcgttcggttgaatcttcatcaataagcctagttcctggtactgactatggtacccaggagtctatctcactcctcgaggtctcgacgctcggcaaggctaagaccgagcccaacaaatgcgtttcacagtgtgctgcttttgaaaatcctaaagggctgattcatggatgtagtaaggataacaggaacgatactgaaggtttcaaataccctctgggccacgaagttaaccattctagagagacctccattgagatggaagaatccgaattggacgcacaatatctccagaacacgtttaaggtgagcaagcgccagtctttcgcccccttctctaatcccggcaatgcggaagaagagtgtgcaaccttctccgctcattctggatcgcttaaaaagcagtcccctaaagttaccttcgagtgtgagcagaaagaagagaatcagggcaagaacgagtccaacattaagcccgttcagacagtgaacatcacagcaggcttcccggtggtcggacagaaagacaagcccgtagacaacgccaaatgcagtattaaaggcgggtccagattctgtctctccagtcagttccgcgggaatgagaccggtttgatcacaccaaataagcacggattgctccagaatccgtatcggattccacccttgtttcctatcaagtctttcgtgaaaactaagtgcaaaaaaaaccttctggaggaaaattttgaggaacattcaatgagccccgagcgagaaatgggcaacgaaaatattcccagtaccgtgagcacgatttcccggaacaacatacgcgaaaacgtatttaaagaggcctcaagcagcaatatcaatgaagtgggcagctcgactaacgaggtcggatcatctataaacgaaatcggaagctcagacgagaatatccaagccgaactagggcgaaataggggtcctaaactaaacgctatgctccgattgggggtcttgcaacccgaggtttacaagcagtcgttaccaggatcgaattgtaagcatcctgaaatcaaaaaacaggaatatgaagaggtcgtccagacagtcaacaccgacttttccccttatcttatctctgataatctggagcagcctatgggctctagccacgcgtcacaggtttgttctgaaacacccgacgatctgctcgatgatggggaaattaaggaggatacatcattcgctgaaaacgacatcaaggagtctagtgcggtcttttctaaaagcgtgcagaagggagaactttctcgtagtccttcccctttcacccacacccacctggcccaggggtatcggcgcggcgccaaaaaactcgaaagtagtgaagagaacctgagctcagaggatgaggagctcccatgttttcagcatctgttgtttggaaaagtcaacaacatccccagtcagtccacccgacatagcacagtggctactgaatgtctgtcaaaaaatacggaggaaaatctcctcagtctcaagaattcgttgaatgactgctcgaaccaggtgatcctggctaaggcctctcaggagcatcatcttagcgaggagactaaatgtagcgcaagcctctttagcagccagtgtagtgagctcgaagacctcacagctaacactaatacacaggatcctttcctgatcggaagctctaaacagatgcgacaccagagtgagtcacagggagttgggctttcagacaaggagctggtgagcgacgacgaggaaagaggaaccggtcttgaagagaataatcaggaggagcagagcatggattccaatttgggcgaggcagcttccggatgtgaatctgaaaccagcgtgtccgaagactgctccgggctgtcttcccagagcgacatccttacaacccagcagcgtgacacaatgcagcataacctcataaaactacagcaagaaatggctgaactggaagccgtgctggagcagcacggatctcagcccagcaattcatatccctctataatatctgattcttcagctctggaggatttgaggaaccctgaacagagtacctccgaaaagggcgtgacgcagtctatcaaggagcgcaaaatgctcaacgagcatgatttcgaagtcagaggtgacgtggtgaatggtcgtaaccatcaaggtcccaaacgcgctagggaatctcaggatcgaaaaatcttccgcggccttgaaatttgttgctacggccctttcactaacatgcccacagaccagctagagtggatggtgcaactctgcggtgcaagcgtagtgaaggaactgagctctttcactctgggaacaggcgttcaccctattgtggtcgtgcagccagacgcctggacagaggataacggttttcatgctattggtcagatgtgcgaagccccggtagtgacaagagagtgggttctggacagtgtggccctctatcagtgccaggaacttgacacctacctgattccgcaaataccccactcgcactactag

SEQ ID NO: 23084 - DNA, 5592 bp, Artificial Sequence
  Description of Artificial Sequence: Synthetic coding sequence
atggacctgagcgccctgcgggtggaggaggtgcagaacgtgatcaacgcaatgcagaagattctggagtgtcctatttgcttagagctgattaaagagcctgtgtcaactaagtgtgaccatattttttgtaagttctgcatgttgaaattgctgaaccagaaaaagggacccagtcagtgcccgctctgcaagaatgatattaccaaacgtagcttgcaggagagtacgcggttctcacagctcgtggaggaattgctgaaaattatttgcgcattccagctggataccggtctggagtatgctaactcttacaactttgccaagaaagagaataactcgccagagcatttgaaagacgaagtgtcaatcattcagagtatgggctaccgaaaccgggccaagaggctcctccagagcgaacccgagaatccctcattacaagagacatctctgtcagtccaactgtccaacctgggaacagtgcgaaccctaaggacaaagcagcggatccagccccagaagaccagtgtgtatatcgagctggggtccgactccagcgaggacacagtgaacaaggcgacttactgttcagtgggcgatcaagagctcctgcagatcacaccccagggaacccgcgatgagatctcgctggattccgctaagaaagccgcgtgtgaattcagtgagactgatgtgactaacactgaacatcaccagccctcgaacaacgacctcaatactactgagaagagagccgcagagcgccatccagagaaataccaaggcagctctgtgtctaacttgcacgttgagccatgtggaacgaatacacatgcaagctccctgcagcacgaaaacagcagcctgttactcaccaaggaccggatgaatgtcgagaaggccgagttctgcaacaagtccaagcagcccggactggcacgatcacaacacaaccggtgggctggctcaaaggagacgtgtaatgatcgcaggacacctagcacagagaaaaaggtggatctcaacgctgaccctctgtgcgagagaaaggagtggaataaacaaaagcttccatgttctgaaaatcctcgtgatacggaggatgtcccttggattaccctgaactcttcaatacaaaaggtgaacgagtggttctcaaggagcgatgagctcctgggaagcgacgattcacacgacggggaaagtgagtcaaacgcaaaagtggctgatgtcctggacgtcctgaatgaagtcgatgagtatagcggttcatcagagaaaattgatttactggcctcagaccctcatgaagctttgatttgcaagagtgaaagagtacattctaaatctgtcgagagcaatatcgaggataaaatcttcggaaaaacgtatagaaagaaagcctcgctgccaaatctcagtcatgtgacagagaaccttattataggcgcatttgtgactgagcctcaaatcattcaggaacgacccctcacaaacaagttaaaaaggaagcgccggccaacaagtggcctgcaccccgaggactttattaagaaggctgacttggccgttcagaagacacctgagatgatcaatcagggtacaaatcagactgagcagaatggccaggttatgaacatcacaaattcaggccatgagaataagaccaagggcgacagcatccagaatgagaaaaatcccaatcccatagaatctctggaaaaggaaagcgcgtttaagactaaggcagagccaatttcgtcctccatctccaatatggagcttgagttgaatatccacaactcgaaggcccctaaaaagaacaggctccgcagaaagtctagcacccggcacattcatgctcttgaattggtggtctcacgcaatcttagtccccctaattgtacagaacttcagatcgactcgtgcagttcctctgaagaaattaagaagaagaagtacaaccaaatgccagtgcgccactcacggaaccttcagctgatggagggaaaagaacccgctaccggagcgaaaaagagcaataagccaaatgaacaaacttccaagcgtcacgacagtgataccttccctgagctgaaactgacaaatgcaccgggaagcttcaccaagtgtagtaacaccagtgaactgaaagagttcgtaaacccatctctccctagagaggagaaggaggaaaaactggagacagtcaaagtgtccaacaatgctgaggacccgaaggatctgatgctcagcggcgaaagagtgctacagactgagcggtctgtcgagtcttcctctatctctctggtgcccgggacagattacggaacgcaggaatccatttccctgttggaagtgtcaactctgggcaaagcgaagaccgagcccaacaaatgcgtatcccagtgtgccgcttttgagaaccccaaaggcctcattcatggctgttctaaggataatcgtaatgacacggaaggcttcaagtatccattggggcacgaggtaaatcactcccgagaaacgagtattgagatggaggaatcggaacttgatgcccagtacctccagaatacattcaaagtatcaaagcggcagtcgttcgcccccttctccaatccaggtaacgcggaagaggagtgcgctaccttctccgcgcacagcggctcattaaagaagcaatcgcccaaagttacctttgaatgtgagcaaaaagaagaaaatcagggtaagaacgagagcaatattaaaccagtgcagactgtgaatattaccgcggggttccccgttgtagggcagaaggacaagccagttgataacgccaaatgttcaattaagggaggcagcaggttttgcctgtcctcccagttcagagggaatgagacagggctgataacccccaacaagcatggtctcctgcaaaacccataccggatcccacccctgtttcctatcaagtcatttgtaaagacaaagtgcaagaaaaacctacttgaggagaactttgaagagcacagcatgtcaccagaaagggaaatggggaacgagaatatcccgtctactgtgagcaccatctctagaaataacatcagggagaacgtttttaaggaagcctccagttccaacatcaacgaggtcggaagtagcactaatgaggtgggaagctcaatcaatgagataggttcatctgacgaaaacatccaagcagagctcgggcggaaccggggccccaagcttaacgccatgttgaggctcggtgttctccagcccgaggtttacaaacaaagtcttccagggagcaattgtaagcaccctgagatcaaaaaacaggagtatgaggaggtcgtccagactgtgaataccgacttctctccatatctgatctccgataacctggagcagcctatgggctcatctcatgcaagccaggtttgctcggaaacccccgatgatctcctggacgacggtgagatcaaggaagatacgtcttttgcagagaacgatatcaaggaaagcagtgccgtctttagcaagtcagtacagaagggggaactgagtaggtcaccgagtcctttcacacacacccatcttgcacaagggtataggcggggagccaagaaactagaaagctcagaggagaaccttagttcagaagacgaagagctgccatgcttccagcatctgctgtttgggaaggtgaacaacattccatctcagtctactagacacagcacagtggccacggagtgtctttccaaaaacactgaagaaaatttgctgtcactgaaaaattcgctaaatgattgttcaaaccaggtcattctagccaaggcttcgcaggagcaccatctgagtgaggagaccaaatgttccgcctcactattctcctctcagtgtagcgaacttgaagacctgaccgccaacaccaacacgcaggatccgttcttgattggctcatctaagcagatgcggcatcagtccgaaagtcaaggagtcgggctctccgacaaagagctggttagcgatgatgaagagagggggactggcctcgaagaaaacaaccaggaggagcagtcaatggactccaacctgggcgaggccgcctccggatgtgagtcagagacatcggttagcgaagattgctccgggctgagctcccagagcgatatcctcacgactcaacaacgggataccatgcaacataatcttatcaaattacagcaggagatggcagaactggaagcagtgctcgagcagcacggtagccagccgtcaaactcctacccttctatcatatccgattcctccgcgctcgaggatctgcgcaaccccgagcaatccaccagcgaaaaggccgtccttacttctcaaaagtcatctgagtatccgatatctcagaatcccgagggcttgtctgctgataagttcgaagtatcggcggatagctctacttcgaaaaacaaggagccgggggtagaaaggtcatccccaagcaaatgtccctcattggacgatcgttggtacatgcattcttgctccgggtctcttcagaaccggaactatccttcccaggaagaattgattaaggtggtcgatgtcgaagagcagcaacttgaggaatcgggcccgcacgacctgacagagaccagctatctaccaagacaggacttggagggtaccccctacctagagtccggaattagcctattctctgacgatccggagagcgatccctctgaggaccgggcacctgagagcgctcgggtggggaatatcccctcatcaacctccgccctgaaagtgcctcagcttaaagttgctgagagtgctcaatctccggccgcagcacacactaccgatactgcaggttataacgcaatggaggagtcagtgtcccgggagaaacccgaactgacggccagcaccgagcgcgtcaacaagcgaatgtctatggtcgtgtctggactgactccagaagaatttatgcttgtatacaagttcgcccgaaagcatcatataactcttacaaatctcattacagaagagaccactcatgttgtgatgaaaactgatgcagaattcgtgtgcgaaagaacactcaaatactttttgggaattgcggggggaaagtgggtcgtgtcttatttttgggtaacacagagcattaaggaaaggaaaatgttaaacgagcatgattttgaggtgagaggagacgtcgtcaacggccggaaccaccagggccccaagcgcgcaagagagagccaggacagaaagatttttcgcgggctagaaatatgctgctacgggccatttaccaatatgccaactgaccagttggagtggatggtccagctctgtggggcctcagtagtgaaagaactgtcttcctttactctggggaccggtgtgcacccgatcgtcgttgtacagccagacgcttggactgaggacaacgggttccacgccatcggacaaatgtgcgaggcaccagtggtcactagggagtgggtgctcgactcggtggcgctgtatcaatgtcaagaattggatacgtacctaattccgcaaattccacactcccactactag

SEQ ID NO: 23085 - DNA, 2139 bp, Artificial Sequence
  Description of Artificial Sequence: Synthetic coding sequence
atgctgaagctgctgaaccagaagaagggccccagccagtgccccctatgcaagaatgatataacgaagcgctccctgcaggaatccacgcgatttagccaactcgtggaggagctcctaaagatcatttgtgccttccaactcgacacaggcctggagtatgctaattcctataactttgctaaaaaggaaaacaattctccagaacatctcaaggacgaggtctccataatacagagtatgggttataggaatagagcaaagaggctactccagtccgaaccagagaatccatctctccaagagaccagtctgagtgtgcaattaagcaatttgggcactgtgaggacactcaggaccaagcagaggatccagccccagaagacatctgtttacatagagcttggatcagattccagcgaggacaccgttaataaagctacttactgtagtgtcggggatcaagaactgcttcagattaccccacagggaacaagagatgagatctccctggatagcgccaaaaaagccgcatgtgaattctccgaaaccgatgtaacgaacactgaacaccaccaaccatccaataacgacctgaacacaactgagaagcgggctgctgagaggcacccggaaaagtatcagggcgaagctgcgtctggatgcgagtctgagacctctgtgagcgaagattgcagcggtcttagctctcagagcgacatactcactacacagcagcgggacacaatgcaacataacctaatcaagctccaacaggagatggccgagcttgaagctgtgctcgaacagcacggatctcagccttccaactcataccctagcatcattagcgattcatccgctcttgaggatctccgaaatccagagcagtcaacttcagagaaggttttgacatctcaaaagagtagcgagtaccctatttcgcaaaatccagagggcctgtccgccgacaagtttgaggtgagcgctgactcaagtacgtcgaaaaacaaggagcccggagttgaacggagctcgccatctaagtgcccctcgctggacgatcgctggtacatgcacagctgttctggaagcctgcagaacagaaactatccttctcaggaggagttaatcaaggtggtggacgtagaggagcagcagctggaagagtccgggccacatgatctgaccgaaacctcctatttgccacgtcaagatctggagggcacgccgtaccttgaaagtggtatcagcctcttcagtgatgatccagaatctgacccttcagaggaccgagctcccgaaagcgctcgtgtgggtaacatccctagctcaacctctgcactcaaggtgccacagctgaaagtggctgaatcagcacagtccccagccgcagcccacacaaccgacacagccggttacaatgcaatggaggaaagcgttagcagagaaaagcccgagctgaccgccagcaccgagagagtgaataagcggatgtcaatggttgtgagtggtttgacaccagaggagtttatgctggtctacaagttcgcgaggaagcatcacatcactctcacaaatctgattaccgaggagaccacccacgtggtcatgaagactgacgccgaattcgtgtgtgagaggaccctgaagtactttctgggaatcgcaggcggtaagtgggtcgtttcctacttctgggtgactcaatctatcaaagaaagaaagatgctcaacgagcacgatttcgaggtccgcggcgacgtggtgaatggtcggaaccatcagggcccgaaacgggccagggagtctcaagatagaaagatcttccggggcctggagatctgttgttacggaccctttacaaacatgcccactgatcaactcgagtggatggtgcagctttgcggcgctagcgtcgtgaaggagctgtcatctttcaccttaggcacaggcgtgcatcccattgttgtcgttcagcccgacgcatggacagaagacaacggcttccatgcgataggacaaatgtgcgaggcaccggtggtgacccgtgaatgggtcttggattctgtggctctctaccagtgtcaggaattggatacatatctgatccctcagattcctcattctcattattag

SEQ ID NO: 23086 - DNA, 5655 bp, Artificial Sequence
  Description of Artificial Sequence: Synthetic coding sequence
atggacctgagcgccctgcgggtggaggaggtgcagaacgtgatcaatgctatgcagaaaattctcgaatgccccatctgtctggaactgattaaggagcctgttagtactaaatgtgaccatattttctgcaaattttgcatgttaaagcttctgaaccagaaaaaagggccttcacagtgtcctctatgtaaaaacgacatcaccaaacggagccttcaagagtctacacgtttttcccagcttgtcgaagagctgcttaagattatatgcgcttttcagctggacactggcctagaatatgcaaactcctataattttgccaaaaaggagaataactcaccagaacacctgaaggatgaagtgagtattattcagtcaatgggatataggaacagggccaagagattgttgcagagtgaacccgaaaacccgtctttgcaggagacttccctgtcagtgcaactctcgaatctgggtaccgtcagaactctgcgcaccaaacagagaatccagcctcagaagacctcagtttacattgagttgggatccgacagctccgaggataccgttaacaaagccacgtactgctcagttggggatcaggaattgttgcagattacaccacagggaacgcgggatgaaattagtttagattccgcaaagaaggctgcatgcgagttttcagaaacagacgtgaccaacaccgagcatcaccaaccctctaacaatgatctgaatactactgaaaagcgtgctgccgagagacacccagagaagtatcagggatctagcgtgagtaatctccacgtcgagccgtgcggaacaaatacgcatgctagctcccttcagcatgagaattccagcttgctactgactaaagaccgcatgaatgtggaaaaggccgagttttgcaacaagtctaagcaaccagggctcgcccgctctcagcacaatcgatgggccgggagcaaagagacatgcaatgatcggaggaccccctccactgagaagaaggtggaccttaacgcagatcccctgtgtgaacgcaaagaatggaacaaacagaagctaccctgttctgaaaatccaagggatacggaagatgtaccctggattactctgaacagtagcattcaaaaagtgaacgaatggttttcccgatccgatgagcttttgggaagcgacgattcccatgatggggagtccgaaagtaacgcgaaagtggccgatgtcctggacgtccttaatgaagtggatgaatacagcggcagctctgaaaaaatcgatcttctagctagtgatccgcacgaagccctcatctgcaagagcgagcgggtccactctaaatctgtcgaaagcaacatagaggacaagattttcggcaagacatatcgcaagaaggctagtcttccaaacttgtctcatgtcacggaaaacctgattatcggcgccttcgtgaccgagcctcagataatccaggagaggccccttacgaacaagctcaaaagaaagagacgccccaccagcggacttcaccctgaagatttcattaaaaaagctgacctcgcggtgcagaagactcctgaaatgataaatcaagggacgaatcagaccgagcagaatggacaggtcatgaacataactaattctggccatgagaacaagaccaagggagatagcatccaaaacgagaagaatccgaatcctattgagtcgctagaaaaggagagcgcctttaagaccaaggcggaacctattagcagctctatctctaatatggagctggaactgaatatacataactccaaggcacctaagaagaacagactccgacgaaagtcaagtacccgccacatacacgccctcgagttagtcgtgtccaggaaccttagccctcccaattgtaccgagctccaaatcgactcatgctcttccagcgaggagatcaagaagaagaagtataaccagatgcctgtccgtcatagtcgcaatctccagttgatggaggggaaagagccagctaccggcgctaagaaatccaacaagcccaacgaacagacctccaaacggcatgatagtgacacattcccagagttaaagctgacgaacgctcccggatcctttaccaaatgcagcaataccagcgagctgaaggaattcgttaacccctccctgccaagggaggagaaggaggagaagctggaaaccgtgaaggtgtcaaacaatgccgaggatcccaaagacctgatgctgtccggggaacgggtattgcagacagagcggtcagtcgagagctcttcaatatcactcgttccaggtactgattatggtacccaggaaagtataagcctgcttgaggtttccaccctggggaaggcaaaaactgagcccaataaatgtgtttcgcagtgtgctgcattcgagaaccccaaaggtctgatacatggctgctcgaaggataatcggaatgatactgaggggttcaagtaccccctggggcatgaggtgaatcacagtagagaaacaagtatcgagatggaggagtcagagctcgatgcacagtacctccagaacacattcaaggtgtccaagcggcagtcattcgctcctttctctaaccccggtaacgctgaggaagagtgcgccacattctcagctcattctggctccctcaagaaacagtctccaaaagtgaccttcgaatgtgaacagaaggaggagaaccaagggaagaacgagtccaacatcaagcctgtacaaactgtgaatattactgctggcttccccgtggttggccagaaggataaacccgtggataacgcgaagtgtagcatcaagggggggagcagattctgcttgagctcacaattccggggcaacgagactgggctgattaccccaaataaacacggtctcctgcagaacccatatcggatcccccctctgttccctattaagtcatttgttaagaccaagtgtaagaaaaacctcttggaagagaacttcgaagaacactccatgagtcccgagagagagatggggaatgaaaacattcccagtaccgtttccacgattagtcgcaataatatcagagagaatgtattcaaggaggcatcctctagcaatataaatgaggtcggctctagcacaaacgaggtcggatctagtataaatgagatcgggagttctgacgagaacatacaggctgagttgggaaggaacaggggacctaagctgaacgccatgttgcggttgggggtcctgcaacccgaggtctacaaacagagtctgcctggctcgaactgcaagcatccagagattaagaagcaggaatatgaagaggtagtccagacagtgaacaccgatttcagcccttacctgatctctgataacttagagcaacccatggggagtagccatgcttcacaagtatgctccgagacaccagatgacctgctggacgacggtgagatcaaggaggacaccagttttgcggagaacgacattaaggaatcaagtgccgtcttttcgaagtcagtgcaaaaaggtgaactgagcaggagtcctagccccttcactcatactcatcttgcacaaggttatcggcgtggagccaagaagctggaatctagcgaagagaacttatcaagtgaggacgaggagcttccatgcttccaacacttattattcggaaaggtgaacaatatcccatctcaaagcacccgccactccactgtggcaaccgagtgcctctcgaaaaacaccgaggagaacctcttaagcctcaagaattctttgaatgactgctccaatcaggtgatcctcgcgaaagccagccaggaacaccacctctccgaggagacaaagtgcagtgcaagtctgttctcctcacagtgcagcgagttggaggacttaacagccaatacgaacactcaggacccattcttaatcggatcaagcaagcaaatgcggcatcagagcgagtctcagggggtagggctgtctgataaggaactcgtgagtgacgacgaggaacgaggtaccggactggaggagaataatcaggaagagcagtcgatggatagcaacctgggtgaggccgcctccgggtgtgaatcagagacctctgtgtccgaagattgttcaggcctgtcctctcagtcagatattttaacaacccaacagagggacaccatgcagcacaacttgatcaagttacagcaggagatggccgaactcgaggccgttttggagcaacatgggagccagcctagtaattcgtaccccagcattatttcagatagctcggcactggaggatctgaggaacccagaacagagcacctcagagaaggactcccatatccatggtcagagaaacaactctatgttttcaaaaagacccagagagcacatcagcgtccttacgtctcaaaagtcaagcgaatatcctatatcacagaaccccgaaggcttatcagcagataagtttgaagtttctgcggactctagcacatctaagaacaaggagcccggggtggaacggagtagcccttccaagtgccccagtctggacgatcgatggtatatgcatagctgtagcggctcgctacagaataggaattatccctcgcaggaagaactgattaaagtcgttgatgtcgaggagcagcagctggaagaaagcggaccacacgacctcaccgagacaagctacctgccgcggcaggacctcgaggggaccccctatcttgagagtggaatcagtctctttagtgatgatcctgaaagcgacccgagcgaggatcgggcaccagaatcagctcgcgtcggcaatatcccctcatcaacaagtgccctgaaggtcccccaattgaaagtggccgagagcgctcagagccccgctgcagcacacactaccgacacagctggctataacgctatggaagagtccgtgtctagagagaagcctgagctgactgcctccaccgaaagggtgaacaagcgaatgtcaatggtggtgagcggattgacaccggaggagtttatgctggtgtacaaatttgcacggaagcaccacatcaccctgaccaacctgattactgaagagacgacccacgttgtcatgaagaccgacgccgagtttgtctgtgaacggacactgaagtactttttagggatagctgggggcaagtgggtggtgtcttatttctgggtgacccagagcatcaaagaaagaaagatgttgaacgagcatgactttgaggtgaggggtgacgtcgtgaacggaaggaaccaccaaggacccaagcgggccagggagagtcaggaccggaagatatttcgagggctcgagatctgctgctacggaccatttaccaacatgcctaccgaccagctcgagtggatggttcagctgtgcggggcctcggtcgttaaggagctcagttcgttcaccttgggcactggggtgcaccctatcgtggtggtgcagcccgacgcgtggactgaggataacggattccacgcaatcggccagatgtgtgaagcccctgtagtaactcgtgaatgggtactcgatagtgtggccctctatcagtgtcaagaacttgacacctacctgattccgcagatcccacatagccactattag

SEQ ID NO: 23087 - DNA, 192 bp, Artificial Sequence
  Description of Artificial Sequence: Synthetic coding sequence
atggacctgagcgccctgcgggtggaggaggtgcagaacgtgatcaacgctatgcagaaaatcttggaatgcccaatctgtctggaattaatcaaagaacctgtgagtacaaagtgcgaccacatcttttgtaagttctgcatgctgaagctacttaaccagaaaaaaggcccctctcagtgtccactctag

SEQ ID NO: 23088 - DNA, 192 bp, Artificial Sequence
  Description of Artificial Sequence: Synthetic coding sequence
atggacctgagcgccctgcgggtggaggaggtgcagaacgtgatcaatgccatgcaaaagattctcgagtgtccaatctgtctggaactgattaaggaaccagtaagcacaaagtgcgaccacatcttttgtaaattctgtatgctgaaactgttaaaccagaagaagggtccatcacagtgtcctctgtag

SEQ ID NO: 23089 - DNA, 2100 bp, Artificial Sequence
  Description of Artificial Sequence: Synthetic coding sequence
atggacctgagcgccctgcgggtggaggaggtgcagaacgtgatcaacgcaatgcagaaaatcctggaatgcccaatttgtctggagctcataaaggagccagtgtcgactaagtgcgatcatattttctgcaaattttgtatgctcaagctgctgaaccagaagaagggcccttcacaatgcccgctctgtaaaaatgatatcacaaaacgtagcctacaggagagtacacgcttttcacaattggtggaagaactcttgaaaatcatctgcgccttccagctcgatactggcttagaatatgctaactcctacaactttgctaagaaagagaataattccccagaacacctgaaagacgaggtcagcattatccaaagtatggggtatcgcaatagggctaaaagactgttacagtcagaacctgagaatccttcactacaggagacttcgctgtcagtgcagttgtcgaatttggggactgtgaggaccctccgaaccaaacaacgcatccagccacagaagacttcagtgtacattgagctggggtcagatagctccgaagacacagttaataaggccacctattgttcagttggggatcaggagctcctgcaaatcacccctcagggcacaagggacgagatatcactcgacagcgccaagaaggccgcttgcgagttttcagagacagacgttacaaataccgaacaccaccagcctagcaacaacgacctcaacacaactgagaaacgagctgccgaacgccacccagaaaagtatcagggtgaagccgccagcggctgtgagtcagagacaagcgtctcagaggattgctccggcctgtccagtcaaagtgacatactcaccacacagcaaagggacaccatgcaacataatctcatcaagttacagcaagagatggctgaactggaggcggtattggaacagcatggcagccagccttctaatagttatccatctattatttctgattcatctgcactggaagatctgaggaatccggagcaatcaacgagtgaaaaggttctgacctcacagaagagctccgagtacccgatctctcagaaccccgaaggcttatcggccgacaaattcgaggtgagtgccgattctagcacctccaaaaataaggagccaggggtggagcggagcagtccaagcaagtgcccttctctcgatgatcgctggtatatgcactcgtgtagtggttcactgcagaaccgaaattatcccagccaagaggagctgatcaaagtggtcgatgtggaagaacagcagctggaagagtctggaccacatgacctgactgagacaagttacctgccacggcaggatttggaaggaaccccctacctcgagtccggaatcagcctgttttccgacgaccctgaatctgatcctagcgaagatagggcgccagagtcagcccgggtcggcaacattccctccagcacctcagccctgaaggttccccagcttaaagttgctgagtctgcccagagccccgccgctgcacacactacggatactgccgggtacaatgccatggaagagtccgtttccagagagaagccagagctaacagcgtctactgaaagggtgaacaagcgtatgagtatggtagtgtcaggcctgacacctgaagagtttatgctcgtgtataaatttgcacggaagcatcatataaccctgacaaatttgatcactgaagagaccacccacgtcgtgatgaaaacagatgctgaatttgtgtgcgagcggaccctcaagtacttcctgggcattgccggcgggaagtgggtcgtgagttatttttgggtgactcagtctataaaggagcgaaagatgctcaatgagcacgacttcgaggtacgcggagacgtggtgaatgggcggaatcatcagggtcccaagcgtgctagagaaagtcaggatcggaagatatttcggggcctggaaatctgttgttatgggccgttcaccaacatgcccaccggatgcccgccaaattgtggatgtgccgcgcgctgtctggatcggggacagtggttgccctgtaactgggctgacgtgtag

SEQ ID NO: 23090 - DNA, 1950 bp, Artificial Sequence
  Description of Artificial Sequence: Synthetic coding sequence
atggacctgagcgccctgcgggtggaggaggtgcagaacgtgatcaacgcaatgcagaagattctcgagtgcccaatttgcctcgagctgattaaggaacctgtgagcacgaagtgcgatcacatcttctgcaagttctgcatgctgaaactgctgaatcagaagaaagggccaagccaatgtcccctttgtaaaaacgatataactaagcggagtctccaggagagcacaaggtttagtcagctggttgaggagctgttgaagatcatttgtgccttccaattagacaccggtcttgagtacgccaacagctacaatttcgccaagaaggaaaacaattcacccgaacacctgaaagacgaggtttccatcatccagtccatgggataccgaaatcgcgcaaaacggctgttacaatcagaacccgagaatcctagcctgcaagagacatccttgagtgttcagctgtccaacctcggaaccgtgagaaccctacggaccaaacaacggatacagccacagaaaacgtccgtttacatcgaactcgggagcgacagctccgaggatacagtcaacaaagccacttactgtagcgtgggcgaccaggagttgctacagattactcctcagggaactagagatgaaatcagtctggattccgcaaagaaagccgcctgtgaattttcggagacagatgttaccaataccgagcatcaccagccctccaacaacgacctaaacactaccgaaaagagagctgccgagcgccaccccgagaaataccaaggctccagtgtttctaatttgcatgtagagccctgtggcacaaacacccatgcctccagtctccagcatgaaaattccagcttattgctcaccaaagatcgaatgaatgtggagaaagcggagttctgcaacaagtccaagcaacctggattggccagatctcagcacaaccgctgggctggatcaaaggaaacctgcaacgacagaaggacccctagcacggaaaaaaaagtggacctcaacgcggatcctctgtgcgaacggaaggagtggaacaaacagaaactcccttgtagcgaaaacccgcgggacaccgaggacgtcccatggataacccttaatagctcaattcagaaagtgaatgaatggttctctcgatcagacgaactcctgggttcagacgatagccacgacggcgaatccgagtcgaatgcgaaggtggccgacgtgctagacgttttaaatgaggtagatgagtacagcggtagctcagagaaaatagacctcctcgccagtgatcctcatgaagccctgatatgcaagagtgagcgagtgcatagtaaatctgtggagtctaatatagaggataaaatcttcggaaagacctaccgtaaaaaggctagtctccctaatctctctcatgttacggaaaatctcatcatcggtgcttttgtcacagagccacagattatacaggaacgaccgctgacgaacaagcttaagagaaagcgcaggcccacctccggcctgcaccctgaagattttatcaagaaggccgatcttgccgttcagaaaacacccgagatgatcaaccaaggaactaaccaaacggaacagaacggtcaagtcatgaatataactaactcaggtcacgaaaacaagaccaaaggcgattctatccaaaacgaaaagaaccccaatcccatcgagtccctcgaaaaagagtccgccttcaaaacaaaagccgagcctatctcaagcagcatatcaaatatggaactcgagctgaatatccacaattccaaagcacctaagaagaacagattgagacggaaatcctccacacggcacatccatgctctcgaacttgttgtgagccgtaatctctcaccaccgaactgcacagagttgcagatcgactcttgtagctcttccgaggagtag

SEQ ID NO: 23091 - DNA, 5658 bp, Artificial Sequence
  Description of Artificial Sequence: Synthetic coding sequence
atggacctgagcgccctgcgggtggaggaggtgcagaacgtgatcaacgcgatgcagaagattctcgaatgtcctatttgcctcgaactcattaaagaacccgtgtcgactaagtgtgaccatattttctgtaaattctgtatgctgaaactactgaaccagaagaagggacccagccagtgccctctctgcaaaaacgacataacgaagaggtccctgcaagagtcgaccaggttttctcagctggtagaagagctgctaaagatcatatgcgccttccagctcgataccggccttgagtatgccaactcctacaacttcgccaaaaaggaaaataacagccccgagcatctgaaagatgaggtgtctatcattcagtctatgggctacaggaacagagcgaagcgtttacttcaaagcgagcccgagaacccgtcactacaagaaacctctttgtccgtgcaactctctaatctgggtacagttcggaccctgcgcactaagcaaagaattcagcctcagaagacaagcgtgtatatagaattgggatctgacagtagcgaggacacagtgaacaaagctacatactgcagcgtcggggatcaggagcttctgcaaataactcctcagggaacacgagatgagatttccttagactcggctaagaaggctgcctgtgagtttagtgaaaccgacgtcactaataccgagcaccaccagccaagcaataatgatcttaacaccactgagaagcgtgctgccgagcggcacccagagaaatatcaggggagctcagtcagcaacctccacgtagagccctgtggtacaaacacccacgcctcatctttgcagcatgaaaatagtagcttgctcctgaccaaggataggatgaatgtggaaaaggccgagttctgtaacaagtctaagcagccagggctggccagaagccagcacaaccggtgggccggcagtaaggagacgtgtaatgaccgcaggacacccagtaccgaaaaaaaggtggatctgaacgccgacccactgtgcgagcgcaaggagtggaacaagcagaagctgccctgctcagaaaatcccagagatactgaagacgttccctggatcactttaaactcttctatacagaaagttaatgagtggttcagcagaagcgatgagcttttaggaagcgatgactcccatgacggagagagcgagtctaacgctaaggtcgccgacgtcctggatgtgctaaacgaggttgatgagtattctggaagcagcgagaagattgatttgctggcctcagatccgcacgaagccctgatctgtaagtcggaacgggtgcacagtaagtccgtagagtccaacatcgaggataaaatttttggtaagacgtaccgtaagaaggctagcttgccgaacctctctcacgtgacagagaatttaataattggggcttttgtgaccgagccccagatcattcaggaacgcccactcactaacaaattaaagcgtaaaaggagacctacgagcggtctacaccctgaggactttatcaagaaagcagatctagctgtacaaaaaacccctgaaatgataaatcaggggactaaccagacagagcagaatgggcaagtaatgaacataacaaacagcggccacgagaataagaccaagggggacagcattcagaatgagaagaacccaaatcctattgagtcgctcgagaaagagtccgctttcaaaacaaaggcagagccaatatcatctagtattagcaatatggagctggagctcaatattcataactcaaaggctcccaagaagaaccggctgaggagaaagtcttcaactagacatatccacgcactggagttggttgtgtcacgcaacttgtccccccccaattgcaccgagctgcaaatcgactcttgttcaagcagcgaagagatcaaaaagaaaaaatacaaccagatgcccgttcgccatagccgcaacctgcagttgatggagggaaaagagccagccactggagcgaaaaaatccaataaacctaacgagcaaactagtaagcgtcacgatagtgacacgtttccagagctgaagctgaccaacgctccaggaagcttcacaaaatgcagtaacacttctgaactaaaagagttcgtgaacccctccctgccgagagaggagaaggaagaaaagctggagaccgtcaaggtctccaacaacgccgaggacccaaaggacctcatgctgtctggcgagcgtgtgctgcaaactgagcggtcagttgaatcttcgtcaatcagcctagtgccaggcactgactacggtactcaggaatcgatatccctgctggaagttagcacgctcggaaaggctaaaactgagccaaataaatgtgtctcccaatgtgcagcgtttgagaaccctaagggactgatacacggttgttctaaagacaacaggaatgacacagaaggatttaaatacccccttgggcacgaggtaaatcacagccgagaaacgtcaatagaaatggaggagagtgagctggacgctcagtacttgcagaataccttcaaagtctctaagagacagtcttttgcgccattctcaaatcccggtaacgcggaggaagagtgcgcaaccttcagtgcacattcaggctcgctgaagaaacaatcgccaaaggtgacatttgaatgtgaacagaaggaagagaaccaaggaaaaaacgaatccaatatcaagccggtgcagactgttaatattacagctggcttcccagttgttgggcagaaggacaagcctgtcgacaatgctaaatgtagtattaagggcggaagccggttctgtttatccagtcaatttagaggaaatgaaacgggactgatcacaccaaataagcacgggttgctacagaacccataccggatacccccactgtttcccatcaagtcatttgtgaagaccaagtgcaagaaaaacctactcgaagaaaattttgaggaacatagtatgagcccggagagggagatgggtaacgagaatatcccctcgacggtatccaccatttcacggaataatatcagagaaaacgtcttcaaggaggccagttcaagtaacattaacgaggttgggtctagtacgaacgaggttggctcctctatcaatgagatcgggtccagcgacgaaaacattcaggcagaattgggacgcaaccgtggtcccaagctgaatgcaatgctccgcctgggtgtcctacagcccgaggtgtataaacaatcgctccctggctccaactgtaagcacccggagatcaaaaaacaggagtacgaggaggtggtgcagacagtgaacacggatttctccccttacctgatatctgacaatctcgagcagcctatggggtcctctcatgcatcacaggtgtgttcagagaccccagacgatctgctcgacgacggtgaaattaaagaagatacatctttcgctgaaaatgatatcaaagagtctagtgctgtgtttagcaagagcgtacagaagggagaactctctcgatctcctagtccatttactcacactcacctggctcaggggtataggagaggggcgaaaaaactggaaagcagcgaagagaacctgtcttcggaggatgaagagttgccctgctttcagcatctgctgttcggaaaggtcaataatatcccctcgcagagcacaaggcactccacagtggccaccgagtgtttgagtaagaacacggaagagaatcttttgagtctgaaaaattctctaaatgactgcagcaatcaggtgatcttggccaaggctagccaggaacaccacctaagcgaagagacaaagtgcagcgcctccctcttcagtagtcagtgcagcgagctggaggacctaacagccaataccaacacacaagatccattcttgatagggagcagtaaacagatgaggcaccaatctgaatcacagggggtgggactgagtgataaggagctggtgagtgatgatgaggaacggggaactgggcttgaggagaataaccaggaggagcaatccatggactcgaatcttggagaagctgctagcggctgcgagtccgagaccagcgtgtccgaggactgtagtggattgtcatcccaaagcgatatcctcactacccagcagcgcgataccatgcagcacaatctgatcaagctccagcaggagatggctgagttagaggcggtcctagagcagcacggctcccagccaagtaactcatatccctctattatcagtgattcttccgcactagaagatctgagaaaccctgaacagtctacttccgagaaggacagtcatattcacggacaaagaaataactcgatgttctctaagaggccacgggaacacatctcggccgttctcacctctcagaagtcttctgagtacccaattagccagaatcccgaaggattaagtgccgacaagttcgaggtgagtgccgattcgagtacatctaaaaacaaggaacccggagtggaaagatccagtccttcgaagtgcccttctttagacgaccgatggtacatgcacagttgttctgggtccttgcagaatagaaattatccatcacaggaggagctcatcaaagtagttgatgttgaagagcagcaactagaggaatctggtccccacgatcttaccgaaaccagctatctgccgagacaggacctcgagggtactccatacttagagtctggcataagtctgttctccgatgatcccgagtcggatccatctgaagacagagcaccagagagcgcgcgcgtgggcaacatcccttcctcaacctcggctttgaaggtcccacagctcaaagttgccgaatctgcgcagagcccagctgcggctcacaccactgatacagccggttacaacgccatggaggagagtgtaagtcgtgaaaaaccagagctgacagcctccacggagagggttaacaagcgcatgtctatggttgtgtctggtctcacccctgaagagtttatgctggtgtacaaatttgcacgaaagcatcacattaccctcacaaacctgatcaccgaggagacaactcacgtggtaatgaagacagacgcagagtttgtatgcgagcgcactctgaagtattttttggggattgcgggtggcaaatgggttgtctcatacttctgggtgacacagtcaatcaaggagagaaagatgcttaatgagcatgacttcgaggtgagaggtgatgtcgtgaacggtcgcaatcaccagggacccaagcgagcaagggagagccaggacaggaaaatcttcagaggcctggaaatctgctgctatggaccattcaccaatatgccgactgaccagctagagtggatggtacagctatgcggtgcatctgtcgtgaaagagttgtcaagtttcacactggggaccggggttcatccaatagtggtggtgcagcccgatgcatggactgaagacaacggctttcatgctatcggacaaatgtgcgaggcccccgtggtcacacgcgaatgggtgctggatagtgtggccctctaccagtgccaggagctggacacatatttgattccccagatccctcactctcattactag

SEQ ID NO: 23092 - DNA, 669 bp, Artificial Sequence
  Description of Artificial Sequence: Synthetic coding sequence
atggacctgagcgccctgcgggtggaggaggtgcagaacgtgatcaacgccatgcagaagatcttagagtgccctatctgcctagaactgatcaaggaacccgtgtccacaaaatgtgaccatatcttctgcaaattctgcatgctgaaactactgaaccagaagaaaggtcctagtcagtgtccactctgcaagaatgatatcacaaaaagatccctgcaagaaagcacccggttctcccagctggtggaagagcttttaaagattatatgcgccttccagctcgacactggtcttgaatacgccaattcatataatttcgccaagaaagaaaacaacagtccagagcatttgaaggatgaagtgagcatcatacagagcatgggttaccggaatcgggcaaagaggcttctgcagagcgaacccgaaaatccctccctcgagacaagcctgagcgtccagctctcaaacctgggaaccgttcgaaccctaagaaccaaacagcgcatccagcctcaaaaaacatctgtctatatcgagttgggctctgattctagtgaggacaccgttaacaaggccacatattgcagcgtgggggaccaagaactactgcagatcactccacaggggactcgggatgagatctctctcgattcagccaagaaatag

SEQ ID NO: 23093 - DNA, 1869 bp, Artificial Sequence
  Description of Artificial Sequence: Synthetic coding sequence
atggacctgagcgccctgcgggtggaggaggtgcagaacgtgatcaacgctatgcaaaaaattctggaatgccccatttgtctggagctgatcaaagagccagtgagcaccaagtgtgaccacatcttctgcaaaagcctccaagaaagcaccagattcagccagctagtggaagaactgttgaaaatcatttgtgcctttcagctcgatactggtcttgagtacgctaactcatataatttcgctaagaaggaaaacaactcccccgaacacctgaaggacgaggtgtctatcatacaatcaatgggatacagaaaccgcgctaagcggttgctgcagtccgagcccgagaacccgagccttcaggagacctccctgagtgtgcagctgtccaatcttggcactgtacgtacgctgcggacaaagcagagaattcagccacaaaagacatctgtttacatcgaactgggttccgatagcagcgaggatacagttaataaagctacctattgcagcgtgggtgaccaggaattactccaaattaccccccaaggaactagagacgagatttcccttgactctgccaaaaaggccgcttgcgagttctccgagaccgacgtgacaaacactgagcaccaccagccttctaacaatgacctgaatacaaccgagaagagggcagccgaacgccacccggagaaataccaggggtcttccgtgagcaacctccatgtggaaccgtgtggaaccaacacgcatgctagctcgcttcagcatgagaatagctctctgctgttgacaaaggatcgtatgaatgttgaaaaggccgaattttgtaacaagagcaaacaaccaggcctggcacgttctcagcataaccgttgggcaggctcgaaagagacctgcaatgatcggcgcactccaagcactgaaaagaaagtggacctgaacgctgaccccttatgcgagcggaaggagtggaacaaacaaaaactaccatgttccgagaatcctagggacacggaagatgtgccatggataaccttgaattcttctatacagaaggtgaacgaatggttctctagatctgacgagctcttaggcagtgatgacagtcatgatggtgagagtgagagtaatgccaaggtcgccgacgtgcttgacgtgttgaatgaagtggatgagtacagcgggtcttccgagaaaattgacttactggcttcagatccgcacgaggcactcatctgcaagtccgagagggtgcactccaagagcgtagagagcaatatcgaagataagatttttggtaagacatacaggaaaaaagcctcgttgcccaatctatctcacgtgactgagaacctaattataggcgcctttgttacagagccacaaatcatacaagagcgtcccctgaccaataagctgaaacggaaacgccgacctaccagcgggctgcaccctgaggatttcattaagaaggccgacctggcagtgcagaaaacgcccgagatgattaaccagggaaccaatcagacagagcagaatggccaggtgatgaacatcacgaatagcggccacgagaataaaacgaagggtgactccatccagaacgaaaaaaaccccaacccaattgagtccctcgagaaggagtcagcattcaaaactaaggccgaacctatatcatcaagcatcagcaacatggagttagaattgaacattcataattccaaagcacccaaaaaaaaccgactcaggcgtaaatcatccacgagacacatccatgccctggaactcgttgtgtctcgtaacctgagtccgccaaactgcaccgaacttcagatagactcatgcagttcttcagaatag

SEQ ID NO: 23094 - DNA, 1872 bp, Artificial Sequence
  Description of Artificial Sequence: Synthetic coding sequence
atggacctgagcgccctgcgggtggaggaggtgcagaacgtgatcaacgccatgcagaagatcttagagtgtcccatatgtctagaacttattaaagagccagtgtcaacgaaatgcgaccatatattctgtaaattttgcatgctgaaactactgaaccagaaaaaaggcccctcccagtgccctctgtgtaagaatgatatcaccaaacgttccctgcaggagagtacaagattctcccagctcgtcgaggaattattgaagatcatctgtgctttccaacttgacacgggcctcgagtacgcaaactcttataacttcgcaaagaaggagaataactcgcctgaacacctcaaggatgaggtgtctattatccagtctatgggctatcgcaatagggccaagaggctccttcagtccgagcccgagaatccttctctcgagactagcctttccgtccaactgtccaatctgggaaccgtgaggaccctacggactaagcagcggatccagccccagaagacctccgtgtatatcgaactgggaagcgattcctccgaggatactgtgaataaagcaacgtactgctccgttggcgatcaggaactgctccagataaccccgcagggaactagagatgaaatctcactggactctgccaaaaaggctgcatgtgagtttagtgaaacggacgtaaccaataccgagcaccaccagccaagcaacaatgacctgaacaccactgagaagcgggctgctgagcgtcaccctgagaagtaccagggagaggccgccagcggctgcgagtcagagacttctgtgtccgaagactgctccggactcagctctcagtctgacatcctcaccacacaacagcgcgacaccatgcagcacaatctaataaagctgcagcaggaaatggccgagctggaagcggttctggagcagcacggcagccaaccatcaaactcctacccaagtatcatcagtgattctagtgcgctcgaggacctgagaaacccagagcagtctacctctgaaaaggccgtgctgacttctcaaaagagctctgaataccccatttcccagaaccctgagggcctgtctgcggataagtttgaggtctctgcagactccagcacaagcaaaaacaaggaaccaggagtagaacgctcatcaccctcaaagtgcccctcactggacgatcgctggtacatgcactcatgcagcggatcccttcaaaacagaaactatccgagccaggaggagttgataaaagttgttgacgtggaagagcaacagctggaggagtctggtccccacgatctcactgagacatcatacctccctagacaggacttggagggcaccccatatttagaatccgggatctccctgttctccgatgatcctgaaagtgatcccagcgaggatcgcgcccctgaaagcgcgagagttgggaacatcccctcatccaccagcgcgctgaaggttccccagctcaaggtggcggagtcagctcagagccccgccgccgcacacacgaccgataccgcaggttataacgccatggaggaatctgtgtccagagagaagccagagctgactgcgagcactgagcgcgtgaacaaacgaatgtctatggtggtgtctgggcttactccagaggaattcatgttagtttataagttcgcgaggaagcaccatataacccttacaaacctgattacagaagaaactacccacgtggttatgaagaccgatgccgaatttgtttgtgaacgtacactcaagtacttcttgggaattgccggcggaaaatgggtcgtgagttacttttgggtcacccagagcatcaaggagagaaaatag

SEQ ID NO: 23095 - DNA, 1497 bp, Artificial Sequence
  Description of Artificial Sequence: Synthetic coding sequence
gagctgctgaagatcatctgcgccttccagctggacaccggcctggagtatgcgaattcttacaatttcgccaagaaggagaacaatagtccagaacatcttaaagacgaagtctccattatccaatctatgggttaccggaaccgagccaaacgactgctgcagtccgagcccgaaaacccgtcgttggagacttctctgtctgtgcagctgtcgaacctggggaccgtgcggacattgagaacgaaacagcgtatccaaccccagaagacttctgtatatatcgagctggccgcttgcgagtttagcgaaacagacgtcaccaatacagagcatcatcagcccagcaacaatgacttgaatactactgaaaaacgcgccgctgagagacatcccgagaagtaccagggagaagccgcctccggctgcgaatccgagacttccgtttctgaagattgctctgggctatcctcacagtccgatatcctgacgacccagcagagagacacaatgcagcataatctgatcaagctacagcaggagatggctgagctggaagccgtactagagcagcacggaagtcagccctcaaatagctatccctcaatcatttctgattcgagcgctctcgaggacttgcgtaaccccgaacagtccacaagcgaaaaggcagtgcttaccagtcagaaaagttccgagtatccaatcagccagaacccagagggcttatcagcagacaagttcgaagttagtgcagatagcagtacgtccaaaaataaggagcccggagtcgagaggtcatcaccctccaaatgccctagcctggacgataggtggtacatgcactcctgttccggcagcctccagaatcgcaactacccaagtcaggaagaactcatcaaggtggttgacgtggaagagcaacagctggaagagtccggacctcacgatcttactgaaacctcttacctgcctcgccaggatttggaaggcacaccctacctggagtcagggatcagtctcttctcagatgatcctgagtccgatcctagtgaggacagggccccggagtcagcgagggttggcaacatcccctctagcaccagcgcgctcaaggttccccagctgaaggtcgccgagtcggctcaaagcccagccgccgcgcacaccaccgacacggccggatataacgccatggaggagtcggtgtccagggagaaaccagaactgaccgcaagcacagagcgagtgaacaagcgcatgagtatggtggtgagcggcttgacccctgaggaattcatgttggtttacaaattcgccaggaaacaccacattactcttacaaacctcattacagaggagacaacccacgtggtgatgaagacagacgctgagttcgtgtgtgaaaggacactgaaatactttttgggcatcgccggaggcaagtgggttgttagctatttctgggtcactcagtcaatcaaagaaagaaagtag

SEQ ID NO: 23096 - DNA, 297 bp, Artificial Sequence
  Description of Artificial Sequence: Synthetic coding sequence
atggacctgagcgccctgcgggtggaggaggtgcagaacgtgatcaacgcgatgcagaagattctcgagtgcccaatttgcctggagcttattaaggagcccgtgtctactaagtgcgaccacatcttctgtaagtccctccaggaatcaaccagattttcccagctggttgaggagctcctgaagattatttgcgcttttcagttggatactggactcgagtacgctaacagctacaacttcgccaagaaggagaacaactccccagaacatctgaaggacgaagtaagcatttag

SEQ ID NO: 23097 - DNA, 2280 bp, Artificial Sequence
  Description of Artificial Sequence: Synthetic coding sequence
atggacctgagcgccctgcgggtggaggaggtgcagaacgtgatcaatgccatgcagaaaatattagagtgtcccatatgtctagaattgataaaagaaccagtctctactaaatgcgaccacatcttttgcaagttctgcatgctgaagctccttaatcaaaaaaaagggcctagtcaatgcccgctgtgtaagaatgacattactaagaggagccttcaggagagtacgcggttcagccagctggttgaggagctgcttaagatcatctgtgctttccagctggatactggactagagtacgccaattcctacaactttgcgaaaaaggagaataacagtcctgagcacctaaaggatgaagtttctatcatccagtccatgggctaccggaatcgagcgaagcgcctgctgcaaagtgagcccgaaaatccctccctccaggagactagccttagcgtccagctgagcaatctggggactgtgcggacactccgcactaaacagagaatccagccacagaagacctctgtctatatcgaactcggatcagatagtagcgaagataccgtgaataaagctacatactgctcagtcggagaccaggaattactgcagataacaccccaaggaacccgtgacgaaatttccctggactctgccaaaaaagccgcatgtgagttcagcgagacagacgtcactaatacagaacatcaccagccgtctaataacgacttgaataccacagaaaagagagcggcagaacgacaccccgagaaataccagggggaagcggccagcgggtgcgaatcggagaccagtgtctccgaagactgtagcgggctgtccagccagtcggacatcctcacaacacaacagagagatactatgcagcacaacctcattaagttgcaacaggaaatggccgagctggaagccgtgcttgagcagcacgggagccagccttctaacagttatccatccataatcagcgactcctctgcactcgaggatttgcggaatccagagcaaagcacttcagaaaaggtgttgacttctcagaaaagctctgaatacccaatctcccagaaccccgagggcctgtcagccgacaagtttgaagtttctgctgactcttcaaccagcaaaaacaaggagccaggagtggaacgctcctctccaagcaagtgcccctcgctggacgatcggtggtatatgcactcatgttccggtagcttacagaacagaaactaccccagccaggaggagttaatcaaagtagtagacgttgaagagcagcagctggaagagtctgggccacatgaccttaccgagacatcatatctgcccaggcaggatctggagggtactccttatctggagtctggaatttccctgttctccgacgaccctgaaagtgaccctagtgaagaccgcgctcctgagtccgcccgcgtggggaatataccaagctcaacaagtgcgctaaaagtccctcaattaaaggtggctgaaagcgcacagtctcccgccgcagcccatacaacagacactgccggctacaacgcaatggaggaaagcgtgtctcgagaaaaaccagagctaaccgcctccacagagcgcgttaataagagaatgtccatggttgtcagcggcctgaccccggaggaatttatgcttgtgtataaattcgctcgaaagcatcacatcacgcttacaaacctgataacagaagaaaccacccatgtggttatgaaaactgatgcggagtttgtgtgtgagcgtacgctaaagtacttcctggggatcgcgggaggcaaatgggtggtgtcatacttttgggttacacagagtattaaggagcgtaaaatgctgaatgagcacgattttgaggtgaggggcgatgtggtgaacggccgtaaccaccaagggcctaagagggcaagggagtcacaggaccgaaaaatatttagaggattagaaatttgctgttacggcccatttacgaatatgccaaccgatcaactggaatggatggttcaactctgtggagcttccgttgtaaaggagctcagcagtttcacattgggaacaggagtacatcctatcgttgttgtccaaccggatgcgtggactgaagacaatggattccatgcaattgggcagatgtgcgaggcaccggtggttaccagggaatgggttcttgattcggtggccctataccagtgtcaagagctggacacttatctgatcccccagatccctcattcccattactag

SEQ ID NO: 23098 - DNA, 180 bp, Artificial Sequence
  Description of Artificial Sequence: Synthetic coding sequence
atggacctgagcgccctgcgggtggaggaggtgcagaacgtgatcaatgcaatgcaaaaaatcctggagtgtccaatctgccttgaactcataaaagagcctgtatcaacgaagtgcgaccacatcttttgtaaggtccttctgtgttgcccttcctggagcactgttgtccgatcatag

SEQ ID NO: 23099 - DNA, 5451 bp, Artificial Sequence
  Description of Artificial Sequence: Synthetic coding sequence
atgctgaagctgctgaaccagaagaagggccccagccagtgccccctctgtaaaaatgatatcactaaaagatcactgcaagagtctacccggtttagccagctcgttgaggagttgctgaagattatctgtgcattccaactcgacaccgggctggaatatgcaaacagctacaatttcgcaaagaaggaaaacaatagccccgagcacctgaaagacgaagtctctattattcagtccatggggtaccgcaacagagctaaacggttgctgcagtcagagcccgaaaatccatctcttcaagagacttctctgagcgtccaactaagcaatctcggaacagtgaggaccttgcggacgaaacagcgtattcagcctcagaagacttccgtgtatatcgagcttggcagtgatagctctgaggacaccgttaataaggctacgtactgctctgtaggcgaccaggaactgctccagatcactccacaggggaccagagatgagatttccctcgatagtgccaaaaaggcagcatgcgagttctctgagaccgacgtaacgaacacagaacatcatcaacccagcaacaatgatctgaatacaaccgaaaaacgcgcagccgaaaggcacccagagaaatatcaggggtcatctgtgtcgaaccttcacgtagagccatgtgggacaaatactcatgcctcctccctgcaacacgaaaactcttctctgctattgacaaaagacaggatgaatgtagagaaggcagagttctgtaacaaatccaaacagccaggcctggctaggtcccagcataacagatgggccggatcaaaggaaacatgtaacgatagacgtaccccctctaccgaaaagaaggttgacctgaacgctgacccattatgtgaaagaaaggagtggaacaaacagaagctgccatgcagcgagaatccgcgggacacagaagatgtgccatggattacactcaactcatcgatacagaaggttaacgagtggttttctcgatctgatgaactcctgggaagtgatgactcccatgatggggaaagcgagagcaacgcgaaagtggcggacgttttagatgttctgaatgaggtggatgaatatagcggctcttctgagaaaatagacttacttgcctctgatcctcatgaagctttgatttgtaagtccgagcgggtgcactctaaatcagttgagtcaaatatcgaagacaaaatctttggaaaaacgtaccgtaaaaaggcttccctgcctaacctttcacatgtgactgaaaatttgatcatcggggctttcgtgacggagccccagattattcaagaacgccccctcacaaataaactcaaaaggaaaagaaggcctaccagtggtttgcatcccgaggactttatcaaaaaggcggatctggctgtccagaagactccagaaatgataaaccagggaaccaatcaaactgagcagaatggccaagtgatgaacatcacaaactctgggcatgaaaataagacaaagggggatagcatccagaatgaaaaaaatccaaaccctatcgaaagtcttgagaaggaaagcgcctttaaaactaaggcagaacctatctcatcatccatctccaatatggaacttgagctgaatatccacaatagcaaggcacctaaaaaaaaccgacttcgccgcaagtcgtctaccagacacatccacgccctggagctggtcgtgagtcgcaatctgagccccccaaattgcacagagttgcagatcgattcttgctctagctctgaagaaattaaaaaaaaaaaatataaccagatgccagtgcgacattcaagaaatctgcagcttatggaagggaaggaacctgcaactggcgcaaagaaatccaacaagccgaacgagcagactagtaagagacacgactcagacactttcccagagctgaagctgaccaatgctccaggctccttcactaagtgtagcaatacgtccgagctgaaggagtttgttaatcccagtctcccccgagaagagaaagaagaaaagctggagaccgtgaaagtaagtaataacgcagaagacccaaaagatctgatgcttagcggagagagggttttacagaccgagcgatccgtggaaagcagctctatatccctggtcccagggacagattacggaacgcaggagtccatttcattgttggaagttagtacacttggaaaagccaagaccgagcctaataagtgtgtgtctcagtgtgccgcttttgagaacccaaaaggtctcattcatggatgtagcaaagacaacagaaatgatacagagggatttaaataccctctcggccacgaggtaaaccactctcgagagaccagcatagagatggaagaaagcgagctggacgctcagtacctccagaacacctttaaggtcagcaagagacaaagcttcgccccgtttagcaaccctggcaacgcggaagaggaatgtgcaactttttcagcgcattcaggctcattgaagaagcagagcccaaaggtcactttcgagtgcgagcaaaaagaggagaatcagggaaaaaacgaatccaacatcaaacccgtgcagacggtgaatatcacagccggattcccagtcgtggggcagaaagacaagccggtagataatgccaagtgttcaattaagggtggatctcgcttttgtctgtcctctcagttcaggggcaatgagaccgggcttatcaccccaaataagcatggcttgctgcagaacccttatcgcatcccccccctgtttcctataaaatctttcgttaagactaaatgtaagaaaaacctgttggaagaaaactttgaggagcactctatgtcacctgaaagggagatgggaaacgaaaatatcccgtccaccgtctcaaccatttctcggaacaacattcgcgagaatgtgtttaaggaggccagcagtagcaacattaatgaggtgggctcttcgaccaacgaagtgggctcatctatcaacgaaatcgggtcatccgatgagaatatccaggctgagctgggacgtaatcgcgggcctaaactgaacgccatgctgaggcttggggtgctgcagccggaagtatataaacagtccctcccgggttcaaactgtaaacatcctgagatcaaaaaacaggagtacgaggaagtggtgcaaactgttaacacagatttcagcccctacctgatttccgacaacctggagcagcctatgggatccagccatgcttcccaggtatgttctgagactcctgatgacctgctcgatgacggagagattaaagaagatacatcttttgctgaaaacgacatcaaagagagttcagccgtgttttccaagagcgtgcagaaaggggaattgtcacgctccccttctccctttacccacacccatctcgctcaagggtatagacgcggggctaagaagctggaaagctctgaggaaaacctctcttcagaggacgaggaactaccatgttttcaacaccttctcttcggcaaggtgaacaacataccatcacagtccacaagacactctacagtggcaactgagtgcctgagcaaaaacaccgaagagaatctgttgtctcttaagaactcactgaatgactgttccaatcaggtcattcttgctaaggctagccaagagcaccacctgtccgaagaaactaaatgctcagcatccctgttctcctcccaatgtagtgagttagaggatcttaccgcaaatacaaacacccaggatcccttccttattggcagtagcaaacagatgcgacatcagtcggaatcacagggcgttggactgagtgacaaggagctggtctctgacgacgaggagagagggacagggctagaagagaacaaccaagaggagcagtcgatggactcgaacttgggcgaagccgcctcaggctgcgaatcagagacctctgttagcgaggactgtagcgggctgtcgagccagtctgatattttaactactcaacagagagatactatgcagcacaatttaattaaactccagcaggagatggcggagttagaagccgtgttagaacagcatgggtctcagccctcgaatagctacccgagtattatatcggacagcagtgcccttgaagacttgaggaaccctgagcagtctacctcagagaaggccgtcctgacttcacagaagtcttcagagtatcccataagccagaacccggaaggcctgagcgccgacaaattcgaggttagcgccgatagctccacaagtaaaaacaaagagcccggcgtggagcgctcttcgccatccaaatgcccaagtttggatgacagatggtacatgcacagttgcagtggttccctgcaaaatcgaaattatccaagtcaggaggagttgattaaggtggtggacgtggaggagcagcaattggaggagtctggtcctcacgatcttaccgagaccagttacctccctcgacaggatttggaggggacaccttatctggagtccggtatctcgctgttcagcgatgaccccgaaagtgatccatctgaagacagagctccggagtctgctcgcgtcggaaacatcccctcgagcaccagtgcactcaaagttccccagctaaaggtggccgaatcagcccagtctcccgccgcagcacacaccaccgatactgctggatataatgcaatggaagagtcggtgagtcgggagaaacccgaattgactgccagcactgaacgggtgaacaaacgcatgagcatggtggttagcgggttgactccagaagagttcatgcttgtttacaagttcgctcgaaaacaccacatcaccctgacaaacctcataaccgaggagacaacacacgtggttatgaagacagacgctgaattcgtctgcgagaggaccctcaagtatttcctcgggatagctggcgggaagtgggtcgtgtcctatttttgggtcacacagtctatcaaagagcgcaaaatgctgaatgagcatgatttcgaagtgcgcggcgacgtggttaacgggagaaatcaccagggcccaaagcgggcaagagagtcccaggataggaaaattttcagggggctcgaaatatgttgctatggcccttttaccaacatgcctaccgaccagttggaatggatggtgcaactatgcggagccagcgtcgtgaaagaattaagctcatttacactcggcacaggcgtgcacccgattgtcgtcgtccagcctgatgcctggacggaagataacggctttcatgctatcggccagatgtgcgaagcgcccgtcgtaacacgagagtgggttctcgacagtgtcgcattataccaatgtcaggagcttgacacttacctgatccctcagattccccactctcactactag

SEQ ID NO: 23100 - DNA, 1719 bp, Artificial Sequence
  Description of Artificial Sequence: Synthetic coding sequence
atgctgaagctgctgaaccagaagaagggccccagccagtgccccctttgtaagaatgatatcactaagagatctctgcaggagtcaacacgcttttctcagttagtggaagagctactcaagatcatctgcgccttccagctggacactggtctggaatacgccaatagctacaactttgccaaaaaagagaacaattcccccgagcacctgaaggacgaagtttccataatccagagcatgggctatcggaatcgcgcaaagagactactgcagtcagagcccgaaaacccctctttacaagagacatccctctctgtacagctgtccaatctgggtaccgtgcgaactctgagaaccaaacagcggatacagccccagaagacatccgtgtatattgagttgggaagcgacagctccgaggacactgtgaataaggccacctactgcagtgtaggcgaccaggagttgctccagattaccccgcaggggactagagatgaaatttcactggattccgcgaagaaagcagcctgtgaattctctgagacagacgtgaccaacacagaacaccatcagccatcaaataacgatctgaatacaacagaaaagcgggctgccgagcgtcatcccgaaaagtaccaaggagaagcagctagcggatgcgagagcgagacctcagtcagcgaggactgctctggcctgtctagtcagtctgatatcctaaccacccagcagagagataccatgcagcacaatttgatcaaattacaacaggaaatggctgaacttgaggccgtgctggagcagcacggttcccagccttcgaattcttatccctcaatcatatccgattcctcagctttggaggatctccggaatcctgagcagagcactagtgaaaaggccgtgcttacaagccagaaatctagcgagtaccccatatcccagaatccagaggggctaagcgccgacaagttcgaggtgtccgccgacagtagcacaagtaaaaacaaggagccaggagtggagaggagttcaccatccaagtgtccaagcctggacgaccgatggtacatgcatagttgtagtggctcgctccagaaccgtaactatccatctcaggaggagctgataaaggtagtggacgtggaggaacagcagctggaagaatccggaccgcacgatttgactgagacttcctacctaccgcgccaggacttggaaggtacaccttacctcgagagcggcatttcactcttttccgatgatcccgaatctgatccctcagaggaccgggcccccgagtcagcgcgcgtaggcaacatacctagctcaacctcggcattgaaagttcctcaactgaaagtagccgaaagcgctcagagtcctgcagcagcgcacaccaccgacaccgccggctataatgctatggaggaatctgtgtcccgagaaaaaccagaactcacggccagcactgagcgggttaataagaggatgtccatggtcgtcagtggcctgacacccgaggaatttatgctagtctataagttcgctcgcaagcatcatattacattgactaacctgattaccgaagagactacgcatgtcgttatgaagacagacgccgagttcgtttgcgaaagaactctaaaatatttcctgggaattgctggcggaaaatgggtggttagctacttctgggtcacacagtcctag

SEQ ID NO: 23101 - DNA, 1422 bp, Artificial Sequence
  Description of Artificial Sequence: Synthetic coding sequence
atggacctgagcgccctgcgggtggaggaggtgcagaacgtgatcaacgccatgcagaagatcctggaatgccctatctgtctagagctcataaaggagcccgtctcgaccaaatgtgaccatatattctgcaagttctgcatgctgaagcttctgaatcagaagaagggcccgtctcagtgcccactctgtaagaatgacataaccaagaggtccctgcaggaatcaaccagattttcccaactcgttgaggagttgctcaagattatatgcgcctttcagctcgacaccgggctggaatacgctaattcctataacttcgcaaagaaggaaaacaactcaccagagcatctgaaggacgaggttagcatcattcagtctatgggctatagaaatagagcaaaacgcctcctgcagagcgaaccagaaaacccttccctgcaagaaacttctctgagtgtgcagctgtcaaaccttggcaccgtgaggacattacgtactaagcaaagaattcagccacagaaaacatccgtgtatattgagcttggctccgactcttcagaagacaccgttaataaagcgacttattgcagcgtgggagatcaggagctccttcagattaccccccaggggactcgcgacgaaatttctctggacagtgcaaagaaagcagcgtgcgaatttagcgagactgacgttacaaacaccgaacaccatcagccttccaataacgacctgaatacgaccgaaaagcgggcagcagagcgacacccagagaagtaccagggctcatctgtatccaatctgcatgtcgagccttgcggcaccaatacacacgcatcatcactgcagcatgaaaattcatccctgctcctcactaaggataggatgaatgtggagaaggctgagttttgcaacaaaagcaaacaacccggcctggcccgatcccagcataatcgttgggccggctcgaaagagacctgcaacgaccgcaggacaccgagcactgaaaaaaaggtggatctgaacgccgacccactctgcgagcgcaaagagtggaataaacagaaactcccttgctccgaaaatccccgagacaccgaagacgtaccctggatcacgctaaatagtagcatacagaaagtaaatgagtggttttccaggtctgacgaattactcggctcagatgactcccacgatggagagtcggagagtaatgccaaagtcgctgatgtcctggatgttctgaatgaggtggacgagtacagcggaagcagcgagaagattgatctgttagcctcagatccccatgaagctctgatttgcaagtcggaaagggttcactccaagtctgtagagagcaatatcgaggacaaaatcttcggaaaaacttacaggaagaaagccagcctgccgaactag

SEQ ID NO: 23102 - DNA, 534 bp, Artificial Sequence
  Description of Artificial Sequence: Synthetic coding sequence
atgaacgtggagaaggccgagttctgcaacaagagcaagcagcccggccttgcccgatcacagcacaatcggtgggccggaagcaaagaaacgtgtaacgatcgccggaccccatctacagaaaagaaagtggacctgaacgctgatcccctgtgcgaacgaaaggagtggaacaagcagaaactcccctgctccgaaaatcccagagataccgaggatgtgccatggataacgttgaattcctctatccagaaggtgaatgaatggtttagtagatcagacgagctgctaggttccgatgattcgcatgacggggaaagtgagtcaaatgccaaagttgccgacgtcctggacgtgttaaatgaagtggacgagtactctggcagctctgaaaagatcgatttactggcgagcgatccacacgaagcccttatttgcaaatccgagagggtgcattccaaatccgtggagtctaacatcgaagataaaatttttggaaagacctaccgaaaaaaggcttctctgcctaattag

SEQ ID NO: 23103 - DNA, 10257 bp, Artificial Sequence
  Description of Artificial Sequence: Synthetic coding sequence
atgcccatcggcagcaaggagcggcccaccttcttcgagatcttcaaaacccgctgcaataaggccgatttggggcctatcagtttgaactggtttgaggaactgagctctgaggcacccccctacaattcggaacccgctgaggaatccgagcacaaaaataataactatgaacctaacttgttcaagacgcctcaacgcaagccttcctacaatcagctggcaagcactccaatcatatttaaagaacagggactgaccctgcccctgtatcaaagcccagtaaaggaactggataaattcaaacttgacctcgggagaaatgttcctaattctagacataaatcactgaggacagtcaaaacaaagatggaccaagcagatgatgtgtcatgcccgcttcttaacagctgcctatcagaatcccctgtggtcctccagtgtacccatgtaaccccacagagagacaaatcagtggtatgcgggagcctgtttcacaccccgaagttcgtgaagggccgacagacccctaagcacatctccgaatcactgggggcagaggtggatcccgatatgagttggtcctcgagcttagcaacccccccaactttgtcatcaacagtgttaatcgttagaaacgaggaagcttccgagactgtgtttccccacgacacgaccgccaatgtcaaatcttatttttcaaatcacgacgaatccctgaagaaaaacgataggttcattgcctcggtgaccgattctgagaacactaaccaacgagaagcggcctctcacggctttggtaagacatcaggcaactcattcaaggtcaactcgtgcaaagaccatattggcaaaagtatgccaaacgtgcttgaagatgaggtctacgagaccgtggtggatacaagtgaggaagattcattctctctctgcttttcaaagtgccggacaaagaatctccagaaagtccgcaccagtaaaacaagaaaaaaaatcttccatgaggctaacgcggatgagtgtgagaagtccaagaaccaggtaaaagaaaagtatagcttcgtgtctgaggtggaacccaatgacactgaccccctagattctaatgtggccaatcaaaaaccttttgagtctgggtccgacaagatctccaaagaggtagttccttccttagcctgtgaatggagccagttgactctcagtggcctcaatggggcccaaatggaaaaaatccccttactgcacatcagttcttgtgaccaaaatatttcagaaaaggacctgctggacactgaaaataaacgcaagaaagactttttgacaagcgagaacagtttacccagaatttcgtccttaccaaaaagtgaaaaacctctcaatgaggagaccgtcgttaataagcgtgatgaggaacagcaccttgagtctcatactgactgtattctggcggttaaacaagccatcagtggaacttccccagtggccagcagttttcaggggattaagaagtccatctttagaattcgcgaatcccccaaggagacctttaacgcttccttcagcggccacatgaccgaccccaactttaagaaagaaaccgaagcgagtgagtcaggcctcgaaatacacactgtgtgctcccagaaggaagactcactgtgccctaatcttattgacaatggctcttggcccgccactaccactcagaatagcgtagccctcaaaaacgcaggcctgatcagcacgctcaaaaagaaaaccaataaatttatatatgctatccacgacgagacaagctataagggaaagaaaatccctaaggaccagaagtctgagcttataaattgcagcgcacaattcgaagctaacgcattcgaggctcctctcacatttgccaatgccgacagcgggttattgcattcctcagtgaagcggagctgtagccagaatgacagtgaagaaccaaccctgtcattgacgtcaagtttcggtactatcctgcggaagtgcagccgcaacgagacatgctcgaataacaccgtcatctcccaggatctcgattacaaggaagcaaagtgtaataaagagaaactgcagctcttcatcactcccgaggccgacagcctgagttgcctccaggagggccagtgcgagaacgacccgaaaagtaaaaaggttagcgatataaaggaagaggtgctggcggccgcctgccatcccgtgcagcactcaaaggtcgaatacagcgataccgatttccaatcccagaagagcctcttgtacgatcatgagaatgcgagtacccttatcctgactcccacaagcaaggatgttctgtctaaccttgtaatgattagccgtggcaaggagagttacaagatgagcgataaactaaaaggaaataattacgagagcgatgtagagctcacaaagaatatccccatggaaaagaaccaggatgtatgcgcactgaacgagaactataagaacgtggaactgctacctcctgaaaaatacatgcgggtggcttcaccttcgagaaaggtccaattcaatcagaatacaaacctcagggtgatacaaaagaaccaagaagaaacaacatctatttcaaaaatcacggtgaatccagactctgaggagctctttagcgacaacgaaaataatttcgtgttccaggtggctaacgaaaggaataacctcgccctcggcaataccaaggagcttcacgaaactgatctgacctgcgtcaatgagcccatctttaaaaactccactatggtgctttacggcgataccggcgacaagcaggccacacaggtgagcataaaaaaagacctagtctacgtgctggccgaggagaataaaaatagcgttaagcaacatatcaagatgaccctgggccaggacttaaaatcagacatttcactgaacattgacaagattcccgaaaaaaataacgactacatgaataaatgggctggactcctgggaccaattagcaaccactctttcgggggcagctttcgaacagcctctaataaagagatcaagcttagtgagcacaacattaaaaagtcgaagatgtttttcaaagatatagaggagcagtatccaacttcgttagcttgcgtcgaaatcgtgaatacccttgctctggataaccagaagaagctgagcaaacctcagagtatcaacacagtgtcagctcatttacagagcagcgtagtcgtttccgattgcaaaaactctcatattacaccgcaaatgctctttagtaaacaggactttaactctaatcacaatctgacacccagccagaaggctgagattactgagctgtcgactatcctggaggaaagcggttcgcagttcgaatttacacagttcagaaaaccaagctacattttgcagaaaagcacatttgaagtgcctgagaaccaaatgactattctcaaaaccacaagcgaggaatgccgcgacgcagacttacatgtaatcatgaatgcaccatcaatcggtcaggtcgacagtagcaagcagttcgaaggcacagtggaaatcaaacgtaagttcgctggtttgctgaaaaacgattgcaataagtccgccagcggttatctgactgatgagaacgaggtgggattccggggcttctactctgcccatggcaccaaattgaacgtttccacagaggcgctgcaaaaagctgttaaactgtttagcgatattgagaacatttctgaggaaacatcagccgaagtacaccccattagtctctctagtagcaagtgtcacgactcagtggtctccatgttcaagatcgagaatcacaacgataagaccgtgagtgaaaagaataacaagtgtcaactgatattgcagaacaacatcgagatgacgaccggaacattcgtcgaggaaataacagaaaattataagcgtaacactgagaatgaggataacaagtacacggctgcctcacgcaattcccacaatctcgagttcgacgggtccgactcttccaaaaatgacactgtttgtatacacaaagacgaaaccgacctgctcttcactgatcaacataatatctgtctaaaactctccggtcagttcatgaaagaagggaatacacagatcaaggaggacctgtctgatctgactttcctggaggtggcaaaagcgcaggaagcttgtcacggcaacacctccaataaagagcaactgaccgctacaaaaacggaacaaaatattaaagacttcgagaccagcgatacattttttcagaccgcttccgggaaaaacattagcgtggctaaggaatcctttaataaaatcgtaaatttttttgatcaaaagcccgaggagctccacaacttctccctgaactcagagctgcactccgacatccgtaaaaacaaaatggacatcctttcctatgaggagacagacatagtgaagcacaagatcctgaaggaatccgtgccggtcggcaccggcaatcagctggtgacctttcagggacagcctgaacgtgacgaaaagataaaggaacccaccctgctgggattccatacggcttctggaaagaaagtaaaaattgccaaagaatcgctggacaaggttaaaaatctttttgatgaaaaggagcagggcacatcggagataacttctttcagccaccagtgggccaagaccttgaaatatagggaagcttgcaaagatctcgagctggcttgtgagactatcgagatcaccgctgcccccaagtgcaaagaaatgcagaattccctcaataatgacaagaatctggtgagtattgagactgtggtcccaccaaagttgctgtccgacaatctctgcagacaaaccgagaatctgaaaacaagcaaaagtatctttctgaaagtgaaggtgcatgaaaacgtggagaaggagacggcgaagtctcccgccacgtgctacacaaaccaatctccttattccgtgattgaaaacagcgccctcgccttttatacctcttgctccaggaaaacgtccgtgtcccagacctccttactggaggcgaaaaaatggctgcgtgagggaatcttcgacggccaacctgagcgtattaataccgcagattacgtggggaactatctgtacgaaaataactctaacagcactatagccgagaatgacaaaaatcacctctcagagaaacaggacacttacctctccaactccagcatgagcaattcctactcctatcacagcgacgaggtctacaacgattcagggtacctgtcgaagaacaagctcgattctggcatcgaacccgtgctcaagaacgtggaagaccagaaaaatacttccttttctaaagttatctccaatgtgaaagacgcaaacgcctacccacaaacggttaatgaggacatctgtgtggaggagctggtaacttcctcaagcccgtgtaagaacaaaaatgcagccatcaagctgtcaatcagcaattctaacaatttcgaagtcggcccccccgctttccggatcgcctcaggcaaaatagtgtgcgtgtctcacgagactatcaaaaaagtaaaggacatattcaccgattccttttctaaggtaatcaaggagaataatgagaacaaaagcaaaatatgccaaacaaaaattatggcaggttgttacgaagcgctagatgactcagaggatattctgcacaatagcctggataatgacgaatgctcgacccacagtcataaggtatttgcagatatacaaagtgaagagattctgcagcacaaccaaaatatgtccggactggagaaggtgtccaagatatcgccttgtgacgtttccctcgagacttctgacatatgtaaatgcagtatcggaaaactacacaagtccgtatccagcgccaacacatgcggaatctttagtactgcatccgggaagagcgtccaggtgagcgatgcaagcctgcagaacgccagacaggttttttctgaaatcgaggactccacaaaacaggttttttcaaaggtcttgtttaagagcaatgaacattcggaccaactcaccagagaagagaatactgctatccggacccctgaacacctcatcagccagaaaggcttttcttacaatgtggttaacagtagcgccttttcaggattctccaccgccagtggtaaacaggtgagcattttagagtcttccctccacaaggtgaagggagttctagaggaattcgatttgatccgaacagagcacagcctgcactacagtcctaccagtaggcagaatgtctctaaaatcctgccccgcgttgacaagaggaacccagagcattgtgtcaactcggaaatggagaagacctgctctaaagagttcaagttgtccaacaacctaaacgtagaaggtgggagcagtgagaataatcactcaatcaaagtctcgccctacctgagtcagtttcagcaggataagcagcagctggttttagggacaaaggtgagccttgtagaaaacatacatgtcctggggaaagaacaggcatccccaaaaaacgtgaagatggaaatcggaaagaccgagactttctccgatgtacctgtgaagacgaatatcgaggtctgcagcacctactcgaaagattcagagaactactttgaaacagaggcggtggagattgctaaggcatttatggaggacgatgagctaacagacagcaaactgccaagccacgctacgcatagtctgttcacctgccctgagaatgaggagatggttctgtccaactcccgaattggtaaaagacgaggggagcctctaattttggttggagaacccagtattaaacggaatctgctgaatgaattcgaccgaattatcgaaaaccaggaaaaatccttaaaggcatcaaaaagtacgcccgacggaaccattaaagatcgcagattgttcatgcaccatgtgtccctggagcctatcacctgtgtccctttcaggacgacaaaggaacggcaagagatacagaatcctaattttactgccccaggtcaggagttcctgtccaagtcacatctgtacgaacacctgaccctggagaagagcagcagcaaccttgcagtgtcagggcatcccttctaccaggtgtccgccacacgcaacgagaagatgcgccacttgataactactgggcgtcctaccaaagtgtttgtgcccccattcaaaaccaaatctcacttccatagggtcgagcagtgtgttcgaaatattaacctggaggaaaatagacagaaacagaatattgatggtcacggatcagacgactcaaaaaataagatcaatgataatgagattcatcagtttaataaaaacaactctaaccaggcggtcgctgtgactttcacgaagtgcgaagaggaaccactggatcttatcacgtcattgcagaatgccagggacattcaggatatgagaatcaagaaaaagcagcgtcaacgggtctttccacagcccggcagtctgtatctggctaagacaagtaccctcccgcggatttcactgaaggccgctgttggcggccaggtcccatcagcctgctctcataaacagttatatacctatggcgtgagcaagcattgcataaagatcaactccaaaaacgccgagtcctttcagtttcataccgaggattacttcgggaaagaatccctgtggaccggaaagggaattcagttggccgatggcggctggctgattccttccaatgatggcaaggccggcaaggaagaattctatcgagcactttgcgacactccaggggtcgacccaaagttaatcagccgcatttgggtttacaatcattatcgttggattatatggaaactggctgctatggaatgcgcttttccaaaagaatttgctaaccgctgtctgtcaccagaacgggtgctgcttcagcttaagtaccgctatgataccgagatcgaccggtcccgaaggtcagcaataaagaagatcatggagcgtgatgataccgcagcgaaaaccttagtgttatgtgtgtcagacatcatatcacttagtgccaatattagcgaaacatcctcaaataaaacatccagcgcggacacccaaaaggtggccatcattgagctgaccgatggttggtacgcagtcaaggcacagttagatcctcctctcctggcagttttgaaaaacggcaggctgactgtaggccagaagattattctccacggagcagaactggtcggctcccctgacgcatgcaccccgctggaagctcccgagagtttaatgctgaagatatcagccaactccacaaggcccgcacgctggtacacaaaactggggtttttccctgaccccaggccatttccgctgcctctgtccagtctgttttctgacggaggaaatgttggatgcgtggacgtgatcatccagcgtgcttatcctatccaatggatggagaagacatctagtggcctatacatatttcgcaatgagagagaggaagagaaagaagccgcaaagtacgtggaggcacagcagaagagactggaggccctgttcacaaaaatccaagaagagttcgaggagcacgaggagaatactacaaagccataccttccgagtcgggctctgacccggcagcaggtgagggccctgcaggatggagctgagctgtacgaagctgttaaaaatgcggccgaccctgcttatttggagggatattttagtgaagaacagctaagggctttgaacaatcatagacagatgctgaatgacaaaaaacaagcgcagattcagctggagatccgaaaagctatggaatctgcagagcagaaagaacaaggactaagtcgagacgtaacaactgtttggaaactgcggattgtgagctattcaaaaaaggagaaggacagcgttatcctgtcaatctggcgtccctctagcgacctttattcactattaacagaggggaaaaggtacaggatataccatctggcaactagcaagagcaaaagcaagagtgagagggccaatatacagctggcggcgactaaaaagacccagtatcagcagctccccgtctccgacgagattctgtttcagatatatcaacctcgcgaacctctccatttcagcaagttcctagaccccgatttccagccaagttgcagtgaggtcgacctgattggcttcgttgtgtctgtggtgaagaagaccgggctggcaccattcgtatatctgtctgacgaatgttataacttattagccataaagttttggattgatctcaacgaagacatcatcaaaccacacatgcttatcgccgctagcaatctccagtggagaccggagagtaagagtggtctgctgactctgtttgctggtgatttcagtgtgttcagtgcctctcccaaagagggacacttccaagagacttttaataagatgaagaacacagtagaaaatattgacatactttgtaacgaggccgaaaacaaattgatgcatatacttcacgccaacgatcctaagtggagtacaccgaccaaagactgtacctctggcccctacacagcccagattatccctggaacaggcaacaaactactcatgtctagccccaactgcgaaatctactaccaatcacccctctccctctgtatggctaaacgaaaaagtgtgagtacccccgtttcagcacaaatgaccagcaaaagctgcaagggcgagaaggaaatagatgaccagaagaattgcaaaaaacgccgggcactcgactttctctctcgacttcctctccccccccccgtcagtccgatctgtacttttgtcagccctgcagctcagaaggcgttccaaccccctagatcctgcggaacaaaatacgagactccaataaagaagaaagaactaaatagccctcagatgactcctttcaagaagtttaacgaaatctctcttctcgaatccaattcgattgcagatgaggaactggctctaatcaatacccaagctctgctctctggcagcacaggggaaaagcagtttatctcagtgagcgagtctactagaacggccccaacatcctcagaggactacttgcgactgaagcgacgatgcacgacatcccttattaaggaacaggagtcttcccaagctagcaccgaagagtgtgaaaagaacaagcaggatacgatcactactaagaagtacatttag

SEQ ID NO: 23104 - DNA, 1809 bp, Artificial Sequence
  Description of Artificial Sequence: Synthetic coding sequence
atgcccatcggcagcaaggagcggcccaccttcttcgagatcttcaagacccgctgtaacaaagctggaccaatcagtctaaactggttcgaagagcttagtagcgaggcgcctccctacaatagtgagcccgcagaggagtccgagcataaaaacaataattatgagcccaacctgtttaagaccccacagagaaaacctagctataatcagcttgcctcaacaccaatcatatttaaagagcaaggcctgaccctgcccctatatcagagccctgtcaaggagctcgataagtttaagctggacctgggccggaacgtgccaaattcccgccataaatctctgagaacagtaaagacgaagatggatcaggcggatgatgtatcatgcccactgctgaattcttgcctgtctgaaagtccagtcgtgttacagtgcacccacgttacacctcagcgcgacaaaagcgttgtgtgcggatcgctcttccacacaccaaaattcgtaaagggtaggcagacccccaagcacatttctgaaagcctgggcgccgaggtcgatcctgacatgagctggtcttcgagtctggcgacacctcctactttatcttccactgtgttaatcgtacgaaatgaggaagctagcgagaccgttttcccccatgacacaactgctaacgtcaagtcttatttctctaaccacgatgagagtctcaaaaagaacgatcggttcattgcctcagtcacagacagcgagaacacgaaccagcgagaggccgcctctcatggctttgggaaaacaagtgggaatagctttaaagtaaattcttgcaaggatcatatcggaaaatcaatgcccaacgtcctggaagacgaggtctacgagaccgtggtagatactagcgaagaggattccttctccttatgttttagcaagtgccggactaagaaccttcaaaaagtccgtacctctaagacacgaaagaagatttttcatgaagcaaacgcagacgagtgcgagaagtcaaagaatcaggtcaaagagaagtactcttttgttagtgaggtggaaccaaacgatactgatcccctcgatagtaacgttgccaaccagaaacccttcgaatctggctcagacaagatctctaaggaagtggtgcctagcctagcctgtgagtggtcacagctgacgctatcaggccttaatggagcccagatggaaaagataccattgctgcacatttcaagctgtgatcagaacatttcagagaaagacctgcttgacacggagaacaagaggaaaaaggattttctgacttccgagaacagcctgcccaggatcagttctttgccaaagagcgagaaaccactgaatgaagagaccgtggtgaataaaagagatgaggagcagcaccttgaatcacacacggactgtatcctcgcggtcaagcaggcaatatcaggtacgtccccagtggcgtcttccttccaggggatcaagaaaagtatctttaggatacgagaatccccaaaagagaccttcaacgccagtttctctggccatatgacagacccaaatttcaaaaaggaaacagaagcgagtgagagtggactggagattcacaccgtgtgctcccagaaagaggatagcctgtgtcctaacctgattgacaatggctcttggcctgccactactacccagaactcagtcgcgctgaagaatgcagggctgatcagtaccctcaagaagaaaacaaacaaatttatatatgccattcatgacgagacaagctataagggcaaaaaatag

SEQ ID NO: 23105 - DNA, 10257 bp, Artificial Sequence
  Description of Artificial Sequence: Synthetic coding sequence
atgcccatcggcagcaaggagcggcccaccttcttcgagatcttcaaaactaggtgcaacaaagctgaccttggcccaatcagtctgaactggtttgaagagctctccagtgaggcaccaccttataacagcgagcccgcggaggagagcgagcacaagaacaacaattatgagccaaacctgtttaagactcctcagcggaaaccttcctacaaccagttggcatccacgccgattatattcaaggagcaagggctcactctgcccctataccagtcccccgttaaggagctggacaaatttaaactcgatcttggaagaaatgtgccaaacagccgccacaaaagtttgagaactgtgaaaacaaagatggatcaagccgacgatgtttcctgtccgctgctcaactcttgcctctctgaatccccagttgtcctgcagtgcacacacgtgacgccccaacgggacaagtcagtggtttgtggcagtctgttccatactcctaagttcgtcaaggggaggcagaccccgaagcacatctcagagtccctgggcgccgaggtggatcccgacatgtcttggtcatcttcgctggccacaccccccaccctgtctagtacagttctgatagtgagaaatgaggaggcttcagaaacggtcttcccacacgatacaaccgccaacgtcaagtcttatttttctaaccacgacgagagcctgaagaagaatgatcgtttcattgcctctgtgaccgactccgaaaacacaaaccagcgcgaagccgcgagtcatggctttggaaaaacctccggcaactctttcaaagtcaattcttgtaaggaccacataggcaaatcaatgcccaacgtgctagaagatgaggtgtatgaaaccgtcgtggatacatcagaagaggactctttcagcctgtgctttagtaagtgccgcactaagaacctgcagaaggttcgaaccagtaaaactaggaaaaagatattccacgaagccaatgcagatgagtgcgaaaaaagtaaaaaccaggtgaaggagaagtactcttttgtgagcgaggttgagcccaatgataccgaccccctcgacagcaatgtagcaaaccagaagcctttcgaaagcggctcagacaagatttctaaagaggtggtgccttccttggcttgtgaatggagccagctaactctgtcgggcctaaacggggcgcagatggagaaaattccacttctgcatatctcttcctgcgatcagaacatctccgagaaagatttattagacacggaaaacaaacgaaagaaagatttcctgacatccgagaactctttaccccgcatatcttctctgcctaagtcagaaaaaccactcaacgaggaaaccgtggtcaacaaacgagacgaagagcagcatcttgagagccacaccgactgcattttggccgtcaagcaggccatttcaggaacctcacccgtcgcctcttcattccagggcataaagaaatccatcttcagaattagagagtctcctaaagagacctttaacgcatccttctcgggccacatgaccgatccgaactttaaaaaggagactgaggctagtgagagcggcctggagatacacaccgtgtgctcccaaaaggaagattcactctgccccaacctgattgataacgggtcttggcctgctaccacgacccagaacagcgtagctctgaagaatgctggactcatttccacactaaagaaaaaaaccaataagttcatttatgccattcacgatgagacctcatataagggaaagaaaattcccaaagatcagaaatcagaattaattaactgctctgcccagttcgaggctaacgcctttgaggctcctttgaccttcgccaacgcggattctggccttctgcactcgagcgtgaagaggagctgcagccagaatgatagtgaggagcccaccctgagccttactagttcctttgggactatcctgcgaaagtgcagccggaatgaaacgtgttcaaataacacggtcatcagccaagacctggattataaggaagctaagtgtaataaagagaagttacagctctttattacgccagaggctgattcgctgtcttgcttgcaggagggacagtgtgagaacgatcctaagtcgaagaaggttagcgatatcaaggaagaggtgttagccgccgcctgccacccagtccagcacagtaaggtagaatacagcgataccgacttccagagtcagaagtctctgctctatgatcacgagaatgcttccaccttgatacttacccctaccagtaaagacgtcctgagtaatcttgttatgatatcgagaggtaaggagtcctataaaatgtcagacaaactgaaggggaataactacgagtcagacgtcgaactcactaagaacatccctatggaaaagaaccaggacgtgtgcgcactgaatgagaattacaaaaacgtcgaattactgcctcccgagaagtatatgagggtggcttcaccctctaggaaggttcagtttaaccagaatactaacttacgggtgatccaaaaaaatcaggaggagactacaagcatctcaaaaataactgtcaaccccgattcggaggaactgttctccgacaatgagaataactttgtgttccaggtggctaatgagaggaataatctggccttggggaatactaaggaacttcacgagaccgatttaacatgtgtcaatgaacctatctttaagaacagtacaatggtgctatacggcgacaccggagataaacaggcaacccaggtgagtataaagaaggacttggtttatgtgctagcggaggagaacaaaaatagcgtgaaacaacatatcaagatgactctgggacaagatctgaagagtgatatcagtctaaatattgacaagatccccgagaaaaacaacgactacatgaataagtgggcgggactgttagggcccatatcgaaccattcattcggggggtcctttaggacagcctctaataaggagattaaacttagcgagcataatataaaaaagagcaagatgtttttcaaagatattgaggagcagtaccccacctctctggcctgcgtagagatcgtcaacactctggcgctggacaatcagaaaaagctttccaagccccagtcgatcaataccgtgagcgcccaccttcagtcttcagtcgttgtgagcgactgtaagaacagtcacatcacgccacagatgctgttctctaagcaggattttaattctaaccacaatcttactccctctcaaaaagcagaaattaccgaattgtccacaatattggaggaaagcggcagtcagtttgagttcacgcagtttagaaaaccaagttatatcctccaaaagagtacctttgaggttccagaaaatcagatgaccatcctgaagactacgtcagaggaatgcagagatgcggatctgcatgtcatcatgaatgcccctagcatcggtcaggtcgactcatcgaaacagtttgaaggaactgtcgaaattaaacgcaagttcgccggacttctgaagaacgactgtaacaaaagcgcctccggttatttgacagatgaaaatgaggtcggtttccgcggattctatagcgcccatggcactaagctgaacgtgtccactgaggccctgcaaaaagccgtcaaactgtttagtgatattgaaaacattagtgaagaaacttctgcagaggtccaccccatcagtttgagctcctccaaatgccatgattccgtggtgagcatgtttaaaattgaaaatcataacgataagaccgtgtctgagaaaaacaacaagtgtcagttgattctgcagaacaatatcgagatgacaaccggaacttttgttgaagagatcaccgaaaattacaaaaggaacaccgagaacgaggacaacaagtatactgcagctagtcggaattcccacaacctagagttcgatggttctgatagtagtaaaaatgatacggtgtgtattcataaagacgagacggatctcctgtttacagaccagcacaatatctgcttgaaactcagcggccaattcatgaaagaaggtaacacccaaattaaagaggatttatcagatctgacatttctggaggtcgcaaaggcgcaagaggcatgtcacggaaacacttccaataaggaacagctgaccgcaactaaaactgaacaaaatatcaaagatttcgagacatcagatacatttttccaaacagcgtcaggaaagaacatcagcgtggccaaggaatcctttaataaaatcgtgaattttttcgaccagaagccagaagagttacacaacttcagcctgaatagcgaactgcattctgacattagaaagaacaaaatggatatactctcatacgaagaaactgacatagtgaagcacaaaatcctgaaggagtcagtacccgtgggaactggcaatcaattggttaccttccagggtcagccagaaagagacgagaaaatcaaggagccaaccctgcttggattccatacagcatctgggaagaaagtaaaaattgcaaaggaaagcttggataaagtgaaaaacctgttcgacgaaaaggagcagggcacatctgaaataacatccttctctcaccagtgggccaagaccctcaaatatagagaggcctgtaaggacctcgagctggcctgcgaaaccatagagatcacagcggcgccgaagtgtaaggagatgcaaaactctctgaacaatgacaagaacctggtgtccatagaaacggtcgtcccaccgaagcttttgagcgataacctgtgtagacaaacggagaatctcaagacctccaagtccatcttcttgaaagtgaaggtccacgagaatgttgaaaaagaaacagctaagagccccgctacctgttatacaaaccagtcaccttacagcgtcatcgagaattcggcattggccttctacacctcttgcagtcggaaaactagcgtgagtcagacttccttactagaggcaaagaaatggctgcgcgagggcatttttgacggccaaccagaacggatcaacactgcagattacgtgggcaactacctgtacgaaaacaattcaaactccacaattgctgaaaacgataagaaccacctgagtgagaagcaggatacatacctctccaatagctcgatgtcaaacagttatagctatcacagcgacgaggtatataacgattccggctacctgagtaagaataagctagacagtggaatcgaacccgtacttaagaatgtagaggatcagaagaataccagttttagcaaggtcatctcaaacgttaaggacgcaaacgcctacccgcagaccgtcaacgaggacatctgtgtagaagagctggtcacctcttcctcaccgtgcaaaaataagaacgcagctataaagctgtctatctccaactcaaataatttcgaagtcggcccccccgcgttccgaattgcttctgggaaaatcgtgtgcgtgtcccatgaaacgattaaaaaggtaaaagatatctttacggacagtttcagtaaggtgatcaaggaaaacaacgagaataagtctaaaatctgtcagacaaagattatggccggctgttatgaggcgcttgacgacagcgaagacatcctacacaacagcctggataacgacgaatgctcaactcactcccataaggtgtttgccgatatacaatccgaagagatactgcagcacaatcaaaatatgtccggcttagaaaaggtgagcaaaataagcccctgcgacgtctcactagaaacaagcgacatttgcaaatgcagcatcggcaagctgcacaagtctgtgagctccgctaatacttgcggaatattcagcacagcctccggtaagtccgtacaggtgagcgatgcctctcttcaaaacgccagacaagtatttagcgagattgaagattctactaagcaggtcttcagtaaagttttattcaaaagcaatgaacacagtgaccagctgactcgagaggaaaataccgccattcgcacacctgagcacctgattagccagaaggggttcagttacaacgttgttaatagcagtgcattctcagggttctctacagcatccgggaaacaagtgtctatcctggagtcgtccttgcacaaggtgaaaggcgtattagaagagttcgaccttatccgaacagaacactccttacactactcgcccaccagtaggcagaatgtgagtaaaattctgccccgcgttgataagcggaaccctgaacactgtgtcaactccgaaatggaaaaaacatgcagcaaagagttcaagctgtctaataaccttaacgtcgaaggcggcagctccgagaataaccactccatcaaggtttcgccttacttaagccaatttcagcaagacaagcagcaactggtcctgggcacgaaagtctctctcgtcgagaacatccacgtcttgggcaaggagcaagcatcaccgaagaatgtgaaaatggaaatcgggaagacagaaaccttctcagacgtgcccgtgaaaacgaatatcgaggtttgtagcacatatagcaaagattccgagaactacttcgaaacggaggccgtggaaatcgctaaagccttcatggaggatgatgaacttacagactcaaagctgcccagccacgccactcattccttgtttacatgtcccgagaatgaggaaatggttctgagtaactctcgtatagggaagcgtcgcggagaacccttgatactggtgggggaaccaagcatcaagcgcaaccttctgaatgagtttgaccgtatcatagagaaccaagaaaaaagcctgaaagccagcaagtctactccagatggaaccattaaggaccgcagactctttatgcaccatgtgagtctcgagcccatcacctgcgtcccatttcggaccacgaaggaacgccaggagattcagaaccccaacttcactgcccctgggcaggaattcctttcaaaaagtcacctctacgagcatctgactctggaaaagagcagctccaaccttgcagttagcggacatccgttttaccaggtttctgccacccggaacgagaaaatgaggcacctgatcaccaccggaaggccaacaaaggtgttcgtccctccgttcaaaaccaagtctcatttccaccgagtggaacaatgtgtgagaaacataaatctggaagagaataggcaaaaacagaacattgacgggcacggcagcgacgacagcaagaacaagatcaacgataatgaaattcatcagtttaataagaacaatagtaaccaagcggtggcggtaaccttcacaaaatgcgaggaagaacctctggatcttataacgtcgctgcagaacgccagagatatccaggacatgcgcatcaagaaaaagcagagacagagggttttcccacagcccggctccttgtatctggctaaaacatccaccctcccaagaatcagtctgaaggccgctgtgggcgggcaggtcccaagcgcttgctcacacaagcaactgtacacatacggtgtatctaaacattgcatcaagatcaactccaagaatgctgagagctttcaatttcatacagaggactattttggtaaagaaagcttgtggactggcaaaggaatccagctggccgacggtggctggctgatccccagcaacgacggcaaggccggcaaagaagagttctatagggcgctctgtgatacgcccggggttgaccccaaactgataagtaggatttgggtgtacaaccattaccgctggattatatggaaactggctgccatggaatgcgcatttccaaaggaatttgcgaaccggtgcctctcccccgaacgggtcttattgcagctgaaatatcggtatgatacagagatcgatcggtcgaggaggtcagccattaaaaagatcatggagcgggacgacaccgcggccaagaccctggtactctgtgtgagcgatattatcagcctctctgccaacatctcagaaacatcttctaataaaacttctagcgccgatactcagaaagtggctatcattgaactgacggacggctggtatgccgtgaaagcccagctggatccccctctgctggccgtgctcaagaacgggcgccttaccgtcggtcagaagatcatcctccatggtgccgagttggtaggttctcccgacgcttgcacccctctggaagccccagagtcactgatgctgaagatctctgctaacagcacaaggcctgcgagatggtacactaagttaggtttttttcccgatccaaggccattcccgcttccattatcttcactcttctcagatggcggaaacgtcggctgtgtggacgtgataattcagcgggcctaccccatacagtggatggagaagacaagctccggactctacatttttcgaaatgaaagagaggaggaaaaggaagcagctaagtacgtcgaagcacagcaaaaacgtctggaagccctgttcactaaaattcaggaagagttcgaggaacatgaggaaaacaccaccaaaccttacctgccaagcagggctctcactcggcaacaagtgagagccttacaggatggagcggagctgtatgaagctgtgaagaatgcagctgacccggcctacctggagggttacttttccgaggaacaactccgggcgctcaataaccaccgacagatgctcaatgataagaagcaagcccaaattcaattagagattcggaaggccatggaaagcgctgaacagaaggagcagggtttgtctagagatgtcactactgtttggaaactgcggattgtgtcatacagtaagaaggagaaggattcagttatcctgtctatttggcgaccttcctctgacctatactcgttgttgacagagggcaagcggtatcgcatctaccacctggctacgtcaaaaagtaaaagcaagagcgagagagccaacatccaactcgcggccactaagaagacacaataccagcagttgcccgtgagcgatgagattctgttccaaatctaccagcctcgtgagcccctgcactttagcaaattcctggatccggactttcagcctagctgttccgaggtcgatctgattggctttgtcgtttcagtcgtgaaaaagactggtttagccccctttgtgtacctcagcgatgagtgctacaacctgcttgctataaagttttggatcgacttaaatgaagacataatcaaacctcacatgctcatcgcagcctccaacctgcagtggcgtcccgagtccaaaagcggcttgttaacactgttcgctggtgattttagcgtcttcagcgcaagtccaaaggaagggcattttcaggaaacatttaacaagatgaagaacaccgtggaaaatatcgacattctttgcaatgaggccgagaacaaattgatgcatatcctgcatgccaacgatcctaagtggtcaacccctacgaaggactgcacaagcggcccatacaccgctcagatcattcccggcactggcaataagctcctgatgagctcccccaactgcgagatttattatcagtcaccgctttctctgtgtatggccaagaggaagagtgtgagcacacccgtgagcgcccagatgacttcaaagtcctgcaaaggcgagaaggaaattgatgatcagaaaaactgtaaaaagcggcgcgcactcgactttttatctaggctgccattgccgcccccggtgagccccatatgcacttttgtgagccccgccgctcaaaaggcatttcagccacccaggtcgtgcggaactaaatatgaaacccccatcaagaagaaggaactgaactcgccgcaaatgaccccatttaagaaattcaatgagattagcctgctggagtccaactccatagctgacgaagagctggcgcttataaacactcaggctctgctgtcaggttctaccggcgagaaacagttcatcagcgttagtgaatccactcggacggctccaacgtcctcggaggactacttgcgccttaagaggcggtgcaccacatctttgattaaggagcaggagtcatcccaagcatccacagaggagtgcgaaaagaataagcaagatacaattacgactaagaaatacatatag

SEQ ID NO: 23106 - DNA, 2667 bp, Artificial Sequence
  Description of Artificial Sequence: Synthetic coding sequence
atgcactgccccggcgaggcccccctggccgccccccggcccaccccaaaggacccttgcctgaggaacgtcctagcaaaggcattgtacgataacgtcgcagaaagcccagatgaactctcgttccgcaagggcgacataatgacagtcctggagcaggacacacagggactggatgggtggtggctttgcagcctccatggaaggcagggaatagttcctggcaacagactcaagattttagtgggtatgtatgacaagaaacccgccggcccaggtcccggcccccctgcaacccctgctcagcctcagcccggcctgcatgcaccggctcctcctgctagtcagtatacgcccatgctaccaaacacctatcagccacaaccagactcagtgtatctggttcctacacccagcaaggctcaacagggcctctaccaggtacctggtccgagcccgcaattccagtccccacctgcaaaacagacatctacgttcagtaaacagacacctcatcatccattcccatccccggccaccgacttgtatcaggtccccccggggcctggagggcctgcccaagatatctatcaggtacccccctccgccggcatgggtcacgatatctatcaagtccctcccagtatggacaccagaagctgggagggaacaaagccgcccgccaaggtggtcgtgccaacacgcgtcggtcagggttacgtttatgaggccgctcaaccagagcaggatgagtacgacattcctcggcatctgcttgcgccaggcccacaggatatctacgacgtaccccccgtgcgaggtctgttgccctctcagtatggccaggaagtgtacgacaccccgccaatggctgtgaaaggtcccaatggaagggatcccctgctggaagtgtatgatgtgcctccttccgtggaaaagggtctaccaccatcgaaccatcatgctgtttatgatgttcccccctccgtgagcaaggatgtcccagacgggcccctcctgcgagaagagacatacgacgtgccccctgctttcgcaaaagcaaaaccatttgaccctgcacggacccctcttgtgctcgccgctccgcctccagatagtccgccggcagaagacgtgtacgatgtgcctccgcctgccccagacctgtatgacgtccctcccggactcaggagaccaggccccggcactctgtacgatgttcctagagagagagtcctgccaccggaggttgccgacggcggtgtagtggactccggcgtctacgcagttcccccccctgcggagagggaagctccggcggagggcaaaaggctgtcggcttcctccacaggctccaccaggtcaagccagtctgcttcatcccttgaggtggcaggcccagggcgggagcccctggaactggaggtggccgtagaagctttggctcggctccagcagggcgtgtcggccactgttgcgcatctgttggacctcgctgggtccgccggcgctactggtagctggcggagccccagcgagcctcaggagcccctggtacaggatctccaggccgccgtggcagcagtccaatctgccgtgcacgagttgttggaattcgctagatcagccgtgggcaatgcagcccacacatcagacagagccctgcatgctaagctcagtcgacaacttcagaaaatggaagatgtgcaccagacactcgtcgctcacggacaggcactggacgccggccgcggaggtagcggcgccactctagaggatctagatagattagtggcttgtagccgcgccgtgcctgaagacgccaagcagttagcttccttcctacacgggaacgcatcactccttttcagacgtacaaaggctacggcacctggacctgaagggggagggacattacaccccaaccctaccgacaagacttccagtatccagtctaggcctctgccgtccccccccaaatttacctctcaggacagtcctgacggtcaatatgaaaatagcgaaggtggctggatggaggattacgactatgtgcacctccaggggaaagaggagtttgagaagacccagaaagagctgttggagaaagggagcatcactcgtcagggcaagagccaactggagcttcagcagctaaagcagtttgaaagattggagcaagaggtatcaaggcccattgaccatgatttggctaactggacgccagcccaaccactagcccctggtcggactggaggcctgggaccatctgatcgccagctgttgctcttctatcttgagcagtgcgaggctaatttgactactttgactaatgcagtggatgccttttttacggccgttgccaccaaccagccgcctaaaattttcgtcgctcactcgaaattcgtgattctgtctgctcacaagctcgtattcataggcgacactctgtcccgccaagctaaagcagccgacgtgcgtagccaggtgacccactacagcaacctgctgtgcgacttgctgcgcggcatcgtggcaactacaaaggcagctgcactgcagtacccatcaccatcagcggcccaggacatggttgagcgcgtgaaggagttaggtcactctacccaacagttccggagggtgttgggccagctggctgcagcctag

SEQ ID NO: 23107 - DNA, 2613 bp, Artificial Sequence
  Description of Artificial Sequence: Synthetic coding sequence
atgaaccacctgaacgtgctggccaaggccctgtacgacaacgtggcagaatctccagatgaactgagctttaggaagggagacatcatgaccgtgctggagcaagacacccaaggtttggatgggtggtggttgtgttcactgcatgggaggcaggggatagtgcccggtaaccggctaaagatacttgtgggtatgtacgataaaaaacctgccggcccgggtcccggcccccctgcgactcctgcccagccccaaccgggcctgcacgctcccgctccaccagcttcccagtatacccccatgctgccaaatacttaccaaccccaacccgattcggtctacttagtgccaacacccagtaaggcccaacaggggctttatcaggttccgggaccttctccccaatttcagtctcctcctgctaagcagacctcaacgttctcgaagcaaacgccccaccacccattccctagcccagcaacagacctctaccaggtgcctcctggcccgggaggtcccgcacaggatatttaccaggtgcccccaagcgctggcatgggacatgatatctatcaagtccccccaagtatggacacacgatcctgggagggtaccaagccacctgccaaagtggttgttcccacccgcgtgggtcaggggtacgtctacgaggccgcccaacccgagcaagatgagtatgacattcctaggcatctcctggcccccggcccacaggatatctacgatgtgcctcctgtcagggggctcctgcccagtcagtacggtcaggaagtgtatgatacgccaccgatggctgtcaaaggacccaacggcagggaccctctcctggaggtgtatgatgttcccccaagcgtcgagaaaggcctccctccatcaaaccaccacgcagtctatgatgtaccaccctcagtctctaaggacgttcctgacggccccctcctgcgcgaagaaacctatgatgtacctccagcattcgcgaaagctaagccgtttgatcccgctcgcacccctctggtgttagctgctccccctcctgattctcctccagctgaggacgtctatgatgtgccaccgccggcacccgatctctacgatgtccccccaggtctgcgaagaccaggccccgggaccctctacgatgtgcctcgtgaacgggtgctccccccagaggtggccgatggtggcgtggttgactctggggtgtacgcagttccaccacccgctgaacgggaggcacccgcagaaggcaagagactgtccgcctcatctacagggtcgacgcggagtagccagagtgcttctagtttagaagttgctggtccggggcgcgaacccctggaactggaagtcgccgtggaagcactggcacggcttcagcaaggcgtcagcgccacagtggctcaccttctggatttagcggggagtgccggcgctacaggctcgtggaggtctcctagcgagccccaagaaccccttgtccaggacctgcaagccgccgtggccgccgtgcagagcgcagtccacgagctcctcgagtttgccaggtccgccgttggtaacgccgcccatacctcagaccgcgctttacacgccaaactatcccgccagctccaaaagatggaggatgtgcatcaaaccctggtcgcgcatggccaggccctggacgctggtaggggaggatccggggctacactcgaggatttggaccgattggtcgcctgttcacgagcagtccccgaggacgcaaagcagctggcctcctttcttcacggaaacgcttcactgctgttccgacgtacgaaagctacagcacccggacccgagggcggcggcacgctccatccaaatccgacggacaagacttcatctattcagagcagacccctgccctcccctcccaaatttacaagccaggactcgccagacggacagtacgagaactctgaggggggatggatggaggactatgattacgtgcacctgcaaggtaaagaggagtttgagaaaacacagaaagagctccttgagaagggctcaattacacgccaggggaagtcccaactggagctacagcagcttaagcagtttgagcgactggagcaggaggtgtcccgacccatcgatcacgatctggcaaactggacacccgctcaacctctcgctcccggccggacgggcggattggggccttccgatcgccaactgctgcttttttatctggagcaatgcgaggccaaccttaccacactgaccaacgccgtggacgccttcttcaccgctgtggccacaaatcaaccaccaaaaatctttgtcgcccatagcaagttcgtcattctgtccgcacataaactagtgtttattggcgacacactctcgcggcaggcaaaagcagcggatgtgagatctcaagtgactcactactctaacctgttgtgcgacctcctgcgcgggattgtcgccactactaaggccgcggcactccagtaccctagcccgtcagccgcgcaagatatggttgagcgcgtgaaggagttaggacactccactcagcaattcaggcgggtgcttggccaactcgcggcggcctag

SEQ ID NO: 23108 - DNA, 2667 bp, Artificial Sequence
  Description of Artificial Sequence: Synthetic coding sequence
atgaaccacctgaacgtgctggccaaggccctgtacgacaacgtggccgagagcccggatgaactgagcttcaggaagggagatatcatgaccgtgttagagcaggatacccagggactggacggctggtggctgtgctccctccacggtagacaagggattgtccccggtaaccgcctgaagattctggtgggaatgtacgacaagaaaccagctggacctggccccgggccccccgctacccctgcgcaaccgcagccgggcctccacgctcccgcccctccagctagtcagtatacacccatgctgccaaacacatatcaaccacagcctgactcggtgtacctggtgcctacccctagcaaggcccagcaggggctgtaccaggttccaggcccgtctcctcagtttcagtcaccgcctgctaagcaaacatccactttttcaaaacagactccacaccatccattcccatccccggccactgacctttaccaggtacccccaggaccaggaggccctgctcaggacatctaccaagtgccccccagtgcaggtatgggccacgacatctatcaggttcctccaagtatggatactcggagttgggaaggaaccaagccccctgcgaaggtggtggtgcctacccgcgtcggccaaggctatgtgtacgaggcggcccagcccgagcaggatgagtatgacataccccgacacctgctggctcctggccctcaggacatctatgatgtccctcctgtgagggggctgcttccctcacagtacggccaagaagtgtatgatacacccccaatggctgttaagggccccaacggacgcgacccactcctcgaggtttacgatgttcctccttctgtcgagaagggcctgcccccttcgaatcatcacgccgtgagtaagtgtcagggaaatgccagagcaaggctgcgcctctggggcgtgtgggtgtatgatgttccgccctctgtgtctaaggatgttccggacggtccgttactgcgggaggagacctatgacgtgccgcccgcctttgccaaagcgaagcctttcgacccagcgcggaccccgctagtcttagctgcaccaccccctgattcacccccagccgaggacgtgtacgacgtcccaccccctgcccctgacctgtacgacgtgcctcctggcctgcggaggcccggccccggaacattatatgatgtgcccagggagagagtgctcccacctgaggttgcagatggaggcgtggtcgacagtggggtgtatgccgtgcccccgcccgcagagcgggaagcaccagctgaaggcaagagactgagcgccagttcaactgggtctacaagatcttcccagtccgcttcctccctggaagtagccggtcctgggagggaacctctggagctggaagtcgccgtggaagctcttgctcgcctgcagcagggcgtctccgctacagtcgcacacttactggacctcgccggctcagctggggcaaccggctcctggcggagcccctccgagcctcaggagcccttagtgcaagatctgcaagcagcagtggccgccgtgcagtctgccgtacacgagctgttggaatttgctaggtctgctgtcggtaatgctgcacatacttccgatcgggctcttcacgcaaaactgtccaggcagctccagaaaatggaagatgttcatcagacgctggttgcgcatggacaggccctagacgccggacgtgggggctccggagctacattagaagatttggacaggcttgtggcctgttcaagagctgtccccgaggatgctaagcaacttgcttcctttctgcacgggaatgcatccctgctgttccgtcgtacaaaagccaccgcccctggacccgaagggggggggacactgcacccaaaccctacagacaagacaagcagcattcagtcacggccactgccatcaccgcctaagtttacgtctcaagattcacccgacgggcagtacgagaacagcgaggggggatggatggaagactacgactatgtgcaccttcaggggaaggaagaattcgaaaaaacccaaaaggagctcctggagaaggggagtataaccaggcagggcaaatcccagctcgagctgcaacaactgaagcagtttgaacgcttggaacaggaggtgagccgccctatcgatcatgacttggcaaactggacacctgcccagccactggcccctggcaggacaggtggtctgggaccaagtgatcgacagcttctactgttctacctcgaacagtgtgaggcaaatcttacaacgctgacaaatgccgtggatgcgtttttcacggcagttgctacgaaccagccccctaagatattcgttgcacactctaagtttgtgatactaagtgcacacaaacttgtgttcataggtgataccctgtctcgccaggccaaggcagccgatgtgagatctcaggtgacgcactatagtaatcttctttgcgacctccttaggggcattgttgcaaccaccaaggccgccgcccttcagtacccaagcccttctgccgcacaggatatggtggaaagagtgaaagagctgggccattccacccagcaattccggagagttctcggtcagcttgcagctgcctag

SEQ ID NO: 23109 - DNA, 2751 bp, Artificial Sequence
  Description of Artificial Sequence: Synthetic coding sequence
atgcccgccaagcccttcctgagcagcgtgctgctgagctggaaggtcctggacttcagcggacccggcccgcagggcacaggccaaccatgctcttgcggccattgggccgaggggcagggtggtccacccgaacctgctggcggcccaaatgtcctggcaaaagctctgtatgataatgttgccgagagcccggatgagctgtcatttagaaaaggagatatcatgacagtgctggaacaggacacccaagggctggacgggtggtggctgtgctcccttcacgggaggcaaggaattgtgcctggtaatcgactaaagatactggtggggatgtatgacaaaaaacccgccggcccaggccccggtccacccgccactccagcccagccacagcccggactgcatgcaccggcccctcctgcctcgcaatacacaccaatgctgcccaacacataccagccccaaccggattccgtttacctggttccaacaccgtccaaggcccaacagggcctgtatcaggtgccgggtccctctccacagtttcagtcaccccccgctaaacagacatctacatttagcaagcaaacaccccaccatccgttccctagccccgctacagacttatatcaagtcccccccggtccaggcggccctgcacaggatatatatcaggtgcctccaagcgctggcatgggacatgacatctaccaggtaccccctagtatggacaccagatcctgggaggggacaaaacctcctgctaaagtcgtagtgcccacccgagtcggacaggggtacgtgtatgaggctgctcagcctgagcaggacgaatacgatatccctaggcacctcctggctcctggcccccaggacatctacgacgtgccacccgtgcggggcttgctgccatcccagtatggtcaagaggtctatgatacacctcccatggctgtgaaaggccccaacggtcgagatcccctgctggaggtttacgatgttcccccttcagtcgagaagggcttgccaccttctaatcatcatgctgtgtatgacgtccctccatccgtgagtaaggatgtgccagatgggcccttgttaagagaggaaacatatgacgtaccaccagcattcgccaaggcaaagccctttgaccctgcaagaacgcctctggtcctggcagcacccccaccagattccccccccgccgaggatgtgtatgacgtgcccccaccagcaccagacttatacgacgtcccaccaggccttcgcaggcctggcccgggaacactatacgatgtcccccgggagcgagtattaccccctgaggtcgctgatggaggcgtggttgactccggagtgtatgccgtgcctccacccgccgagagggaagcccctgcggaggggaagcggctttcggcctccagtaccggatccacccgaagctcacagtccgcgagctcacttgaagttgcagggcccggtcgggagcctcttgagctcgaggtcgctgtcgaggcactagcacgcctccagcagggggtgagcgctactgtggctcatctactggatctggctgggtccgctggcgccacaggatcttggcggagtccctctgagccccaggagcctttagtacaggatcttcaggccgccgtggccgccgtacagtctgctgtgcacgaacttctggagttcgcacggagcgctgtaggcaatgccgcacatacttcagatcgcgccttgcacgcaaaattatcccggcagctgcagaaaatggaggatgtgcaccaaaccttggtggcgcacggccaggctcttgacgctggtagaggtggatccggtgctaccctcgaggaccttgaccgcctggttgcctgctcccgagctgtccctgaggatgctaagcagctggctagcttcctgcatggtaacgcttcacttctatttcgcagaacaaaggccactgcaccaggcccagagggcgggggcactctgcatcccaaccccacagacaagactagcagtattcagtcccgacctctgccctccccaccaaagtttacatcacaggacagcccagacggccagtacgaaaattcagagggtggctggatggaggactacgattacgtgcatctgcagggaaaagaggaatttgaaaaaactcagaaggagcttctggagaaaggatcaattacccgacaaggtaagagtcagttagaacttcagcagctgaagcagttcgaacggctagaacaggaagtgagccgccctatcgaccacgatctggccaattggaccccagcccagcctcttgcacctggccgtaccggtggcctgggaccatctgatagacagcttctcctgttttacctggaacaatgcgaagctaatctgactacactcacaaacgccgtcgacgcgttcttcaccgcagtagccaccaatcagcctcccaaaatcttcgtggctcactccaagtttgtaatcctgagcgctcataagcttgtctttataggagataccctgtcccgacaagccaaggccgctgacgtgaggtctcaagtcacacactatagcaatctgctctgcgatctgctgaggggtatcgtggccaccaccaaagcagctgcgttgcagtatccatctcctagtgctgctcaggacatggtcgagcgcgtgaaggagctgggacactcaacccagcagttccgaagggtcctcggccagttggccgcggcatag

SEQ ID NO: 23110 - DNA, 2667 bp, Artificial Sequence
  Description of Artificial Sequence: Synthetic coding sequence
atgctgacccaccggccccaggaggccgagcagcggggccggaccccagggccatcattcgaatggaacgtgcttgcaaaggcgttgtacgacaatgttgccgagagtcctgatgagctgagcttccggaagggagatataatgaccgtgttggagcaggatacccaggggctcgacggctggtggctctgtagtctgcacggacgccaggggattgtaccaggaaaccgccttaaaatcctcgtagggatgtatgacaagaaacccgcgggccccgggcctggacctcccgctaccccggcccagccacaacccgggctacatgccccagctcctcccgcctcccagtacacacccatgttaccgaatacatatcagcctcagccagattctgtgtatttagttcccactccatctaaagcccagcagggtctgtatcaagttccgggcccttcacctcagtttcagtctcctccagccaaacaaacctcaacattcagcaaacagaccccccaccacccctttcctagtccggcaacagatctgtaccaagtgccgcccggtcctgggggtcccgctcaagatatctatcaggttccgcccagcgctggtatgggacatgacatataccaggtcccacctagcatggacactagatcctgggaaggcactaagccgcctgccaaagtggtggttccgacgcgggtagggcagggctatgtctacgaggctgcccagccagagcaggatgagtatgacatccccaggcacctgctggccccaggccctcaggatatttatgatgtacccccagttaggggactgcttcccagtcagtacggtcaagaggtctacgacaccccaccaatggctgtgaaggggccaaacggtcgtgacccactcctggaggtgtacgacgtgccaccaagcgtcgaaaagggtttgcctccttctaatcaccatgctgtgtatgacgtgccgccgtcagtttccaaagacgtacctgacggccctttgttaagagaggaaacctatgacgttccccctgcattcgccaaagccaagccctttgatccagctagaacacctttggtgctggctgctccacctccggactctccaccagcggaagatgtctatgacgtgcctccccccgcccccgacctgtatgacgtgccgccaggactgcgacgccccggtcccggcaccctctatgatgtgccaagagagcgcgtcctgccccccgaagttgcggacggtggggtcgtggactctggagtttatgccgttccgccccctgccgaaagagaggccccagccgagggcaaacgactgagtgctagcagcactgggtcaactcgcagctcacagagtgcttcttccctagaggtcgctggccccggccgggaaccattggagctagaggtggccgtagaagcgctggcccgtctgcagcagggggtatccgccactgtggcccacctgcttgaccttgccggatccgccggagccactggctcttggcggtctccaagtgagccccaggagccactcgtgcaagacctgcaggcggctgtcgctgccgttcagtccgccgttcacgagctcctcgaatttgcccggtccgccgtgggaaacgctgcgcatacaagcgaccgggccctgcacgctaaactgtcccgacagcttcaaaaaatggaggatgtacatcagacattagtggcccatggacaggctctggacgcaggtcggggcgggtccggtgccactctggaggatctggacaggttggtggcatgttcacgcgcagtgcctgaggatgctaaacagcttgcttctttcctccatggcaacgcttctttgctgttccgaaggaccaaagccacagctcctggacctgaggggggcggcacactgcatccaaatcccaccgacaaaacgtctagtatccagtcccgtcccctgccctctccccctaaatttacctctcaagacagccccgatggacagtacgagaactccgagggcggttggatggaggattacgactacgtacatctgcaaggtaaggaagaattcgaaaagacccagaaggagctcctcgaaaaagggagtatcacaaggcagggcaagagccagttggagctccaacagctcaagcaattcgagaggctggaacaggaagtgagcaggcccatcgatcacgacctggccaactggacccccgcacaacctcttgcgccagggcggaccggtggtttgggaccatcagaccgacagttacttcttttttatctcgagcagtgtgaggcaaatctgacaacattgacgaacgcggtagatgcgttcttcaccgctgtagctaccaatcaaccaccgaagattttcgtcgcacatagcaagtttgttattctcagcgcccacaagcttgtgttcattggagatacactatcccggcaggcgaaggccgctgacgtgaggtcccaggtcactcactactccaatctactgtgtgatctcctcaggggcattgtcgctacaacaaaagctgccgctctacagtatccgtccccatctgccgcgcaagacatggtggaacgggtgaaggagttggggcacagtacgcagcaatttagacgcgtgctggggcaattggctgcagcttag

SEQ ID NO: 23111 - DNA, 2169 bp, Artificial Sequence
  Description of Artificial Sequence: Synthetic coding sequence
atgcagggcaagaacgtgctggccaaggccctgtacgacaacgtggcagaatcacccgacgaactcagcttccgcaaaggcgatattatgaccgtgctggagcaggatactcagggcctagatggctggtggctctgtagccttcatggccgacagggcattgtcccagggaatagactcaaaatcctggtcgtggttcccacccgtgtggggcaggggtacgtttatgaagccgcccagccagagcaggacgagtatgacattccacgccatctcctggctcccgggccacaggacatttacgacgtgcctcccgttcgcggcctcctgccgagtcagtatggccaagaagtgtacgatacacctcccatggccgtgaaaggaccgaacggaagagaccccttgctcgaggtctatgacgtaccacctagtgtcgaaaaagggctgcccccctcgaaccatcacgccgtgtatgacgtgccgccctccgtgtctaaggatgtgcctgacgggccgctactgagggaagagacctacgatgtcccaccagcctttgcaaaagcaaagccttttgatcctgccagaactcccctggtgctggcggcccccccccctgactcccctcctgcggaggatgtgtacgatgtccctccacccgcaccagatctgtatgacgtgcctcccggactcaggagaccagggccaggaacactctacgatgttcctcgagaacgggttttaccccccgaggtggcagacggcggagtcgtggactccggggtctatgccgtgccccctccagctgagagagaggcccctgctgaagggaaaagactgagtgcgtccagtacaggatcgacgcgatccagtcaaagcgcctctagcctggaagtggccggcccaggcagagagcccttggaactggaagtcgctgtggaggctctggccaggctccagcagggagtttctgctacagtggcccacctgctagacctggccggttcagctggagccaccggttcttggagaagccctagtgaaccccaggagccactggtccaagacctgcaagctgcagtggctgcggtgcaatctgccgttcatgagttattagagttcgcacggtctgccgtcggtaacgctgcccacacttccgacagagccctgcatgccaagcttagtcgccagttgcaaaaaatggaagacgtgcatcagactctggtggctcacgggcaagcactagatgccggtcgcggtgggagcggcgctacccttgaagacctggatcgcctcgtggcttgcagcagagccgtccctgaagatgctaagcaacttgctagttttctgcacggcaatgcatctctgctattcagacgaacaaaagctactgccccaggaccggaggggggcgggacactccacccaaatccaacagacaagacttcttctattcagagccgaccacttcccagcccccccaagtttacatctcaggacagccccgatggtcagtacgaaaatagtgagggcggttggatggaagattatgattacgtgcatctgcagggaaaagaggagttcgagaaaacccaaaaagagctccttgagaagggctctatcacaagacagggcaaaagtcagcttgaactgcagcaactgaagcagttcgaacggttggagcaagaggtctctcgccctattgatcacgatttagccaattggacccctgcgcaacccttggcccctggacggactggcgggctgggcccctctgatcgtcagttactgcttttctacctggagcagtgcgaggctaacttgacaaccctgactaacgcggtggacgctttctttacggcagttgcgaccaaccaaccccctaagatcttcgtcgctcatagcaagtttgtaatcttgtctgcacataaactggtcttcatcggtgatacactctcaaggcaggcaaaggccgccgatgtgcgcagccaggttacacactatagcaacctgttgtgtgatctcctcagaggcatcgtggccaccactaaagccgctgcactgcaatacccgagtccgtccgctgctcaggatatggtggaacgggttaaagagttggggcacagtacgcagcagttcagaagagtcctgggccaactcgcggccgcttag

SEQ ID NO: 23112 - DNA, 2613 bp, Artificial Sequence
  Description of Artificial Sequence: Synthetic coding sequence
atgagcgtgcccaacgtgctggccaaggccctgtacgacaacgtggcagaatctcccgacgagctaagttttaggaagggggatatcatgacggtgctggaacaggacactcaaggactcgatggatggtggctctgttccttacacggacgacagggtattgtgccgggtaatcgtctgaagatattggtaggcatgtacgacaaaaaaccagcaggaccagggccaggaccccctgccacccctgcgcaaccgcaaccaggcttgcacgcaccggccccccccgccagccagtacactcctatgctgcccaatacctaccagccacagcccgattcagtgtacttggtaccaacacctagtaaggcgcagcaaggcctctatcaagtaccgggtccatcgccccaattccaatcaccacccgcaaagcagaccagcacatttagtaagcagacccctcatcatcccttccccagtcccgccaccgacttgtaccaggtaccaccaggccctggcggtcctgcccaggatatctatcaggtgcctcccagtgcaggaatgggccacgatatctatcaggtgcctccaagcatggatacccgaagctgggagggtaccaagccaccggccaaagtggtggtccccacgcgagtggggcaaggctatgtttacgaggcggcacagccggaacaggatgaatacgacatccccagacaccttctggctccaggacctcaggatatctacgacgtcccacccgttcgggggcttctgcccagtcagtacggccaggaagtatacgacactccacccatggccgtgaagggccccaacggacgggaccccctgctggaggtctacgatgtgcctccttcggtggaaaaagggctgccaccatctaatcatcatgcagtttacgatgtgccaccctccgtgtctaaggacgtgcctgacggccctctgttacgggaggagacctacgatgtgccaccggccttcgcaaaagctaagccatttgatccggcccgtaccccattagtgcttgctgcccccccccctgacagtccaccagcagaggatgtctacgatgtccccccacctgcccccgacctgtacgatgttccacccggcctccgacggcccgggcctggaactctctacgacgtccccagagagagggtcctgcccccagaagttgctgatggtggcgtcgtagacagcggggtgtacgctgtgccaccccctgcagagagggaggcgccagccgaaggcaaacggctctcagctagtagtactggctcaacgagaagcagccagtccgcctcttctcttgaggtcgccggtccaggccgggagcccctcgagctcgaggtcgcggtggaagccctcgctagacttcagcagggagtgagcgcgactgtggcacacttactggatctggcagggtctgcgggtgccactggttcatggcgtagccccagtgagccccaggaacctctggtccaggatcttcaggccgcagtagcggcagtgcaaagcgccgttcacgagcttctcgagttcgcccgctctgcggtcgggaacgcagcacacacctccgacagggcactgcatgcaaagctgtccagacaattgcagaaaatggaggatgttcaccagacacttgttgcccacggacaggcacttgatgcagggaggggcggatctggagcaacactggaggatttggacaggttagtggcatgctccagagcagtccctgaggacgcaaaacagttagcaagttttctgcacgggaacgctagccttcttttcagaagaacaaaagcaaccgcccccggcccagagggtggtgggacacttcatcccaaccccaccgacaaaaccagtagcattcagtcacggccacttccctccccgccgaagtttacttcacaggactctccagacgggcagtatgaaaactctgagggcgggtggatggaggactacgattacgtacacctccaggggaaggaagagtttgagaagacacagaaagagctgctggagaagggcagcatcaccaggcagggtaaatctcagttggagctacagcagctaaaacagttcgagcggctcgagcaagaggtgtcacggcccattgaccacgatctcgcaaattggacacctgcccaacccttggctccaggacgcactggcgggttggggccttccgaccgtcagttacttctcttctatctcgagcagtgtgaggccaacctaaccacgctcactaacgcagtggatgctttttttacggctgtcgcgaccaatcagccaccgaaaatctttgtggctcactccaagtttgtaatcttgtctgcacataaactggtctttatcggggacacgctttctcgccaggccaaagccgccgatgtgagaagtcaggtcactcactactctaacttactttgcgatctgctgaggggaattgtggccacgacaaaggccgcagcactgcaatacccaagtcctagtgccgcccaagacatggtggagcgagtgaaagaacttggccacagcacgcaacagttcaggcgcgtcctcggacaattagcagcggcctag

SEQ ID NO: 23113 - DNA, 2607 bp, Artificial Sequence
  Description of Artificial Sequence: Synthetic coding sequence
atggagaacgtgctggccaaggccctgtacgacaacgtggccgagtccccagatgaattgagctttaggaaaggcgacattatgactgttctggagcaagacacacaggggcttgatgggtggtggctttgcagcttacatggtaggcagggaattgtgcccggcaaccggttgaagattttagtgggaatgtacgacaagaaaccggctggcccggggcccggcccacccgctactcctgctcagccccagcctgggttacacgcgcctgcacctccagcaagtcagtatacacccatgctccctaatacataccaaccgcaacctgacagcgtgtacctggttcctacacccagcaaagcccagcaaggtctgtatcaggtccctggaccctctcctcagttccagtctccaccagctaaacagacaagcacattctccaagcagactccccaccaccccttcccaagcccagccacagacctatatcaggtgccccctgggcccggcggacccgcccaggatatttaccaggtgcctccgtcagcgggcatgggccacgacatataccaggtgccaccttcgatggacaccaggtcctgggagggcaccaagccacctgcaaaggtggtcgtccccacacgagtcggtcaggggtatgtgtatgaagccgctcagcctgaacaggatgaatacgatattcccaggcacctgctcgcaccgggccctcaagatatctacgacgtacctccagtacgtgggctccttccaagtcagtatggacaggaagtgtatgacacacctccaatggccgttaaaggccccaatggaagagatccattactcgaggtctacgatgtgcctccctctgtggaaaaaggtttgcctccctccaatcatcatgctgtctacgatgttccaccctctgtcagtaaagacgtgccagatggtccactactgagggaagaaacatacgatgtcccccctgcatttgcaaaagcaaagccctttgacccagcccggacccctctggtgctggccgctccaccccctgactccccacccgcagaggatgtttatgacgtcccgccgcccgcaccagacctctatgacgttcctccaggcctgagacggccagggcctgggaccttgtacgacgtgcctagagagcgtgtactacctcctgaagtggcggacggcggcgtggttgactctggggtgtacgctgtgccccctcctgccgagcgggaagccccagcagaggggaagagactatccgcctcatctaccggatcaactaggtcatcgcagtcagcttccagcctggaggtcgctggacccggcagagagcccctggaactggaagtggcggtggaggccctggctcgcctgcagcagggagtgtccgccaccgtcgcccatctcctggatttggctgggtctgcaggcgcaactggctcatggcggtcaccctcggagcctcaggagccactggtgcaagacctgcaggccgctgtggctgctgtgcagtccgccgtccacgagctcctggaattcgcacgctccgcggtgggcaatgccgcccacactagcgaccgggctctgcatgctaaactatcaagacagctgcagaaaatggaggacgtgcaccagaccctcgtggctcacgggcaagcactggatgctggaagaggaggaagtggtgcaactctcgaagatttggatcgcctggtggcatgtagccgggccgtgcctgaagatgcgaagcaactcgcctcctttctgcacggcaacgcctcattgctttttcgtagaaccaaggcgaccgcccctggacccgagggcgggggtacactgcatccaaacccaaccgataaaacttcctcgattcagtcacggccccttccgtctccacctaaattcacttcccaggatagtcccgacgggcagtacgaaaacagtgagggcggatggatggaggattacgattacgttcatctccaaggcaaggaagaattcgaaaagacacagaaggaacttctggagaagggctcaatcactcggcagggaaagagccagttagagttacagcagctgaaacagtttgaacggctggaacaggaggtgtcccggccaatcgaccacgatttagccaattggacacctgcgcagcccctggcccctgggcggaccggggggttagggccctccgacagacaactcttgctattctatttagagcagtgcgaagcaaacctaacaacactgaccaatgccgtggacgcattcttcacagccgttgccacaaatcagccacccaaaatctttgtggcacactcaaagtttgttattctctctgcccacaagctggtgttcatcggggataccctctcccggcaagcaaaagctgccgacgtccggtcgcaggtgacccattatagcaaccttctttgcgacctacttcggggaatcgtggcaaccacaaaagccgccgcccttcaatacccaagcccgtccgcagcgcaggatatggtcgagagggtgaaggaactggggcatagcacacagcaattcagacgggtgctgggacaacttgccgcagcttag

SEQ ID NO: 23114 - DNA, 2526 bp, Artificial Sequence
  Description of Artificial Sequence: Synthetic coding sequence
atgaccgtgctggagcaggacacccagggcctggacggctggtggctgtgttcccttcacggtagacaaggaattgtgccgggcaatcggttgaagattctggtgggcatgtacgataagaagcctgccggcccagggccaggacctcctgctaccccagcacagccccaacccggtctgcacgcccctgcacccccagcatcccagtacacaccaatgctgccaaacacctaccagcctcagcctgactccgtgtacctagtgcccacaccttccaaagcccagcagggattgtatcaggtgcccggcccctctccgcagtttcagtccccccctgctaagcaaacctccactttcagcaaacagacaccccatcacccattcccgtcaccagcgactgatctctaccaggtccctcctggacctggaggtccagcacaagacatttaccaagtgcctccaagtgcaggcatgggccatgacatttaccaggtacctcccagtatggataccaggagttgggaaggaaccaagccgcctgccaaggtggtggtccccaccagggtcggacagggttacgtttacgaggccgcccagccagagcaagacgaatatgacattccccgccatttattagctccgggccctcaagatatctacgatgtgccgcccgtgcggggcctccttccatcgcagtacggtcaagaggtatatgacactccacctatggccgtgaagggccccaacggccgggaccccctcctggaagtgtacgatgttccaccatctgtggaaaaggggctgccaccatccaatcaccacgccgtgtacgatgtgccaccgtctgtatccaaagacgtgccggatggtcctttgttaagggaagagacatacgacgtccccccagcttttgctaaggcaaaaccatttgacccggcccgtacgcccctggtacttgctgcccccccccctgactctcccccagccgaggacgtgtacgatgtgcctcctccagcgcccgacctgtatgatgtgccccccggccttcgcagacctggacccggaacactctacgacgtcccacgagagagagttttgcccccggaggtcgctgacggaggggttgtggattcaggcgtctatgccgtgcccccccccgccgaacgtgaggcccctgcagagggtaaaaggctctcagcatcaagcactggtagtaccagatcctcccagagtgctagcagtctagaggtggccggccccggccgtgagcctctagagctggaggtggccgtggaagctctcgcccgcctgcagcagggcgtcagtgccaccgtcgctcacctgcttgacctcgccggctcagctggagccactgggtcttggcgatctccttctgaaccccaggagcctttggtgcaagacctgcaggctgcggtggcagcagtacagtctgccgtgcacgaactcctggagtttgcacgtagcgcagtgggaaatgctgcgcatacatctgatagggcgctgcatgcgaagctcagtaggcagttgcagaagatggaggacgtccatcagaccctggtcgcgcatggtcaggcgctcgacgccgggcggggaggaagtggggctactctggaggacctggatcggctggtagcctgcagccgtgctgtccccgaagatgctaaacagctggcttcattcctccatggcaacgcctcccttctgttccgccggaccaaagctacagcgcctggccccgaagggggaggcactctgcaccccaatcccactgacaagaccagctctatccagagtcgcccactcccatcaccacctaaattcacgtcccaagactctcccgacggacagtatgaaaactctgagggcggctggatggaggattatgactacgtacacctccaggggaaggaggagttcgaaaaaacgcagaaggagctgctggagaaagggtccatcacaagacagggtaagtctcagctggagttgcagcaattaaaacaatttgaacgtctggagcaggaagtgagccggcccattgaccacgatctggctaattggaccccggcgcagccactcgctccaggaaggactggcggccttggtcctagtgaccgacaactcctccttttctacctcgagcagtgcgaagctaacctaactacactcacaaacgccgtcgatgctttcttcacagccgtggctactaatcagccccccaaaatattcgtcgcacattctaagtttgtcatcttgtccgcccataagctggtttttatcggggacacgctgagccggcaagctaaggccgcagacgtacggtcgcaggttacacactatagtaatctgttgtgtgacctgctcagaggcatcgtggccacaactaaagcagccgctcttcaatacccttctccaagcgctgctcaagatatggtggaaagagtcaaagaattaggccattccactcagcaatttcggcgcgtgctgggacagctcgccgccgcctag

SEQ ID NO: 23115 - DNA, 741 bp, Artificial Sequence
  Description of Artificial Sequence: Synthetic coding sequence
atgcccgtgcagccccccagcaaggacaccgaggagatggaggccgaaggcgacagtgccgccgagatgaacggagaagaagaggagagtgaagaagaacgttcagggtcacagacagaatcggaagaggaatccagcgaaatggatgacgaggactatgaacgcaggcggtcagaatgcgttagtgagatgctggatttagaaaaacagttctccgaactgaaggagaaactctttcgagagcgcctgagccaactgcgactgaggctcgaagaagtgggggccgaacgggccccagaatacacggagccccttggaggacttcagcggagtctgaaaattagaatacaggtcgctggtatctataaagggttttgccttgatgtcatccgaaacaaatatgagtgcgaactgcaaggcgcaaaacaacacctggaatccgaaaaactgctgctctacgataccttacaaggggaactacaggagcggattcaaaggctggaggaagaccgccagagtctagatctatcatcggaatggtgggatgataaactacacgcccggggatcttctcggagctgggatagcctgccacctagcaagcgaaaaaaggcccccctggtgtcaggaccttacatcgtatatatgctgcaggaaattgacatactggaagattggaccgccatcaagaaggccagggctgccgtttccccacaaaaaaggaaaagcgacggcccctag

SEQ ID NO: 23116 - DNA, 873 bp, Artificial Sequence
  Description of Artificial Sequence: Synthetic coding sequence
atgcccgtgcagccccccagcaaggacaccgaggagatggaggccgaaggagactccgccgcggaaatgaatggggaagaagaagagtctgaggaagagcgcagcggtagccaaaccgaatctgaggaggagtcatccgagatggacgacgaggattacgagcggaggcggagtgaatgcgtgtctgaaatgcttgacctggagaagcaattctctgagcttaaggagaagctgttccgcgagcggcttagccaactcagactgcggctcgaagaggtgggggccgagagggctccagagtacacagaaccactaggcggattgcagcgtagcctgaagatccgaattcaggtcgctggtatatacaaaggattctgtctggatgtgattcggaacaaatatgagtgcgaactccagggagccaagcagcaccttgaatcagagaagttgctgctgtatgacactctgcaaggcgagttacaggagcgcattcagcggttagaggaggaccgacagtcactcgatcttagcagtgagtggtgggacgataagctgcacgcgcggggcagtagccgaagttgggatagccttccaccttctaaacgaaagaaagcacctttggtctccggaccttacatcgtgtacatgctgcaagagattgacattctagaagactggacagctattaagaaggctcgggccgccgttagcccccagaagcgcaaatccgacgatcgaaggacacatcgccctttgcgggtttgccctgctcgactgctttggtgttgctgggctctacccttgcacctggctctcgcatggaccccccccctgccttcgagcagacccgcacagctgtggccttggtcttag

SEQ ID NO: 23117 - DNA, 735 bp, Artificial Sequence
  Description of Artificial Sequence: Synthetic coding sequence
atgcccgtgcagccccccagcaaggacaccgaggagatggaggccgagggcgactctgctgccgagatgaatggtgaagaggaggagagtgaggaggaaagatccggatcccagacggagtcagaggaggaatcatctgagatggatgatgaagactacgagagaagaaggtcagagtgcgtgtctgagatgctagaccttgaaaagcagttcagtgaactcaaagagaagttgtttagagagcggttgagccagctgcggcttagactcgaggaggtcggggccgaacgagctcccgagtataccgagccccttggggggcttcaacggtctctaaaaatccgcatacaggttgccgggatctacaagggcttctgcttggacgtcatcaggaataagtatgagtgtgagctgcagggcgctaaacagcacctggaatcagagaaactgctgctttatgatactctgcagggggaattgcaggagcggatccagcggctcgaagaggaccgccaatcactagatctcagttcagaatggtgggacgacaagctgcacgctcgaggcagttccaggtcctgggattctctaccaccgtctaaacgaaagaaggctcccctggtcagtggcccttacatcgtgtatatgctgcaagaaattgacatcctcgaggactggacagctattaaaaaagctcgggcagctgtaagccctcagaagcggaaatctgattag

SEQ ID NO: 23118 - DNA, 1494 bp, Artificial Sequence
  Description of Artificial Sequence: Synthetic coding sequence
atggccgagatgggcagcaagggcgtgaccgccggcaagatcgcctctaatgtgcagaaaaagctgacacgtgctcaggagaaagtcctccaaaaactgggaaaagccgacgagacgaaagatgagcaattcgagcaatgtgttcagaacttcaataaacagctgaccgagggcacccgccttcaaaaagatcttaggacctaccttgcatctgtgaaagccatgcatgaagcgtcaaagaagttgaatgaatgtcttcaggaagtttacgaacccgactggccagggagggacgaggcaaacaaaatcgccgaaaacaacgacttgttgtggatggattatcatcagaagctcgtcgaccaggcattactgacaatggatacatatcttggtcagtttcctgacatcaagtcaagaatcgccaagcgcggccggaagctcgtcgattatgattctgcacgacatcactacgaaagccttcagactgctaagaagaaggacgaggccaagatcgcaaaggccgaggaggaactgatcaaggcccagaaggtgtttgaggagatgaacgtggacctgcaagaggaactcccttctctctggaactcacgggtaggattttatgtgaacacatttcagagtattgctggcctggaagagaactttcacaaggagatgagcaaacttaaccagaatctcaatgacgtgttagtgggcttagagaagcagcatggctctaataccttcaccgtcaaggcgcagccgcgtaagaagagcaaactctttagccgcctccgaagaaagaagaactccgacaacgctccagctaaaggaaacaagtccccttcccctccagatggaagcccggccgcgactccagagatccgtgtgaaccacgaaccagagcctgcgggaggtgccacacctggagctactctcccgaaaagtcccagtcagctgagaaaagggccccccgttcctcctccaccaaaacatactccaagcaaggaggtcaaacaggagcagatcctgtcactgtttgaggacactttcgtacctgagatctcagttacaacgccaagccaaccggctgaagccagtgaggtggcaggaggcacacaaccagcggctggggcccaggaacccggagaaactgcagcaagtgaagccgcctccagctctcttccagcggttgtggtcgagaccttccccgccactgtgaatggtaccgttgagggcggatccggggctggaagacttgatctcccaccgggattcatgttcaaggttcaggcgcagcacgattataccgccactgataccgatgagcttcagctgaaggcgggcgatgtcgtgttggttattcccttccaaaacccagaggaacaggatgaaggctggctgatgggcgtcaaagagagtgactggaatcagcacaaggagcttgaaaagtgccgcggtgtgtttccggaaaatttcaccgagagggtgccatag

SEQ ID NO: 23119 - DNA, 1782 bp, Artificial Sequence
  Description of Artificial Sequence: Synthetic coding sequence
atggccgagatgggcagcaagggcgtgaccgccggcaagatcgccagcaacgtgcagaaaaagctgaccagggcgcaggagaaagtactgcagaagctcggtaaggcagacgagacaaaagatgaacagttcgagcagtgcgttcagaacttcaataaacagctcaccgaaggcactcgcctacagaaagatctgcggacctatctcgcgagcgtaaaagctatgcacgaggcctctaagaagcttaacgaatgcctccaggaggtatacgaaccagactggcccggtcgcgacgaggctaataagattgcggaaaataatgatttactatggatggactaccaccagaagctcgtcgaccaggcactactcacaatggatacttatctgggacaatttcctgacataaagtctagaatcgctaagcggggacgcaagttggtggactacgatagtgcaagacatcactacgaatccctacagactgccaagaagaaagacgaggccaagatcgctaagcctgtgtccctcctggagaaagcggctccacagtggtgtcagggcaagcttcaagctcacctcgtcgctcagactaatctcctcagaaatcaagcagaggaagaactcattaaagcccagaaggttttcgaggaaatgaatgtggaccttcaggaagaactgccttctctgtggaatagtagggtcggcttctacgtgaatacattccagagcatcgctggcctcgaggaaaatttccacaaagagatgagcaaactcaaccaaaacctcaacgacgtgctggtcggcctggaaaagcagcacggatccaataccttcacggtgaaagctcagccatcagataatgcccctgctaagggtaacaagagtcccagtcccccagacggttctcctgctgctactcctgagatcagggtgaatcatgagcccgagccagctgggggggcaactcctggggccactttgcccaaatctccttcgcagctcaggaaggggcccccagtgcctcccccgccaaagcacaccccgtctaaggaggttaaacaggaacaaattttgtcgttattcgaggataccttcgtgccagagatctccgtgacgactccaagccagttcgaagctcccgggccattcagcgagcaggcatctcttctggacctggacttcgaccctctaccccccgttaccagtccagtaaaggcccctacgccctcgggtcagtctattccctgggacttgtgggaacccaccgaatctccagctggttcccttccttcaggagagcccagcgcagccgagggtactttcgctgtgtcttggccaagccagactgcagagccaggcccagcacagcctgcagaagcttccgaagtggcgggtgggactcagcctgctgctggcgcccaggagccaggtgagaccgcagcatcagaagcagcttcctcatctctgcctgccgtggtggtcgagactttccctgcaacagtgaacggaacagtggaaggaggctcgggagcaggcaggctggatctgccacccgggttcatgttcaaggtccaggctcagcacgactatacggctacagatactgacgagctgcagctcaaagctggggacgtagttctcgtgatcccctttcagaaccccgaggagcaagacgaggggtggcttatgggggttaaggaatcggactggaaccagcataaagagcttgagaagtgtcggggggtgttccccgaaaacttcacagagcgagtgccctag

SEQ ID NO: 23120 - DNA, 1557 bp, Artificial Sequence
  Description of Artificial Sequence: Synthetic coding sequence
atggccgagatgggcagcaagggcgtgaccgccggcaagatcgccagcaacgtacagaaaaaactaacccgcgcccaggagaaggtgctgcaaaagctcggcaaggctgatgagacaaaagatgaacaattcgaacaatgcgtccagaatttcaacaaacagctgactgaggggaccaggctgcagaaagacctcaggacgtatctggcaagtgtgaaagctatgcatgaggcttccaaaaagcttaatgaatgtttgcaggaagtctacgaacctgattggccgggccgcgatgaagccaataagatcgcagaaaacaatgacttgctgtggatggactatcatcaaaagctcgtggaccaggctctgttgactatggatacctatctggggcaatttcctgatatcaagtctaggattgcgaagcgggggaggaaactagtggactacgacagcgccaggcaccattacgagagccttcagactgcaaaaaaaaaagatgaggcaaagatcgctaaagctgaggaggagctaattaaagctcagaaagtcttcgaggaaatgaacgtggatttacaggaggaattgccctccttatggaacagcagggtggggttctacgtgaacacgtttcagtcaatcgctgggctggaggagaactttcataaggagatgtcaaaactgaatcagaatttgaatgacgtgctagttggattggagaaacagcacgggagcaacacctttacggttaaggcgcagccttctgacaatgcccccgctaaagggaataagtctcccagtcccccggacggctctcccgctgctaccccagaaattagagtgaaccacgaaccagaacccgccgggggggccaccccaggggctaccctgcccaaaagtccctctcagctgagaaagggacctcccgtacctcctcctcctaagcacactccctctaaggaagtgaagcaggagcagattcttagcctgttcgaagacacattcgtgcccgagatttcggttaccaccccatcccagccaaccgagagccccgctggcagcctgccgtcaggagaaccaagcgccgccgagggaacatttgcagtctcatggccctctcagaccgcggaaccagggccggcgcagcccgccgaagctagcgaggttgcaggggggacccaaccggctgcaggagcccaggagcccggcgagaccgccgctagtgaagccgcttccagctcgttgccagccgtcgtggttgaaacattccctgccactgtgaacggaacagtggaaggcggctctggcgccggaaggttagacctgccaccaggcttcatgtttaaggtgcaggcacagcatgactataccgcaactgacaccgacgagttgcagctgaaggcaggggacgtggtcctagtaattccattccagaaccctgaggagcaagatgagggttggttgatgggcgtgaaggagagcgattggaaccagcataaggagctggaaaaatgtaggggcgtctttcctgagaatttcactgaaagggtgccgtag

SEQ ID NO: 23121 - DNA, 1230 bp, Artificial Sequence
  Description of Artificial Sequence: Synthetic coding sequence
atggccgagatgggcagcaagggcgtgaccgccggcaagatcgcctcaaatgtgcagaaaaagctgactcgggcccaggaaaaggtgttgcaaaaactgggcaaggccgacgagactaaggacgagcagttcgaacagtgtgtacagaacttcaataaacagctgactgagggcactcgcttgcaaaaagatctcaggacgtatctcgcgtccgtgaaagctatgcacgaggccagtaagaagctgaatgaatgcctccaggaagtttatgaacccgattggccgggcagagatgaagctaataagattgcggaaaacaacgacctcctttggatggactaccaccagaaactggtggaccaggccctgttgacgatggatacgtatctaggacagtttcccgacatcaaatcccgaattgccaaacgcggtaggaaactagtggattatgacagtgctagacaccactacgaatccctgcagactgccaagaagaaagacgaggccaaaatcgcaaaggcggaggaagaattaattaaagctcaaaaggtgtttgaggagatgaacgttgatctccaggaagagctgccctcgctctggaactcacgagtgggattctatgttaatactttccagagcattgccggtctggaggaaaacttccacaaagagatgtctaaacttaatcagaacctgaacgacgtgctcgtaggactggaaaagcaacatggcagtaacacctttactgtaaaggcacagcccagtgacaacgctcccgcaaagggaaacaaatctccaagcccacctgacggaagtccagctgctacccccgaaattagggtgaaccatgaacccgaacccgcaggcggggccactcccggagcaaccctgccaaaatcaccatctcagagcagtctgccagcagtcgtcgttgaaacctttcctgccactgtgaacggtactgtcgagggcggaagtggcgcaggcagactggatttaccacccggatttatgtttaaggttcaggcccagcacgattacaccgcaaccgatacggatgaactgcagctgaaagcaggagacgtggtgttggtcatccctttccagaatcctgaggagcaggacgaaggatggctcatgggagtgaaggagagcgactggaaccagcataaagagcttgagaagtgcaggggtgtgttccctgaaaatttcacagagcgagtgccttag

SEQ ID NO: 23122 - DNA, 1521 bp, Artificial Sequence
  Description of Artificial Sequence: Synthetic coding sequence
atggccgagatgggcagcaagggcgtgaccgccggcaagatcgcctccaatgtccagaagaagcttacacgggcccaggagaaggtgttacagaaactgggcaaggccgacgaaactaaagacgaacagttcgaacagtgtgtccagaattttaacaagcaactgactgagggtacaagattgcaaaaagacctgagaacctacctggccagcgtcaaagccatgcacgaagcctcaaagaagcttaatgaatgtttacaggaggtttatgagccagattggccaggcagggacgaggcaaataagatagcagagaataacgatctattgtggatggattatcatcagaagttggtcgaccaggccctgctcactatggatacttatctgggccagttcccggatattaaatcccggatcgccaagaggggaagaaagctggtggattacgattcagctaggcaccactatgagtctctgcagaccgctaagaagaaggacgaggccaaaatcgccaagcccgtgtccctcctcgagaaggctgcaccacaatggtgccaaggcaaattgcaggcccacttggtggctcaaacaaacttactccggaaccaggcagaagaagagttgatcaaggcacagaaggtgttcgaagagatgaatgtggatctgcaagaagagctacccagtctttggaactccagggtcggcttctatgtcaatacgttccagtctatcgccggactggaggaaaacttccacaaggaaatgtccaaactcaaccagaatctgaacgacgtgctggtcggtctggaaaagcagcatggttctaatacctttactgttaaggctcagcccagtgataatgctcccgccaaaggcaacaagagcccttcaccgccggacgggtctcccgcagctacacccgagattcgcgtaaaccatgagccagagccagctggtggggctacacccggggcgactcttcctaagtcccccagccaacctaccgagtcccccgccggtagtttgcccagcggggagccaagcgcggctgaaggtacctttgctgtgagttggcccagccaaactgccgagcccggaccggctcaaccagcggaggccagcgaggttgccgggggcactcagccggccgcgggagctcaagagcctggtgagacggcagctagcgaagcggctagcagcagcttgcccgccgttgtggttgaaacttttcctgcaaccgtgaacgggaccgtagagggtggttctggcgctggaagactggatctgcctcccggctttatgtttaaggtgcaggctcaacatgattatacagccacggataccgatgagttgcagcttaaagccggtgacgttgttctcgttatcccatttcagaatccagaagagcaagacgaaggatggctgatgggagtgaaggagtccgactggaaccagcataaggaattagagaagtgccgaggtgtgttccccgaaaacttcacggagagagtcccttag

SEQ ID NO: 23123 - DNA, 1365 bp, Artificial Sequence
  Description of Artificial Sequence: Synthetic coding sequence
atggccgagatgggcagcaagggcgtgaccgccggcaagatcgcctctaacgttcagaaaaagttgactcgggcccaggaaaaggttctgcagaagctagggaaagctgacgagacgaaggatgagcaatttgagcaatgcgtgcaaaattttaataaacagttgaccgaagggacccggctccagaaagatctcaggacctaccttgcttcagtaaaggctatgcacgaggcgtccaaaaagctgaacgagtgcctgcaagaagtatatgaacccgactggcccggacgagatgaggccaataaaattgctgagaataacgatttgttatggatggattaccatcagaagttagtcgatcaggcactcctcacgatggacacgtacctgggccaatttcccgacatcaagagcaggatcgccaagaggggaagaaaactcgtggactacgactccgctaggcatcattatgagagcctgcagactgccaaaaaaaaggatgaggcaaagatcgctaaagcggaagaggagcttataaaagcgcaaaaggtgtttgaggagatgaacgtggacttgcaggaggagctcccgtctctgtggaattcaagagtagggttctacgtcaacacttttcagagcattgctggcctggaggaaaactttcataaagagatgagtaagctgaatcagaatcttaacgatgtgctggtggggctggagaaacagcacgggtccaacacattcaccgtgaaggcccaaccgcgtaagaagagtaagctgttttccaggcttcgaaggaagaagaactcagacaatgcacctgcaaagggcaacaagagcccgagcccaccggatggaagccctgcggccacgcccgagattcgggttaatcatgaaccagaaccagccggtggcgcaaccccgggcgccaccctgccgaaaagcccttcacaaccagcagaggcctctgaagtcgcaggggggacacagcccgcggcaggtgcccaagagccaggagaaacagccgctagcgaagcagcctcatcttctctaccagccgttgtggtggaaacttttcccgcaactgtgaatggtacagttgaagggggctcaggagcaggccgcctggatctgccccccgggttcatgttcaaggtgcaggctcaacacgattatacggccactgacacagatgaacttcagctcaaggctggtgatgttgttctagtgattccttttcaaaatcctgaagagcaggacgaaggttggctaatgggggtgaaggagtccgactggaatcagcataaggaactggaaaaatgccgtggggtatttcccgagaattttacagaaagagtgccgtag

SEQ ID NO: 23124 - DNA, 1653 bp, Artificial Sequence
  Description of Artificial Sequence: Synthetic coding sequence
atggccgagatgggcagcaagggcgtgaccgccggcaagatcgcctccaacgtgcaaaaaaagctgactcgcgcacaagaaaaagtcctgcaaaaactgggaaaagcggatgagacaaaggacgagcagtttgaacagtgtgtgcaaaattttaataagcagctgactgagggcacgagactccagaaggatttgagaacgtatcttgccagcgtcaaagcaatgcacgaagcttcgaaaaagctgaacgagtgcctccaggaggtgtacgagcccgactggcccgggcgggatgaggcaaacaagattgccgagaataatgacctgttgtggatggactatcaccaaaaactcgtcgaccaagctctgctgacaatggacacctacctggggcaattcccggatatcaagtctaggatcgctaagcggggacgcaagttagtagattacgacagcgcccgtcaccactacgaatctcttcagacagccaagaagaaggacgaagccaagattgccaagccggtgagcttgctggaaaaggcagcgcctcagtggtgtcagggcaagctccaagcacacctcgtagcacagaccaacctgttgagaaatcaggctgaggaagaactgattaaggcccagaaagtatttgaagagatgaatgtggatcttcaggaggagttaccatctttgtggaacagccgggtgggattctacgtcaacacctttcagtcgatcgcgggacttgaggagaacttccacaaggagatgagcaaactcaaccagaacttgaacgatgtgctcgtgggtctagagaagcagcatgggagtaatacattcaccgtcaaggctcagcccagcgacaacgctccagctaaaggcaacaaaagcccctctccccccgatggttccccagcagccacacccgagattcgcgtgaaccatgagcccgagcctgctggcggagccaccccgggcgccactctgcccaagagtccctctcagttcgaagctccaggcccattctccgagcaagctagcctcttagatctagattttgacccattgccccctgtgacaagccccgtgaaagctccaacgccttcgggtcagtccattccctgggatctgtgggagcctacagaaagtcccgccgggtctctcccctccggcgaaccctccgcagcagaaggaactttcgctgttagctggcccagccagacggccgagccgggtccagctcaacccgccgaggctagtgaggttgcgggcggaacacaacccgccgcaggcgcgcaggagccgggcgaaacagccgccagtgaagcagcatcatcttctctacctgctgtggtggtcgagactttccccgcaacagttaacggcactgtagagggaggttccggagccggccggctcgacctgcccccagggtttatgtttaaagtccaggctcagcacgattatactgctacagatactgatgaactgcaactcaaggcgggggacgtagtccttgttataccctttcagaaccccgaggagcaggatgagggatggctgatgggagtgaaagaaagtgactggaatcagcataaggagctggaaaaatgtcggggtgtgttccctgagaactttaccgagagagttccatag

SEQ ID NO: 23125 - DNA, 1449 bp, Artificial Sequence
  Description of Artificial Sequence: Synthetic coding sequence
atggccgagatgggcagcaagggcgtgaccgccggcaagatcgccagcaacgtgcagaaaaagctgacccgcgcccaggagaaggtcctgcagaagctcggaaaagcagatgaaactaaggacgagcaatttgaacagtgtgtgcagaatttcaacaaacagttaacagaaggaacaaggctccagaaggacctgcgtacctatttggctagtgtgaaggccatgcatgaggcctccaagaagctaaacgagtgcctgcaggaggtctacgaacctgattggcctggccgcgacgaggccaacaaaatcgccgagaataatgacttactgtggatggattatcatcaaaagctggtggaccaggcacttctgacaatggacacgtatttaggccagtttcctgacattaagagccgcattgcaaagcgggggaggaaactggtggactatgactcagctcgccaccattatgagtccctacaaaccgccaaaaagaaggacgaggctaagattgccaaagcggaagaggagctgatcaaagcccagaaagtattcgaagagatgaacgtagatttacaggaagaacttcctagtttgtggaacagtcgcgtgggcttctatgtcaacactttccagtccatagctggactggaggagaatttccacaaggagatgagcaaactgaaccagaatctgaacgacgtgctggtcggcctcgaaaagcagcacggctcgaacacgtttacagtcaaggcacagccgagcgacaacgctcctgctaagggtaataaaagcccctccccccccgacggatcaccggccgccacccccgaaataagagttaatcacgagccagagcctgctgggggggctactccaggcgccactctcccgaagtcccccagtcaattacgcaaggggccccctgtccctcctcccccaaaacacactccaagcaaggaggtcaagcaggaacagatcctttccttgtttgaggacacgtttgtccccgagatctctgtcacaacaccttcccaaccggccgaagcctcggaagtggcaggaggaacccagccggctgccggcgcacaagagcctggagagacggcagcctcggaagcagcgagcagtagtctgccagcagtggttgttgagacttttccggcaaccgttaacggaacagtagaggggggtagcggcgcaggacggttagatctccctccaggcttcatgttcaaagtccaggcacagcacgactataccgctaccgacaccgacgaacttcagctgaaggcaggggacgtggtgctggtcatccctttccagaacccagaagaacaggacgaggggtggctaatgggcgtgaaggaaagcgattggaaccagcacaaggagctggagaagtgccgaggagtgttcccagagaactttacggagagggtgccttag

SEQ ID NO: 23126 - DNA, 1428 bp, Artificial Sequence
  Description of Artificial Sequence: Synthetic coding sequence
atggccgagatgggcagcaagggcgtgaccgccggcaagatcgcctccaatgttcagaagaaactgactcgggctcaggagaaagttttgcaaaagttaggaaaggccgatgaaaccaaagacgagcaatttgaacagtgtgtgcagaattttaataagcagctgacagaagggaccaggcttcagaaagacttgcgaacctacctcgcatcggttaaagcaatgcacgaggcttctaagaaattaaatgaatgcctacaggaggtttacgagcctgattggcccggccgggatgaggccaataagatcgctgagaacaacgatcttctttggatggactaccaccagaaactggtcgaccaagcccttttgacaatggacacatacctgggacaatttcccgacatcaaaagtcgtatcgcaaagcgaggccggaagctcgtcgactacgatagtgctcgtcaccattacgagtctcttcaaaccgctaagaagaaagatgaagctaagattgccaaagccgaagaggagttgataaaggcccagaaggtcttcgaggagatgaatgtggacctgcaggaagagctcccatctctatggaactcaagagtcggtttttatgtgaacacatttcagagcattgccgggctggaagagaactttcataaggagatgtcaaaactgaatcaaaatctcaatgacgtgctggtgggcctagagaaacagcacggttcgaatacttttaccgtgaaggcacaaccttctgataatgccccagctaaaggaaataagtctccttctcctccagacggtagcccggccgccacccctgagatccgtgtgaaccatgaacccgagcccgcggggggcgctacccctggggccactctccctaaatccccttcccagccaaccgagagccctgccggtagtcttcctagcggcgaaccaagtgcggccgagggaacatttgctgtgtcttggccttcccagacagcagagcctggccctgcccagcctgccgaagcttctgaagtggcgggcggaacccagcctgctgctggcgcccaggagcctggcgaaactgccgcaagtgaagcagcctccagttcactgccagcagtggtggtggaaaccttccccgccacggtgaatggaactgttgagggaggtagtggagctggaagactggatctccctccaggattcatgtttaaagtgcaagcacaacacgactacactgccactgacacagatgagctccagctgaaggctggcgacgtcgtgctggtgatcccctttcagaatcccgaagagcaagacgaaggatggttgatgggagttaaagaatccgactggaatcagcataaggagcttgagaaatgcagaggggtattccccgagaattttaccgagcgggttccgtag

SEQ ID NO: 23127 - DNA, 1320 bp, Artificial Sequence
  Description of Artificial Sequence: Synthetic coding sequence
atggccgagatgggcagcaagggcgtgaccgccggcaagatcgccagtaatgtgcagaaaaagctcactagggcgcaggagaaggtcctacaaaagctaggtaaggccgatgaaaccaaagacgagcaattcgaacagtgcgtacagaattttaataagcagttgacagagggcacccggctccagaaggacctgaggacctacctggcctctgtcaaggccatgcatgaggcttccaagaaattaaatgaatgcctccaagaggtgtatgagcccgactggccaggcagagatgaggcaaataaaatcgcagaaaataacgacctcctctggatggattatcatcagaagctggtcgaccaggcactacttacaatggacacatatcttggacaatttccagatatcaagagccgcatcgccaagagaggacgcaagcttgtcgactacgacagcgctcgtcaccattacgaatctctacaaacagccaagaaaaaggatgaagccaagatagccaaagctgaggaggaactcattaaggcacagaaggtgtttgaggagatgaacgttgaccttcaggaagaactgccgtctctatggaactctcgggtggggttctacgtcaacaccttccaatccatcgctggccttgaagaaaattttcataaggagatgtcaaaactgaatcagaacctgaacgacgtgctggtcgggttagagaagcagcatggatctaacaccttcacggtcaaagctcagcccagtgataacgctcccgctaagggtaacaagtccccgtctccccccgatgggtcacccgctgcgactcccgagattcgggtcaatcacgaaccagaacccgcaggtggtgccacaccaggggccacactgcccaaatcaccttctcagcctgcagaggcctccgaagttgccggtggaacacagcccgctgccggagcccaggagccaggcgagaccgcggcctctgaggccgccagtagctccctccctgctgttgtcgtggaaacatttcccgctactgtcaatggtaccgtagaaggcggctcgggggccgggcgactagatcttccccctggatttatgttcaaggttcaggcccagcacgactatactgctacggataccgacgaactgcagcttaaggccggtgatgtggtcctcgtgattccatttcaaaatcccgaggaacaggatgaagggtggttgatgggtgtcaaggagagtgactggaatcagcataaggagctcgagaaatgtcgcggcgtctttccagaaaattttaccgagcgagtgccttag

SEQ ID NO: 23128 - DNA, 1956 bp, Artificial Sequence
  Description of Artificial Sequence: Synthetic coding sequence
atgggcaagaagcacaagaagcacaagagcgacaagcacctgtacgaagaatacgttgagaaacctctgaaactggtgctgaaagtcggcggcaatgaggtcacggagttgagcactgggtccagcgggcacgacagcagccttttcgaggataagaacgaccatgataaacataaggaccgtaagagaaaaaagagaaagaaaggagaaaaacagataccaggtgaggaaaagggtagaaaacggcgtcgtgtgaaagaagataagaagaagagagatcgggatcgggtggagaatgaggcggagaaggacctgcagtgtcacgcacctgtgaggttggacctgccccccgagaaacctcttaccagctcactagccaagcaggaagaagtggaacaaacccccctgcaagaggcccttaatcagttgatgcgtcagctgcagagaaaggatccctctgcctttttctcctttccagtcacagacttcatagcgccgggatattctatgataataaaacaccccatggattttagtacaatgaaagaaaagattaagaataatgactatcagtctattgaggaactcaaagacaactttaagctaatgtgtactaatgccatgatatataataagcctgaaacaatttactacaaggccgcaaaaaagcttctgcatagcgggatgaaaatcctgtctcaggagagaatccagagtctgaagcagtctatagactttatggccgatctgcaaaagaccagaaagcagaaagacggaactgatactagccagagcggggaagatggagggtgctggcagagggaacgcgaagactccggagatgctgaggctcacgcctttaaaagtccctcaaaggaaaataaaaaaaaagataaggatatgctcgaagacaaatttaaatcaaataacctggaacgtgagcaggaacagcttgacaggattgtgaaagagagtggaggcaagctcactaggaggttggttaatagccaatgcgagttcgagaggagaaagccagacgggacaaccaccctcgggttgctccatccagttgacccaatcgtaggcgagccgggttactgtcctgtcagactgggcatgacaaccggaagactgcagtcaggggtgaacactcttcaggggtttaaggaggataaaaggaataaggtcacacccgtcctctatctgaattatggcccttactccagttacgctccccactatgactcgacctttgcaaacatttctaaggacgatagcgacttgatatatagtacgtacggcgaggactcagacctcccttctgacttttctatccacgagtttctcgcgacttgccaggactacccgtatgtcatggcggacagcctcttagacgtgctgacaaaaggtggacattcaagaacccttcaggagatggagatgagtctgcctgaggacgagggccatacaagaaccctcgataccgctaaagagatggaaataaccgaggtggagccacctgggaggctggactctagcacccaggatcggctgatcgctctaaaggctgtgactaattttggagtgccagtagaagtgttcgacagtgaagaggccgagatattccagaaaaagctcgacgaaaccacccggctgctgagagaacttcaggaagctcaaaatgaacgactgtctactaggcccccacccaatatgatctgcctgctgggcccttcctaccgcgagatgcacctggctgagcaagtcacgaataatctgaaggaactggctcagcaggtgacgccaggggatattgtatccacgtatggagttcgaaaagccatgggaattagtatcccgagccccgttatggagaacaactttgtcgacttaaccgaggacacagaagaacccaagaagacagacgttgcggagtgcggtcccggaggatcgtag

SEQ ID NO: 23129 - DNA, 1959 bp, Artificial Sequence
  Description of Artificial Sequence: Synthetic coding sequence
atgggcaagaagcacaagaagcacaagagcgacaagcacctgtacgaggagtatgttgagaaaccactaaagttagtcctgaaagtgggcgggaacgaagttactgagttatcaacaggcagctccggccatgattcatcactttttgaggataaaaacgaccacgacaaacataaagatcggaaacgaaagaaaaggaagaaaggggagaaacagattcctggtgaagaaaaaggcaggaagaggcgaagggtgaaggaggacaagaagaagcgcgatcgagaccgcgtagagaatgaagctgaaaaggatcttcaatgccatgcccccgtccggctggatttgccgcccgaaaagcccttaacaagctcactggctaagcaagaggaggtagaacagacgccactccaggaggcccttaaccagctcatgagacagctgcagagaaaagatccctccgcatttttttcgttccctgttaccgatttcatcgcccccggctatagtatgattatcaagcacccaatggatttctctacaatgaaagaaaagatcaagaacaatgactaccagtccatcgaggaactgaaggacaacttcaagctaatgtgtacgaacgccatgatttataataagccggagacaatttattacaaggccgcgaagaagctacttcactccgggatgaaaatcctgagtcaggagcgaatccaatccctgaaacagtcgatcgattttatggctgacctgcagaaaacgaggaagcagaaggacgggacagacacgagtcagtctggcgaggatggcggatgctggcaaagggaaagggaagattctggcgatgctgaggcacacgcgttcaagagcccatcaaaagaaaacaaaaaaaaggataaggacatgctcgaagataagtttaagtctaataaccttgagcgcgaacaggagcagctggacagaattgtgaaggaatctggaggaaagctaactcggcgcctggttaatagccagtgtgagtttgagagaaggaagccggacggtactactacattggggctgttgcacccagttgatcctattgtgggtgagcctggttactgtcccgttaggttggggatgactactgggcgcttacagagtggggtcaacaccctgcaaggcttcaaggaagacaaacgtaacaaagttacaccggtcctttaccttaactatgggccctattccagttatgcaccgcactacgactctaccttcgccaatatttccaaggatgattcagatctgatctactcaacatatggagaagattcagatcttccctcagatttctcaatacatgaattcctcgcaacctgtcaggattacccatatgtgatggccgactcactgctggacgtcctgactaagggcggccattctcgaactttacaggagatggagatgagtctccctgaggatgagggacatacccggacccttgacacagctaaagaaatggagcagattacagaagttgagcctcctggcaggcttgatagcagcacacaggacagactgattgcactcaaagctgttaccaatttcggcgtgcccgttgaggtgttcgactcggaggaagcagagattttccagaaaaagctggatgaaaccaccagacttttacgggaattgcaagaagctcagaatgaacgactgtccaccaggcccccccccaacatgatctgcctcctcgggccttcatatagagagatgcatctagctgagcaggtgaccaacaaccttaaggagctggcacagcaggtcactcccggagacatcgtatctacctacggggtgcgcaaagcaatgggcatatccatccccagcccagtgatggagaacaacttcgtcgatcttaccgaggatactgaagagccaaaaaagaccgatgtggctgagtgtggccctggcggctcctag

SEQ ID NO: 23130 - DNA, 1959 bp, Artificial Sequence
  Description of Artificial Sequence: Synthetic coding sequence
atgggcaagaagcacaagaagcacaagagcgacaagcacctgtacgaggaatacgtcgagaagccgctgaaactcgtccttaaggtgggagggaacgaagtcactgagctcagcacgggcagtagtggacatgattcctccctgtttgaggacaagaacgatcacgataagcacaaggataggaaacggaaaaagagaaagaagggcgaaaaacagatccccggtgaagagaaaggacggaagagaagaagggtgaaagaggacaaaaaaaaaagagatcgggatcgagtcgagaatgaggccgagaaggacctgcagtgtcacgccccggtgaggctcgatttgcctcccgaaaagcctctcacatcatccctggctaaacaggaagaggtggagcagactcccctgcaggaggcactgaatcagttgatgaggcagttgcagcggaaggatccatctgcgttctttagctttcccgtcactgactttatcgctcccggatattcaatgataatcaagcaccccatggatttttctacaatgaaggaaaaaattaagaataatgattatcagagcatcgaagagcttaaggataactttaagctgatgtgcacaaacgcaatgatctacaacaaacccgagactatatactataaggcagctaagaaattgctacacagtgggatgaagattctctctcaagagcgtattcaaagtctgaagcagtccatcgattttatggctgatttacagaagactcggaagcagaaggacgggaccgatacaagccagtcaggggaagatggcggatgctggcaacgagagcgagaagactcaggggatgcagaggcacacgctttcaagtcaccctcaaaagaaaataaaaaaaaggacaaagatatgctcgaggacaagtttaaatccaacaatctcgaacgcgagcaggagcagctggatcgcatcgttaaggagtcgggaggtaaactgaccaggagactggtgaattcccagtgtgagtttgaacggaggaaaccggacggcacaacgaccctgggattgctgcatcccgtggacccgattgtgggggagcctggctactgtccagtgcggctgggtatgactacagggaggctgcaatccggggtaaatactctgcaaggtttcaaggaggacaaacggaacaaggtgacccccgtgctttacttaaattacgggccttattcgtcatatgccccacactacgattctacttttgcaaacatctctaaagacgacagcgacctgatatattctacttacggagaagattcagacttgcccagtgacttcagtatccacgaattcctggctacttgtcaagactatccatacgtgatggccgacagcctgctggatgtgcttacgaaaggaggtcattctcgcacactgcaggaaatggaaatgtctctgcccgaggatgaaggacataccaggactctggacaccgccaaggagatggaacagatcaccgaggttgaacctcccggtcggctggactccagtacgcaagatcgactgatcgcgttaaaggccgtcaccaattttggcgttcctgtcgaagtgttcgattctgaggaggccgagatcttccagaagaaactggacgaaacgacccgactgctcagagaactgcaggaagcccagaacgagcgtctgtccacccgcccacctccgaacatgatctgtttactagggccatcatatcgtgagatgcatctcgctgagcaggtgacgaataacttaaaagagctcgcccagcaggtgactccgggtgatatcgttagtacctatggagtgagaaaggctatggggatcagcatcccatctccagtgatggagaataactttgtagatctcacagaggatacagaggagcccaagaaaacagacgtcgccgagtgcggacctggcgggagctag

SEQ ID NO: 23131 - DNA, 1980 bp, Artificial Sequence
  Description of Artificial Sequence: Synthetic coding sequence
atggccgccgtgatcctggagagcatcttcctgaagcggagccagcagaaaaaaaagaccagcccactaaatttcaagaagcggctattccttctaacggtacacaagctgtcctattacgagtatgatttcgaaaggggtcgaaggggctcaaagaaaggatccattgacgtggagaaaatcacctgcgtggagaccgttgtgccggaaaagaatcctccgccggagaggcagattccaagaaggggcgaagagtcgagtgagatggaacagatttccattatcgagagattcccgtacccctttcaggtggtgtatgatgaagggcctctctatgttttctcaccaaccgaggaactgcggaaaagatggatccaccagctgaagaacgtcatccggtataatagtgacctggtacagaaatatcatccctgtttttggatcgatgggcaatacttgtgttgctcacagacagccaaaaatgcaatgggctgtcagatccttgagaataggaacgggtctttgaagcctggatcgtcacacagaaagaccaaaaaacccctgcctccaacacctgaggaggatcagattctcaagaagcccctcccaccggaaccggccgccgcccccgtgagcacttccgagttgaaaaaggttgtggccctatacgattacatgcccatgaacgccaacgatctacaactgaggaagggtgatgagtactttattctggaggaatctaatttaccatggtggagggctagggacaagaacggccaggaggggtatattccctccaactacgttactgaagccgaggatagcattgagatgtacgaatggtactctaaacacatgacccggtcccaagccgaacagctgctgaagcaggagggaaaggaaggcggcttcatcgttcgagactcaagcaaggccggcaaatataccgtttcagtcttcgccaagtctaccggtgatccccagggcgtgattcggcactatgtagtatgttctactccccagtcccagtattacctcgccgagaaacacctattttctaccattcctgaactcattaattaccaccagcataactccgctgggctaatctctcgattgaagtaccccgtgagtcagcaaaacaaaaacgcaccaagcaccgctggcctgggatatggaagctgggagatcgatcctaaggatttaacatttctgaaagaactagggacaggtcagtttggtgtggtgaaatatgggaaatggcgcgggcagtatgatgttgctattaaaatgatcaaggaggggtctatgtcggaggacgaattcattgaagaagcaaaagttatgatgaatctcagtcacgaaaagctcgtgcagctgtatggggtatgtacaaaacagagacccatttttattatcactgagtacatggctaacggatgcctattaaattatctaagagagatgcgacaccgtttccaaacacaacagctgcttgagatgtgtaaagatgtttgtgaagccatggaatacctggagagtaaacaatttctacaccgggaccttgcagcccgcaactgcctcgtaaatgaccagggagtcgtgaaggtgagtgacttcggactgtcccgatatgtcctggatgacgagtacacatcttccgtaggatctaaatttccagtcagatggtccccccctgaggtactcatgtattccaagttctcttctaaaagtgatatttgggcatttggtgttctgatgtgggagatctattccctgggaaagatgccctacgagagatttactaatagtgagaccgcagaacacattgcacaggggcttcggctgtaccggccacacctcgcatccgaaaaggtttacaccattatgtactcttgttggcatgaaaaggctgatgagcgaccaacattcaagatcctcctaagcaatattctggacgtgatggatgaagagtcttag

SEQ ID NO: 23132 - DNA, 627 bp, Artificial Sequence
  Description of Artificial Sequence: Synthetic coding sequence
gtgatccggcactacgtggtgtgcagcaccccccagagccagtactaccttgcagaaaaacatctttttagcacgatacctgaactgattaattaccaccagcacaattccgccggtctgattagcaggacccagcagttactggaaatgtgcaaagacgtgtgcgaggccatggagtatcttgagagtaagcaattcctccaccgggatctggctgcacgcaactgccttgtaaacgaccagggggtggtcaaggtgtccgattttggcctaagccggtatgttctggatgatgagtatacctcaagtgtcggcagtaaatttcctgtaaggtggagcccccctgaagttctgatgtacagtaaattctcatctaaatctgatatttgggcattcggcgtcctcatgtgggaaatctatagtttggggaaaatgccctacgagcggtttacaaattctgagactgctgagcatatcgctcaaggactcaggctgtacagaccccaccttgcatctgaaaaggtttacactattatgtacagttgctggcatgaaaaagccgatgagagacccacttttaaaattctcctgtcgaatattctggacgtgatggatgaggaaagctag

SEQ ID NO: 23133 - DNA, 420 bp, Artificial Sequence
  Description of Artificial Sequence: Synthetic coding sequence
gtgatccggcactacgtggtgtgcagcaccccccagagccagtactacttagctgagaagcacctcttcagtactatcccagagttaattaattaccaccagcataattctgcagggctgatctccaggctgaagtacccagtgtcccagcagaataaaaacgcccccagcacagcgggactgggttatggagtgcttatgtgggagatctattctcttggaaagatgccatacgagcgcttcaccaactccgagaccgcagagcacattgcccagggcctacggttatatcgacctcatctggcctcagagaaggtctacaccattatgtattcatgctggcatgaaaaggctgatgagcggcccacatttaagatcctgctttctaacattctagacgtgatggatgaagagtcctag

SEQ ID NO: 23134 - DNA, 705 bp, Artificial Sequence
  Description of Artificial Sequence: Synthetic coding sequence
cggcactacgtggtgtgcagcaccccccagagccagtactacctggctgagaagcatctctttagcacaatacccgaactgattaattatcaccagcacaactccgccggccttatctcccggttaaaatacccagtgtcccagcagaacaagaacgccccttcaacagcaggcctggggtatggaagctgggagatagacccaaaagatctgactttcctcaaagaactcggaaccggccagtttggcgtcgtcaaatacggcaagtggagaggacagtacgatgtggccattaagatgattaaggagggaagcatgtccgaggatgagtttatcgaagaggcaaaggtgatgatgtatgttctggacgacgagtacactagcagcgttgggtccaagttcccagtaagatggagcccacctgaggtgctgatgtactctaaattttctagcaagagcgacatctgggctttcggcgtcctcatgtgggagatctattccctcggtaaaatgccatacgagcgatttacgaattcagaaacagcagaacacattgcccaagggcttcgactttatcgaccccatttggcctcggagaaggtctatacaatcatgtactcctgctggcatgagaaggccgacgagcgtccgacattcaagatactgctgtctaatatcttagacgtgatggatgaagagagctag

SEQ ID NO: 23135 - DNA, 225 bp, Artificial Sequence
  Description of Artificial Sequence: Synthetic coding sequence
gtgatccggcactacgtggtgtgcagcaccccccagagccagtactatctcgctgagaaacatctgttttcaacaataccggaactgatcaactaccaccaacataatagtgcaggactgatatctcggcttaaatatcccgttagtcaacagaataaaaatgccccatctacagccggactgggatacggtatgagttggatgatgaacacacaggcacagtag

SEQ ID NO: 23136 - DNA, 1452 bp, Artificial Sequence
  Description of Artificial Sequence: Synthetic coding sequence
atggccgccgtgatcctggagagcatcttcctgaagcggagccagcagaagaagaagacttcccctctgaattttaaaaagaggttattcttactgaccgtgcacaagctgtcctactatgagtatgattttgagcgtgggaggagaggctccaagaagggctctatagacgtggagaaaatcacctgcgtagagaccgtggtgcctgagaagaatcccccaccagagcgccagatcccacggcgcggggaagagtcaagcgaaatggaacagattagcataattgaaagattcccttaccccttccaggttgtctacgacgaagggcccctgtatgtgtttagcccgacagaagaactcaggaagagatggatccatcagctgaagaacgtgattcgctacaattccgacctcgtacaaaagtatcatccctgtttctggattgatggtcaatacctctgctgctcacaaacagcaaagaacgcgatgggatgccagatactcgaaaaccgcaacggaagtcttaaacctggatccagtcacagaaaaactaaaaagcctctgccacctactccagaggaagatcagatactcaaaaagcccttaccgcccgaacccgccgccgcaccggttagcacatccgaacttaaaaaagttgtggcattgtacgactacatgcccatgaatgccaacgatctccagttgcgcaaaggggacgagtactttatcttagaagagtctaatctgccctggtggcgggcacgcgacaagaacggccaagaaggctacatcccatctaactacgtgacagaagccgaagatagcatcgagatgtacgaatggtatagcaaacatatgacacggtcccaggccgagcaactcttaaaacaggaggggaaggaagggggattcatagtgcgcgattcttcgaaagccggaaagtataccgtttccgtgtttgctaagtccaccggtgatccccagggcgtcatcaggcattacgttgtttgcagtacaccacagtctcagtattacctggccgctcgcaactgcctagtaaatgatcagggagtggtgaaggtgagcgatttcgggctgtcccgttacgttctggatgacgaatacacgagttccgtgggcagcaagttccccgtcaggtggtctcctcctgaagtcctaatgtacagtaaattctcctcaaaatccgatatttgggcttttggcgttctcatgtgggaaatatacagtctcggaaaaatgccctatgaaaggttcactaattcagaaactgctgaacatatagcacaaggattacgcctatacaggccacatctggcaagtgagaaggtgtacaccatcatgtactcatgttggcatgagaaagccgatgaaaggcctacattcaaaatcctgctctccaatattctggatgtgatggacgaggagagctag

SEQ ID NO: 23137 - DNA, 519 bp, Artificial Sequence
  Description of Artificial Sequence: Synthetic coding sequence
gtgatccggcactacgtggtgtgcagcaccccccagagccagtactatcttgccgagaaacatttgttctccacaatccccgagctgatcaattatcatcaacacaatagcgctgggctgatttcaagacttaagtaccccgtcagccaacagaataagaatgcgcccagtacagccggccttggctatggcagttgggaaattgaccccaaagatctgactttcctgaaggaactgggcactggacagttcggcgtcgtgaagtacggaaaatggcgcgggcagtatgatgtggctatcaaaatgatcaaagagggatcaatgagtgaagacgaattcattgaagaggcaaaggtcatgatgaacctttcgcatgagaaactggtgcagctctacggtgtttgcactaagcaacgcccaatctttatcattaccgagtacatggccaatggctgtctgccgtgtaccgtagctggcatgcgcaaacagatgagcgtgccactgtctaaattcttctag

SEQ ID NO: 23138 - DNA, 594 bp, Artificial Sequence
  Description of Artificial Sequence: Synthetic coding sequence
gtgatccggcactacgtggtgtgcagcaccccccagagccagtactacctggctgaaaagcatctgtttagcaccatcccagaactcatcaattaccaccagcacaattctgcaggattgatttctaggctaaagtaccctgtgtcccagcagaacaagaatgcgccgagcacagcaggcttgggctatggctcttgggagatcgatccaaaagatctcacgtttctgaaggagctggggaccggccagttcggtgtagtgaaatacgggaagtggcgtggtcagtacgacgtggccatcaagatgatcaaggagggctccatgtcagaagatgagtttattgaggaggcaaaggtgatgatgaatttgtcacacgagaagctggtgcagttatacggcgtctgcacgaaacagcgcccgatctttatcatcacggagtacatggcaaatgggtgtcttttgaattacttaagagagatgcggcacagatttcaaacccagcagttactcgaaatgtgcaaggacgtgtgcgaagccatggaatatcttgagagcaagcaattcctgcatcgcgatctggtttgccccggctag

SEQ ID NO: 23139 - DNA, 156 bp, Artificial Sequence
  Description of Artificial Sequence: Synthetic coding sequence
atccggcactacgtggtgtgcagcaccccccagagccagtactacctcgccgaaaaacaccttttcagcaccatccctgaactcattaattaccatcagcataacagcgcaggcgaggactccgcagctgctcgggatgtgcaaggctgcctgtag

SEQ ID NO: 23140 - DNA, 891 bp, Artificial Sequence
  Description of Artificial Sequence: Synthetic coding sequence
atgaagaacgagatcgccgccgtggtgttcttcttcacccggctggtgagaaagcacgacaaactcaagaaggaagccgtggagagatttgctgagaagctgaccctgatccttcaggagaaatacaaaaatcactggtacccagagaagcctagcaaaggccaggcttaccggtgtataagagtgaataagtttcagcgcgtggatcccgatgttctgaaggcttgcgagaatagctgtattttgtacagcgacctgggtcttccgaaagagctcacgctatgggtcgacccatgcgaggtgtgctgccggcgcgatggagtgagcccctgctggccagattgctctcaaacacccgatttggttatcaggccaccctggccacccaaagccctggactacaggcgggagcccttgcgcccagccagttcgttccttatcatgtacggtgaaaagaataacgcttttatagttgcctcctttgaaaataaagatgaaaataaggatgagatctcccgcaaagtgacccgcgcccttgacaaagtgacttcagactatcactcgggctcttcttctagcgacgaagaaacgagcaaggaaatggaggtgaagccatcaagtgtaaccgccgccgcaagcccagtgtatcagatctccgaactgatcttcccccccctgccaatgtggcatcccctcccacgcaagaaaccaggtatgtaccggggcaacgggcatcaaaaccattacccccctcctgtgccttttggctaccccaatcagggaaggaagaataagccatatcggcctataccagtaacctgggtgccacctcctggcatgcactgcgacagaaatcactggataaacccccatatgctggccccgcactag

SEQ ID NO: 23141 - DNA, 759 bp, Artificial Sequence
  Description of Artificial Sequence: Synthetic coding sequence
atgaagaacgagatcgccgccgtggtgttcttcttcacccggctggttagaaagcacgataagctcaaaaaagaggcagtcgaaagattcgccgagaagttgaccctcatactccaggagaagtacaaaaaccactggtaccccgaaaaaccctctaagggccaggcctaccgatgcattagggttaacaaattccagagggtggaccctgatgtgttgaaggcctgtgagaactcatgtatcctgtatagcgatctgggactccccaaggagttaacgctttgggttgacccatgcgaagtttgctgtcgctacggagagaagaacaatgcatttatcgtggcaagcttcgagaacaaggacgaaaacaaagatgaaatcagccgaaaagtgaccagggccctggacaaggtgacatccgactaccattctggatctagtagctccgatgaggaaacaagcaaggagatggaggttaaacccagtagtgtgactgccgccgcgtctcctgtgtatcagatttccgagttaattttcccaccattgcctatgtggcaccccttgcccaggaaaaagcccggaatgtatagaggcaacggacaccagaaccactaccctccaccagttccattcggctacccaaaccagggtcggaagaacaagccttatcgacctatccccgtgacctgggttcccccacccgggatgcattgtgatagaaatcactggatcaatccacatatgctggcacctcattag

SEQ ID NO: 23142 - DNA, 141 bp, Artificial Sequence
  Description of Artificial Sequence: Synthetic coding sequence
atgaagaacgagatcgccgccgtggtgttcttcttcacccggctggtcaggaagcatgacaaactcaaaaaggaggccgtagagaggtttgccgagaagctgacactcattctgcaggaaaagtacaaaaatcattggtag

SEQ ID NO: 23143 - DNA, 1560 bp, Artificial Sequence
  Description of Artificial Sequence: Synthetic coding sequence
atgatgagcgagcacgacctggccgacgtggtgcagatcgccgtggaagacctttcacccgatcaccctgttgtgttagagaatcacgtggtaacagacgaagacgaaccagctctcaaacggcagcggttggagattaactgccaagacccttcaatcaagactatttgcctgagactcgattcgattgaggctaaacttcaggccctcgaggcaacctgcaagagtctggaggagaaactggatttagtcactaacaagcagcactccccgattcaggtgcccatggtggccggcagcccactaggagcaacccagacgtgcaacaaagtgagatgcgtagtacctcagaccacagtcatcctgaacaacgacaggcagaacgcaatagtggccaagatggaggaccccttgagtaatagggccccagactcactcgagaacgtgatctccaacgccgtcccaggcaggagacaaaacactattgtggttaaggtgccaggccaggaggactcacatcacgaagacggcgaaagcgggagtgaggcctctgattcagtatctagttgcgggcaggctgggtctcaaagcatcgggagcaacgtcacactaattacactgaattccgaggaggattacccaaatgggacatggctaggcgacgagaataatccagaaatgcgagtgcgatgtgccattatcccgtcggatatgttgcacataagcactaattgccgaaccgccgagaagatggccctgactctcttggattatctcttccacagggaggtgcaggctgtatctaacctgtctggtcaggggaagcacggtaaaaagcagctcgaccctctcacaatttacgggatccgttgtcacctgttttacaagtttggaatcacagaaagcgattggtatagaatcaaacaatcgattgacagcaagtgtcggactgcctggaggagaaagcagcggggccaatcattggcggtgaagtcattttctcgtcgtacgcccaacagtagctcatactgcccctcggagccaatgatgtctaccccgccccctgcctccgagttgccgcagccccagccccaaccgcaggccttacactacgctctggccaatgctcaacaggtgcagattcatcagatcggggaggatggacaggtgcaggtcgggcacctccacatcgctcaagtcccacaaggagaacaggtgcagattacacaggattccgaggggaacctgcagatccaccatgttggccaagacggacagttattggaagccacgcggattccctgtcttttagcaccttctgtttttaaggcatcttccggccaggtcctgcagggtgctcaactcatcgcggtggcttccagtgatccagcagctgccggagtggatggcagcccactccaggggtctgatattcaggtgcagtatgtacagctggcaccagtgtccgaccacacggccggagctcagaccgctgaggctctgcagcctaccttgcaaccagagatgcagctggagcatggcgcaatccagatacagtag

SEQ ID NO: 23144 - DNA, 1398 bp, Artificial Sequence
  Description of Artificial Sequence: Synthetic coding sequence
atgatgagcgagcacgacctggccgacgtggtgcagatcgccgtggaggatttaagccccgatcaccccgttgtgctggaaaaccacgtggtcacagatgaggatgaacctgccctgaaacggcaacggctagaaatcaactgtcaagatcccagtattaagagctttctgtattcaataaaccaaacaatttgtcttaggctggattcaattgaagccaagttgcaagctttagaggctacatgcaagagcctcgaagaaaagctggatcttgttacgaataagcagcacagccccattcaagtgcccatggtggcaggatcacctctcggagcaactcagacttgcaatgcggtgcccggacgcagacaaaacactatcgtggtgaaggttccaggccaggaagactctcaccatgaagacggcgagtccggcagtgaagcatccgatagcgtgtcttcttgcggtcaagcgggttcccaatcgatcgggtcaaatgtcactcttatcactttgaattccgaggaggattaccccaatggcacatggttaggtgatgaaaataacccggaaatgcgagtgagatgtgccattatcccgtcagatatgttgcacatttctacgaattgtagaaccgctgagaaaatggcccttaccttgcttgactatctgttccatcgagaggtgcaggccgtcagcaatctcagcggacagggcaagcacgggaaaaaacagctggaccctttgactatctacgggataaggtgtcaccttttctataaatttggcattacagagagtgattggtacaggatcaaacaatccattgacagcaaatgcagaacagcctggcgtcgcaaacagcgtggccagagccttgccgtgaagtctttctcccgccggacccctaatagttcatcctactgtccgtcagagccgatgatgagcacaccaccacccgcaagtgagctgcctcaaccacaaccgcagcctcaagctctccattatgctctggctaacgctcagcaggtccaaatacaccagatcggagaggatggacaggtccaggtgattccacagggccacctccacattgcgcaggtcccccagggggagcaagtgcaaatcacacaagacagcgaggggaacttgcaaattcatcacgtgggacaggacgggcaggtgctccagggtgcgcaactcattgcggtcgcttccagcgacccagccgcagcaggagtcgatggctccccactgcagggctcagatatccaggtgcagtatgttcagctggctccggttagcgaccatacagccggtgctcagacagccgaagcgcttcagccaactttacagccggagatgcagctggagcacggagccatccagattcagtag

SEQ ID NO: 23145 - DNA, 1410 bp, Artificial Sequence
  Description of Artificial Sequence: Synthetic coding sequence
atgatgagcgagcacgacctggccgacgtggtgcagatcgccgtggaagatctatcacccgaccacccagttgtactggagaatcatgtagtaaccgacgaagacgagcctgcccttaagaggcagagactcgagattaattgccaagacccctctatcaagtcttttctatacagtattaaccagaccatttgcctcaggcttgatagtatagaggcgaaacttcaggccctcgaagccacctgtaaaagtctggaggaaaagctggacctggtcactaacaagcagcattcccctatacaagtcccaatggtagcgggctcccctctgggggccacccagacatgcaacaaagtaaggtgtgctgtgccaggcaggcgacagaacacaatagtagttaaagttcctggccaggaggattcccaccatgaagacggagagtcagggtctgaggcatctgactccgtgtccagttgtggacaagcgggatcccagagtattgggtccaatgtcaccttgatcacccttaacagcgaggaggactatcctaacgggacctggctgggcgacgaaaacaacccggagatgagagtccgttgcgcaatcattccatccgacatgctacacatcagcaccaattgtcgtactgcggagaaaatggccctgacccttctagactacttattccacagggaggtccaagctgtgtccaatttgtccggccagggaaagcatggaaaaaagcagctagatccccttactatttacgggataaggtgtcacctcttttacaaattcggcatcacagagtccgattggtatcggattaagcagagcatcgatagtaagtgccggacggcttggcgccgcaaacagcggggtcagtccttggctgtcaagtctttctcacggcgaacccccaactctagttcatattgcccttccgaaccgatgatgtcaactccgccaccggcgagcgaactacctcaacctcagccacagcctcaggccctgcattacgcgcttgcgaatgcacagcaggtccagatccaccagattggggaagatggtcaggtccaggtgatcccccagggccatctccatatcgcccaagtgccgcagggcgagcaggtgcagattacccaggattctgaaggaaatcttcagatccaccacgtgggacaggatggacaggtgctccagggagctcaactgatcgccgtggcatcgtccgaccccgcggctgctggcgtggatggttccccactgcagggatccgacatacaggtgcagtacgtgcagctggcacctgtgagcgatcatacagcgggcgcccaaaccgcagaggccctccagcctacgcttcagcctgaaatgcaattagagcatggtgccattcagatacaatag

SEQ ID NO: 23146 - DNA, 1494 bp, Artificial Sequence
  Description of Artificial Sequence: Synthetic coding sequence
atgatgagcgagcacgacctggccgacgtggtgcagatcgccgtggaagacctgtcacccgaccatcccggaaccgagctctgggatatcgtgttggagaatcacgtggttactgacgaagatgaacctgcactgaagcgccagcgtctagagattaactgtcaagacccatctataaagagctttctgtatagcattaaccagacaatatgtctgcggttggactccatcgaagcgaaactgcaagctcttgaagccacttgtaagagtctggaagagaaattggacttggtcactaataagcaacatagtcctatccaggtaccaatggtagccgggtccccactcggtgccacccagacttgcaacaaagttcgctgtgccgttcctggccgacgccagaacacaattgtggtgaaggtacctggccaggaagattcccaccacgaggatggcgagtccgggagcgaagcctcagattcagtatcttcctgcggacaggccgggtcccagtcgattggttccaatgtgacactcatcacactgaactctgaagaggattatcccaacgggacctggcttggggatgaaaacaaccccgaaatgcgagtgcggtgcgcgatcatccctagtgacatgctgcatatctccaccaattgccgcacggcggagaaaatggcattaacgctgctggattatctgtttcacagggaggtccaggccgtgagtaacctctctggccaggggaaacacggcaagaagcagctggatcctcttacaatttatggcattaggtgccacctgttctataagttcggtatcacagaatcagattggtatcgcataaaacagtccatagattccaagtgcaggactgcatggaggaggaagcaaaggggacaatctttggccgtgaagtccttttcgaggagaaccccaaatagctcttcttattgtcctagtgaaccgatgatgtctaccccgcctcctgcatccgaacttccccaaccccagccccagccacaggccctacactatgcactggcaaatgctcaacaagtgcagattcaccagatcggtgaagacgggcaggttcaggtaattcctcagggtcatctccacatcgctcaagtcccacagggcgaacaggtgcagatcacccaagattcagagggcaacctgcagattcatcacgtagggcaggatggccagctgctggaggctactcgaatcccatgcttacttgctccatcagtatttaaagcctcttcaggccaggtgctccagggtgctcagctgatcgccgtagcttcaagcgatcctgctgcagccggagttgacggctctccactccagggtagtgacattcaggtgcagtatgtgcagcttgcaccagtctcggaccacaccgccggcgcgcagacagctgaggcactgcaacccactttgcagccggagatgcagttggagcacggagctatccagatccaatag

SEQ ID NO: 23147 - DNA, 1560 bp, Artificial Sequence
  Description of Artificial Sequence: Synthetic coding sequence
atgatgagcgagcacgacctggccgacgtggtgcagatcgccgtggaggacctcagtccagaccatccagtcgtcttagagaatcatgttgtcaccgacgaggatgagcctgcactgaagcggcagaggctggagatcaactgtcaagacccaagcatcaagaccatttgtctgcgccttgattccatagaggctaagctccaagctctggaggccacttgtaagagcttagaagaaaagctcgaccttgtgacaaataaacaacatagccccatccaagtgcccatggtcgccggtagcccccttggggcaactcagacgtgtaacaaagtccgatgcgttgtgccacaaacaacggtaatcctgaataatgaccggcagaatgccatcgtcgccaaaatggaagacccccttagtaatcgtgcaccggattcgctcgagaatgtgatttcaaatgccgtgccaggtcgccgacagaacacaatcgtcgtgaaggtgccaggtcaggaagactctcaccatgaggatggagagtctggcagcgaagcttccgactctgtgagcagttgcggccaggcagggagccagtcaattgggtctaatgtgactctgattaccttgaacagcgaggaggactatcctaatgggacctggttgggcgacgaaaataatcccgagatgcgtgtgagatgtgcaatcatccccagcgacatgttgcatataagcactaattgccggaccgcagagaagatggcgcttactttgctggactatttgtttcacagagaggtgcaggccgtgtccaatttgtccgggcagggaaagcacggcaagaaacagctggatccactgacaatctacgggatccgatgtcatctgttttataagttcggcatcactgagagcgactggtaccgaatcaagcagagtatcgacagtaagtgtcgaaccgcctggagacggaaacagagagggcagtcacttgccgtaaaatccttctctcggaggacaccaaactcatcgagttattgtccaagcgaaccgatgatgagtaccccgcccccagcatctgaacttcctcagccacaacctcagccacaggccctacactatgcgttggctaatgcccagcaggtgcagatccaccaaatcggagaagacggacaggtacaggtgggccacctgcatatcgcacaggtgccgcagggtgaacaggtccaaatcacccaagactcggaagggaaccttcaaattcaccacgtggggcaagacgggcagcttctcgaagcgacccgcattccttgcttgctcgcaccatccgtcttcaaagcaagcagtggccaggtgctgcagggcgcccagctgatcgctgtcgcctcctccgaccctgccgcggccggggtggacgggtccccccttcaaggctccgatattcaggttcagtacgtccagctagccccggtgagcgaccatacagccggcgcccaaacagcagaagccttgcagccaacactgcaacctgagatgcagcttgaacacggtgcaatccagatccagtag

SEQ ID NO: 23148 - DNA, 1476 bp, Artificial Sequence
  Description of Artificial Sequence: Synthetic coding sequence
atgatgagcgagcacgacctggccgacgtggtgcagatcgccgtggaggacctcagtccagaccaccccgtagttctggagaatcatgttgttaccgacgaagacgagcccgcgttaaagaggcagagacttgagataaattgccaggatccttctattaaatcctttctgtactccattaatcagacaatctgcctgcggcttgacagcattgaagcgaaactacaggcgctggaggcgacttgcaaaagtctggaggagaaacttgatctggtgacgaataagcagcactcccctatccaggtcccaatggtggcaggtagtccacttggagcaactcagacctgtaacaaggtgaggtgcgctgtgccagggcgcagacaaaataccatcgtcgtgaaggtgcccggtcaggaggacagccatcatgaggacggcgagtcggggtcggaggcatctgatagcgtgtcatcatgtggacaagctggatcacagtctatcggtagtaacgtgaccctgatcacgctaaattccgaggaagattaccccaatggcacttggctgggggacgagaacaatcccgagatgagagtgcgttgcgccataattcccagcgatatgctccacatctcaactaattgcagaaccgctgagaaaatggccctgacactgcttgactacctcttccaccgggaagtacaagcagtgagcaacttgagcggtcaaggaaagcacgggaagaagcaactggatccactgaccatttatggtattagatgccacctcttctacaagttcggaattaccgaaagcgattggtaccgcatcaaacagagcattgacagtaagtgtaggacagcctggaggaggaaacagcggggccaaagtctggccgtgaagagcttctcacgccggacaccgaacagctcaagctattgtccctcggaacctatgatgagcacacccccccccgcaagcgagttgccccagcctcagccacagccccaagctctacattacgcacttgctaatgcccagcaagtccagatacaccaaattggtgaagatggccaggtgcaggttatccctcaaggtcatcttcatatcgcccaggtccctcagggtgagcaggttcagatcacccaggactctgagggaaatctccaaatacaccacgtcggacaggatggccagttacttgaagccacgcgcataccttgcctgctcgcgcccagcgtcttcaaagcatcgagtggacaggtgcttcagggcgcacagctcatagccgtcgcgtcctccgaccccgccgctgcgggtgtcgacgggtcacctctgcaaggcagtgatatccaagtgcagtacgtgcagcttgccccagtgagcgaccacaccgctggggcacagaccgcagaggcacttcagcccactttgcagcctgagatgcagctggaacacggggccattcaaatccaatag

SEQ ID NO: 23149 - DNA, 357 bp, Artificial Sequence
  Description of Artificial Sequence: Synthetic coding sequence
atgatgagcgagcacgacctggccgacgtggtgcagatcgccgtggaggaccttagccctgaccaccccgttgttctggaaaaccatgtagtcacagacgaggatgagccagctctaaagcgccagaggctggagattaactgccaagatccaagtatcaagtcatttttatactcgataaaccaaacaatttgcttacgcttggacagcatagaggctaagttacaggccctggaagcgacctgcaaatcacttgaagaaaagctcgatctcgtgacaaataaacagcactccccaattcaggtcccgatggtggccggatcgccattgggagctacacagacctgtaacaagtag

SEQ ID NO: 23150 - DNA, 87 bp, Artificial Sequence
  Description of Artificial Sequence: Synthetic coding sequence
atgatgagcgagcacgacctggccgacgtggtgcagatcgccgtggaggatctgagccccgaccatccagtcgttctggagaattag

SEQ ID NO: 23151 - DNA, 288 bp, Artificial Sequence
  Description of Artificial Sequence: Synthetic coding sequence
atgatgagcgagcacgacctggccgacgtggtgcagatcgccgtggaagatctcagcccagaccaccccgtagtcctcgagaatcatgttgtgacagacgaagacgagcctgccctgaaacgtcagaggttagagataaattgtcaggaccccagtatcaaatcttttctctacagcatcaatcagacaatttgcctgcgactggactctatcgaagccaagctgcaagccctggaggcaacatgcaagtccctggaggagaagcttgatctggtcacaaataagtag

SEQ ID NO: 23152 - DNA, 372 bp, Artificial Sequence
  Description of Artificial Sequence: Synthetic coding sequence
atgatgagcgagcacgacctggccgacgtggtgcagatcgccgtggaggacctgtccccggaccacccagttgtcttggagaaccacgttgtgaccgatgaagatgagcctgcactgaaaagacagcggctggaaatcaactgccaggatccatcgataaagtcctttttgtactctattaaccaaactatatgcctccgcctggacagtatcgaggcaaaactgcaggcgctggaggccacttgcaaaagtttggaagagaaactggatttggtcacaaataaacagcactccccgatacaggtacccatggttgctggctctcctcttggcgctacccagacatgtaataaagtcaggtgtgtagtatag

SEQ ID NO: 23153 - DNA, 588 bp, Artificial Sequence
  Description of Artificial Sequence: Synthetic coding sequence
atgatgagcgagcacgacctggccgacgtggtgcagatcgccgtggaggacttgagtcccgaccaccccggcacagagctgtgggacatcgtactggaaaatcacgtggtgacggacgaggacgaacccgccctgaaacgtcagcgcctggaaataaattgccaggacccatctattaagtccttcctttatagcattaatcagacaatctgcctgagactggatagtattgaggctaaactccaagcccttgaagctacttgcaagtctctcgaggaaaagttagatctagtgaccaacaagcagcactctccgattcaggtgccaatggtggctggctccccgctgggggccacccagacctgtaataaggttcgttgcgctgtccccggacggcgtcagaatacgatcgtggttaaagtgccaggtcaggaggactcccaccacgaggatggcgaaagtggaagtgaagcatccgatagcgtgtcaagctgtggacaggccggcagtcaaagtatcggtagcaatgtgactcttattacgttaaatagcgaggaggattatccaaacggaacatggctcggatag

SEQ ID NO: 23154 - DNA, 360 bp, Artificial Sequence
  Description of Artificial Sequence: Synthetic coding sequence
atgatgagcgagcacgacctggccgacgtggtgcagatcgccgtggaggatctatcccctgatcaccctgtggtcttggagaaccacgtcgtgaccgacgaggatgagccagccttaaaaagacagagactggaaattaactgtcaggacccgagtattaaatcctttctgtattcaatcaatcaaactatatgtcttaggctggattccatcgaggccaagcttcaagctctggaagccacctgcaagtctttggaggagaaactagatttagtcaccaataaacagcatagccctattcaggtgcccatggtggccggttcaccactaggagcaactcagacatgcaacaaagtgtag

SEQ ID NO: 23155 - DNA, 1401 bp, Artificial Sequence
  Description of Artificial Sequence: Synthetic coding sequence
atgatgagcgagcacgacctggccgacgtggtgcagatcgccgtggaggatctctcaccggatcacccagtagttctagagaatcatgtggtgaccgatgaggacgagccagcccttaagagacagcgccttgaaattaactgccaggatccaagcattaaatcctttctgtactccataaatcagacaatctgcctgcgattggattccatcgaagctaagcttcaagctctcgaagctacttgcaagagtctggaggaaaaattagacttggtcaccaataaacagcatagtccaatccaggtcccaatggtggccgggagccctctgggcgcaacccagacatgtaacaaggtgaggtgcgctgtaccaggtcgacgtcaaaacaccatcgttgtgaaagtgccagggcaggaggactcgcaccatgaagacggcgagtccggttctgaggccagcgatagcgtaagttcctgtgggcaagcaggatcacaatccatagggtccaatgttaccctgataacgctgaacagcgaggaggattatcccaacggaacttggctgggcgatgaaaataatccagagatgcgcgtccgatgtgctatcattccctcagatatgttacacatatcaaccaactgcaggactgctgagaagatggctctgactttactcgattacctgtttcacagggaggtgcaagctgtatccaacctgtctgggcagggtaagcatggaaagaaacagctggatcctctgaccatctacggcattaggtgtcacctgttttataaattcggcatcacagaatccgactggtacagaattaagcaaagcatcgatagtaagtgtcgcactgcatggcgtaggaaacagaggggccagtccttggccgtcaagagctttagccggcgaacacccaatagttcgtcatactgtcctagcgagcctatgatgtcgaccccaccaccagcctctgagctaccacagccacagccgcagcctcaggctctgcactatgcactagcgaacgcccagcaggtgcagatccaccaaattggcgaagacgggcaggttcaggtaggacatctccacattgcccaggtgccccagggcgagcaagtgcagatcacacaagattcagaaggaaatctccagatccaccatgtgggtcaggatggacaggtcctgcagggtgctcagctcattgccgtggcaagcagtgatccagccgctgccggggtcgatggctctcccttacagggatccgatattcaggtgcagtacgtgcagttggcgcctgtgagtgatcacaccgctggcgctcagaccgccgaagccctacagcccacgctccaaccagaaatgcagctggaacacggtgcaatccagatccagtag

SEQ ID NO: 23156 - DNA, 753 bp, Artificial Sequence
  Description of Artificial Sequence: Synthetic coding sequence
atgggcagccccgagcccacccagggcccccggctgagccccatcctaattccttactcaggtcgccgatataaggtaggccgcgctagcggcgccctgtgtcatcaggattccttgcctcctatcctggagctgggcctcacattcctgcgcgcctcggccggattttctgtgccaactagttctagtttcgctctgcctgagcccttgagatctttgtgtctgggcaatggcgagggtctgggactatccctgaccctgaccgtcttagcgtggatcttgggactgtcaggcacactgggtgctctcgtgttgttcatggttgctactgggattttccaagaggccctgtggcacctactgctcctgtctttcagtgtggaggctctaccttgcttcttcttcttcccttttttccttctctgtagatgtttgcgcgccgagttgcagatccagcagcggctggacggtactctctctctggatctgatgcgccttgaaagcgacggcgaaactgggtgtgcagccgaatctagcgttctgcagggcgcacagttaatcgcagtggccagtagcgatccggcagccgccggcgtagacggtagccctctgcaaggcagcgacattcaggtgcagtatgtccagctggcacctgtgtccgaccacaccgccggggcacaaacggcagaggctttgcaaccgaccctgcagcctgaaatgcagctcgagcacggggcaattcaaattcagtag

SEQ ID NO: 23157 - DNA, 1527 bp, Artificial Sequence
  Description of Artificial Sequence: Synthetic coding sequence
atgatgagcgagcacgacctggccgacgtggtgcagatcgccgtggaggatctgagtccagaccatccggtggtcctggaaaaccatgttgtgacagacgaagacgaacctgctttgaaacgccagcgtcttgagatcaattgtcaggacccctcaatcaagtccttcctgtatagcatcaatcagactatttgtctccgcctcgactctatcgaagctaaactccaagcactggaggctacatgcaagagcttggaagagaaactggacctagtgaccaacaagcagcatagtccgatacaggtacctatggttgcaggctcccctctaggcgcgacccagacatgtaacaaggtcaggtgtgtggtgccgcagactactgtcatcctgaataacgacaggcagaatgccattgtggcaaaaatggaggaccccctcagcaatcgagccccggactccctcgaaaacgtgatctcaaacgccgtcccagggcgccggcaaaacacaatcgttgtgaaggtgccaggacaggaagacagtcaccatgaggatggtgaaagcggttctgaagcctctgacagcgtgagctcatgtggacaggcgggctcccagtcaatcggcagtaatgtgactctaatcacactcaatagcgaagaggattaccccaacggcacatggctgggcgatgagaacaaccccgagatgcgtgtccgctgcgctattatcccatccgatatgctgcacattagcacaaactgtcggactgccgaaaagatggcactcacactactggactatcttttccacagagaggtgcaggccgtgagtaacttgagcgggcaagggaagcatggcaaaaagcaactggacccactgaccatctatgggatcagatgccacttgttctataaatttggaataactgagagcgattggtaccgaatcaaacagtctatcgatagtaagtgccgaacagcctggagaaggaaacaacgcggtcagtctctcgcagtgaagtccttctcacggcgaacccccaacagtagctcttactgtccctccgagccaatgatgtctaccccaccgcccgcttcagaactaccccagccacaacctcagcctcaggctctccattacgccttggcaaacgcacaacaggtgcagattcatcaaattggtgaagacggacaggttcaggtgatccctcaagggcacctccacattgcccaggtgccccagggtgaacaggtccagattacccaggattcagaaggaaatctccagatacaccatgttggtcaagatggacaggtgttgcagggggcacagcttattgccgtggcttcgtccgatccagcagccgctggcgtggacgggagccccttacagggaagcgatatccaggtgcagtacgtccaattggcccctgtgtcagaccacacagccggcgctcagactgctgaagctcttcagcccacacttcagcccgagatgcagcttgaacatggtgctatacagatccaatag

SEQ ID NO: 23158 - DNA, 1476 bp, Artificial Sequence
  Description of Artificial Sequence: Synthetic coding sequence
atgatgagcgagcacgacctggccgacgtggtgcagatcgccgtggaggacctgagtcccgaccatccagtcgtgcttgaaaaccatgtggtcaccgacgaggacgaacccgcgttaaagaggcagaggctcgagatcaattgccaagaccctagtatcaaatcttttctctacagtattaaccagacaatctgtctgagactggacagcatcgaagcaaagctccaggcactggaggcaacgtgcaaatcgctcgaggagaagctggatctggtcaccaataaacaacacagccccattcaggtccccatggtggcggggtctcccctaggcgcaactcaaacgtgcaataaggtcagatgcgcagtacctgggagaaggcagaataccatagtggtcaaagtgcccggtcaagaggatagccaccatgaggatggggaatccggatctgaagccagcgactcggtgtcgtcttgtgggcaggctggctcacaatctattggaagcaatgtaaccctgataacgctcaactctgaagaagactaccccaacggcacttggctcggggacgagaacaatcctgagatgcgcgtgcggtgcgctataatccccagcgacatgctgcatatctcgaccaattgccggacagctgagaagatggcccttactctattggactacctgttccacagagaagtgcaagccgtgagtaacctatccgggcagggtaagcacgggaaaaagcagctcgaccctctcacaatatatgggatcagatgccacctgttctataaattcgggattactgaatccgattggtataggatcaagcagtcaatcgactctaaatgccgtacagcatggagacgtaagcaacggggccaaagcttagcagtgaaatcattctctcgcaggacaccgaacagctcgtcttattgtccctccgagcctatgatgtcaaccccacctcccgcctctgagctgccgcagccgcagccgcagccccaggccctgcattacgccctggcaaacgcccagcaagtgcagatacaccagattggagaggatggccaagttcaagtaatcccacagggacacctgcatatcgcacaggttccacagggggaacaggtacagataacccaggactctgaaggcaacctccaaattcaccacgttggacaagatggacagctcctggaagccacccgaatcccttgcctgcttgctccaagcgttttcaaggcgagttccggccaggtcttacaaggcgcccaactgattgccgtggcctcatcggacccagccgctgccggcgtcgacgggagccctttacaggggagtgacattcaggtccagtatgtccagctggctccggtgtctgatcataccgcgggcgcacagactgccgaggcattgcaaccaacccttcagcccgaaatgcagctggaacacggcgcaatccagattcagtag

SEQ ID NO: 23159 - DNA, 3153 bp, Artificial Sequence
  Description of Artificial Sequence: Synthetic coding sequence
atggccgccgtgaagaaggagggcggcgccctgagcgaggccatgtccctggaaggggacgagtgggaactgagcaaggagaacgtgcagcccctccgacagggaaggatcatgagtacgcttcagggtgcccttgcacaggagtctgcttgcaacaacactttgcagcagcagaaaagagcgtttgaatatgagattcgcttctacaccgggaacgacccactggatgtgtgggaccggtacatctcctggacagagcagaactatccccagggcggcaaggaaagtaacatgtccacattactggagcgcgcggtggaagcgctgcagggcgagaaaagatactacagtgaccccaggttcctcaatctctggctgaaactgggacggctctgcaacgagcctctcgacatgtattcctatctgcataatcagggcataggggtcagtcttgcacagttctacatctcatgggccgaggagtacgaggcaagagagaacttccgaaaggccgacgccatcttccaagaggggattcagcagaaggcggaacccctggaacgactgcagtctcaacatagacagttccaggcccgtgtgtccaggcaaaccctgctggcattggaaaaagaagaagaggaggaggtattcgaatcaagtgttcctcagcgttcaacactggcagagctaaaatccaaaggaaagaaaactgcaagggctcctattatccgggtcggcggcgccctgaaggcgccaagccaaaatcgtggcttgcaaaatccctttccacagcaaatgcagaataattcacggatcacagtatttgacgaaaacgctgatgaggcatccacggctgagctttccaagccaaccgtacaaccttggatcgcaccgcccatgcctcgcgcaaaagagaatgagctgcaagcaggaccctggaacaccggcaggtccctggagcatcggcctagaggcaacacagccagtttgatagcagtacccgcggttctacccagctttactccatatgtcgaagaaaccgcgaggcagcctgtgatgaccccttgcaagatcgaaccctcaattaaccatattctttccacaagaaagcctggaaaagaggaaggggaccctctgcagagagtgcagtcccatcagcaagcgagtgaggagaagaaagagaaaatgatgtactgcaaggagaaaatctatgccggtgtaggagagttcagtttcgaggagatacgtgcagaagtttttagaaagaagctcaaggaacagcgagaggccgagctgctgacctccgcagagaaaagggccgagatgcaaaagcaaattgaggaaatggagaagaagctgaaggagattcagactacccaacaggaacgcaccggggaccagcaagaagagacaatgccaaccaaggaaacaacaaaactgcagattgcctccgaatcgcagaagattccaggaatgacactgtcttccagtgtatgtcaggtcaattgttgcgcccgcgagactagcttggctgaaaatatctggcaagagcagccccatagcaaggggccgagcgttccattctctatattcgatgaatttctgttatcagaaaagaagaacaagtctccacccgccgatcctcctcgagttctcgcacagaggagacccctggcggtgctcaaaacctccgaatctattacatccaacgaagatgtctcccccgacgtgtgcgacgaattcaccggcatagagcccctttctgaagacgctataatcaccgggttccgcaatgtgaccatctgccctaaccccgaagatacgtgcgatttcgcgcgagctgcaaggttcgtatccactcccttccatgagattatgagcctgaaggatcttccctctgatccagagagactattacccgaagaggatctggacgtaaaaacgtcggaagatcaacagactgcctgcggaacaatctacagccaaaccctgagcataaaaaagctctctcctatcatcgaggactcacgggaggccactcattcatctgggttttctggaagctccgctagtgtggcgtccacctcatctattaaatgcctgcagatacccgaaaagctggaactgactaatgagacctctgagaatcctactcaatcgccctggtgttcccagtaccggaggcagttactcaagagcttgccagaattatccgctagtgccgagctctgcatcgaagaccggcctatgcctaaactggagatcgagaaggagatagagcttggaaacgaggactactgtatcaagcgggagtatctaatctgcgaggactacaaactcttctgggttgccccaaggaactctgctgagctgaccgttattaaagttagtagtcagcccgtgccttgggacttctatatcaacttgaaacttaaggaaaggttaaatgaggactttgaccatttctgctcatgctatcagtaccaagatggttgtattgtttggcaccagtacataaattgttttactctgcaggatttacttcagcattcagagtacattacccacgaaatcaccgttctcatcatctataatctgctgactatcgtggagatgctccacaaggccgagatcgtgcatggagacctctcccctaggtgtctgatcctgagaaacagaattcatgacccatacgactgcaacaaaaacaaccaagcccttaaaattgtcgactttagttacagcgtggacttgcgcgtacagctggacgtgttcaccctgtcgggtttccgtacagtccagattttggaagggcagaagatactggcgaattgttcttccccctatcaggtggacctttttggtatcgcagatctggcccacttactactgttcaaggagcatctgcaggtgttctgggacgggtctttctggaaactgtctcagaatatatctgaactgaaagatggggaactgtggaataagttcttcgttcgaattctcaatgctaacgacgaagctacagtgtctgtactgggagaacttgcggctgaaatgaatggcgtttttgacactacttttcaaagtcacctgaataaggccctttggaaggttggcaagcttacctccccaggggctctcctgttccagtag

SEQ ID NO: 23160 - DNA, 3195 bp, Artificial Sequence
  Description of Artificial Sequence: Synthetic coding sequence
atggccgccgtgaagaaggagggcggcgccctgagcgaggccatgagccttgagggcgacgagtgggagctatccaaggagaatgtgcaacctttgagacagggaaggataatgagcactcttcagggcgccctcgcacaggaatcggcctgtaacaataccttacagcagcagaaaagagcgttcgagtacgagattcggttctataccgggaacgaccctttagatgtttgggatcgatgggtttttcttttccacaaagacaaccgcaacattaacagatatattagctggaccgagcagaactacccacaggggggaaaagagtcaaatatgtccacactgcttgagcgggctgtcgaggcactgcagggtgaaaagcgttattattccgaccccagatttcttaatctgtggttgaaattagggaggctttgcaacgagcctctggatatgtactcatacttgcataaccaggggataggggtcagccttgcccagttctacatctcttgggccgaggaatatgaagctcgcgagaactttcggaaagcagatgccattttccaggagggaattcagcagaaggcagagcctctggagaggttacaatcccaacatcgccagtttcaggcaagagtgtccagacagaccttgcttgcattggaaaaggaggaggaggaagaggtctttgagtctagtgtcccccaacgatcgaccctagccgaacttaagtcaaagggtaagaaaacggccagggccccaataatcagggtgggtggcgctttgaaagctccatcccaaaatcgtgggttgcagaatccattcccacagcagatgcagaacaactctagaatcaccgtatttgatgagaatgcagacgaggcctccacagcagagctgagcaaaccaaccgttcaaccatggatcgcacctcccatgcccagggctaaggaaaacgagcttcaagcggggccttggaacacaggtcggagtctggaacaccgaccccggggtaacacagccagcctgattgccgtgcccgcagttctgccctcattcacaccatatgttgaagaaacagcccgacagccagttatgacaccttgtaagattgaacctagtatcaaccatatactgtccacaaggaaacccgggaaggaggagggcgatcccctgcaacgcgtccagagtcaccaacaggcttcggaggaaaaaaaagagaaaatgatgtactgtaaggaaaaaatttacgcaggggtcggcgaatttagctttgaagagatccgggctgaggtcttccggaagaaattaaaagaacagcgcgaggcggagctgctcacctctgctgagaaacgggctgaaatgcaaaagcagatcgaggagatggagaaaaagctgaaggagatccagaccactcagcaggagcggaccggtgatcagcaggaggagaccatgcctaccaaggagacaacaaagctgcaaattgcttccgagtcccagaaaataccaggaatgaccctgtcttctagtgtgtgccaggtgaactgttgtgccagggaaacttctcttgccgaaaacatatggcaggaacagccgcactctaagggacctagcgtcccattctccatcttcgacgaattcctcttgtctgaaaagaaaaacaagagcccccctgcagatccacctcgagtcctcgctcagaggaggccgctggcagttctgaaaaccagcgagagtataacaagtaatgaggacgtgagccctgacgtttgcgatgaattcacaggaattgagcctctatcagaagatgcaatcatcaccggtttcagaaatgtcactatttgccccaaccctgaagatacgtgtgactttgccagagctgcgcgcttcgtgagcacacctttccacgaaataatgagcctgaaggacctcccctccgatcccgagaggctcctgcccgaggaggatttagatgttaagactagcgaagatcagcagacggcatgtggtaccatttactcacaaaccttgtccattaagaaactatcgccaattatagaggattctagagaggctacacatagcagcggcttttctgggtcttccgcctccgtcgccagcacatccagcattaaatgtttacagatccccgagaagttagaacttacaaacgaaacatccgagaatccaacccaaagcccctggtgcagtcagtatcgccgccagttgctgaagagcctcccggaattatcagcatctgccgagttgtgcattgaggatcgacctatgcccaaactcgagattgagaaggagatagagctcgggaacgaggattactgtatcaagagagagtacttaatatgtgaggactataagctattctgggttgctccccggaacagcgccgaactgactgttattaaagtcagttctcagcccgtgccctgggacttttacataaatctcaagctgaaagagcgactcaatgaggacttcgaccatttctgttcgtgttaccagtatcaggacgggtgcatcgtatggcaccagtacatcaactgtttcactttgcaggatctcctacagcactccgagtatatcactcatgagatcactgtactgatcatttataatctgctgaccattgtcgaaatgctgcacaaagccgaaatcgtccacggagaccttagcccaagatgtctaattttgagaaaccgaattcacgatccatatgattgcaacaagaataaccaggcccttaaaatcgtggattttagctactcagtggatctgagagtgcaattagacgtattcacactcagcggctttcggaccgtacagattttagaagggcagaaaatccttgccaactgctcctctccataccaagtggacctgttcggcatagctgacctcgcacacttgcttctatttaaggaacaccttcaagtcttttgggacggcagcttttggaagctgtctcaaaacatcagcgagctgaaggatggggagctgtggaacaaatttttcgttaggattcttaatgcaaacgatgaggcaacagtcagcgtcctgggcgagctggcggctgaaatgaatggagtgttcgacacgacctttcagtcccatctcaacaaagccctgtggaaagtcggcaagctaacaagcccaggggccctcctgttccaatag

SEQ ID NO: 23161 - DNA, 2802 bp, Artificial Sequence
  Description of Artificial Sequence: Synthetic coding sequence
atggccgccgtgaagaaggagggcggcgccctgagcgaggccatgtctctggaaggggacgagtgggaactctccaaagagaacgttcaaccgttacgccaaggcaggattatgagtacactgcaaggagcattagcccaggagtccgcatgcaacaatacactccagcagcagaagcgtgcattcgaatacgaaatcagattctatacaggaaacgatccactggatgtctgggataggtacattagttggaccgagcagaattatccacagggaggcaaggagtcaaatatgagcaccctccttgaacgggccgtggaagccctccagggcgaaaacttttggaaggccgatgccatatttcaggaggggatccagcagaaggcagaacccttggaacggctccaatcgcagcatagacagtttcaggctagagtatcaagacagactctgctggccctggaaaaagaggaggaagaagaggtgtttgaatcctcagttccgcaacggagcactctggcagagttgaagagtaaagggaagaagactgccagggccccgatcatccgcgtgggcggggcgctgaaggcacctagccagaaccgcggacttcaaaacccctttccacagcagatgcaaaacaattcccgaataactgtcttcgacgagaacgctgatgaggcttcgacagccgaattgagcaagccaaccgtacagccctggatagcgccgcctatgccccgcgcgaaggagaacgaactacaggcgggcccctggaacaccggccgctcattggaacaccgtccacggggaaataccgcctcactgattgcggtccccgctgtcctaccttcctttacgccttatgtggaggagacggctaggcagccggttatgacgccatgtaagattgagccatcaattaaccacattctatccaccagaaaaccagggaaggaggagggagaccccctgcagcgggtacagagccatcagcaggcctccgaagagaaaaaagagaaaatgatgtactgtaaggagaaaatttatgccggggtcggcgagttttccttcgaggagatccgcgcagaagtgtttcgaaaaaagctaaaagaacagcgcgaagctgagctactgacatccgccgagaagcgagcagaaatgcagaagcagatcgaggagatggaaaagaagctaaaggagattcagacaacacagcaggaacgcactggagaccaacaggaggagactatgccaactaaagagaccactaaactgcagattgcgtcagagtctcaaaagatccccgggatgacgctcagcagcagtgtctgccaggtgaactgctgtgctcgtgagacgtccctggcagaaaacatctggcaggaacaacctcattccaaggtgagtttgagcctcggcccctcagtgcctttctcaatatttgacgaatttctcctgtcagagaaaaaaaataaatccccacccgccgatccaccaagggtcctggcccagcgacggcctcttgccgtcctgaaaaccagtgagagtatcacctcaaacgaggatgtctctcccgatgtctgcgacgagttcaccgggattgagcctctctccgaagacgcaatcattactggctttcgcaacgtcacgatatgccctaacccggaagataccagggaggcgacacactcttctggcttctctgggagctccgctagcgtggcatccacgagctccatcaaatgtcttcaaatccctgaaaaactcgagttgaccaacgagacatccgagaacccaacccaatcaccttggtgctctcagtaccggcggcaattgctcaaatctcttccagaactcagcgccagcgccgaactttgtatagaggaccgcccgatgcccaagctggaaattgagaaagagatcgaactcgggaacgaggattattgtatcaagagagagtatctgatctgtgaggactataaacttttttgggtcgccccacgcaattccgcagagcttacggtgattaaagtgagctctcaaccggtgccctgggacttttatataaatctgaagctgaaggaacggctgaacgaagattttgaccatttctgttcgtgctatcagtaccaggatggctgtattgtctggcatcagtacatcaactgttttactttgcaggacctgcttcagcatagtgagtatatcactcatgagattaccgttttgatcatatacaacctcctcacaattgtcgaaatgctgcacaaagcagaaatcgtgcatggcgacctctcaccacgctgcctgatcctccgcaaccgcattcacgacccttacgactgcaacaagaataaccaggctctcaagattgttgatttttcatatagcgttgacctgcgcgtccagctggacgttttcacactttcgggtttcaggacagtccaaatacttgagggacagaaaatactggcaaactgttcctcgccctatcaggttgatcttttcggaattgccgacttggctcatctgctcctgttcaaggaacacttgcaggtgttctgggatggaagcttttggaagctgtcacagaacatcagtgaactcaaggatggcgagctgtggaacaaattcttcgtgagaatcctaaacgcaaatgacgaggcaacagtgtctgtcctgggcgaactcgcggcagagatgaacggcgtgttcgatacaaccttccagtcccatctgaacaaggccctctggaaagtgggaaagctaacctcgcctggcgcactcctgttccagtag

SEQ ID NO: 23162 - DNA, 3393 bp, Artificial Sequence
  Description of Artificial Sequence: Synthetic coding sequence
atgctggagatctgcctgaagctggtgggctgcaagagcaagaagggtctttcttcgtcaagctcctgctacctggaagaggctctacagcgccctgtggccagcgactttgagcctcaaggtttgagtgaggctgctcggtggaactcaaaagagaatttgctggccggaccgtcagagaacgaccctaacttgtttgtcgcactctacgatttcgtggcaagcggagataacacactttctattaccaaaggggagaagctgagggtcctgggatataaccacaatggggagtggtgtgaagctcagactaaaaacggacaggggtgggttccttctaattacatcacgccggtgaattcccttgaaaagcattcttggtaccatggccctgtttcacgcaatgcagccgagtatcttctgagtagcggcattaatggcagtttcctggtgagggagagcgagtcaagccccggacaaaggagtatctcccttcggtacgagggtagagtgtatcactaccgcattaatactgcaagcgatggcaagttgtatgtctccagtgagagccgcttcaatactttagccgagctggtccaccatcatagcaccgtggcggacgggttaattaccaccttgcactacccagcgccgaaaagaaataaaccaaccgtttacggagtttcaccaaattacgacaaatgggagatggagcggactgatattactatgaagcataagctgggtggcggtcagtatggagaagtgtatgaaggtgtttggaagaagtactcactgaccgtggctgtgaaaacattgaaggaggacaccatggaggtcgaagagttcctcaaagaagccgccgtcatgaaagaaattaagcatcctaacctcgtccagcttcttggcgtgtgtacgcgagaaccccctttctacatcataaccgagtttatgacctacggcaacttgttggactacttacgggaatgtaaccgccaggaagtgaacgcagtggtgcttctctatatggccacccagattagctcggctatggagtatctcgagaagaaaaacttcatccatcgagacctcgctgcccgcaattgcttagtgggcgagaatcaccttgtgaaggtcgccgactttggcctgtcacgtctgatgaccggagacacctatacggctcatgccggcgccaaatttccaataaaatggacagctccagaatccctagcatataacaagttcagcatcaagtcagacgtttgggccttcggcgtgctcctatgggagatagcaacatatggcatgtcaccctaccccggcattgacctcagtcaggtctacgagctcctggagaaagactataggatggaacggcctgaagggtgtcctgagaaagtgtatgagctgatgagggcttgctggcagtggaatccaagtgaccggccttctttcgctgaaattcaccaggcatttgaaacaatgtttcaggaatcttcgattagtgacgaggtggaaaaggaattgggcaaacaaggcgtgcgcggagcagttagcactcttctgcaggccccagaactccccacaaaaacaagaacaagcagacgggccgcagagcatcgggatactactgatgtccccgagatgccacacagtaaagggcagggggagagcgaccccctcgaccacgaacctgccgtttcccccctccttcccagaaaagaacgaggaccaccagagggaggcctgaatgaggatgagcgcctgctccctaaggataaaaaaaccaatctgtttagtgcgctgatcaaaaagaaaaagaaaactgctccaactccacctaaacggtcctcatcattcagggaaatggatggtcagcctgaaagacgaggagccggtgaagaggagggaagggacatcagcaacggggcactcgcattcaccccattggacactgctgatcccgccaaatctccaaaaccatccaatggcgcaggagtcccgaatggggccctgagggaaagtggcggaagtggcttcagatccccccacttatggaagaaaagttctaccctcacctcctcccgtctggctaccggggaggaagaggggggcgggtccagctctaaacgatttctcagatcttgctccgctagctgtgtacctcatggagcaaaggatactgagtggcgatccgtgaccctcccacgagacttgcagagcactggacggcagttcgacagttcgaccttcggcggtcataaatctgagaaaccagcactacctaggaaacgggcaggcgagaaccggtcagaccaggtgacacgggggactgtgacccctccaccaagactggtgaagaaaaatgaagaggccgctgacgaggtgtttaaggacatcatggaatcttcacctgggagcagcccgcctaacctaactccaaagccactgagaagacaggttactgttgcgcccgcttctgggctgcctcacaaagaagaagccgggaaggggtcagcgctcggtaccccggccgctgccgaacccgtaacccctacttcgaaggctggatctggagcccctggcggcacgtccaaaggtcccgcagaagaatcccgtgtgcgacggcataaacactcaagcgagtccccggggcgcgacaaaggcaagctcagccgtctgaagcctgcccctcctccacctccagctgcctcagctggtaaggccggcggtaaaccctcccagtctccatctcaagaagccgctggcgaagccgtgcttggcgcgaaaactaaagctactagcctagtggacgctgtgaattccgacgccgccaaaccaagccagccaggcgaaggattgaagaaacccgtgctgccagccacaccgaagcctcagtctgcgaaaccatccggtactcccatctctccagccccggtcccgtccacactaccctctgcaagctctgctctggccggggaccagccatctagtacggcatttatacctttgatttctacaagagtcagcctgcgcaaaaccaggcagcctccagaaaggattgctagtggggccatcaccaagggcgttgttctcgactctaccgaggccctttgcctggctatttcacgcaatagtgagcagatggcatcccatagtgcagtgctcgaagccggcaaaaatctctacactttctgtgtatcttatgttgactccatccagcaaatgaggaacaaattcgcctttcgggaagccattaacaagctcgagaacaacctgcgggaactgcagatttgtcccgccaccgcaggctccggacccgccgccacacaagacttctctaaacttttgagcagcgttaaggaaatttctgatatcgtgcaaagatag

SEQ ID NO: 23163 - DNA, 3450 bp, Artificial Sequence
  Description of Artificial Sequence: Synthetic coding sequence
atgggccagcagcccggcaaggtgctgggcgaccagcggcggcccagtttacccgccctccattttataaaaggtgccggtaagaaggagtccagcagacatgggggaccacactgcaacgtttttgttgagcacgaagcactacaaagaccggtggccagtgattttgagccacaagggctgtcggaggcggcccggtggaactctaaagaaaacctgctggcggggccgtctgaaaatgatcccaatctcttcgtcgccctatacgatttcgttgcatctggagataacactctttctataaccaaaggggaaaaacttcgggtgttaggttacaatcacaatggtgagtggtgtgaggctcagaccaaaaacgggcagggatgggtgccctccaactacattacacccgtcaacagtttagagaaacattcttggtatcatggcccagtctctcggaacgctgctgagtaccttctctctagtggcatcaacggcagcttcctggtccgggaatctgagagtagcccaggacagcgttcaatatccttgcgatacgagggtcgagtttatcattataggatcaatactgcgagtgacggcaaactgtatgtgagcagcgagtccagattcaatacgctcgcggagttggtacaccatcatagtacagtggccgatggcctgatcactacattgcactatccagcccctaaacgcaacaagcccaccgtgtatggtgtttctcccaattacgataaatgggagatggagcgaaccgacataactatgaaacacaaactgggaggcgggcagtacggagaagtctatgagggtgtctggaagaaatactctctgactgttgcagtcaaaaccctaaaggaggataccatggaggtggaagagttcctgaaagaagccgcagttatgaaggaaatcaaacaccccaacctggtgcagctccttggagtctgcaccagggagccccccttctacataataaccgagtttatgacgtacgggaacttactcgactatctgagggagtgcaacaggcaagaggtgaacgctgttgtgctgctgtatatggcaactcagatcagctctgctatggaataccttgaaaaaaagaatttcatccaccgggatctcgccgcaaggaactgtctggtcggggagaatcatctggtgaaggtggccgactttgggctgtctcgacttatgactggagatacatatactgcccacgctggagctaaatttcccattaagtggacagccccagagtcattagcttataacaaattctctataaagagtgacgtttgggctttcggggtcctgctgtgggaaatcgccacttacggcatgagtccttatcctgggattgatctcagccaggtctatgagcttttagaaaaagactaccgcatggagagaccagagggctgtccagaaaaggtctatgagttaatgagggcgtgttggcagtggaacccctcagataggcctagcttcgccgaaattcaccaagccttcgagaccatgtttcaagaaagctccatcagcgatgaagtggagaaggagctggggaaacagggtgttcgcggagcagtgtctactcttcttcaagcacccgagcttccaacaaagaccagaacctcacggcgagccgccgagcacagagataccactgatgtgccggagatgcctcactctaagggccagggcgaatccgatccactggaccacgagccagccgtgtctcccttgctcccaaggaaggagaggggccctccagaaggaggcttgaatgaggatgaacgcctcctccccaaggataagaagaccaacctattttccgcactgatcaaaaaaaaaaaaaagaccgcccccacacccccaaagcgcagttctagcttcagggaaatggatggccagcccgagcgtagaggcgctggtgaggaggagggacgcgatatttcgaacggcgctctcgcctttactcctctggatacagcagatcctgctaaatcaccgaagccttctaatggcgccggcgtgcctaacggtgccctgagggagtccggcggtagtggcttcagaagcccacatctttggaaaaaatctagcaccctgacttcgtcacgccttgccacaggggaagaagagggaggagggagcagcagcaagcgcttcttacgctcctgctctgcatcctgtgtgccacacggtgcgaaggacacagaatggcggtccgtgactttacctagggacctccagtccactgggaggcagttcgatagctccaccttcggggggcacaagagcgagaaacctgccctgcctcggaagagagctggggaaaatcggtccgatcaggtgacccgcggtaccgtaacaccacccccccgcctggtcaaaaaaaacgaagaagccgctgacgaagtgtttaaagatatcatggagagctctcccggttccagtcctcctaatttaacccccaaacccctcaggaggcaggttactgtggcccccgcctctggcctgccacacaaagaggaagctggaaaaggctccgccctgggaacccctgccgcagccgagcccgttacacctacgtctaaggccggctctggtgctccaggcgggaccagcaaggggcccgcggaggagtcaagggtgagacggcacaagcactcaagtgagagcccaggcagagacaagggcaagctcagcaggttaaaaccggcccctcctccacctcctgcagcttcggctggaaaggcaggtggaaagccttcgcaatctccctcccaggaggcagctggcgaggctgttcttggggcaaagacaaaagctacatcccttgttgatgcggtgaatagcgacgctgccaaaccatcacagcctggcgagggtctaaagaaacccgtcctgccagctaccccaaagcctcagtccgccaagccatccgggactcctatatccccggctcctgtcccgtctactctgccttccgcctcttctgcactcgccggggatcagccctctagcactgccttcattcctctgatcagcacacgcgtgtcactccggaagacaagacaaccgccagaacgcatcgcttccggagcaataaccaaaggcgtggttcttgattcaaccgaggcgctatgtttggctatcagccggaattctgagcagatggctagccacagcgccgtgcttgaagctggcaagaacctgtacacattctgtgtgagttacgtggatagcatccagcagatgaggaataagttcgcattccgtgaagccatcaacaaactcgaaaacaatctgcgagagcttcaaatctgccccgctactgctggctcaggacctgctgccacccaggacttttccaagctactgtcgagcgtgaaggaaattagtgacatcgttcagagatag

SEQ ID NO: 23164 - DNA, 195 bp, Artificial Sequence
  Description of Artificial Sequence: Synthetic coding sequence
atgggccagcagcccggcaaggtgctgggcgaccagcggcggcccagcctgcccgccctgcatttcattaaaggtgcaggaaagaaagagagttcacggcacggagggcctcactgcaacgtttttgtcgaacaggcgctccagaggccggttgcctctgactttgaaccacaggggttgtccgaagccgcatag

SEQ ID NO: 23165 - DNA, 486 bp, Artificial Sequence
  Description of Artificial Sequence: Synthetic coding sequence
ggccggcccggccggagccgggcccggggcggcggcgagggcggctggagagggggcggaagggccggtcgcgctggccccgaacctggccctcgcgcggggcggggcgtacctgctcccgactgctggagaggtaaaatgctagagatctgcttgaaactggtaggctgcaaatctaagaagggattgagttccagtagttcttgctaccttgaagaggcacttcaaagacctgtggccagtgactttgaacctcagggtttgagcgaggccgcccgttggaattccaaggagaatctattggcaggtcctagcgagaatgatccaaatctcttcgtggccctgtatgatttcgtggcttccggcgacaatactctttcaatcacaaaaggcgagaaactccgcgttttgggttataatcataacggcgaatggtgtgaagcacagacgaagaacgggcaaggctgggtccctagtaactattag

SEQ ID NO: 23166 - DNA, 2838 bp, Artificial Sequence
  Description of Artificial Sequence: Synthetic coding sequence
ctgcggctgctgcgggagcccctgcagcaccccggccgggtgggctcgagttccttcaatgggggacgtcgcgcccaccaccatgctcccctaagctcaccaaaggcccagcaggctcattgcctgtggtgtgtgccacaactgcgccaggtcggggatgggactcatggccatcatcatgaagcccaagggggcggacagtacggggaagtgtatgaaggagtgtggaagaaatacagcctgaccgtggctgtgaaaacactcaaagaggataccatggaagtggaagagttcttgaaagaggctgccgtcatgaaagagataaagcaccccaacctggtccaactgctcggagtgtgcactagggagccgcccttttacataattacagaatttatgacctacggcaaccttctcgactacctgcgcgagtgtaacagacaggaggtaaacgccgtcgtgctgctgtacatggccacccaaatttccagcgcaatggagtatttggaaaagaaaaacttcatccatagagacctagccgctcggaactgtctcgtgggcgaaaatcatctggtgaaagtagccgatttcggcctgagccgcctgatgaccggggacacctacactgctcacgcaggcgccaagttcccaattaagtggaccgcacctgaaagcctggcctacaataagttttctattaagagtgacgtatgggcatttggagtccttctctgggagatagcaacatacggcatgtctccctatcccggtatcgacctgtctcaggtctatgaacttttagagaaagactacagaatggaacggcccgaggggtgccccgagaaggtgtacgagctgatgcgggcatgttggcagtggaacccaagcgaccggccttctttcgctgagatccatcaggcctttgagactatgtttcaggaatcctccattagcgacgaagtggagaaggagctgggaaagcagggggtgcgcggggccgtctccactctcctgcaggcaccggaactgcctacaaagacaagaacttcgagaagagctgccgaacatcgtgacacaaccgacgtgcccgagatgccccactcgaaaggacagggagagtccgaccccctcgaccacgagcccgctgtgtcaccgctgctgccccggaaagagagggggccacctgagggggggctgaacgaggacgagaggctcctaccgaaagataaaaagacaaacctcttctccgctttgatcaagaagaaaaagaagaccgcgcccacacctcctaagcgctcttccagttttagagagatggatgggcagcccgaaaggcggggggcaggagaggaagagggcagggacataagcaacggggcccttgcattcacgccactggatacggctgatccagccaagagcccgaagccatccaacggtgccggtgtccccaatggtgcactgagagaaagcggaggctccggatttcgttctccccacctttggaaaaaatcctctactctgacgtccagtcgcctggctaccggcgaggaggaaggagggggttcctcttctaaacgctttctgaggagctgcagtgcatcctgtgtgccccatggcgccaaggatactgaatggcggagcgtgactctcccccgcgatctccagagtaccggccggcaatttgatagtagtaccttcggggggcataagagcgaaaagcctgccctgccacgtaagagagccggcgagaaccggtcagaccaggtcacacgggggacagtcaccccccccccacgactggttaaaaaaaacgaggaggcggcggatgaggtgtttaaagatatcatggaaagctctccgggatcgtcccctccaaatctgacccctaaacctcttaggcggcaggtgacggtcgcccccgcatctggactgcctcacaaggaagaggcgggaaaggggtctgccctggggaccccagcagccgctgagcccgtgactcccacaagtaaggccggttccggtgcccctgggggcacatctaaaggacccgcagaagagagcagggtccgccggcataagcacagtagcgagagtccaggaagagataagggaaagctcagccggctgaaacccgcccccccccccccgccagctgctagcgcggggaaggcgggtggcaagcccagtcagtctccgagtcaggaagccgcaggtgaggccgtgctgggtgccaagacaaaggccacttcccttgtcgatgcagtgaatagtgacgcagcgaaaccttctcagcccggcgagggtctgaaaaagcctgttctgccggcaactcctaaaccacaaagtgcaaagccgtcaggcacccccatctccccggctccagtgccaagcaccttgccctcagcttcctccgccctcgccggagaccagccaagctccacggccttcattccacttatcagcacgcgggtgtcgctgcgcaagacgcgacagccaccagagcgcatagcctccggtgccatcaccaagggcgtcgttctggactccacggaggccctttgtttagccatttccaggaattccgagcagatggcctcccacagcgccgtgcttgaggcagggaagaatctatacactttttgtgtgtcctacgtcgacagcatccagcagatgcgcaataagttcgcctttcgggaggctatcaacaaattggaaaacaatttgcgagagcttcagatctgccctgcaacagctggaagtggacctgccgcgacgcaagactttagtaaactcctgtctagcgttaaggaaatcagtgacatcgtccagcggtag

SEQ ID NO: 23167 - DNA, 2649 bp, Artificial Sequence
  Description of Artificial Sequence: Synthetic coding sequence
atgggcccctggagccggagcctgagcgccctgctgctgctgctgcaggtgtcatcttggctctgtcaggagccagagccatgtcaccccggatttgacgcagagtcttataccttcaccgtcccccgcaggcacctggaacgagggagagtcctcggcagagtgaatttcgaagactgcacaggacgtcagagaactgcttatttcagcttggacacaagattcaaagtcggcacggacggtgtgattactgtgaagaggcctctccgattccacaacccccagatccactttctcgtctatgcttgggatagcacctatcgaaaattttcgaccaaagtgactttgaacaccgtggggcatcatcaccggccgcccccacaccaagcctccgtgtctgggatccaagctgagctcctgacttttcctaattcctccccagggttgaggcgccagaagagagactgggttattcctcctatctcgtgtcctgaaaatgaaaaggggccttttcctaagaacttagtgcagataaaatccaacaaggataaagagggaaaggtgttttactcgattactgggcagggagcagacaccccacctgtgggagtctttataatcgaaagagagaccggttggttgaaggtgacagaaccacttgatagagaaagaattgcgacatatacactattcagccatgctgtgagctctaatggtaacgccgtagaagacccaatggagattctgatcacagtgactgaccaaaacgacaataaaccagaattcacacaggaggttttcaaggggtcggtgatggaaggcgccctcccaggcactagtgttatggaggtgacggccacagacgccgatgatgacgtgaatacgtataatgctgcaatagcttacaccatcctgagccaagacccagagctccctgacaagaatatgtttactattaatagaaatacaggcgtcatttctgtcgtgaccactggcctcgacagagaaagcttccccacttacacgcttgtggtgcaggccgccgaccttcagggggagggtttgagcactaccgctaccgcagtaatcaccgtgacagataccaatgataacccacccatctttaatcccaccacttataaagggcaggtgccggaaaacgaagccaatgtggtgatcacaactctcaaggtgacagacgcagacgctccaaacacaccagcgtgggaggccgtttacacaattcttaacgacgatggagggcagttcgtggttaccacaaacccagtcaataacgatgggatacttaagaccgctaagggcctcgacttcgaggcaaagcagcagtacatcctccacgtggctgtgacaaacgtggttccattcgaagtgtcgcttaccacttctacagccacggtgaccgtggatgtactggacgtgaatgaggcacccatctttgttcccccggaaaaaagagttgaggtgagcgaggactttggtgttgggcaggaaattactagttacaccgcacaggagcccgacacattcatggaacagaaaataacttataggatatggagagatacagctaactggctagaaattaaccccgacacgggcgccatatcaacacgggcggagctagaccgggaagatttcgagcacgttaagaatagcacatatactgccttaatcatcgccaccgataatggaagcccagtcgccaccggtaccgggaccctgctgttgatactctccgatgttaacgacaacgcccctatacctgagccgcggaccatattcttctgtgagcggaatcccaagccgcaagttatcaacatcatcgacgcggacctgcccccaaatacatctcctttcactgcagagttgacccacggtgcatcagctaactggacaattcagtacaacgaccctacccaggagtccattatccttaagcctaagatggcacttgaagtcggtgattataagatcaacctcaagctcatggataaccaaaataaagaccaagtgacaaccctcgaggtgagcgtttgcgattgcgagggcgccgctggagtctgcagaaaagcccagccggtcgaggcagggctgcagatccccgctatcttgggtatcctcggcggcatcctggccttactgatccttatacttctgcttctcctattcctgagaagaagggccgtggtgaaggaacctcttctcccaccagaggacgatactagagataatgtgtattactatgatgaggaagggggtggcgaggaagatcaggactttgacctgtcccagctgcataggggactggacgctaggcctgaagtcacaaggaacgacgtcgccccaacactgatgagcgtgcccagataccttccacgacccgcaaatcccgacgaaatcggaaacttcatagacgagaatttgaaggctgccgacacagatccaactgcacctccttacgactccctgctggtcttcgactacgaggggtccgggtctgaggccgcatcactgtcatcacttaactcctcagagagcgacaaagatcaggattacgattacctgaatgaatgggggaatcgtttcaaaaaactcgcagacatgtacggaggtggggaggacgattag

SEQ ID NO: 23168 - DNA, 1944 bp, Artificial Sequence
  Description of Artificial Sequence: Synthetic coding sequence
atgggcccctggagccggagcctgagcgccctgctgctgctgctgcaggtttctagctggctttgtcaggagcccgagccgtgtcaccccggatttgatgctgaatcctatacctttaccgtgcctaggagacacctggaacgtggaagggtactcggccgtgtgaatttcgaggactgcactggtaggcagaggacagcttacttctccctggacacgcgcttcaaggtaggcaccgatggcgtgattacagtgaagagacctctgagattccacaatccgcagatacactttttagtgtacgcgtgggattccacttaccgtaaattctctaccaaggtgactctcaacactgtcggccaccatcatagaccccctccccaccaggctagtgtgtcaggcattcaggccgaactgctcacctttccaaactcctcgccagggctgcgacggcaaaaacgcgactgggtgataccgccaatctcctgccccgagaacgaaaaaggcccttttcctaaaaacttggtgcaaattaagtcaaacaaagataaggagggcaaggtattttacagtattactggacagggggcagacactccacctgtcggggtgttcatcatcgaaagagagacgggctggttgaaggtcaccgagcctttggatcgcgagaggattgctacctataccttattcagccacgctgtgagtagcaatggtaatgccgtcgaggatcccatggaaatactgatcactgttacggaccagaacgacaacaaaccagagttcacgcaagaggtatttaagggctctgtaatggagggcgcactgccagggaccagcgtgatggaggtcacggctactgacgccgatgacgacgtcaacacctataacgccgccatagcttataccatcctgagtcaggatccagagctccccgacaaaaatatgttcacaataaatcggaacacaggggtgattagcgttgtaactacgggactcgaccgcgaaagtttccctacctacactctggtggtccaggcagccgaccttcagggtgaaggactgagcaccactgcgactgccgtgatcaccgtcacagacaccaatgacaatccacctattttcaaccccaccacctataagggccaggtcccagaaaatgaggccaacgtggtgatcacaaccctcaaagtgacagatgccgacgctcctaatacccctgcttgggaggcagtgtacacaatacttaacgacgatgggggacagttcgtcgtgacgacgaaccctgtcaataatgacgggatcctcaaaacagctaagggactggattttgaggcaaaacaacaatacatactgcacgtggccgtgaccaacgtggtcccttttgaagtctcattgaccacgtccaccgccacggtgacagtagacgtgcttgacgtaaatgaggccccaatcttcgttcctccagagaaaagagtggaggtatctgaggacttcggggtagggcaagagattacctcatataccgcccaagagccagataccttcatggagcaaaaaatcacatacaggatctggcgggacacagctaattggttggagattaatccagataccggggccatatctactcgcgccgagttggaccgcgaagacttcgaacatgtgaaaaattccacttataccgcgctgattattgctacagataatggttcccccgtcgctacgggtactggcaccctgctgcttattctgtcagatgtgaacgataacgcacccatccccgagccgagaacaatctttttttgcgagaggaatccaaaaccacaggtcattaatattatcgacgctgatctgcctccaaatctcgcctctcagtctatcgggataacagacatgtctcattgtacttgcccggccccccaactgcccgcaattttttag

SEQ ID NO: 23169 - DNA, 2703 bp, Artificial Sequence
  Description of Artificial Sequence: Synthetic coding sequence
atgggcccctggagccggagcctgagcgccctgctgctgctgctgcaggtcagctcatggctgtgtcaagagccagaaccatgccaccccgggttcgacgccgaatcctacaccttcactgtcccccgacgccacctcgagcgcggcagagtcctgggccgggtgaacttcgaggactgcacaggtcggcagaggaccgcctatttttcgttggataccagatttaaagtcgggaccgatggagtcatcaccgtcaaaaggccgctgcgatttcacaatccccaaatccacttcctggtgtacgcctgggattccacatatagaaagttctcaactaaggtgaccttaaacacggtgggacatcaccacagaccgcccccccaccaagcttctgtttcagggatccaagcagaactcctcaccttccccaactcatctccagggctccggaggcaaaagagggactgggtgattcctcctattagttgtccggagaacgagaagggcccattccccaagaatctagtgcagattaagtcaaacaaagacaaggaaggcaaagtgttctattccataaccggccagggggctgataccccacccgtgggagtttttatcatcgagagagagaccggttggctcaaagttactgagcccctggaccgcgagcgtattgcaacttacacccttttcagccatgctgtttcctcgaacgggaacgctgtggaagaccctatggagattctcatcacagtcactgaccaaaacgataacaaaccagagtttacacaggaggtctttaaaggaagcgtgatggaaggggctctcccaggcaccagcgtgatggaagtaactgctaccgacgctgacgatgacgttaatacatataacgccgccatcgcctatacaatcttatctcaggaccccgagttgccagataaaaacatgtttaccattaaccgaaatactggagtgatttccgtcgtgactaccggtctcgatcgcgagagtttccctacgtatacgctagtcgtgcaggccgctgatctacagggggaggggctgtccactactgcaacagccgtcatcacagtcactgacacgaatgataaccccccaatatttaatccaacgacctacaaagggcaggtccctgagaacgaggccaacgtggtgatcactacattgaaggtgactgacgctgatgctcctaacacccctgcgtgggaagctgtttacacgatcctgaatgacgatggcgggcaatttgtagtgactaccaatcctgtgaataatgatggaattttgaagacggccaagctcgccagatgccgcaactggcacccccattcgtgttcctacccttgtcccctgggtctggactttgaggccaagcaacagtacattctgcacgtagcagtgacaaatgtcgtcccttttgaagtctcactgacaaccagcactgccaccgtcacagtggatgtgctggatgtgaacgaagcccctattttcgtgccacctgaaaaacgtgtggaggtgagtgaagacttcggcgttgggcaggagattactagttatacagctcaggagcccgacacctttatggagcaaaagataacctatcgtatttggcgcgatactgcgaactggcttgaaatcaacccagacaccggcgctatctctactagagccgaattggaccgggaagacttcgagcacgtcaaaaattctacctataccgcactcattattgccactgacaacggaagccccgtggctaccgggacaggaacgttgcttctcatcttgtccgatgtaaacgacaacgccccaattcctgaacctcggacgattttcttttgtgagcgtaacccaaagcctcaggtaatcaatataatagatgccgacttacccccaaatactagcccattcaccgcagagcttacacacggggccagcgccaactggactatccagtataacgatcctacacaggagtccatcatcctaaagcccaagatggcacttgaggtgggtgactacaaaataaacttgaaacttatggataaccagaataaagatcaagttaccactctcgaggtttccgtttgtgactgcgaaggagccgccggtgtttgtagaaaggcgcagccggtagaggccggtctccaaatccccgcgatattaggaatcctcgggggcattctcgccctgctgatcctcatcctcttattgttattgttccttcgccgcagagctgtcgtgaaggaacccctgcttcccccagaagacgacacaagggacaacgtgtactattatgacgaagaaggaggaggagaagaggaccaggattttgacttgtctcaattgcacaggggcctcgacgcgcgtcccgaagtgactcggaacgacgtggccccaacactcatgtccgtcccacgctacctgcctaggccagccaatcctgacgagatcggcaatttcattgatgaaaacctgaaagccgcagacactgacccgacagcacccccctacgacagcctgctagttttcgattacgaggggtctggaagcgaggccgcttcactctcctcactgaattccagtgaatccgacaaggatcaggactacgattatctgaatgagtggggaaatcggttcaaaaagctcgcggacatgtacggagggggcgaagacgattag

SEQ ID NO: 23170 - DNA, 2466 bp, Artificial Sequence
  Description of Artificial Sequence: Synthetic coding sequence
atgggcccctggagccggagcctgagcgccctgctgctgctgctgcaggtcagttcctggctgtgccaagaacccgagccgtgtcaccccggctttgatgccgagtcttatactttcaccgtgcccagaagacacctcgagcgagggcgagtactgggaagagtcaactttgaagattgtaccggtaggcagaggaccgcctatttcagcttagacacacgattcaaagttggcacagatggcgtgatcacagtgaaacggccactccgattccataaccctcaaatccactttctggtgtatgcttgggacagtacttaccgcaaatttagcaccaaggtcaccctaaacactgtgggtcatcatcatcgccccccaccccatcaggcctcagttagcggtatacaggctgaactcctcacattcccaaatagtagccctggtctgaggaggcagaaacgcgactgggtgattcctccaatcagctgtccggaaaacgagaaaggtccctttccgaagaatttagtgcagattaaaagtaataaggataaagaaggcaaagtattctatagcattacgggacagggcgcagatacacctcccgttggcgtctttattatcgagagggagacaggctggctgaaagtgaccgaaccactcgaccgggagaggatcgcgacatacaccctgttttctcatgctgtgagctcgaacggaaacgccgtcgaagaccccatggaaatcctgattaccgtgacagatcagaacgacaacaagcccgagttcacccaggaggtcttcaagggatccgtgatggaaggggcattgcccgggacaagcgtaatggaggtgaccgctacagatgctgacgatgacgtcaatacatataatgccgcaatcgcttatacaatcctctcccaggacccagagttgccagataaaaacatgtttaccataaatcgcaacaccggcgtaatttccgttgtgaccacaggccttgaccgcgaaagtttcccaacttacacgctcgtagtgcaggccgctgatctccaaggggagggcctgagcaccacggccacagcagttataacagtcacggataccaatgacaatccgcccatttttaatccaaccactggcctcgactttgaggctaagcagcagtatattctgcatgtggctgtcactaacgtagtgccatttgaggtctcactgactacgtccacagcaaccgtgactgttgatgtactggacgtgaatgaagcaccaatctttgtgcctcccgagaaaagagtagaagtgagcgaagattttggcgtgggtcaggagatcactagctacacggctcaggagcccgacactttcatggaacagaagataacttatcgaatctggcgagacactgcaaattggctggagataaacccagatactggcgctatttccacacgggctgaattagaccgggaagacttcgagcacgtgaaaaactccacatacactgccctgattattgcaaccgataacggaagcccagttgccacaggcaccggcacattgctgctcattctctccgacgtgaatgataatgccccaattccagagccaaggaccatcttcttctgcgaaaggaacccgaagccacaggtgatcaacattattgatgccgacctaccacctaacacaagcccgttcactgctgaattgacccacggtgctagtgccaactggacaatacagtacaacgatcccacccaggaaagcattatactgaagcccaagatggcccttgaggtcggcgactataaaattaatctcaagctgatggacaaccagaacaaggaccaggtaaccaccctcgaagtgagtgtctgcgactgtgagggagcagcgggtgtttgccggaaagcacaacctgtcgaggcgggtctgcagattccagccatccttggcattctaggaggtatcttggctctccttatcctgatcctcttactgctactctttctcagaagaagagccgtcgtaaaggagccccttttgccgcccgaggatgatacacgtgataatgtttactattacgatgaagagggggggggcgaagaggatcaagacttcgacctgtcacagttacacagaggcctggacgctcgcccggaggtcacacgtaacgacgtggctcctacacttatgtctgtcccccgatatctgcccagaccagccaatccagacgaaattggcaactttatcgacgagaacctgaaggccgcagacaccgacccgactgcgcctccatatgacagtttactcgtcttcgactacgagggcagcggaagcgaggcagcatctctgagctctctaaactcttctgagtccgacaaggatcaggactacgactacctgaacgagtggggcaaccgcttcaaaaagctggcagacatgtatggggggggagaggatgattag

SEQ ID NO: 23171 - DNA, 2391 bp, Artificial Sequence
  Description of Artificial Sequence: Synthetic coding sequence
atgaaggagaactactgcctgcaggccgccctggtgtgcctgggcatgttgtgtcacagtcacgcatttgcccctgaacgcagaggtcatctgaggccctccttccacgggcatcatgagaaaggaaaggaggggcaggtgctacagcgctccaaaaggggatgggtatggaatcagtttttcgtaattgaagagtacacaggacctgatcctgtgctggtgggacgtctacactcagatattgattcaggcgatggcaatatcaagtatattctgagcggagaaggcgccgggacaattttcgtgatcgatgacaaatctggcaatatccacgctaccaagacccttgaccgagaggagcgcgctcagtatacccttatggctcaggcggttgacagggacacaaaccggcctcttgagccaccttctgagttcatcgtgaaggtgcaggacatcaatgataatccgcctgaatttttgcatgagacttatcatgctaatgttcctgagagatctaatgtcggcacttccgtgatccaagtgactgcaagcgacgccgacgatccaacttatggcaacagcgccaagttagtctattcaattttagaggggcaaccctactttagtgtcgaagctcaaaccggaatcatacggacagctttgcctaatatggaccgtgaagctaaagaggaataccatgtggtgattcaggccaaggacatgggcgggcacatgggtgggctctccggaactactaaagtgactatcactctgacagacgtgaatgacaacccgccaaaatttccccagtcagtctatcagatgagtgtcagcgaggcagccgtgcctggagaagaagtcggaagagtgaaggcgaaagaccctgatattggggagaacgggttagtcacctataatatcgtagacggggacgggatggaaagttttgaaattacgacagattatgagacacaggagggtgtgatcaaactcaagaagccagttgactttgagactaaacgagcatacagtcttaaagtcgaggccgctaacgtgcatatcgaccccaagttcatcagtaacggccccttcaaagacacggtgaccgtcaaaatttccgtcgaagatgcagacgagccaccaatgttcctggccccaagttatatccacgaagtacaagaaaatgccgctgctggcactgtcgtgggacgcgtccacgcaaaggatccagacgccgctaacagcccgattagatacagcattgaccggcacaccgatcttgaccgtttttttactatcaatcctgaggacgggtttatcaaaaccacgaaacctcttgatagggaggaaacagcctggctcaacatcaccgtgtttgccgccgagatccacaacaggcatcaagaggccaaagtccctgtggctatccgggtactggatgttaatgataacgctccaaaattcgctgccccatacgaaggatttatctgtgagtccgaccagaccaagccgttgtccaatcagcccattgtgaccatatccgcagatgacaaagatgacaccgccaacggcccccggttcatcttttcacttcctccggaaatcattcataatcctaatttcacggtgcgggataatcgagataatacggcaggtgtgtacgccagaagaggaggattcagcagacagaaacaagatctgtacctgctgcctatcgtgatttcggatggagggattccaccgatgtcaagcacgaacaccctgacaataaaagtctgcggatgtgacgtcaatggggcactgctttcgtgtaatgcagaagcttatattctaaacgccggtctaagtaccggcgcgctgattgctatcttggcatgcatcgtgatcctgctggtaattgttgttttgtttgttacattgcgacggcagaaaaaggaacctctcatcgtgtttgaggaggaggatgtccgggagaatatcatcacttacgacgatgaaggaggtggagaggaagacaccgaggctttcgacatcgcaactctccagaacccagatgggataaatggttttattccccgaaaagatattaaacctgaatatcagtatatgccacgccctggcttgcgccctgcccctaactctgtggatgtagacgatttcatcaatactagaatacaggaggctgacaatgatcctactgcccccccatatgactcaattcaaatctatggctatgagggcagggggtcagttgctggaagccttagctctcttgagtcggctaccactgactctgacctggactacgactacctgcaaaactggggcccgaggttcaagaaactggctgacttgtacggctcaaaagatacctttgatgatgatagttag

SEQ ID NO: 23172 - DNA, 2082 bp, Artificial Sequence
  Description of Artificial Sequence: Synthetic coding sequence
atgaaggagaactactgcctgcaggccgccctggtgtgcctgggcatgctatgccacagccacgcattcgcaccggagcgcaggggtcacctcagaccatcctttcacgggcaccacgaaaagggaaaggaaggacaggtcctccaacgctcaaaaagggggtgggtctggaaccagttcttcgtcattgaagagtataccggcccggatccagtcttagtcggccgccttcatagcgacattgacagcggtgacggtaacataaagtatattctgtcgggtgaaggtgcgggcaccatcttcgtcatagacgacaaatcgggtaatatccacgcaactaagactctagaccgggaagaaagagctcaatacactcttatggcccaggccgtggaccgcgataccaatcggcccctagagccaccctccgagttcatcgtgaaggtacaggatatcaacgataaccctcccgaatttctacacgaaacataccacgccaatgttcccgagcgtagcaacgtcggaaccagtgtaattcaggtcactgcgtctgatgccgatgatcctacctacggcaatagtgcaaaactcgtttacagcatactcgaggggcaaccttacttttctgtggaagcacagacagggatcatacgcactgcgttaccgaatatggatagagaggctaaagaagaatatcatgtggtaattcaagccaaggacatgggaggtcacatgggcggcctctcagggaccaccaaagtcaccatcaccctgaccgatgttaatgataatcctcccaaattcccacagagcgtctaccagatgagcgtctccgaggccgcggttcccggggaagaagtgggccgcgtgaaggccaaagaccccgacattggggagaatggcttggtgacatacaatatcgtggatggagacggtatggaatcatttgagattactacggactatgagacccaggagggcgtaattaagcttaaaaagcccgtggattttgaaaccaagcgtgcatacagcctgaaagtggaagccgctaatgttcacattgatcctaaattcattagcaatggtccatttaaggatactgtgaccgtcaaaattagcgttgaagatgccgatgagcctcccatgttcttggccccttcttatatccatgaagttcaggagaacgcagcggctgggacagtggttggcagggtccacgctaaggatcctgacgctgcaaacagcccgatccgttatagcatcgacagacacaccgacttagacagattctttactatcaatcctgaagacggattcatcaaaaccacgaaacctcttgaccgcgaagaaaccgcatggctgaatataactgtgtttgcagccgagatccataataggcaccaggaagccaaggtgcctgtcgccatcagggtgctcgacgtcaatgataatgcaccaaaattcgccgccccctacgagggctttatttgcgagagcgaccaaaccaaaccgctgtccaatcaacctattgtgactatctccgccgacgacaaggatgacaccgccaacggcccacgattcatcttttctctccctcccgagattatacataaccctaactttactgtgagggacaatcgcgataatacagccggcgtatatgcaagacggggaggcttctctcgccagaagcaggacctgtacctgctgccaattgttatatccgacgggggcatcccacccatgagttcaaccaacacgctcaccatcaaagtctgtggctgtgacgttaatggagccctgctgagctgtaatgccgaggcatatatactcaatgctggcctgtcaaccggagcgctgattgcgatcctcgcatgtatcgtgattctccttggctgtccatcactcatggaacccccaagtccacgcgaagatatgagactgctctacctagggttccagctcatgcttttctcctacgtaaaggtgaaccgccgcttctgtctccttggagtcttcattaaactgcccttcctctatgtggtggcaaccgagtccccaacgaccctgacttctctgtag

SEQ ID NO: 23173 - DNA, 516 bp, Artificial Sequence
  Description of Artificial Sequence: Synthetic coding sequence
atgaaggagaactactgcctgcaggccgccctggtgtgcctgggcatgctgtgtcacagccatgccttcgccccagagagacgcgggcatctcagaccctccttccatggacatcatgagaaggggaaggaggggcaggttctacaacgctctaaaagaggctgggtctggaatcagtttttcgtcattgaggagtacaccggaccggatccagtgctcgtcggacgcttgcactctgacattgattcaggtgatggcaacattaagtatatactgagcggcgagggcgccggaaccatctttgtgattgatgacaagagcggaaacatccacgcaaccaagacactagacagagaggaacgggcccagtacacactaatggcacaggccgtggatagagatacgaacaggaatagcttatccagatcccgcacgctgatgacaaccttaagaagctcttgtacacgcccgattatgccaacatgcttgcgcgggcccatgtgggtacggacatag

SEQ ID NO: 23174 - DNA, 2340 bp, Artificial Sequence
  Description of Artificial Sequence: Synthetic coding sequence
atgggccccggcctggccgcccggcggctgcggccccccagccgggctccagaaattactgtttttagtgctcagcggccatgtgacatacctagttgctgccatctcctgagtgatcagtcagatgggtggtccgtcctacagaagctagcagctagtatccagtgggtcaagaagctgcactctgatattgattctggtgacggtaatattaaatacatccttagtggagaaggagctgggaccatcttcgtcatcgatgacaaaagtggcaacatccacgccaccaaaacactggatagggaagaacgggcccaatacacgctaatggcgcaggccgtggaccgcgatacaaaccgaccactcgagccacccagcgaatttattgtcaaggtgcaggacataaatgacaacccccctgaattcttacatgagacttaccatgcgaacgtgcccgaaagaagcaacgtaggcacctcggtgatccaggtgaccgcctcagacgccgacgacccgacgtacggtaatagtgctaagctagtctactcaatcctcgaggggcagccttactttagcgtagaagcgcagacgggcattatcaggacagccttgcctaatatggaccgggaggctaaggaggagtaccacgtggtgatccaggcgaaagatatgggtggccacatgggtggccttagtggaacaacaaaagtcactattaccctgacagatgtaaatgataacccccccaaatttccccagtctgtgtaccagatgagtgtgtctgaggcagcggtccccggggaagaagtcgggcgggtcaaggctaaggaccccgacatcggggagaatgggctcgttacatacaatattgtggacggcgatggcatggagagcttcgaaatcactactgattacgaaacccaggaaggcgttattaagttgaaaaagccagtggacttcgagacaaagcgcgcttactccctgaaggtggaggctgcgaacgtccacatagatccaaaatttattagtaatggaccttttaaagataccgtcacagtaaaaatctccgtcgaagacgcggatgagccacctatgtttcttgcaccatcctatatacatgaggtacaggagaacgcagcagcagggaccgtggtcggacgggtacacgcgaaggatccagatgcagcaaattcccctattaggtattccattgatcgccataccgatctggaccgatttttcaccataaacccggaagatggcttcataaagaccaccaagcctttggatagggaggagaccgcatggctcaacatcaccgtgtttgccgccgaaatccataaccggcaccaagaagctaaggtgcctgtcgccatccgcgtgctagatgtgaatgataacgcccccaaatttgcagccccatatgaaggatttatctgcgaatctgaccaaacgaagcccctgtctaaccagcccatcgttactatttcagcagacgacaaggacgacactgctaacgggcccaggtttattttctccctgcctcctgagattattcataatccaaacttcaccgtgcgtgataacagggacaacacggcgggggtgtatgctcgacgcggaggcttcagtcgccagaaacaggacctttacctccttcctatagtgatatctgatggtggaatccctcccatgtctagcaccaacacactgactattaaagtctgtggctgtgacgttaacggggcactgctgtcttgcaacgccgaagcctacatactgaacgccggactgtccacaggcgcgctgattgcaatcctggcttgcatcgtgatcttgctagttatcgtcgtgctgttcgtcactttaaggcgacaaaagaaagaaccccttatcgtttttgaggaagaggatgtgcgggagaatataatcacatacgacgatgagggtgggggggaagaagataccgaagctttcgatattgctactctccaaaaccctgatgggattaatggttttatcccaaggaaagatattaaacctgagtatcagtacatgccaagacccggcctgcggccagctcccaattcagtcgatgtggacgatttcattaacacacggatccaggaggctgacaacgatcccactgcacctccttatgacagcatacagatttacgggtatgaaggccggggctcggttgctggatccctatcatcactggaaagcgccacaactgattcagatttggactatgattatctgcagaactggggtcccagatttaaaaagctggcagatctctatggttccaaagacaccttcgatgacgactcttag

SEQ ID NO: 23175 - DNA, 528 bp, Artificial Sequence
  Description of Artificial Sequence: Synthetic coding sequence
atgcagccccggacccccctggtgctgtgcgtgctgctgagccaggtgctgctgctgacatctgccgaggatctcgactgcactcccggcttccagcagaaggttttccacataaaccagcccgctgagttcattgaagaccagtcaattctgaacctgacgttctctgattgcaagggcaatgacaagctccgctacgaagtgagtagcccatactttaaggtgaattcagacggtggtttggtcgccctgcgcaacatcacagccgtagggaagaccttgttcgtgcacgcccgtacaccccatgctgaagatatggcagagctggtgattgtggggggaaaggatatccagggatctctgcaggatatttttaaattcgctaggacgtcaccagtcccaagacaaaaaaggtccatcgtcgtctctccaatcctgattcctgaaaaccagcgccagcctttcccacgcgacgtcggcaagatgaagatctggcaggtgctgtgtctggctaggtggctgacatag

SEQ ID NO: 23176 - DNA, 2142 bp, Artificial Sequence
  Description of Artificial Sequence: Synthetic coding sequence
atgcagccccggacccccctggtgctgtgcgtgctgctgagccaggtactcctacttactagtgcagaggacctggattgtacgccaggctttcagcaaaaggtctttcatattaatcagcctgccgaattcatcgaggatcaatctatcctgaatctgaccttctccgattgcaaggggaacgacaagcttaggtacgaggtatcctctccctactttaaagttaattccgacggcggccttgtggccctgagaaatatcactgccgttggcaaaaccctgttcgtacacgcccgaaccccccacgctgaggacatggccgagcttgtcatcgtgggcggcaaggacatacaggggtccctgcaagatatcttcaagtttgcccggaccagcccagtgcccagacagaagcgtagcattgtggtgagccccatcctgatcccagaaaaccagcgccaacctttccctagagatgtgggcaaggtggtggacagcgaccgccccgagaggtccaagtttcgactgacgggaaagggagtggaccaggagcccaaggggatattccggattaacgagaacacaggctccgtctctgtcacgcgaacgctggatcgagaggtcattgccgtgtaccaactcttcgtggagactactgacgtgaatggtaaaactctggagggccccgtccccctcgaagtgatcgtaatcgatcagaacgacaacaggcccattttccgagagggcccttacattggccacgtgatggagggcagtcccactggaactacggtgatgcgcatgaccgcgttcgatgcagatgaccccgcaacagacaacgctctgctgagatacaacatcaggcagcaaacacctgataagcctagtccaaacatgttctacatagaccctgagaaaggggatatcgtgaccgtggtttctccagcactcctggacagggaaacactcgagaacccaaagtatgaactcattatcgaggctcaggacatggctggcctggatgttggcctcaccggaaccgccaccgcaactatcatgattgacgataagaatgatcatagcccaaagtttacaaagaaggagtttcaggctacagtcgaggagggtgctgtgggcgtcattgttaatttgacggtggaggataaagacgatccaacaaccggggcctggagagctgcctacactattatcaacggcaaccccgggcaatcctttgaaatccacacaaatccgcaaactaatgagggaatgctgtctgttgttaagcccctggactatgagatatctgccttccacacactgcttatcaaagtggagaacgaggatcccttagtacccgatgtgagttatggtccttctagcacagcaacggttcatataactgtgctagatgtcaatgaggggccagttttctatccggatcctatgatggtaacccgtcaggaagacctatccgttggctcagtgttgctgactgtcaatgccaccgatcctgattccctgcaacatcagacaatcaggtattccgtgtataaagacccggccggatggctgaacattaaccctatcaatggcaccgtggataccacagccgtgctggaccgtgagagcccattcgttgataattcggtatatactgccctgttccttgcaatcgacagtggtaacccgccagcaactggcactgggactctgctaatcactctagaggatgtgaacgacaacgcccccttcatctaccccaccgttgctgaggtgtgtgacgatgctaagaatctgagcgtggtgattcttggcgcctcggataaagatctgcatcccaatacagacccatttaaatttgaaattcacaaacaggcagtcccagataaggtgtggaaaatcagtaaaatcaataacacccatgccttggtctcactgctgcaaaatctcaacaaggctaactacaacctgcccataatggtgaccgattcaggaaaacccccaatgactaatataacggacctgagggtgcaggtgtgctcgtgccgaaactctaaagttgattgcaacgcagccggggcactccggttctctcttccatctgtgctactgcttagtctattttctcttgcctgtctctag

SEQ ID NO: 23177 - DNA, 2283 bp, Artificial Sequence
  Description of Artificial Sequence: Synthetic coding sequence
atgaagaccccccccggcgccagcagccggaccaagtgcagccgggagctgagaagtttctgcgcatttagttgcccaagggcgaaacagcccacctgcactgcttggtttcctcagcaagaacacccatcggagaacgggccacagatgccagggcgcgatcccccagcggcctctactatgcaagtactgttgctgacctccgcagaggacctggattgtacacctgggttccaacagaaggtgtttcacattaaccagcctgcggaattcattgaggatcagtcgatcctgaacctgacattcagtgactgcaagggaaatgataaactccgttacgaagtgagcagcccatattttaaagtcaattctgatggagggctcgttgcattaaggaacatcacagctgttggcaagaccctgtttgtccacgccaggacaccccatgcagaggatatggcagagttagtgatagttgggggcaaagacatacagggaagtctccaggacatattcaagttcgcaaggaccagccctgtgccccggcagaaacgaagtatcgtcgtgtcaccaattctcatcccagagaaccagcgacagcctttcccccgcgacgtcgggaaggtggtggattccgaccgcccagagcggagcaagtttcggcttaccggcaaaggtgtcgatcaggaaccaaaggggatttttcggattaatgagaacactggatccgtatctgtcacccggacccttgatcgagaagtaattgccgtgtaccagctctttgtggaaacaaccgacgtcaatggaaaaacgttggagggtcccgtgcccttagaagttatcgtcatagaccaaaacgacaaccgtcccattttcagagaaggaccttatatcggacacgtgatggagggtagtcctactggcaccaccgttatgcgaatgactgcatttgatgctgacgatcctgccacagacaatgctcttcttcgatacaatatcaggcagcagactcctgataaaccatcccccaatatgttctacatcgaccccgaaaagggcgatattgtgactgtcgtcagccctgctttactagaccgggagaccctggaaaaccctaagtacgaactgataatagaggcccaagatatggcaggcctggatgtaggcttgacaggaaccgccacagcaacaatcatgatagatgataagaatgatcactccccaaagttcaccaaaaaggaatttcaggctacagtggaggaaggcgccgtgggagtgattgtgaatctgaccgtggaggataaagacgatcccacgacgggcgcctggcgagcagcctatacaataatcaatggtaatcctggccagtcttttgaaatccacacaaatccacaaaccaacgaaggcatgctgtctgtggtgaagcctctggactacgagatctcagccttccatacccttctgataaaggtggagaatgaagatccattagttcccgatgtttcttacggaccatcctccaccgccacggtgcatataaccgttctcgatgtcaatgagggcccggtgttttaccccgacccaatgatggtaaccagacaggaggatctgtcagttggttcagtcttgctgacagttaacgctactgatccagatagcttgcaacaccagaccattcgatattcggtgtacaaggacccagccggctggctgaatattaaccctattaacggtactgttgacactaccgccgtgttagatcgtgagtctccttttgttgacaactctgtgtacactgctctctttctggcaatcgactccgggaaccctcctgccaccggcaccgggacacttctaattacgctagaagacgttaacgacaatgctccctttatctatccaaccgtcgctgaagtctgcgacgatgctaagaacctgtccgttgtcatccttggcgccagcgacaaggatctccacccaaacaccgatcctttcaagttcgagatccataagcaggcagttcccgacaaagtgtggaagattagcaaaatcaacaatacgcacgctctggtgtctttactccaaaacctgaacaaagccaactacaaccttcctatcatggttacagacagcgggaaaccccctatgaccaacatcaccgatttgagggtccaggtgtgctcctgccggaattccaaagtggactgtaatgctgctggcgctctaagattttctctgccttccgtcctgctcttatcccttttttcccttgcatgtaagtag

SEQ ID NO: 23178 - DNA, 2142 bp, Artificial Sequence
  Description of Artificial Sequence: Synthetic coding sequence
atgcagccccggacccccctggtgctgtgcgtgctgctgagccaggtcctcttgttaacgagtgcagaggacctcgattgcacaccaggatttcagcagaaggtctttcacatcaatcaacccgcagaattcatagaggatcaaagcattctaaatctgactttcagcgactgtaaaggcaacgataagctgcgttatgaagtcagttctccctatttcaaggttaactcagatggtggacttgtcgctcttcgcaacataaccgctgtcggcaaaaccctgtttgtgcacgccaggacgccccatgctgaagacatggctgaactggttatcgtgggaggaaaagatatccaggggagcctccaggacatcttcaaattcgcgaggactagcccagtcccccgacagaaaagaagcatcgttgtatctcctatacttatccccgagaaccagagacagccctttccccgggacgtcggcaaggtcgtcgatagcgatcggccagagcggtccaagtttagacttacaggcaaaggcgtggaccaggaacctaagggtatctttaggattaacgagaacaccggttccgtgtctgtcactcgcaccctcgatagggaggtgattgcggtgtaccaattgtttgtggagacaactgacgtgaacggcaaaaccctggagggcccggtccccctcgaggttatagtgatagatcagaatgacaacaggccgattttccgcgaaggcccatacattggccatgtcatggagggaagtcccactgggacaaccgtgatgaggatgactgcctttgatgccgacgatccagctacagacaacgccctgttacggtacaatataaggcagcagacccctgacaaacctagccctaatatgttctacattgatccagagaaaggtgacatcgtcacagtggtgagccctgccctgttggacagagagacactagagaatccgaagtacgagctgattatcgaggcccaagacatggccggcctggacgtgggcctaaccgggacagccactgccaccattatgatagatgacaagaatgatcactctcctaagttcacaaagaaggagttccaggccaccgtagaggagggcgctgttggcgtgattgttaatctgactgttgaagacaaagacgatcctacaaccggtgcttggcgtgctgcctataccattattaatggcaatccgggtcagtctttcgagattcatactaatccacagaccaacgagggcatgctgtccgtggtgaagccactggattatgaaatctcagcttttcacaccttattgatcaaagtggaaaatgaagatcccctagtgcccgacgttagttatgggccttcctcaaccgctactgttcatatcaccgtgctggacgtgaatgaggggccggtcttctaccctgatcctatgatggtgaccagacaggaagacctctctgtggggtcagtcctccttacagtgaacgcaacagacccggatagcctccaacatcagaccatccgctactccgtgtacaaggaccctgccggatggttgaacattaaccccatcaacggcactgtcgacacgaccgctgttcttgaccgggagtcaccatttgtggacaactctgtatatacagccctgtttctggccatcgactctggaaaccctcccgccacgggcaccggcaccctgctaatcacactcgaggacgtcaacgacaatgcaccattcatctatcctacagttgctgaggtttgtgatgacgccaaaaatctcagcgtcgtcatcctcggggctagtgacaaggatctccatccaaatacggacccattcaagtttgagatacataaacaggcggtaccagacaaggtgtggaagatatccaaaataaataatacgcatgcactcgtgtctctgttgcagaatctaaataaagccaactacaatctgcctatcatggttactgattctggcaagcctcccatgaccaacatcacagacctgagagtgcaagtttgcagttgtagaaatagcaaggtggattgcaacgcagccggtgccctgcggttttcgttaccatcagtcctgctgctgagcctgttctcgctcgcatgtaagtag

SEQ ID NO: 23179 - DNA, 573 bp, Artificial Sequence
  Description of Artificial Sequence: Synthetic coding sequence
atgcagccccggacccccctggtgctgtgcgtgctgctgagccaggtactgttgctgacgtccgccgaagatctggattgcacccctggctttcagcagaaggtctttcacatcaatcagcctgccgagttcatcgaagatcagagcattctcaacctaacgttttctgactgcaaagggaatgataagctgcgctacgaggtgtcttctccctactttaaagtcaacagcgatggcggattggtagctttacggaacattactgcagtgggtaagaccctattcgttcacgctcgaacgcctcacgccgaagacatggccgaattggtcattgtggggggaaaagatatccagggctccctgcaggacatcttcaagttcgcgcggacatctccagtgcccagacagaagcggagcattgttgtctccccaatccttattccagagaatcagcggcagccttttccaagagacgttgggaaacggacccacaaccccatcaatagcgagcttctgcttaatgagggaattacggcagatcttaacccttgcatcaccatcctggccatatag

SEQ ID NO: 23180 - DNA, 528 bp, Artificial Sequence
  Description of Artificial Sequence: Synthetic coding sequence
atgcagccccggacccccctggtgctgtgcgtgctgctgagccaggtgttattgctcacgtcagccgaagacctcgattgcactccaggattccagcagaaggtgttccacattaaccaaccagccgagttcatcgaggaccagtcaatcctaaacctcactttcagcgactgtaaagggaatgataagttaaggtacgaggtcagttcaccatacttcaaggtcaactcagatggcgggctggtagctctccggaatattaccgcagtgggtaagactctgttcgtgcatgccagaacacctcatgccgaggacatggccgagctggttattgtcgggggcaaggatatccagggctctctgcaggatatcttcaaattcgccaggacttcccctgtgccaagacagaaacgcagcatcgtggtcagccccatcctgataccagagaatcagcggcagccctttcctcgggatgtagggaagatgaaaatctggcaggtgctttgcctggccaggtggttgacctag

SEQ ID NO: 23181 - DNA, 2025 bp, Artificial Sequence
  Description of Artificial Sequence: Synthetic coding sequence
atgcagccccggacccccctggtgctgtgcgtgctgctgagccaggttctactgctaactagcgcagaggacctggactgcacaccagggtttcagcagaaggtgtttcatattaatcaacccgctgaatttattgaggaccagtccattctcaacctgacatttagcgattgtaagggcaacgataagcttaggtacgaggtttcttcaccatacttcaaagtcaattccgatggaggactggtcgcactgagaaatataactgcagtgggcaaaaccttattcgtgcacgcgagaactcctcatgctgaagatatggctgaactagtcatcgttggcggaaaagacattcaggggtcgctccaggtagttgattctgaccgtccggagcgcagcaagtttagactcaccggaaaaggggtcgaccaagaaccgaaggggatctttagaatcaacgagaatactggatccgtgtccgtgacccgcactctagatcgggaggtgatcgctgtgtaccagctattcgtagagacaaccgatgtgaacggcaagacattggagggaccagttcccctggaggtgatcgtgatcgaccagaacgataacagacccatttttagagaaggcccctacatcgggcatgtgatggagggtagtcctactgggacgactgttatgcgaatgaccgcattcgacgcagacgaccctgctacagataacgctctattaaggtacaatattcgacagcagactcccgataagccgagtccgaacatgttttatattgatcccgagaagggcgacatcgtgacagtggtgtccccggccctcttagatcgcgaaacactcgagaatcccaaatacgagctgataatcgaagctcaggacatggcagggctagacgtgggccttacaggaaccgcgactgcgacaatcatgatagatgacaaaaacgatcactccccaaaattcactaagaaagagttccaagccacggtcgaggagggcgctgttggtgtgatagtcaacctgacggtagaggataaggatgacccaactaccggcgcctggcgcgccgcgtacaccattataaacggaaatcctggccaatcattcgagatccatactaatccacagacaaatgaaggcatgctgtcagtggtgaagcctcttgactacgagatttccgccttccataccctcctcataaaagtggagaacgaggaccccttggtgcctgatgtgagttatggtccctccagcacagcaacagtgcatatcaccgttctagacgtcaacgagggccctgtgttctaccctgatcctatgatggttacgcggcaggaagacttgtctgtcggctcagtcctactcactgtgaatgcaacggatcctgattctctgcagcaccagaccatccggtactctgtttacaaagatccagctggatggctgaatatcaatcctatcaacggcacagtggatacaaccgccgtcctggacagagaaagcccttttgtggataacagcgtatacactgccttgtttcttgcgattgatagcggcaatccccctgccacgggaacgggtacgctattgattacattggaagatgtgaacgacaatgcacccttcatatatcccaccgttgcagaagtgtgcgatgacgctaagaatctgagtgtggttatcttaggcgctagcgacaaggatcttcaccccaacacagacccctttaaattcgagatccataagcaggctgtcccagataaggtttggaaaatcagtaaaattaataacacccatgctctcgtcagtctcctccaaaacctgaacaaagcaaactataatcttcctatcatggtgacagactctggtaaaccgcctatgaccaacatcaccgacctgcgtgtgcaggtctgttcttgtagaaatagcaaggtggactgcaatgccgcgggggctttacgcttttctctgccctcagtgcttctgctgtccctgttttctctggcttgcaagtag

SEQ ID NO: 23182 - DNA, 1248 bp, Artificial Sequence
  Description of Artificial Sequence: Synthetic coding sequence
atgcagccccggacccccctggtgctgtgcgtgctgctgagccaggtcgctctcctggatcgcgagacgctcgaaaaccctaaatatgagctaattatcgaggcacaggacatggctggccttgatgttggtctaacaggaactgccactgctactatcatgattgacgacaagaatgatcatagtccaaaatttaccaagaaagagtttcaagccacagttgaggagggggcagttggtgttatcgtcaatttaactgtggaagacaaggatgatccaaccaccggtgcatggagagccgcatacacgatcataaatggtaaccctgggcagtcgtttgaaatccataccaatccccagaccaatgagggaatgttgtccgtcgtgaagcctctggactacgaaatttccgcattccacaccctcttgataaaagttgagaacgaggaccctcttgttcccgacgtgtcctatggcccctcatctactgccactgtgcacatcacagtgctcgatgttaacgaggggccggtattttacccagatcccatgatggtgacacgtcaggaggacttgtctgtagggagtgtgctgctcaccgtaaacgcgacagaccccgactcgctgcagcaccaaacgatacgctactcagtctacaaagaccctgcaggctggctgaacatcaatcctatcaacgggaccgttgacactacagcggtgctcgatcgggagagcccgttcgtggataactcagtatatacagcactctttttggccatagatagcgggaatcctcctgccaccggcacaggaaccctgctgataaccctggaagatgtgaatgacaacgcccccttcatctacccaactgtcgccgaagtttgcgacgatgctaaaaatctctcagtagttatcctcggggcctctgacaaagatctgcatcccaatacggatcccttcaagttcgagatccataagcaggctgttccagataaggtgtggaaaatttccaaaattaataatacccacgccctagtgtcccttctccaaaatctcaataaggcaaactacaacctaccaattatggtgactgacagcggcaaacctcctatgactaacatcactgacctccgggtgcaggtctgctcttgccgaaattcaaaagtggactgtaatgcagccggagcgctgcggtttagcctgcccagtgtcctgctgctgtccctgtttagcctggcttgcaaatag

SEQ ID NO: 23183 - DNA, 819 bp, Artificial Sequence
  Description of Artificial Sequence: Synthetic coding sequence
atgcagccccggacccccctggtgctgtgcgtgctgctgagccaggttcttctcctcacatccgccgaggaccttgattgcacacctggctttcagcagaaggttttccacattaatcagccagccgagttcatagaagaggatttgtcggtaggtagcgtgctgctgactgtcaacgctacagaccccgactccctgcagcaccagacaatacgctacagtgtttacaaggatcccgccgggtggttaaatatcaacccgataaacggcaccgtggatactactgcagtgctcgacagagaaagcccgtttgttgataactccgtgtatactgctctcttcctagccattgacagcggaaaccccccggcaacaggtaccggtactctcctcatcactttggaagatgtcaatgacaacgccccgttcatttacccgacagtggccgaggtttgtgacgacgccaagaacctttctgttgtgattctcggggcaagcgacaaggacctgcaccccaatactgaccccttcaaattcgaaatacacaaacaggcagtaccagacaaggtgtggaaaatttctaaaatcaataatactcacgctctggtgtcgctccttcagaacttgaacaaagcgaactataacttgcccattatggtaacagactcgggcaaaccccccatgacaaatattaccgacttgcgcgttcaggtctgtagctgccgcaactcgaaggtggattgcaatgctgctggggctctcaggttttccctcccctctgtcctgttgctcagcctcttttccctggcctgtaagtag

SEQ ID NO: 23184 - DNA, 1212 bp, Artificial Sequence
  Description of Artificial Sequence: Synthetic coding sequence
gtggtgagccccgccctgctggaccgggagaccctggagaaccccaaatatgagctgattatcgaagcacaggatatggctggcctagatgtcgggctcacgggcaccgcaacagccactatcatgatcgacgataaaaatgatcactctcccaaattcactaagaaagagtttcaggccaccgtagaagagggtgccgtcggtgtgattgtgaatctgaccgtggaggataaggacgaccccaccactggagcctggcgtgcggcctacacaatcataaacggaaacccggggcagtcgtttgaaattcatacaaacccccagaccaatgaaggaatgctgtctgtcgtgaaaccactcgattatgaaatatccgccttccatacgctactgatcaaggtcgagaatgaagatcccctggtgcctgatgtctcctacggcccttccagtaccgctactgtgcatattactgtccttgatgttaatgagggccctgtattctacccggaccccatgatggtcacccggcaggaagatctctctgttggcagcgtgctcctgacagtgaacgctacggatcccgatagcctgcagcatcaaaccatccgctattccgtctataaggaccctgccgggtggctgaacattaacccaatcaacggcaccgttgatactacagctgtgcttgacagggagtcaccctttgttgataacagcgtttacactgcgctattcctggctattgacagtgggaacccgcccgccacggggactggaacgctgctcatcactttagaagatgtgaacgataacgcgcctttcatctatcccacagtggccgaggtctgcgacgatgcaaagaacctgagcgtggtgatcctgggagccagcgacaaagaccttcaccccaacaccgatccttttaagttcgaaattcacaagcaggcagtccctgataaggtctggaagatttcaaaaattaacaatacgcacgctttggtgagcttgcttcaaaatttgaataaagccaactacaatctgcccattatggttaccgactcaggcaaaccacctatgactaatatcaccgacctgcgtgtccaggtgtgttcatgtagaaattctaaagtcgattgtaatgccgcaggagccctccgattttcactcccatcagttcttcttctgtcactgttttccctagcatgcctgtag

SEQ ID NO: 23185 - DNA, 2721 bp, Artificial Sequence
  Description of Artificial Sequence: Synthetic coding sequence
atgtgccggatcgccggcgccctgcggaccctgctgcccctgctggcagcccttttgcaggcttcagtggaagcttccggtgagatagccctctgcaagacgggcttccccgaagacgtttactcggccgttctatccaaggatgtacacgaaggacaaccactgctcaatgtcaaatttagtaactgtaacgggaaacgtaaggttcagtatgagagttcggaacccgcggacttcaaagtcgatgaagatgggatggtatacgctgtgaggagctttcccctgtcgtctgagcacgcaaaatttctgatttatgcccaggataaggaaactcaagagaagtggcaggttgctgtcaaactttctctaaaacccaccctgaccgaagagtcagtgaaagagtccgccgaagtagaagaaattgtgttcccaagacagttctcaaagcacagcgggcatctgcaacgccaaaaacgcgattgggtgatccctcctattaacttgcccgagaattcccgaggccccttcccgcaggagctcgtcagaatacgatccgatcgcgataagaatctctcactcaggtatagtgtgacagggcctggcgccgaccaacctcctaccgggatattcattattaaccctatttccggtcagctctccgtaacaaagccactggatagagagcagattgcccgcttccacctgagggcccatgcagtggacattaacggaaatcaggtggagaacccaattgatatcgtcattaacgttatcgacatgaatgataaccgccctgagttcctgcatcaggtttggaatggcacagttcctgaagggagtaaacctggtacatacgtaatgaccgtgactgccatcgacgccgacgacccaaacgccctgaacgggatgctgcggtatagaattgtgagccaggcgccctccacgccctcgccaaatatgtttacaattaacaatgagaccggggatatcattaccgtggcagcaggtctcgatcgcgaaaaagtgcaacaatacaccctcatcattcaggccacggacatggagggaaatcctacctatggccttagtaatacggcgacagctgtcatcaccgtcacagacgtgaatgacaatccgcctgagttcaccgccatgactttttatggagaagtgccagagaaccgcgtggacatcattgtggctaatcttacggtgaccgacaaggaccagcctcataccccagcttggaacgcagtttaccgcatcagcggtggagatcccaccggaaggtttgcgatccagactgatcccaattcgaatgatggacttgtcacagtcgttaaaccaatagattttgagaccaatcggatgtttgtcttgactgtagctgccgaaaatcaggtcccacttgctaaaggaatccagcaccctccccaatccaccgctactgtctccgtaacggtaattgatgtgaacgagaatccgtacttcgccccaaaccctaagataattaggcaagaggaaggtctgcacgcagggaccatgctgacaacatttactgcccaggatcccgaccggtatatgcaacagaatattaggtacaccaagctatctgaccccgcaaattggctgaaaattgatcccgtcaatggacagattaccactatagctgtgctggaccgcgagagccctaatgtgaagaacaatatatataacgcgacttttctggctagtgataatggcattccacctatgtctggaactggcactttacagatttaccttctcgacatcaacgataatgccccgcaggtattacctcaggaggctgaaacctgcgaaacaccagatcctaattccatcaacatcacagcactcgactatgatattgatcccaatgccggcccatttgctttcgacctgcctcttagtcctgttaccataaaaaggaactggaccataacccgattgaacggtgacttcgcccagttaaaccttaaaataaagtttctggaagcaggcatttacgaagtccccatcataatcactgacagcggtaatccccccaaaagcaacatttctatcctgcgtgtgaaggtctgtcagtgtgactctaatggtgactgtaccgacgtggaccgcatcgttggtgctggactgggaactggcgccattatcgccattctgctgtgcattattatattactcattttggttcttatgttcgttgtatggatgaaacggcgggacaaggagaggcaagccaaacaactgcttattgacccagaagacgacgtgcgtgacaacatacttaaatacgatgaagagggagggggggaggaagatcaagattacgatctttctcagctccaacaacccgacactgttgaaccggatgctattaagccagtgggcatcaggagaatggacgaaaggcccattcacgccgagccgcagtacccagtcagatcagcggctcctcaccccggcgatattggtgactttataaatgaagggttgaaagctgccgataatgacccaacagcacctccgtacgactccttgcttgtattcgactatgaggggagcggatctactgcgggcagcctgagctctcttaactcttcatcttcgggtggcgagcaagattatgactaccttaatgactggggccctcgcttcaagaagctcgctgacatgtatggtgggggtgatgattag

SEQ ID NO: 23186 - DNA, 2628 bp, Artificial Sequence
  Description of Artificial Sequence: Synthetic coding sequence
atgttcctgctgcggcggtacgtgtgcatcttcaccgagaagctgaagaaccaagcggagctgtacgttttcttgtcagtgaagttctcgaattgcaatggaaagcggaaagttcaatacgaaagtagtgaacctgctgattttaaggttgatgaagatggaatggtatacgctgtccgttccttccctctctcaagcgagcacgcaaaatttttgatctatgcgcaagataaggaaacgcaggagaagtggcaagtggctgtgaagttgtcgcttaagcccactcttactgaagagtccgtcaaggaatccgcggaggtggaagaaatcgtttttcctaggcagttctcaaaacacagcggccacctgcagagacaaaaaagggactgggtgatcccaccaattaacttgcccgagaactctaggggtcctttcccacaggagctggtgcggatacgctcggacagggataagaacttgtcattacggtattcagtgaccggccctggtgccgatcagccccccactggcatatttataatcaaccctatcagcggtcagctgtcagtgaccaagcctctagaccgagaacagattgcacgctttcaccttcgcgcacacgccgttgatataaacggcaaccaggtcgagaacccgattgacatcgttatcaacgtgatcgatatgaatgacaatcggccagaattcctccaccaggtgtggaatgggactgtgccagagggcagcaaacccggaacctacgtgatgaccgtgaccgctatagatgctgatgatcctaacgccttaaatggcatgctcagatatcggatagtgagtcaggctcccagcacgccttcacccaacatgttcacaatcaataatgaaacgggggacatcataaccgttgccgccggattagaccgagaaaaagtgcagcagtacactctgataatccaggctaccgacatggaagggaaccccacttacggtctctctaacacggctaccgcagtgataacagtcaccgatgtgaacgataacccaccggaatttacagcgatgactttttacggagaagtacctgagaatcgcgtggatattattgtagccaatcttactgttaccgacaaagaccagccccacacacctgcctggaatgcagtgtacaggatcagcggcggtgaccctactggaagatttgcaatacagactgaccccaactccaacgatgggctggtgactgtcgtgaaacccattgactttgagacaaaccgtatgttcgtcctgactgtcgcagctgaaaatcaggtcccgctcgccaagggaatacagcaccccccccaaagcaccgcaaccgtcagtgtgaccgtgatcgacgttaacgagaacccttacttcgcgcctaatcccaagattatcagacaagaggagggtctgcatgccggcactatgctcaccacgttcacagcacaggacccagatcggtacatgcagcagaacatcaggtatacaaaactgtctgatcccgcaaattggctgaagatagatcccgtcaatggtcagataacaacaattgcagtgctggacagggagtctccaaatgttaaaaacaacatctacaatgctacttttcttgcaagcgacaacgggatcccacctatgagtggaacaggaacactgcagatctatctgttagatattaacgataacgccccccaggttctgccacaagaggccgagacttgcgagacaccggacccaaactctatcaatataacggccctggattatgatatcgatccgaatgcgggccccttcgccttcgacttaccactgagcccagttaccatcaagcgcaactggacaatcacacgcctgaacggggacttcgcacagcttaacttaaagataaagttcctagaggcaggaatttacgaggtccctataatcatcactgatagtgggaatccccccaaaagcaatattagcattctgagagtaaaggtatgccagtgcgactccaacggcgattgtaccgacgtcgaccgaatcgtcggtgcaggacttgggacgggcgccataatcgctatccttttatgcataattattctactcatcttagttctgatgttcgtcgtgtggatgaaaaggagggataaggaacgacaggccaagcaacttcttatcgatcccgaggatgacgtcagggacaacatcctgaagtacgatgaggaaggaggtggagaggaggatcaagactacgacctgtcacagctccagcagcctgatacagtggaacccgatgcaatcaaaccagtcggcatccgccgcatggacgagaggccaatccacgcggagccccagtatcctgtacgctctgcggcacctcatcctggagatatcggggattttataaacgaggggcttaaggccgccgataatgacccaacagcacccccatacgatagcctgttagtgttcgactacgaaggcagcggtagcaccgcaggatccctgagcagcctcaattcctcgagctcaggcggcgagcaggattatgactacctgaatgactggggtcctaggttcaagaaattagctgatatgtacggcgggggcgatgactag

SEQ ID NO: 23187 - DNA, 2355 bp, Artificial Sequence
  Description of Artificial Sequence: Synthetic coding sequence
atgcagcggctgatgatgctgctggccaccagcggcgcctgcctgggcctgctagccgtagcagctgtcgccgccgccggcgccaatcccgcacaacgggatacccatagtttgcttcccacccaccgcagacagaaacgggactggatatggaatcaaatgcacatcgatgaggaaaaaaatacgagcctcccgcatcacgtcggtaaaataaaatccagtgtgagtaggaaaaatgctaagtatctcttaaagggagagtatgttggtaaggtcttccgcgtggacgcggaaaccggcgacgtttttgccatcgaacggctcgaccgggagaatatcagtgagtaccatctgaccgccgtgattgttgataaggataccggagaaaacctcgagacaccctcatcattcacaattaaggtgcacgacgttaacgacaattggccagtatttacccatagactgtttaacgctagcgttcccgaatcaagcgccgttggtaccagtgtaattagcgtgacggccgtagacgccgatgatcccaccgttggggaccacgcttctgtcatgtatcaaatcctgaagggcaaggaatatttcgctatagacaatagcggacgaatcattaccattaccaagtcactcgatcgcgaaaaacaagctcgttacgagattgttgtcgaggcccgagatgcccagggtttgagaggcgactctggcacagctaccgtgctggtaactcttcaagacattaatgataactttccatttttcactcagactaagtatactttcgtggtccccgaagatactcgcgtcgggacaagcgtcgggtcattgttcgtggaggatcctgatgaaccccagaataggatgaccaaatactcaatcttacgcggcgactatcaagatgccttcaccattgagacaaacccggcccacaacgaggggatcattaagccgatgaaacccttggattatgaatacatccagcagtattccttcatcgtcgaggctacagatccaacaattgacctcagatacatgagtccgccagcaggaaacagggcgcaggtgattattaatattaccgatgttgacgaacctcctatctttcagcaacctttctatcatttccagttgaaagagaaccaaaaaaaaccactgatcggtactgtgcttgccatggacccggacgctgcacgtcactctattggctattctatccggcggacaagcgataaagggcagttttttcgcgtaaccaagaaaggcgatatctacaacgagaaggagctggaccgcgaggtttacccttggtacaaccttaccgtagaggccaaagagcttgacagtacgggcacgccaacagggaaggagtctatcgtacaggttcacatcgaggtcttagacgaaaatgacaatgcccccgagttcgccaagccttaccagccgaaggtttgcgaaaatgcggtccacgggcagctggtcctgcagatcagtgcaatagacaaggatataactcctcgcaatgtgaagtttaagttcatcttgaatactgagaataatttcacactcactgacaaccatgacaatacagccaacattaccgtgaaatacgggcagttcgacagagagcatacaaaagtccattttctcccggtggtgatctcagacaatggcatgcccagccgcaccggaacatccacactgaccgtagccgtgtgcaagtgtaacgagcagggggaattcacattttgtgaggatatggctgcccaggtgggcgtgtcaatccaggccgtggtagccattttgctttgtattctgacaataacggtcattactctgcttatcttcctgaggcgccgcctgaggaaacaggcccgcgcgcatgggaaaagcgtaccggaaatacacgaacagttagtcacctatgacgaggagggaggaggcgaaatggatacaacctcctatgatgtgtccgtcctcaactccgtgcggaggggcggcgccaagccccctcgtccggcattagacgcaagacccagcttatacgcacaggtccagaagccacctagacacgcccctggggcccacggaggacctggggagatggctgccatgatcgaggtgaagaaggacgaggcagatcatgacggagatggcccaccttatgatacactgcacatttatggatacgaagggtccgagtcaatcgctgaaagcctttctagcctaggaacggactcttccgactcggacgtagattatgattttctgaacgattggggacctagattcaagatgcttgctgagctatacgggtcagacccgcgagaagagctcctttattag

SEQ ID NO: 23188 - DNA, 2010 bp, Artificial Sequence
  Description of Artificial Sequence: Synthetic coding sequence
atgcagcggctgatgatgctgctggccaccagcggcgcctgcctgggcttactggctgttgccgctgtggctgcagcaggcgctaacccagcccaacgggacacgcatagcctgctccctacccacagacggcagaaacgagactggatctggaaccagatgcatattgacgaagaaaaaaacacttccctgccacatcatgttggaaaaattaaaagttccgtgtcacgcaagaatgctaaatatctgttaaagggcgagtatgtcggcaaggtttttcgtgtggacgcagagaccggcgatgtgtttgccatcgaaaggttggaccgcgagaatatttcagagtaccacctgacagccgtaatcgtcgacaaagacactggagagaatctggagactccctcatccttcactattaaagtgcacgacgtaaacgacaactggccggtgtttactcaccggctgtttaatgcttctgtgcccgaaagctccgccgttggaactagtgttatatctgtgaccgctgtggacgctgatgacccaactgtcggcgaccacgcaagtgtgatgtaccagatcctgaaagggaaagagtatttcgccatcgacaacagcggaaggattatcaccattacaaaatcactggatcgggaaaagcaagctcggtatgagatagtggttgaggctcgagatgcacaggggctccggggagactccgggacagccacagtgctcgtgaccctgcaagacatcaatgataacttcccattcttcacacagactaaatataccttcgtcgttcccgaagatacccgggtcggcaccagcgtcggctctctgtttgtggaagatcccgacgaaccgcagaatagaatgacaaagtactcgatcctgaggggagactatcaggatgcctttaccatagagacgaatccggcccacaatgaaggtattattaaaccgatgaaaccattggactatgagtatatccagcagtactccttcatcgtcgaagccaccgatcccaccatcgacctcaggtacatgtctcctcccgccggaaatagagctcaggtgattatcaatattacggatgtggacgagccacccatcttccaacagccattttaccattttcagctggtcctgcagatctctgcgatcgataaggatatcaccccccggaatgtcaagtttaaatttatacttaatacggagaacaactttactttaaccgacaatcacgacaacacggctaacattactgttaagtacggccagtttgatagggaacacaccaaagttcatttcctgccagttgtgataagcgataacgggatgccctccagaacaggtaccagcaccctaacggttgcggtgtgcaagtgcaacgaacagggggaattcactttctgcgaggatatggcagctcaagttggagtgtctattcaggccgtcgtggcaatccttctgtgcattctcactattacggtcataacgctattaatttttttgcggaggcgcttgagaaaacaagcccgcgcccacggaaagagcgttcctgagatacatgagcaattagtcacatacgatgaagagggtgggggcgagatggacacaacttcgtatgatgtctccgtcctgaatagcgttcggcggggaggcgcaaagccgccccgtcccgcattagatgccagaccttccctttatgcccaggtgcagaagcccccccgtcacgcgcctggcgctcacggtggcccgggtgagatggcggccatgatcgaggttaaaaaagacgaggcagaccatgacggggacggccctccctacgatacattgcacatctacggttacgaaggtagcgagagtatcgcagagtcattgagcagtctgggtaccgattcttcggatagtgatgttgattacgatttcctcaatgactggggccccagattcaaaatgttagccgaattatacggcagcgacccacgcgaagaattgctctactag

SEQ ID NO: 23189 - DNA, 672 bp, Artificial Sequence
  Description of Artificial Sequence: Synthetic coding sequence
atgcccagccggaccggcaccagcaccctgaccgtggccgtgtgcaaatgcaacgagcaaggtgagtttactttctgtgaagatatggctgcgcaggtgggggtgtccatccaggccgtcgtagctatcctcctgtgcatcttgaccattaccgtgattacattgctaattttcttgaggcgccgcctgcggaaacaagcaagggcccacgggaagagcgtccccgaaatccatgaacagctcgtcacctatgacgaggagggcggcggtgaaatggatactaccagctacgatgtgagtgtcctcaactccgttcggagaggcggagccaagccccccagacctgcattggacgcccggcccagcctgtacgcccaagtccagaaacctcctcgacatgcccccggagctcatggcggccccggagaaatggcagcaatgatagaggtgaaaaaggatgaggctgaccacgatggagacggacccccctacgacacgctccatatctacggatatgaggggtcggaatcaatagcagagtccctctcttctctgggcaccgactcaagtgactcagatgttgactatgatttcttgaacgactggggtcctcgcttcaaaatgctggctgaactgtatggttccgacccccgggaagaactgctgtactag

SEQ ID NO: 23190 - DNA, 1578 bp, Artificial Sequence
  Description of Artificial Sequence: Synthetic coding sequence
atgcccagcacctgcagcaaggagaacatgtgggcccggagcagcggcagcatgcagaggcaggagacttgttcaccgctgcgggctcaaaaccgaatgacaaagtactctatcctaaggggtgattatcaggacgctttcaccatagaaacaaaccccgcgcacaacgaaggcatcataaagcccatgaagccactggattatgagtacatccagcagtactcgtttatcgtggaagccacggaccctacaatcgacttaagatacatgagcccacctgctggtaatcgggcacaggtgatcataaacatcacggatgttgacgaaccaccaatcttccagcagccattttatcattttcagctgaaagagaatcagaagaaacccttgatcggaactgtccttgccatggaccctgacgctgctaggcatagtatcggatatagcattcggcgaacaagcgataaagggcagttctttagagtgacaaagaagggtgacatttacaacgaaaaggagctcgatcgggaggtgtatccatggtataatctcaccgttgaagctaaagaacttgactccactggcacaccgacaggaaaagagtccattgtgcaggtgcacatcgaggtgttggatgagaatgataacgcccccgaatttgcaaagccatatcagcctaaggtatgcgaaaacgccgtgcacggacagctggtgcttcagatcagcgcaattgataaagacatcacccctagaaatgtgaagtttaaatttatcttgaatacggaaaataattttaccctgaccgataatcacgacaacacggccaatataaccgtaaagtacgggcaattcgatagggaacatactaaggtacactttttacctgtggttattagcgataatgggatgcccagcaggaccggcacctcaacactgaccgtggccgtatgcaagtgcaacgaacagggggagttcactttctgcgaagacatggccgctcaggtgggagtgagcatccaggccgtcgtggcgatccttctgtgtatccttaccatcaccgtgatcacgctactaatttttctgcgccgaagattgagaaagcaggcacgcgcccacggtaagagtgtgcctgaaatacatgagcagctggtgacatatgatgaagaagggggcggggaaatggacactaccagctacgatgttagtgtgttaaactctgtgcggcgaggaggagctaaacctcctaggccagccctggatgcccgtccaagcctttatgctcaagttcaaaaaccaccaaggcatgcccctggagcgcatggtgggccaggcgagatggctgctatgattgaagtaaagaaggacgaggctgaccatgacggggatggcccgccctatgacactctgcacatatacgggtacgaggggtctgagagcattgctgaaagcttatcaagtctgggcacggactcttctgattctgatgtagactacgactttctcaatgattggggccctagattcaaaatgctggcggagctgtacgggtcagatcccagagaggaactgctttactag

SEQ ID NO: 23191 - DNA, 2373 bp, Artificial Sequence
  Description of Artificial Sequence: Synthetic coding sequence
atgcggacctaccggtacttcctgctgctgttctgggtgggccagccctaccctaccctgagcacacctttaagcaaacgcacatctgggttcccggcaaaaaagcgggcattagaactgagcggaaactccaaaaacgaactaaatcgctctaaacgctcttggatgtggaatcagttctttctcctggaggagtacactggatcagactaccagtatgttggcaagctccattccgatcaggatcgcggtgatgggagcctaaaatatattttgagtggagacggggccggcgacctgttcatcataaacgagaacacaggggacatccaagcaaccaaacggctagacagagaagagaaaccagtttacattctgagagcacaagctatcaacagacgtactgggcggcccgtagagccggagagcgaatttataattaagattcatgatattaacgacaacgaacccatctttacgaaagaggtctatacagcaaccgtgccagagatgagtgacgtaggaacattcgtggtgcaggtcacagccacggacgccgacgatccaacctatggcaacagcgctaaagttgtctattccattttacagggacaaccctatttcagcgtggagagcgaaactggtatcatcaagacagccctgctaaacatggacagggagaacagggagcagtatcaggtggtgattcaggccaaagatatgggtgggcagatgggcggcctgtctggcactaccactgtgaacataactctaactgacgtcaacgataatccacctcggtttccccagagcacctaccagtttaagacaccagagagttctcctccgggtacacccattggccgaattaaggcttcagatgctgacgtgggtgaaaacgcagagatagaatactccatcactgatggcgagggattggatatgttcgatgttatcaccgatcaggaaacacaggaggggattatcaccgtgaagaagctcctcgattttgaaaagaagaaggtctacaccctcaaagtggaggcgagcaacccatatgtagaaccccgatttctttacctgggccctttcaaagatagcgcaacagtgaggatcgtggtggaagatgtcgatgaaccccccgtgttttcaaaactcgcgtacatactacagattagggaagacgctcagattaatacgactataggctctgtcactgcccaggaccccgacgctgcaaggaatcctgtcaagtatagtgtggaccgacacactgatatggataggatttttaacatcgattcaggtaatggctctatcttcacaagtaagctgctggacagagagacgctgctgtggcacaatatcaccgtgatcgcaaccgaaataaataatcccaaacagagcagccgggtccccctgtacattaaggtgctcgacgttaacgataacgctcccgagtttgcagagttttatgagacattcgtttgtgagaaggcaaaagctgaccagctcatccaaactctgcatgcggtggacaaggatgacccctatagtggccaccagtttagcttcagcctcgcccccgaggccgcatccgggagcaacttcactattcaggacaacaaggataatacagcagggatattgacgaggaaaaacgggtacaataggcacgaaatgtctacatacctgctgccagttgtgataagcgacaacgactacccagtgcagagcagtactggtaccgtgactgttcgcgtttgcgcatgcgaccaccacggaaatatgcagagctgccacgctgaagccttgatccatccaacaggcctgtcgacgggtgcccttgttgctattctgttgtgtatagtcatccttctggtgaccgtagtcctcttcgctgccctgcggcgacagcgcaaaaaagagcccttaatcatatcaaaggaggatataagggataacatcgtctcttacaatgatgaagggggaggtgaagaggatacccaggctttcgatatcggcacgttacggaatccagaggcaatcgaggacaataaacttcgtcgcgacatcgtgcctgaggccctctttctgccccgacgtaccccgactgcgcgcgacaacactgacgtgagggacttcattaaccagagactaaaggagaacgacaccgatcctacagctccgccctacgatagcctggcgacatatgcctatgaaggcactggatctgtagccgatagcctgtcctccctggaatccgtgaccacggatgccgatcaagactatgattatctttctgactggggtcctcggttcaaaaagctcgcggacatgtatggcggcgttgactcagataaggactcttag

SEQ ID NO: 23192 - DNA, 576 bp, Artificial Sequence
  Description of Artificial Sequence: Synthetic coding sequence
atgggcggcagcggcagccggctgagcaaggagctgctggccgagtaccaggacctcactttcttaaccaaacaggaaattctgttagcgcaccgcaggttttgtgagctgttgccacaggaacagcggagcgtcgagagttcactgcgcgcccaggtcccctttgagcagatcctgtctttaccagagttaaaggccaacccatttaaagagcgtatctgcagagtctttagcacatcaccagcaaaagactcgctcagcttcgaagattttctcgacctccttagtgtttttagcgacactgccacccccgatattaagtcccactatgccttccggattttcgattttgacgacgatggtaccctcaatcgggaggatctgtcacgcctggtgaattgcttgacaggtgagggagaggacaccaggctgagtgcctccgagatgaagcagctcatagataatatactagaagaatctgacatcgaccgcgacggaacaatcaacctatccgaattccagcacgtaatttctcgcagtcccgatttcgcctcctccttcaagatagtgttgtag

SEQ ID NO: 23193 - DNA, 237 bp, Artificial Sequence
  Description of Artificial Sequence: Synthetic coding sequence
atgagcgaggtgctgccctacggcgacgagaagctgagcccctacggggacggcggcgacgtaggccaaatcttctcatgccggctccaagacacaaataacttcttcggcgccgggcagaataaacgcccccccaagctggggcagatcggtaggtccaaacgtgtcgtgattgaggacgataggatcgatgacgttctgaaaaacatgaccgataaggccccacctggggtctag

SEQ ID NO: 23194 - DNA, 1563 bp, Artificial Sequence
  Description of Artificial Sequence: Synthetic coding sequence
atggagggcggccccgccgtgtgctgccaggacccccgggccgagctggtggaaagggtcgcggcaattgatgttacacacctggaagaggcggatggtggacctgagcctacgaggaatggtgtcgacccaccacctcgggcacgggccgcgtcagtgatccccggctccacgtctaggttgctgcctgccaggcccagcctttccgccaggaaactgtccctgcaggagcggccggccggaagttacctggaggcccaggccgggccgtatgccacagggccggcctctcacatcagtccccgtgcatggaggcgacctaccatcgaatcacaccacgtcgccatatccgacgctgaagactgtgtgcagctcaatcagtataaactgcagtctgaaattgggaagggggcctacggcgtagtgcgcctggcatataatgagtccgaggaccggcactatgcgatgaaagtgctctctaagaaaaaattgcttaagcagtacggattcccccgtaggccaccaccaaggggcagccaggctgcccagggcgggcccgcaaaacagcttctgcccctcgaacgagtgtaccaggaaatcgctattctcaaaaaattggatcacgtcaatgtagtcaagttgatagaagtactggacgaccccgctgaggataatctgtacttagcccttcagaatcaggcacagaatatacagctggactccaccaacatcgcaaaacctcacagcctgctgcccagtgaacagcaggattcgggctccacatgggcggccaggagcgtgttcgatctactgagaaagggaccagtgatggaggtgccctgtgacaaaccattttcagaagagcaggccagactctaccttagggatgtgatactaggtctcgagtacctccattgccagaagattgtccatcgagacatcaaaccgtcgaatcttctcctgggagacgacgggcacgtgaaaattgctgatttcggtgtgagcaaccaattcgaaggcaacgatgctcagctgtcatctaccgcgggcactcccgcatttatggcccctgaggctatttctgatagtgggcagtcatttagtgggaaggccctggacgtgtgggccaccggggtgacgctgtattgtttcgtgtacggaaaatgccctttcatcgacgacttcatcctggccctacatcggaagattaagaacgaacctgtggtatttcccgaggaacccgagatatcagaggagctgaaagatttaattttgaagatgctggataaaaaccctgaaaccaggattggggtgccagatattaagctacacccctgggttactaaaaatggtgaagaaccgctgccatcagaagaagagcactgctcagtagttgaggttaccgaggaagaggtcaagaatagtgtccgcctcatcccttcatggactaccgtcatcctggtaaaatctatgctcaggaagcgatctttcggcaacccctttgagccacaggctcgacgcgaggaacgcagtatgagcgcaccaggaaacctcttagtctag

SEQ ID NO: 23195 - DNA, 1518 bp, Artificial Sequence
  Description of Artificial Sequence: Synthetic coding sequence
atggagggcggccccgccgtgtgctgccaggacccccgggccgagctggttgaacgggtggccgcgatcgacgttactcacctggaagaagcggatggcggccccgagcctacccggaacggggtcgacccaccgccgagagcgcgagctgcatccgttatcccagggagtacaagccgtctgctcccggctaggccttcgttgagcgctagaaagctgtccctgcaggagcggcccgccggatcttatctcgaggcccaggcaggaccatacgctacgggcccggcctcacacatatcaccgcgagcatggcgcagaccaacaatcgagtcacatcacgtggcgatcagcgacgccgaggactgcgtccagctgaatcagtataaacttcagagcgagatcggtaagggcgcttatggggtggtgcgcttagcctataacgagtctgaggatcggcattatgcaatgaaagtgctatccaagaagaagctgcttaagcagtacggcttccctcgcagacctcctcccaggggctctcaggccgcccaggggggccctgccaagcaactgttgccactggaaagagtgtatcaagaaattgccatcttgaaaaagttggaccatgtgaacgtggtcaaactgatcgaagtactggatgatccagctgaggataatctgtatctggtgtttgacttgctgaggaaaggtcctgtcatggaagtcccttgtgataagccattctcggaggagcaagctcgcctgtacctaagggacgtaatactcggtctggagtacctccactgtcagaaaatagtacatagggacatcaagccctccaaccttttacttggcgatgatggacacgtaaagattgccgattttggcgtctccaaccagttcgaggggaatgatgcgcaactctccagcacagcgggaaccccagcttttatggccccggaagcaatttctgattcaggccaaagtttctccgggaaagcactggatgtctgggccactggcgttacactgtactgctttgtctatgggaagtgtccgttcatagatgacttcatcttggcactccatcggaaaatcaaaaacgagccggtcgtgtttcctgaagagccggagatctccgaggagctgaaagacctcatacttaagatgctggataaaaatcccgagacacgtataggagtcccagatattaagctgcacccttgggtgacaaagaacggtgaagagccgttaccatcagaggaagagcactgttcagtggttgaggtgacagaggaagaagtgaagaattctgttcgcctgatcccaagttggaccactgtgattttagttaaatccatgttgagaaaaaggtcctttgggaacccctttgagcctcaggctcggagggaggagagatccatgagcgcaccaggaaacctgctggtgaaggaaggcttcggtgaagggggtaagagcccagagcttccaggagtacaggaggacgaggcagcctcttag

SEQ ID NO: 23196 - DNA, 1599 bp, Artificial Sequence
  Description of Artificial Sequence: Synthetic coding sequence
atgcagttcggcaagctgtggtgcggctgcagcggcgagttccccactcgcctacggcgaaggaccccactgacagaggcgatggaaggcggcccagcagtgtgttgccaagatccaagagcagagctggtggagagagtcgccgcaatcgacgtgacccatttagaagaagcagatggcggccctgagccaacccgcaacggggtcgaccccccacccagagcccgggcagcctccgtgattccaggctccacctctcggctcctgcccgcgagaccaagtcttagcgcgcggaaactttcgctgcaggaacgcccagccggttcatacttggaggcgcaggccggaccatacgcaacaggacccgcaagtcacataagtccgagagcctggcggaggcctaccattgagagccatcacgtggccatctccgacgccgaagattgcgtccagctcaatcagtacaaactgcagtcagagataggaaaaggcgcctatggagtcgtccgcctggcatacaacgagtccgaggatcgacattatgccatgaaggtcctctctaaaaagaagttactgaaacaatatggttttccccgccggccccctccgagggggagtcaggccgcacagggaggaccagcaaagcagctgctaccccttgaaagggtatatcaggaaatcgcaatccttaagaaactggaccatgtgaatgtggtgaaactaattgaggttctagatgaccccgccgaggacaatctctacctcgtttttgatctgcttaggaaagggcccgttatggaggtgccctgcgataaacccttctcggaagagcaggcccgtttgtacttgcgcgacgtgatactgggactggaatacctccactgccaaaagatcgtgcacagagatatcaaaccgtccaacctgctgcttggtgacgacgggcatgtcaaaatagccgacttcggcgtaagcaaccaatttgaaggcaacgacgctcagctaagttcaacagctggcacacccgcattcatggcccccgaggcaatcagcgattctggccagtctttttccgggaaggcactggatgtatgggccacgggcgttactttgtactgttttgtttacggcaaatgtccattcattgacgattttatcctggctctgcatcgcaagattaaaaatgagcccgtggtgtttcccgaggagcctgaaatttccgaggagctgaaggacctcatcctgaagatgttggataaaaatccagagacacgcatcggagtgcccgatattaaactgcacccatgggtcaccaaaaatggcgaagaaccactgcctagcgaagaagaacactgcagcgttgtcgaggtgaccgaggaggaggttaaaaacagtgtgaggctgattccctcctggactacggttatactcgttaagtccatgctacgaaaaaggtccttcggcaacccctttgagcctcaagcccgccgcgaagagagatcaatgtcggcacctgggaacctgctggtgaaggagggttttggggaaggcgggaaaagtccagagttgccgggggtgcaagaggacgaagccgcaagttag

SEQ ID NO: 23197 - DNA, 1632 bp, Artificial Sequence
  Description of Artificial Sequence: Synthetic coding sequence
atggagggcggccccgccgtgtgctgccaggacccccgggccgagctcgtggagagggtcgccgcgatcgacgtgacacatctggaggaagcggacggaggccccgagcctacccgcaatggcgtggaccctcctcctcgggcgcgtgcagcatctgtgatccctggttccaccagccgattacttcctgcccggcccagcctgtctgcacggaagctgagcctacaggaacgacctgccggctcgtacctggaagcacaggccggtccctacgcaacaggtcccgccagccacatctccccgagagcatggcgccggcccacaatcgaatcccatcacgtggccattagcgatgccgaggactgcgtgcagctgaatcagtacaagctccagagcgaaatcggcaaaggagcatacggcgtcgtacgcctggcctacaacgagtcggaggaccgccattacgccatgaaagttctaagcaaaaagaaactgctgaaacaatatgggttcccgcgacgtccaccgccccgaggatctcaggctgcccagggcggccccgcgaaacagttattacccctcgagcgggtataccaggagatcgcaattctcaagaagctcgaccacgtcaacgttgttaagcttatcgaggtgctggacgatcctgctgaagacaacctctacctcgcactccagaaccaggctcagaacattcagttggattctactaacatcgctaaaccgcatagtctcttgccctcggagcaacaggattctggttctacgtgggccgcgcggtctgtttttgatctgctgagaaaaggcccagtaatggaggtaccatgtgataaaccctttagcgaggagcaggcacgactgtacctgcgggatgtcatcctggggctggaataccttcattgccagaagatcgtgcatagggatattaaaccttcaaatttactgctgggggatgacgggcacgtgaaaatcgctgacttcggagtgagcaaccagttcgaggggaatgacgctcagctgagcagtactgcaggcacacctgcgtttatggctccagaagccatatcagactctggacaatcatttagcggcaaggcactggatgtgtgggcaaccggcgtgaccttatattgctttgtttacggaaagtgcccgttcatcgatgacttcatccttgcattgcatagaaaaatcaaaaatgagcccgtggtgtttccggaagagccagagatctcggaagaattaaaagaccttattctaaaaatgctggataaaaaccccgagaccaggattggcgtgccagatattaagcttcacccatgggttaccaagaacggcgaggagcccctacccagcgaggaggaacattgcagcgtggtcgaggttactgaggaggaggttaagaactctgtccggcttataccaagctggaccaccgtgattctggtgaaaagcatgttacggaagcggtcctttggaaatccctttgagcctcaggcgagacgggaggagcgctctatgagcgcaccgggaaacttactggtcaaggaaggctttggcgaagggggcaagtcacccgagttacccggcgttcaggaagatgaggcggcatcatag

SEQ ID NO: 23198 - DNA, 1695 bp, Artificial Sequence
  Description of Artificial Sequence: Synthetic coding sequence
atggacgacttcgagcggcggcgggagctgcggcggcagaagcgggaagaaatgaggctcgaagcagaacgcatcgcctaccaaaggaacgacgatgacgaggaggaagccgctcgggagaggaggcgccgcgcaaggcaggaaagacttcgtcagaagcaagaagaggaatctttgggccaagtgacagaccaggtcgaggttaatgcccagaattccgttccagatgaggaagcgaagactactaccaccaatacccaggtggaaggagatgatgaagccgcctttctcgagaggttagctcggcgggaggagcggcggcagaagcgattgcaggaagctttagaacgccagaaagaatttgaccccaccataacggatgcgagcctgtcactgcctagccggaggatgcagaacgacacggccgagaacgaaacaacagagaaagaagagaagtctgaatcaaggcaggaacggtacgagattgaggagacggaaacagtgaccaaaagctaccagaaaaacgattggagggacgccgaggagaacaagaaggaggataaagaaaaggaggaggaggaagaggagaagccaaagcgtggatctatcggggagaatcagggtgaggagaaaggcacgaaagtgcaggccaagagagagaagctgcaagaggataagcccacatttaaaaaagaagaaataaaggatgaaaagataaagaaggacaaagaacccaaggaagaggtgaagtcctttatggataggaagaaaggttttactgaagtgaaatcccagaacggcgagttcatgacccacaaactcaaacacaccgagaacactttcagtagaccagggggacgcgcttcagtggacactaaagaggcggagggagctccacaagtggaagccggaaaaaggctcgaagaactgagaaggcggcgaggtgagaccgagagtgaggagtttgagaagcttaaacagaagcagcaggaagccgctctggagctcgaggaacttaagaagaaacgtgaagagcgtaggaaagtgctcgaggaggaggagcagcgcaggaagcaagaggaagccgacaggaagctgagagaggaggaagaaaaacgacggttgaaggaggagatcgagaggagacgcgcagaggctgcggaaaaacggcagaagatgccggaagacggcctcagtgatgacaagaagccatttaagtgctttacgcctaaggggagctctctgaagatcgaggaaagagctgagtttttgaataaatccgtgcagaagtcgtctggcgtcaaatctacacatcaggctgccatcgtcagtaaaatagattcaaggctggaacaatacactagcgccatcgaagggaccaagtcggcaaagcccacgaaacctgcggcgtcggacctgcccgttccagcagagggtgtgagaaacattaagtctatgtgggaaaagggcaacgtcttctccagtcctactgcagcggggacacccaacaaggagaccgccggtctcaaggtgggcgtgtcttcccgcatcaacgagtggttgacgaagaccccagacggtaacaagtctcccgccccaaaaccctctgacctgcgccccggggatgtcagcagtaaaagaaacctgtgggagaaacagtccgtggataaggttacctctcccacaaaagtgtag

SEQ ID NO: 23199 - DNA, 2382 bp, Artificial Sequence
  Description of Artificial Sequence: Synthetic coding sequence
atggacgacttcgagcggcggcgggagctgcggcggcagaagcgggaagagatgcgcttagaagcagaacggattgcataccagagaaacgacgacgacgaggaagaggcggcccgggagaggcggcggagggcgcgccaagagcgattgcggcagaaacaggaagaggaaagtttaggtcaggtgacggaccaggtggaagtgaatgcccagaactcggtccccgacgaggaggcaaagacaactacaacaaatacacaagttgagggggacgatgaagcagccttcctggaacgcctagccagacgcgaggaacgtcgccagaagcggctgcaggaggcgctggagaggcaaaaggaattcgaccctaccattacagacgcctccctgtctctgccttcacgccgcatgcagaatgataccgctgagaatgagacaaccgagaaagaggagaaatcagaatctagacaggagcggtatgaaattgaagagacagaaaccgtaaccaagtcatatcagaagaacgactggcgggatgccgaagagaataaaaaggaggataaggagaaagaggaagaagaagaggagaaaccaaaaagggggtccattggcgagaaccaagtggaggtgatggtggaagaaaagacaacagaatcccaagaggaaacagtagttatgtcactcaagaatggccagatcagctctgaggagcccaaacaagaagaggaacgggaacagggcagtgacgaaattagccaccacgagaaaatggaggaagaagacaaggagagagcagaagccgaacgcgctagacttgaggccgaggagcgagagaggattaaggccgaacaggataagaagatcgcggacgagagagcccggatcgaggccgaagagaaggcagcagctcaggagcgtgaacgacgtgaggctgaagaacgtgagaggatgagggaggaggagaagagggccgccgaagagcggcagaggattaaagaagaggagaagcgcgcagccgaggagaggcagaggattaaagaggaggaaaagcgggctgccgaggaaagacagcgtattaaggaggaggaaaagcgcgccgccgaggaaagacagcgtgccagagctgaggaggaggaaaaggccaaagtagaagagcagaagcggaataagcaactggaggaaaaaaagcacgcgatgcaagaaaccaaaattaaaggagaaaaggtcgagcagaaaatcgaggggaaatgggtgaacgaaaaaaaggctcaggaggataagctccagacagccgtgctgaagaaacaaggtgaggagaaaggtaccaaggtccaggctaagcgggagaaactgcaagaagacaagcctacgtttaaaaaggaagagattaaagacgagaagattaagaaggataaggaaccgaaagaagaagtgaaatcatttatggatagaaaaaaaggattcaccgaggtcaagagtcagaatggagaatttatgacccataagctgaagcacaccgagaacaccttctctagacctggaggacgggcaagtgttgacacaaaagaggctgaaggcgccccacaggtggaggcaggaaaaagacttgaagagctgcggagaagacgtggcgaaactgaatccgaggagtttgagaagctaaaacaaaagcagcaggaggctgccctagaacttgaggagctgaagaaaaaacgtgaggagcgccggaaagtgctcgaggaggaggagcagaggaggaaacaagaagaggctgatcgcaagctgcgggaggaggaggaaaaacggagattgaaagaagaaattgagcggcggcgggctgaggcagctgaaaaaagacagaagatgcctgaggacggcctatccgatgataagaagccttttaagtgttttactccaaaggggagtagtctgaaaattgaggagcgggccgagtttctaaacaagagcgttcagaaatcttccggggtgaagtctactcatcaggcagccatcgtttctaaaatcgattcccgcctcgagcagtatactagcgccatcgaaggcactaaatcagcgaagcccaccaagccggccgctagcgacctgcctgtgcccgccgagggcgtacgaaatataaaatccatgtgggagaaagggaacgtttttagttcgcccactgcagctggtacacccaataaggagactgctggactgaaggtaggggtcagtagtcggataaatgagtggctcaccaaaactccggatggtaataagtcccccgcaccgaaaccaagcgacctgcgcccaggagatgtgagttctaaacggaatctgtgggaaaaacaatctgttgacaaagtgacgagtcccaccaaagtgtag

SEQ ID NO: 23200 - DNA, 1617 bp, Artificial Sequence
  Description of Artificial Sequence: Synthetic coding sequence
atggacgacttcgagcggcggcgggagctgcggcggcagaagcgggaagaaatgcggctcgaagctgagcggattgcctaccaaaggaatgatgacgacgaagaagaagctgctagagagagaaggagaagggccagacaggagaggctgaggcagaagcaggaagaggaatccttaggccaggtgacagatcaggtggaagtgaacgcacagaactctgtaccggatgaggaagcaaagacaaccaccactaatacccaggtagagggggatgatgaagccgcatttctcgagcggctggcaaggagagaagagagacgacagaaacgcctgcaagaggccctggagaggcagaaggagtttgatccaaccataacagacgcttcactctctcttccaagcagacgaatgcaaaatgacactgcagagaatgagactactgaaaaagaagaaaagtcagaatcgaggcaagagcgatacgaaatcgaggagacagaaacagtgacaaaaagttaccaaaagaatgactggagggacgcagaagagaacaagaaggaggataaggagaaagaggaagaggaagaagagaagccaaaaaggggtagcatcggggagaatcagatcaaagacgagaaaataaaaaaggataaggaacccaaggaagaggtgaagagctttatggaccgtaagaaaggctttaccgaagtgaagagccagaacggcgaatttatgacgcacaagctgaagcacaccgagaacacctttagtagaccaggaggccgggcctctgtggacaccaaggaggcagagggggccccccaggtggaagccggtaaacgactcgaggagctgcggcgtcgtaggggagaaaccgagtctgaagaattcgagaagcttaagcaaaagcagcaggaggccgccctcgagttggaggaacttaagaaaaagcgggaggaacggcgcaaggtactcgaggaggaggagcaaagaaggaaacaggaggaggcagacagaaagctgagggaagaggaggaaaagcgcaggttgaaagaggaaatagagcgaagacgtgcggaggcagcagaaaaaagacagaagatgcctgaggatggcttgagcgatgataaaaaacccttcaagtgctttactccaaaaggctctagtttaaaaatcgaagagagggctgaattcctgaataaaagcgtccagaagtcatccggggtgaagtctactcatcaggctgctatagtgtctaagattgacagtagactggaacagtatactagtgcaatcgaagggaccaagtcggctaaacctaccaaacctgcagcttctgacttgcccgtccctgccgaaggtgtgcggaatatcaaaagcatgtgggagaaggggaacgtattctcaagcccaacagccgcagggactcctaataaggagactgctggcctgaaagtcggggtatcttctcggatcaacgagtggcttacaaagactccagatggcaacaaatcccctgcaccaaagccatctgatctgaggcctggggacgtgtcgagcaagcgaaatctttgggaaaagcagagcgtcgataaagttacaagcccaacgaaagtgtag

SEQ ID NO: 23201 - DNA, 1677 bp, Artificial Sequence
  Description of Artificial Sequence: Synthetic coding sequence
atgctgggcggcagcggcagccacggccggcggagcctggccgccctcagccaaattgcctatcagaggaatgacgacgacgaagaagaagctgctagggagcgaaggcgccgggctcgtcaggaacgcttaaggcaaaaacaggaagaggagagtcttggccaggttactgaccaagtagaagtgaacgctcagaatagtgtcccagacgaagaagccaagactaccaccaccaacacccaggtcgagggagacgacgaggctgcttttctcgagcgtcttgctaggagggaggagagacgtcaaaaacgccttcaggaagctctggagcggcaaaaagagttcgacccgaccataacagatgctagtttgagcctgccctccagacgtatgcagaatgataccgccgagaatgaaacaaccgagaaggaggaaaaaagcgagtctaggcaggaaagatatgagatcgaggaaacggagacagtgaccaagtcataccagaagaatgattggagggatgcagaggaaaacaagaaggaggataaggagaaggaggaagaagaggaggagaagcccaagcgcggatccattggcgagaaccagggagaagagaaggggaccaaagtgcaggcaaaacgggagaagttacaggaggacaagcccaccttcaagaaagaagaaattaaagatgagaaaatcaagaaagacaaagaaccgaaggaagaggttaaatcatttatggacagaaaaaagggcttcaccgaggttaaaagccagaacggggaatttatgacacacaaactgaagcatacagaaaataccttcagtcggccagggggaagggcctccgtggacactaaagaggcagaaggggccccccaggttgaagcagggaagcgcctcgaggagctgcgtcgcagacgcggtgagacagaaagcgaagaattcgaaaagttaaagcaaaagcagcaggaggccgccctggaattagaagagctgaaaaaaaaaagggaagagcgtaggaaggtgctggaagaagaagagcaaagacgaaagcaggaagaagccgataggaaactgagggaagaggaggagaaacgcaggcttaaagaagaaatcgagagacgtcgagcagaagcggccgagaagagacagaaaatgcctgaagacggtctttccgatgataaaaaaccttttaagtgctttacacctaagggtagctctctgaagatcgaagagcgggccgaattcctgaataaatcagtgcaaaaaagtagtggcgtgaaatctactcaccaggctgccatcgtcagtaagatcgattcaaggctcgagcaatacactagcgctattgaaggcacaaagtcagcaaaacctacaaagcccgctgcctcagacttgcccgtacccgccgagggcgtccggaacatcaagtctatgtgggagaaaggcaacgttttttcaagccctacagccgcagggacgccgaataaggagacggccggtttgaaggtgggcgtgtcgtccaggattaatgagtggctgactaagacccccgatggaaacaaatccccagcgcccaagccttctgatctgcgaccaggcgatgtatccagcaaaagaaatctgtgggagaagcagtcggtggataaggtcacttcccccacaaaggtgtag

SEQ ID NO: 23202 - DNA, 1617 bp, Artificial Sequence
  Description of Artificial Sequence: Synthetic coding sequence
atggacgacttcgagcggcggcgggagctgcggcggcagaagcgggaggagatgaggctggaagcagagcggatagcctatcagagaaacgacgacgatgaggaggaggccgctcgcgagcggcgccgacgggcccgccaagagcgcctgcgtcagaaacaggaggaggagtccctgggacaggtgacagatcaggtggaagtgaatgctcagaacagcgttccagatgaagaagcaaagaccacaaccaccaatacgcaggtggaaggcgacgatgaggcagcttttttggagaggctggctagacgcgaagagcgtcgacagaagcgtttgcaggaggctttagagcgtcagaaagagtttgacccaaccattactgatgcctcactgagccttcctagccggcgaatgcagaacgacaccgctgaaaacgaaaccaccgagaaggaggaaaaaagcgaatcccgccaagagcgatacgagatcgaagagaccgagaccgtcaccaagagttatcaaaaaaacgactggagggatgcggaagagaataaaaaagaggacaaagaaaaggaagaagaagaagaggaaaaacctaagcgagggtccattggggagaaccagattaaggacgagaagattaagaaggacaaggagcctaaagaagaggtcaaaagtttcatggataggaagaagggctttaccgaggtgaaatctcagaacggcgagttcatgacacataagcttaagcatacagagaataccttctcgcgccctggcggccgcgcctctgtggatactaaggaagccgaaggagccccacaggtggaagctgggaagagactcgaagagttgcgaagaaggagaggagagacagagtctgaggagtttgaaaaattgaaacagaaacagcaggaggccgcactagaactggaggaacttaagaagaaaagggaggagaggcggaaggtcctggaagaagaagagcaacgacgtaaacaggaggaagccgataggaagctgcgcgaggaagaagaaaaacgacgcctgaaagaggagatagagagacgccgtgctgaagctgcagagaaacgacagaagatgccggaggacggcttaagtgatgacaagaaacccttcaagtgcttcactccaaagggctctagtctaaagatcgaggaaagggctgagttcctgaacaaatccgtgcagaaaagtagtggcgtcaagtctacccatcaagctgcaattgtctctaaaatcgacagtcgcttggagcagtacactagcgctattgaggggactaagagcgctaaaccaacaaagccagcggcctcggacctacccgtgcccgccgaaggagtcagaaacattaaaagcatgtgggaaaaaggtaacgtcttctcaagccctactgccgccggtacaccaaacaaggagacggcaggtttaaaggtcggcgtgtctagtcgaatcaacgaatggcttaccaaaacacccgacggcaataaatcacctgcgcccaaaccttctgatttgcggcccggtgatgtttccagcaagaggaacctgtgggagaaacagtctgttgataaggtgacctccccaaccaaggtgtag

SEQ ID NO: 23203 - DNA, 1692 bp, Artificial Sequence
  Description of Artificial Sequence: Synthetic coding sequence
atggacgacttcgagcggcggcgggagctgcggcggcagaagcgggaggagatgcgtctagaggccgaaaggattgcatatcagcgcaacgatgacgatgaggaggaagctgcacgggaaagaagacgcagagccagacaggagcgtctgcgtcagaaacaggaggaagagtccctgggccaagtcacagatcaggtggaagtgaatgcccaaaactccgtccccgatgaggaagctaaaactaccacaaccaatacccaggtcgagggcgacgacgaagctgcattccttgagagacttgcccgccgagaggagagaagacagaaacgattacaagaagctttggagcgccagaaagagtttgaccccaccatcacagatgcctccctgtcgcttccttcacggaggatgcagaacgacaccgcggaaaatgaaacgactgaaaaggaggagaagtcagagtctcggcaagaaaggtacgagattgaggagactgaaacggtcacaaagtcctaccagaaaaatgattggcgcgacgccgaagagaataagaaagaggacaaggaaaaggaggaggaggaggaggagaagccaaagcgcggtagtataggggagaaccagggggaggaaaagggcaccaaagtccaggccaaaagagagaagttacaggaagacaaacccaccttcaaaaaggaagagatcaaagacgaaaaaattaagaaggacaaagagccgaaagaggaggtgaagtcctttatggatcgaaaaaagggttttacagaggttaagagccagaatggagaatttatgacgcataagctcaaacatacagagaatacgtttagtcgccctggtggccgcgccagcgttgatacgaaagaagcagaaggtgcccctcaggtcgaggcaggcaagcgcttggaggaactgcgccgtaggcggggcgagaccgagtccgaagaattcgagaaactcaagcagaaacagcaggaagcagctctcgaactagaggaactgaaaaagaaaagagaggaaaggcgcaaggtgctcgaagaggaggagcaacgcagaaaacaagaggaggccgacagaaaactcagggaggaggaagagaagagacgcctgaaagaggaaattgagcggagacgggcggaagccgcggaaaagcgccaaaaaatgccggaggacggcctgtcggacgataagaaaccattcaaatgctttacacctaaaggaagtagtctaaaaatcgaagagagagcagaatttcttaataagtccgtgcagaaatcaggcgtcaagagcactcaccaagcagcaattgtgtctaagatagattctcggttagaacagtatacctcagcgatcgagggtactaaatccgcaaagccgacaaagccagccgcttccgatttgcccgtacctgcagagggagtaagaaacatcaaaagtatgtgggagaagggaaacgttttttcctcccccaccgcagccggtacaccgaataaggaaactgccggtttgaaagtgggcgtgtcatcccgcatcaacgagtggctgaccaaaacaccagatggcaataaatcccctgcacccaagcctagcgatctgaggcccggtgacgtgtcaagcaagagaaacttatgggaaaagcagagcgttgacaaggtcacctctccaacaaaagtgtag

SEQ ID NO: 23204 - DNA, 1599 bp, Artificial Sequence
  Description of Artificial Sequence: Synthetic coding sequence
atgctgggcggcagcggcagccacggccggcggagcctggccgccctgagccagatcgcttaccagagaaacgatgacgacgaggaggaagctgccagagaacgccggagaagagctcgccaggagaggctgagacagaaacaagaagaagagagtctgggtcaggtcaccgaccaggttgaggtgaacgcacagaactctgtccctgacgaagaggcaaagaccacgacaactaacactcaggtcgaaggcgatgatgaagcagcttttcttgagcgactggcgaggcgggaggaacggaggcagaaacgactgcaggaagctttggagaggcagaaggaattcgatccaaccattaccgacgctagcctctccttaccttccagacgaatgcaaaatgacaccgctgagaacgagacgaccgagaaggaagagaagagcgaatccagacaagagagatatgaaattgaggagactgagaccgtgactaagagctatcaaaaaaacgattggcgagacgctgaggagaacaaaaaagaggacaaggaaaaagaggaggaagaggaagagaaacccaaacgagggtcaattggagaaaaccagattaaagacgaaaaaataaagaaggataaagaaccaaaagaagaggtgaagagctttatggacagaaaaaagggcttcaccgaggtaaaaagtcagaatggagagtttatgactcataagttgaaacacaccgaaaacacattttcgcgcccgggtggtcgggcctcagttgatactaaggaggccgagggagcaccccaggttgaagcggggaagcggctcgaggaattgagaaggcgcaggggggagacagaatctgaagagttcgagaagctcaagcagaagcagcaggaggctgccttggaactggaagaactaaaaaagaaaagggaagaacgacgaaaagtattggaggaagaggagcagcgccgtaagcaagaagaggctgatcggaagctgcgggaggaagaagaaaagaggagacttaaggaagagatcgagagacggcgcgccgaagcagcagaaaaaaggcagaagatgccagaggatggcttgtctgatgataagaagccctttaaatgctttacgccgaaaggcagttctttaaaaattgaagagagggctgagttcctaaacaaatctgtccagaagtcttcaggagttaaatccactcatcaagccgctatcgtgagcaagatcgattcgagactggaacagtatacctcagctatcgagggaacaaagtctgccaagcctactaaaccagcagcatctgacttgccagtgcctgctgagggtgtccggaatatcaagagcatgtgggaaaaaggaaacgtcttctcgtctcccaccgctgctggcactccaaataaagagactgccgggctgaaggttggcgttagctcgaggattaatgagtggcttaccaagaccccagatggcaataaatcacccgctcctaagccaagtgatctgcggcccggcgacgtaagcagtaaaaggaatctgtgggagaagcagagcgtggataaggtgacgagtcctacaaaagtctag

SEQ ID NO: 23205 - DNA, 528 bp, Artificial Sequence
  Description of Artificial Sequence: Synthetic coding sequence
atgcccgaggacggcctgagcgacgacaagaagcccttcaagtgcttcacgcctaaaggatcatctcttaagatagaggagagagccgaatttcttaacaagtccgttcagaagtcaggtgtaaagtccacccaccaggccgccatcgtaagcaagattgactccaggcttgaacaatacacatccgccatcgagggaactaagtctgcgaagcccaccaaacctgcagcgagtgatctaccagttcccgcagaaggcgtcagaaacattaaaagtatgtgggagaaaggtaacgttttctcatctcccactgcagccgggacacctaataaggagacagctgggcttaaggtcggagtgagctctaggattaacgaatggcttacgaagacccccgatggaaacaaatctcctgctccaaaaccatccctcacgttttgttcctctctgttcggactttggctgatcggcaacctgctgttgcttccttcgtttctgcccctacttccagagtgggtgtttctgtag

SEQ ID NO: 23206 - DNA, 219 bp, Artificial Sequence
  Description of Artificial Sequence: Synthetic coding sequence
atggacgacttcgagcggcggcgggagctgcggcggcagaagcgggaggaaatgcgccttgaggccgagcggatcgcctatcagaggaatgacgacgacgaggaggaagccgcacgtgagcgacgtcgtagggcccgccaggaacgactcagacagaaacaggaggaagagtctctgggtcaggtaactgatcaagtcgaggtcaacgcccagaactag

SEQ ID NO: 23207 - DNA, 1380 bp, Artificial Sequence
  Description of Artificial Sequence: Synthetic coding sequence
atggacgacttcgagcggcggcgggagctgcggcggcagaagcgggaggaaatgcgactggaagccgagcgaattgcttaccaacggaacgatgacgacgaagaggaggctgcacgggaaagacggcgtcgggctaggcaagagcggctcagacagaagcaggaggaggaaagtctgggccaggtcacagaccaggttgaagtcaatgcccagaatagcgttcccgatgaggaggccaagaccacaactaccaatactcaggttgagggggacgatgaagcagcgttcctagaacggttggctcgtcgcgaagaaaggaggcaaaaacgccttcaagaggccctggagaggcaaaaggaattcgatcctaccattaccgatgcttccctttcattgccatctagacgcatgcagaatgatactgccgagaatgagacaactgaaaaggaggaaaaaagcgagtctaggcaggagagatatgagatagaggagacagagaccgttacaaaaagttaccagaagaacgactggagggacgcggaggagaacaagaaggaggacaaagagaaagaagaggaggaagaggagaaacctaagagaggatcaattggcgaaaaccagattaaagacgagaaaatcaaaaaagataaagaaccaaaggaagaagtcaaatctttcatggaccgtaagaagggtttcactgaagtcaaaagccaaaacggggaatttatgacacataagctgaagcacacagaaaataccttcagcagacccggagggagggccagtgtggacacaaaggaggctgagggagcccctcaggttgaagctggaaagcgtctggaggagctgcggaggcggaggggggagactgagtccgaggagttcgagaagcttaaacaaaaacagcaggaagctgcccttgagctcgaggagctgaaaaagaagagggaggaacggagaaaagtgttagaggaggaggagcagcgcagaaaacaggaggaggctgaccggaaactccgggaggaggaagaaaaacgccggcttaaggaggaaatcgaaagacggagggccgaggccgctgagaagcgccagaaaatgccagaagatggacttagtgacgacaaaaagcctttcaagtgtttcactcctaaaggatctagcctcaagattgaagagcgagcagagtttctgaataagagtgtgcagaagagcagtggagtcaaatcaacccaccaggctgcaattgtctctaagattgacagccgactggagcagtatacaagcgccattgagggaaccaagtcagctaagcccacgaaaccagcagcctctgacttacctgtacccgccgagggagtccgcaatattaaatcttag

SEQ ID NO: 23208 - DNA, 219 bp, Artificial Sequence
  Description of Artificial Sequence: Synthetic coding sequence
atggacgacttcgagcggcggcgggagctgcggcggcagaagcgggaggagatgaggcttgaagccgaacgaattgcctaccaaaggaatgacgacgacgaagaggaagcggctagagagagacgaagacgcgcaagacaggagagactgagacagaagcaggaggaggagtcgttaggacaagtgaccgatcaggtagaggtaaatgcccagaattag

SEQ ID NO: 23209 - DNA, 1632 bp, Artificial Sequence
  Description of Artificial Sequence: Synthetic coding sequence
atgaccagctacatgaaggtggaccggcagtggaacgccgagatcttggagcttattctcggtactgggcagttgtcaacgggccagatcgcttatcagcgaaacgatgacgacgaggaggaggccgcacgcgaaagaaggcgacgagccaggcaggagcgcctgagacagaagcaggaagaggagtctctggggcaggtcacagaccaggttgaagtgaacgctcaaaacagcgtccctgacgaggaggccaaaaccaccaccacaaacacccaggttgaaggagatgacgaggcagccttcttagaaaggcttgccagaagagaagagagacgacagaaacggcttcaggaagccctcgaaagacaaaaagagtttgacccgaccatcacagacgcaagcctgagcttgcccagccgtaggatgcagaacgatactgcggagaacgagaccacagaaaaggaagagaagagcgaatctagacaagaacgttacgaaattgaggaaactgagactgttaccaagagttatcagaagaacgactggcgcgatgctgaggagaacaagaaagaggacaaggagaaagaagaagaagaggaggaaaagcctaaacgaggatcaattggcgaaaaccagattaaagacgaaaaaattaaaaaggataaggagcccaaagaggaagtgaaatccttcatggatagaaagaagggttttactgaggtgaaatctcagaatggagaatttatgacccacaaactgaagcataccgagaacacgttttcaaggccaggcggacgagctagtgttgatactaaggaagctgagggtgcaccacaagtggaggccggaaaacggctggaagagctgcggcgacggagaggagagacggagtcagaggagttcgaaaaactcaaacaaaagcagcaggaggctgcattggaactggaagagctgaagaagaagagggaagagcggagaaaagtgttggaagaagaagagcagcgacggaagcaagaggaagcggaccgaaagctgagggaagaggaggagaagaggcgcttaaaagaagaaatagagcgacgtcgggcggaggccgccgaaaagcggcagaaaatgcccgaggacggcttatccgacgataagaaacccttcaagtgttttactccaaaaggttcatctctgaagatcgaggagcgggcagagtttctgaataagtcagtgcaaaaatcatctggagtgaaatctacgcaccaagctgcgatcgtaagtaaaatcgactccagactcgaacaatacacatcagccattgaagggacgaagtcagccaaacccacgaaaccagcagcttccgatctaccagttcccgctgagggggtccggaatatcaaatctatgtgggagaagggtaacgtgttctcatcaccaaccgccgcagggacgcccaataaagagactgccggcctgaaggtgggagtctcctctaggatcaacgagtggctcactaaaacgcccgatggtaataagagcccagctcccaaaccgagcgaccttcggccaggcgacgtcagctcaaagagaaacctttgggagaaacaatcagtcgacaaggtcacaagtcctaccaaagtctag

SEQ ID NO: 23210 - DNA, 3975 bp, Artificial Sequence
  Description of Artificial Sequence: Synthetic coding sequence
atggccgacagcctgtacaacatccggctgctgcgggagttcagcaatgagtacttgaacaagtgtttttacttgaccctcgaagacatgctttatgctcccctggtacttaaacccaacgtgatggtgtttattgctgaactgttttggtggttcgagaatgtgaaaccagattttgtgcaaccaagggacgtgcaggaactcaaagatgccaaaacagtcttacatcaaaagagctctcgaccaccggttcccatcagtaatgccacaaagcggtcatttctaggcagtccagctgccggaactttagctgaactgcaaccccccgtgcagcttcccgctgagggctgtcaccggcactacctgcatcccgaggagcctgagtatctgggcaagggtaccgccgctttttctccttcccacccactgctcccattgcggcaaaagcagcagaagagcatccagggcgaagatattccagatcaacggcacaggtctaactctctgaccagagtcgacggacagccgcgtggcgcagccatagcttggccagaaaaaaagactaggccagcttcgcagcccaccccattcgcgctgcaccacgcagcttcatgtgaagtggacccttcctccggagacagcatcagtctcgcaaggtcaatctctaaggactccctggcgtcaaacatcgtgaatctcacaccacagaatcagccgcacccaaccgccacgaagagtcacggaaaaagcttgctttccaacgtctccatagaagacgaggaggaagagttagtggctattgttcgggccgatgtagtacctcagcaagcagaccccgagtttccccgtgccagccctagggccttggggctgaccgccaacgcccgttcccctcaaggacagctcgatacatctgagtcaaagccagactctttctttttggagcctctgatgccagcagtcttgaagcccgccaaggagaaacaggttataactaaggaagacgagcgcggtgagggcaggcccaggtccattgtcagcaggaggcctagcgaagggcctcagccgttggtccggagaaagatgacaggtagtagagacctgaaccgaacctttaccccaataccgtgttctgaattccctatgggcatcgaccccactgagaccggaccactcagcgtggagaccgccggtgaggtctgcggagggccccttgcgttgggcggattcgatcctttcccacaggggccttctaccgacggcttttttctgcacgtgggccgagccgatgaggataccgaggggcgactctacgtgtcttgttctaagtctcccaattcccacgatagcgaaccttggactttgctgaggcaggactctgatagtgacgtggtggacatcgaggaggcagaacatgatttcatgggggaggctcatccagtcgtgttcagtagatatattggagaggaggagagtgccaagctgcaggaagacatgaaggtcaaggaacatgaagataaggacgatgctagcggccggagcagcccatgcctgtcaaccgcctcacaaatgagcagcgtgtccatggctagtggttccgtcaaaatgacttccttcgccgaacgaaaactgcagcggctgaatagttgtgagactaaaagctcaactagttccagccagaagaccacgcccgacgcaagtgagtcgtgtccggctccactgactacctggaggcagaagcgagagcaatccccatctcaacatggtaaagatccagcatccctgttagcttctgaactggtccagctgcacatgcagctggaagaaaagcgccgtgctattgaggcacagaaaaagaaaatggaggcgctctccgcacgccagcggctcaagctgggcaaagcggcttttctgcacgtggtaaaaaaaggaaaggccgaagcagcaccaccactacgtcctgaacacttcgcaaaagaatattcgcagcataatggggaagattgtggcgatgccgtgtctaaaacagaagatttcctcgtgaaagaggaacagcgcgaggaactgcttcacgaaccacaggacgtcgacaaggaaagcttggctttcgcacaacagcacaaagccaaagaccccgtcgctctccacgagcttgagcgaaataaggtaatttctgccgccctactcgaagataccgtcggcgaagtggttgatgtgaacgaatgcgatctgtccatcgagaagttgaacgagacaatcagcacactgcaacaagcgatcctgaagatttcccagcaacaagagcagctcctgatgaaatctccaacagtacccgtaccagggagcaaaaataatagccaggaccacaaggtaaaggcacccgttcatttcgttgagcctttatcccccactggggtggccgggcaccgcaaagctccccggctgggccagggcaggaattcacgctccggtagacctgccgaactgaaagtgccgaaggaccgtccccaaggatcctcaagaagtaagacacccacaccatctgtggagactctaccccacctcaggccttttcccgcctcatcccacccccgtacaccaactgaccccggcttggacagcgcactcgagccatctggagacccccacggcaagtgtctgttcgatagttaccggctgcacgatgaatctaatcagcggacactgacactctcctcatccaaggacgctaacatcctgtctgagcagatgtctctgaaggaggtgctggacgcctcagtgaaagaagttggttcaagttcttccgacgtgtcaggtaaggaatctgtgcctgtggaagagcccctccggtcacgcgcatccctaatcgaggttgatctgtctgatctgaaggcccctgatgaggacggagagttggtctctttggacggatccgccgatttggtctctgaaggcgaccaaaaaccgggcgttggtttctttttcaaggatgagcagaaggccgaagatgagcttgccaagaaaagagctgccttcctgctgaaacagcagagaaaggccgaggaagccagagttcgcaaacagcaactggaggccgaggtggaactgaagagagatgaagcccggcgcaaagccgaggaggacagggttagaaaagaggaagaaaaggcgagaagagaattgatcaagcaggaatacctgcggcgcaaacagcagcaaattctggaagagcaggggctgggtaagcccaagtctaaaccgaagaagccgcggcccaagtccgtccaccgcgaggagtcctgcagtgactccggcacaaagtgctccagcacaccagacaatctctctcggacccagtcaggaagctcattgtcactagcttccgctgctacgactgagcctgaaagcgtgcacagcgggggaacacccagtcagagagtggaatctatggaggccctcccaatcctgtctagaaacccatctcggagcactgatagggactgggagacggcctccgccgctagtagtcttgcgtcggtagccgagtatacaggccctaaacttttcaaggagccgtctagcaagtccaataagccaatcatccataacgcaatcagtcattgttgcctggccggaaaggtaaatgagcctcacaagaattctatcctcgaggagcttgagaagtgcgatgccaaccattatatcattctgttcagggatgccgggtgtcagttccgggcgctgtattgctactatcccgacaccgaagagatctataagctcaccggcaccggcccaaaaaacatcacaaagaagatgatcgacaaattgtacaagtactcctccgatcgtaagcaattcaatctgatacccgccaaaaccatgagtgtgtcagtagacgctctgaccattcataaccacctatggcaacccaagagaccagctgtgcctaaaaaagctcagacacgcaaatag

SEQ ID NO: 23211 - DNA, 4809 bp, Artificial Sequence
  Description of Artificial Sequence: Synthetic coding sequence
atggtggacgccagcggccgggccgccgccgagggctggcggaagatggaagccccacctgacggcgctgccgacctggtgcctctggatagatatgacgcagccagggcaaagatagcggcgaacctccagtggatatgtgccaaggcttatgggcgtgacaatattcctgaagatctgagagatcctttctacgtggatcagtatgagcaggagcacataaaacctcctgtaatcaagttactgcttagctccgaattgtactgtcgggtctgctcgctaattctgaagggcgaccaagtggcggccctgcagggccaccagtccgtgatacaggcattatcacgcaagggtatctatgtcatggagtccgacgacaccccagtcaccgaatcagatctcagccgtgccccaattaaaatgagcgcacatatggccatggtggatgcattgatgatggcgtataccgtagagatgattagcatagaaaaggtggttgcctcagttaagcggttttccacctttagcgctagtaaggaacttccatatgatctggaggacgcaatggtcttctggattaacaaggtgaatcttaaaatgcgtgagatcaccgagaaggaagtgaaattgaaacagcagctgctggaaagtcccgcccatcaaaaggtgcgataccggcgggagcatttgagcgctaggcagtccccctacttccctctcctcgaagatcttatgcgcgacgggtcagatggagcagcattgctcgccgttatccactattactgtcctgaacagatgaagctggacgacatctgccttaaggaggtgacctctatggctgactcattatataatattcggttgctgcgcgagttctccaacgaatacctgaataaatgcttttatttaacattagaggatatgctttatgcaccacttgtattaaaaccaaacgtaatggtatttatcgccgaattattctggtggttcgaaaatgtaaagcctgattttgttcaaccacgagacgttcaagagctaaaggacgctaaaactgtcctccatcagaaaagctccaggccccctgtccctatttcgaacgctacaaagcggtccttcctcggctccccagcggcagggactctcgccgaactgcaacccccagtgcagctgccagctgaaggctgccatagacactacctgcacccggaagagcccgagtacctgggtaaaggcactgccgccttcagcccttctcacccactgcttccgctgaggcagaaacagcagaagagcatccagggcgaagatattccggaccagcggcaccgatcaaactccctgaccagagtcgacgggcagcctcggggcgctgcaattgcatggcccgagaaaaaaactaggccagcatcccagccgaccccctttgcactgcatcacgcggcctcatgtgaggtagatccatccagtggcgatagtattagtttggctagatcaattagcaaggattctttggcctctaacattgttaacttgactcctcagaatcagccgcatccaacagccactaagtcgcacggcaagagcctcctttcaaacgtatcgatcgaagatgaggaggaggagctagttgctatcgtgagagccgatgtcgtgcctcaacaggccgacccagaatttccgcgtgccagtcctagggccttaggattgacagctaacgcccgaagtccacagggccagctcgacacaagtgaaagtaaacctgatagcttctttcttgaaccgcttatgccagccgttctgaagccggctaaggagaaacaggtgattactaaagaggacgaaagaggggaaggccggccgcggtccatcgtgagtcgaagaccatcggaaggaccacagccactcgtccggaggaagatgaccggatcccgcgatcttaacagaacattcaccccaattccatgcagtgaatttcctatgggtattgaccctacggaaacaggaccactgtccgtcgaaaccgccggagaagtgtgtggcggacccttggcactgggaggctttgaccctttcccccaaggcccctccactgacggatttttcctgcacgtcggccgagccgacgaggacaccgagggacgcctgtatgtgagctgttctaagtccccaaacagccacgacagtgagccatggacgctacttagacaagatagcgactcagatgtggtggatattgaagaagctgagcacgactttatgggggaagctcaccccgttgtgttttcccgctacatcggggaggaagagagcgccaagctccaagaagacatgaaggtcaaggaacacgaggataaggacgacgcctcgggtagatcctctccatgcctgtcgacggcatctcaaatgagttcagtgtctatggccagtggcagcgtcaagatgacatccttcgccgaaagaaaattacagagactgaactcctgcgagactaagtccagtaccagttcatctcagaagactacccctgacgccagcgagtcatgcccggcaccactcactacctggaggcagaagcgcgagcaatctcctagtcaacacggcaaggatcctgcctcactcctggcgtcggaactggtacagctgcatatgcagttggaggagaagaggcgggcaatcgaggctcagaaaaaaaaaatggaggcactgtcagctaggcagagactgaagctgggcaaagctgcctttttgcacgtggtaaaaaagggcaaggctgaagcagctccccccctgaggccggagcactttgccaaggaatactctcagcataacggagaggactgcggcgatgccgtctccaaaaccgaggacttcctcgtgaaagaggagcagcgagaggaactgctccacgagcctcaagatgtagacaaggaatctctcgctttcgctcagcaacataaagcaaaagatcccgtggctctccatgagctcgagagaaacaaagttatctcagcagctctgctggaggacacagttggtgaggtggtcgacgtaaacgaatgtgacctgtcaattgagaaactgaatgaaacaatttccacccttcaacaggcaattctcaaaatctcgcaacagcaggagcagctactgatgaagtcccccaccgtccccgtacctggcagtaagaataattctcaggatcacaaggtgaaagcacccgtgcacttcgtagagccattatctcccaccggagtggctggccatcgcaaagctccacgcctcggtcagggaaggaactctagatctgggcggcccgccgagttgaaggttcccaaggaccgccctcaaggcagttctcgttctaaaacacctacaccaagcgtggagactttaccgcacctgcgcccgtttccagcaagctcacaccctagaactcctacagatccaggcttagattctgctttggagccatcgggagacccccacggaaaatgtctattcgactcatatcgcctgcacgacgagagcaatcaaagaacacttacactgtcatccagtaaggatgctaacatactgtctgaacaaatgtcacttaaagaagtgttagatgcctccgttaaggaggtggggtcgtctagcagcgacgtctcgggcaaggagtcggtgcctgtggaggagcctctaagaagcagggccagcctgatcgaggtggatttaagcgacttaaaggccccagacgaggacggcgagctcgtttctctcgacggatccgccgacctggtaagtgagggcgaccagaagccgggcgtcggattcttctttaaagacgaacagaaagccgaggacgagctggcaaagaagagggccgctttcctgctcaaacagcagcgcaaggctgaagaggcccgagtccggaagcagcagttagaggccgaggtcgagcttaaacgggacgaggcacggcgaaaggccgaggaggatagggtgcgtaaggaagaagaaaaggctcgtcgtgagttaatcaagcaagagtatctcaggcggaaacagcagcagatcctggaggagcagggactggggaagcccaaatcaaagccgaaaaaaccaaggcctaagtcagttcacagggaggagtcctgttctgacagcggcacaaaatgcagttcaacccccgataatctttcccgcacccagagcggttcctccttgagcctggcctcagcggccaccaccgagccagaatccgtccatagtggtggcacccccagtcagcgggtcgaatctatggaggcactgccaatcctgagtcggaatccctctagatctacagatcgggattgggaaaccgcctctgcagcatctagcctggcgtctgtcgctgaatataccggcccaaagctgttcaaggagccaagcagcaagagtaataagcccattatccacaatgccatttcgcactgctgcctggcggggaaggtgaacgagccccacaagaatagtattctcgaggaactagaaaagtgtgatgcaaatcattacataatcctctttcgtgatgccgggtgtcagtttcgcgcactgtactgttattacccagatactgaggagatctacaagctcacgggcacaggacccaaaaatatcacaaaaaagatgatagacaaactttataagtattcctcggaccggaagcaattcaacttgattcccgctaagactatgtccgttagcgtggatgcactcactattcataatcatctctggcaacctaagcggcccgccgtacctaagaaagcgcaaactagaaagtag

SEQ ID NO: 23212 - DNA, 4842 bp, Artificial Sequence
  Description of Artificial Sequence: Synthetic coding sequence
atggtggacgccagcggccgggccgccgccgagggctggcggaagatggaagctccccctgacggcgctgctgacttggtgccactggatcgctatgatgctgccagagctaagatcgcagcgaacctccagtggatctgtgctaaagcctatggccgtgacaacataccagaggacttgcgggatccgttctacgtagaccagtacgagcaggaacacataaaacctcccgtgatcaagctcctcctgagctctgaactctattgcagggtgtgcagcttaattttgaagggagaccaagtggctgccctgcaaggacaccagtcagtcatccaggccctgtctcgcaagggcatttacgttatggaatctgacgacactcctgtgacagaatcggatcttagccgagccccaattaaaatgtcagcccatatggcaatggtggatgccctgatgatggcctacaccgttgaaatgataagcatagaaaaggttgtggccagcgttaagcgattttcaactttctcagcctccaaagagctcccatacgacctcgaggacgctatggttttctggatcaacaaagttaaccttaaaatgcgggagattactgagaaagaagtgaaactgaagcagcagcttctggagtctcccgcacaccagaaatcacctagcaagtggtattggaagctcgtgcctgtgagatacaggcgcgaacaccttagcgctcggcaaagtccatactttcccctgctcgaggatttgatgagagatggctcggacggagccgcgttgctcgcggtgatacattactactgccctgaacaaatgaaactggatgacatctgtctgaaggaggtcacatcaatggctgactctctatacaacatcaggctcctgcgggagttctccaatgagtacctgaacaaatgcttctacctcacactcgaggatatgctgtatgctccgttggtgctgaaaccgaacgtcatggtctttattgcagaacttttttggtggttcgaaaacgtcaaacccgatttcgtgcaacctcgcgacgtgcaagagctgaaggatgctaaaacggtgcttcatcagaaaagcagcaggccccctgtgccaatttctaacgccacaaagagaagtttcctcggtagtcccgccgccggtactcttgcggagctgcagcctcccgtccagctgcccgctgagggctgccatagacactacctacaccccgaagaaccagagtatctcggcaaaggaaccgcagcctttagcccctcccacccactgctgcccctaagacagaaacaacaaaaatcaatccaaggagaggatatacctgaccagaggcacaggtcaaattcgttgactagagttgacggccaaccccgtggggccgccattgcttggccagagaaaaagacaagacccgcttcccaacccacaccatttgctctccaccatgcagccagttgtgaagtagatccttccagtggggattcaatctcactggcccggagcatcagtaaagactcactcgcaagcaacatagtcaatctgaccccgcagaatcaaccacatcctactgccacaaaatcacatggcaagtccctgctcagcaacgtttctatcgaagatgaggaggaagaattagtggcaatcgtccgcgcagacgttgtcccccagcaggctgaccctgaatttccacgcgcttccccacgcgctttaggccttacagccaatgctagaagcccccagggacagttggacacatcagagagcaagccagattcatttttcctggaaccattaatgcctgccgtgctgaaaccagctaaagaaaagcaggtgataactaaggaggacgagcggggagagggtcgacctagatcaattgtttcccgtagacctagcgaaggtccacagcctctggtgcgcagaaaaatgaccggctccagggacttgaatcgaactttcacgcctatcccatgttccgaatttcccatggggattgacccgacagagactgggccactgagtgttgaaacagctggcgaagtttgcggcggcccgctggcgctggggggcttcgatccctttccccagggccctagcactgatggatttttcctgcacgttgggcgcgccgacgaagataccgaggggcggttgtatgtgtcttgctctaaaagccccaactcccacgactccgaaccctggacactgttgcgacaggactctgactcagacgtggtggacatcgaagaagctgagcatgactttatgggcgaagcgcatcccgttgtgttctcccggtacatcggcgaggaggagagtgcgaagcttcaggaagacatgaaggtgaaggagcatgaggacaaggacgatgcgtctggtcggagtagtccctgcctatccaccgcttcacagatgtcatccgtcagtatggcctccggaagtgtgaaaatgacctcgtttgccgaaagaaaactgcagcgacttaatagttgcgagactaaatcctccactagctcctctcaaaagacaacccctgacgccagtgaaagttgccccgctcctctcactacctggcggcagaagcgcgagcagtctccttcacagcacggcaaagatcccgccagtctgctggccagcgagctcgtacaactgcatatgcagttggaagagaaaagacgggccatagaggcacaaaaaaagaaaatggaggcactgagtgcccgacagcggctcaagctcggcaaagccgcattcctgcacgtggttaagaagggaaaggccgaagctgcccctcccctgcgtccagaacattttgcaaaggaatacagccagcacaatggagaggattgtggcgatgccgtgagcaagaccgaagacttccttgtgaaggaggagcagcgagaagagctgctgcatgaacctcaggatgtggataaagaaagcctagccttcgcacagcagcacaaggcgaaggacccagtggccctccacgagctggagcggaacaaagtgatttcagctgcattgctggaggacacagtaggggaggtggtcgacgttaacgaatgtgacttaagtattgagaagttgaacgagacgatcagcacgctacaacaggctatcctcaagatctcgcaacagcaggagcaactgctgatgaaaagcccaaccgttccggtgccaggatccaaaaataatagtcaggaccataaagttaaggccccagtgcacttcgtagagccactttcccccaccggtgtggccggccaccggaaagcaccccggcttgggcagggtcgaaactcgagatcagggcgacccgccgagctgaaggtgcctaaggataggccccaggggagctcccggtcaaagacacccaccccctccgtcgagacattgccacacctccggcctttcccagcatcttctcaccctagaacacctactgaccccggcttagactccgccctggagccatccggcgacccccatggtaagtgcctttttgattcctacagactccatgatgagtcaaatcagcggactctgactctctcgagctcaaaggacgcaaacatactctcagagcagatgtccctcaaagaagtgctcgatgcgtccgttaaagaagtgggcagttcctcctcagatgtgagtggaaaagagtccgtgccggtggaggaaccacttcggagccgcgccagcctgatcgaagtcgacctgtctgatctcaaggcacctgacgaggatggagagctcgtgagccttgatggctctgccgatctggtatcagagggcgaccaaaagcctggagttggctttttcttcaaggacgaacagaaggccgaggacgagctggctaagaaacgtgcggctttcctcctcaaacaacagaggaaggccgaagaggctcgggttaggaagcagcagctggaggcggaagtagagctcaaacgcgatgaagcacgccgcaaggctgaggaagacagagtgcgcaaggaggaagaaaaggccagaagagagctaattaaacaagagtatctgagacggaaacagcagcagatcctggaggaacaaggcctgggcaagccaaaatccaagccgaagaaaccacggccaaaaagtgtacatagggaggagtcctgtagcgattctggcaccaagtgttccagcacacctgacaacctcagtcggacccagtcgggcagtagcctcagtctggcttccgcagcaacaactgaacctgagagcgttcatagcggcgggactcctagccaacgcgtcgagtctatggaagctctcccaattctctccaggaatccctctagaagcactgaccgcgactgggaaaccgccagcgccgcctcctcactggctagcgtagcagaatatacgggcccaaagttgtttaaggaacctagcagcaaatctaataagcctattatacataatgccataagccattgttgtctggctggcaaggtgaatgagccacataagaattctatcctcgaggagctcgaaaagtgtgatgccaaccactacataatactgttccgggacgcaggctgtcaattccgagccctttactgttactaccctgataccgaagaaatatataagcttacaggaacggggcctaaaaatatcaccaagaagatgatcgataagttgtacaaatacagctccgacagaaaacaattcaaccttataccagccaaaacaatgtcagtctccgtggatgcacttacaatccacaatcacctatggcagccaaaaaggcctgctgtgcctaaaaaagcacagactcgcaaatag

SEQ ID NO: 23213 - DNA, 1983 bp, Artificial Sequence
  Description of Artificial Sequence: Synthetic coding sequence
atgcggatgcccagcagcacctgggcccggatcatgagcagctgcgggtgtgacgcatgtagagtaggaccaagctcagttatgcgacccagcccccggtacccaagagcctgggtgacacggacctgggttcccatcccccctcgaccgatggccagctccggcagtgtgccaagggactgctggcttctggccgctatcgcctccctgactctcaacgacaccctgctgcacagggttgtgcctcacggccagtctttccagaacgggtatgcaggcatttttcacttccagctgtggcagttcggggagtgggtggacgtagtcgttgacgacctccttccaattaaagacggcaagctggtattcgttcattcagctgagggtaacgagttctggtccgcccttcttgagaaggcgtatgcaaaagtcaacggttcctacgaagccctgagtgggggatctactagtgaaggattcgaggacttcaccggaggcgtcactgagtggtacgaactgcgaaaggccccttctgacctgtaccagattatccttaaggccctggagagagggtccctcctcggatgttccatagacattagtagtgtgttggacatggaggcaattacttttaaaaagctagtgaagggccacgcctactccgtcaccggagctaagcaggtaaactaccggggacaggtggtctccctcattcgaatgcgtaatccatggggcgaggtggaatggacaggcgcatggagcgatagttcgtcagagtggaacaacgtcgacccgtatgagcgtgaccagctccgcgtcaaaatggaagacggggaattctggatgtcattcagagacttcatgcgagagtttactaggctagagatatgtaacctgaccccagacgctcttaaaagtcgaaccatcaggaagtggaatacgaccctgtatgaaggcacttggcggcgcggctccaccgccggcggttgtaggaattaccctgccacattttgggtaaacccgcagttcaagattcgtcttgacgagaccgacgatcctgacgactacggcgatcgagaatctggttgttcttttgttttggccttgatgcagaagcatcgaagacgtgagcgcagattcggcagagacatggagacaatcggatttgcggtatacgaagtgccaccggaacttgtggggcagcccgccgtccacctgaaacgggacttcttcctcgctaatgccagtagggccagatccgaacaatttatcaatttacgtgaagtttctacaagattccgactaccaccgggcgagtatgttgtagttccaagcacattcgagcctaacaaggaaggcgattttgtgctcagattttttagcgagaaaagtgcgggaaccgttgagctcgacgatcaaattcaggccaatctgccagacgaacaggttctttccgaagaagagatcgatgagaacttcaaagctctgtttcgccaactggcaggcgaagatatggaaatctctgtcaaggaacttcgaacaattctgaacaggatcatatcaaaacacaaagacctccggacaaagggctttagcctggaaagctgcaggtccatggtgaacctgatggacagagacgggaacggtaagctcgggttggtagagttcaatatcttatggaatcgaatccggaactatctgtcaatcttccgcaagtttgacctggataagagcgggtctatgagcgcctacgaaatgcggatggctatcgagtccgcaggcttcaagctgaacaagaagctttacgagcttatcatcaccaggtacagcgaacccgacttggcagtggattttgataactttgtttgctgcctcgtgaggcttgagactatgtttcgttttttcaaaaccctcgatactgatttagacggggtggtcacttttgatttgtttaaatggctgcagctcaccatgtttgcctag

SEQ ID NO: 23214 - DNA, 2145 bp, Artificial Sequence
  Description of Artificial Sequence: Synthetic coding sequence
atgagcgaggagatcatcacccccgtgtactgcaccggcgtgagcgcacaagtacagaagcagcgagctagagaattaggtctcggccgccacgaaaacgccatcaaatatttgggccaagactacgagcagcttagggtgaggtgcttgcaatcaggaactctgttccgtgatgaggcctttcctccagtgccccagagccttggctacaaggatctgggacccaactccagcaaaacatacgggattaagtggaaaagaccgactgagttgctgagcaacccacagtttatagtcgatggagccactcggactgatatctgccaaggagccctcggcgactgttggttgctggcggcaatcgccagcttgacgctgaacgacacccttcttcatcgggtcgtgcctcacggtcagtcattccagaacggctacgctgggatatttcacttccagttatggcagttcggagaatgggtcgatgtggtcgtggacgacctcctccccatcaaggatggaaaacttgtgtttgtgcactcggcagagggtaatgagttttggtccgccttgctcgagaaagcctacgcaaaagtcaacggctcctatgaagccctaagtggcggctcaacatccgaaggatttgaagattttaccggcggtgtcaccgaatggtatgaactgcgaaaagccccgtctgacctttatcagataattctcaaggccctggagcggggctccctgctaggatgcagtattgacattagttccgtgcttgatatggaggctatcaccttcaaaaaactggtcaagggccacgcctactctgtgactggtgccaagcaggtgaactatcgcggacaggtcgtgagtttaattcgcatgcggaatccttggggtgaggttgaatggactggcgcctggagcgactcctcctccgagtggaataacgttgacccatatgagcgcgatcagcttcgggtgaagatggaagatggcgagttctggatgagcttcagagacttcatgcgagagttcacaagactagagatttgtaatctgacccccgacgccttaaagagtagaaccatccggaagtggaataccacgctttacgaagggacgtggcgacggggctcaaccgcaggtggctgccggaattatcctgctaccttctgggtgaatcctcaatttaagattaggctcgacgagaccgacgatcccgatgactatggtgaccgagaaagcggatgcagcttcgttctcgccctgatgcagaagcaccgtcgcagagagcggaggttcggccgagacatggagaccatcgggtttgcggtgtacgaggtgccaccagagctcgtgggccagcctgctgttcatctcaaacgggatttctttctggctaacgcttccagggccagatccgagcaattcataaacctgagagaggttagtacccggttccggctccctcccggtgagtacgtggtggtcccaagtaccttcgagcctaacaaggaaggagacttcgttctgcgcttcttctctgaaaaatcagcaggaacagtggagctcgatgaccagatccaggccaatctgcctgatgagcaagtattaagcgaagaagaaattgatgaaaactttaaggcccttttccgccagctggccggtgaagacatggagatctctgtaaaggaactgaggacgatactgaaccgcattatttccaaacacaaggatctgaggacaaaagggttcagcttggagagttgtaggtccatggtgaatctcatggaccgtgatgggaatggcaagttaggcctggtcgagtttaacatcttgtggaatcgtattagaaactacctgtctattttccgcaaattcgatttggataaatccggtagcatgagcgcctacgagatgagaatggcaatcgaatctgctggctttaagctaaataaaaagctttacgagctcataatcactcggtattccgagccagatctcgcagtcgattttgacaattttgtatgttgtcttgtgcggctcgaaaccatgttcaggtttttcaagaccctggatacagatctcgacggcgtggttacattcgatctgtttaagtggttgcaactcaccatgtttgcctag

SEQ ID NO: 23215 - DNA, 2145 bp, Artificial Sequence
  Description of Artificial Sequence: Synthetic coding sequence
atgagcgaggagatcatcacccccgtgtactgcaccggcgtgagcgcgcaagtgcagaaacagagagcgagggagctcgggttgggtcggcatgagaatgcaattaaatatctggggcaggattatgagcaattaagggtccgctgcctgcaaagcggaacactttttagggatgaggccttcccaccagtaccccagagcctcgggtataaagatctcggccccaactcttctaagacgtacggaatcaagtggaagagaccaactgagcttttgtctaacccccagtttattgtggacggagccactcgcacagatatctgccaaggggcattgggcgattgttggctgctggctgcgatcgctagcctgaccctcaacgataccctgctccacagggttgtgccccacggccagagcttccagaacggttatgctggcattttccattttcaattatggcagttcggggaatgggtcgacgtggttgtcgatgacctcttaccaattaaggatggcaagctcgtgttcgtgcacagcgccgagggaaacgagttctggagcgccctgctcgaaaaggcctacgctaaagtgaacggctcatacgaggcccttagtggcggatccacaagtgagggttttgaagatttcacgggcggggttaccgaatggtatgagctccgcaaggcaccttctgatctctatcagattatcctgaaagccctcgagcgaggttccctgctcgggtgctcaatcgacatcagttcagtgctcgacatggaggcgattacatttaagaagctggtaaaagggcatgcgtatagtgtgactggagccaaacaagttaattatagagggcaggtggtctctctgatcaggatgcggaacccatggggcgaggtggaatggactggcgcttggtcagactcgagcagtgaatggaacaatgttgacccatatgagcgtgatcagctgcgggtcaagatggaggacggcgagttctggatgagctttcgagacttcatgcgcgagttcactcgtctggagatctgcaacctgacaccagacgctttaaaatccagaactattcgcaagtggaacacaaccttgtatgaaggcacctggcggagaggtagcacagccggagggtgcaggaattatccagccactttttgggtaaacccacaatttaaaatccgcctggatgaaacagacgatccggatgattacggcgatcgcgagtctggttgcagctttgtgctggcccttatgcaaaaacatcgacgaagggagcgtcgtttcggccgggacatggaaactatcgggtttgccgtctatgaggtaccacctgaacttgtcggccaaccagcagtgcatttgaagcgcgatttctttttggccaacgccagcagagctaggtcagaacagtttattaatctgcgagaggtgtctacaaggtttcggctcccaccaggggaatacgtggtcgtgcctagtacttttgaacccaacaaagaaggcgatttcgtactgcggtttttctccgaaaaatcagccggcacggtggaacttgacgatcagattcaggctaacctgccagatgaacaagttttgagtgaggaagagatcgatgaaaactttaaagctctgttccgtcagcttgctggtgaagacatggaaatctcggttaaggagctgcgaacaattctcaaccggattatttcaaaacacaaagacttaaggaccaaaggattttcgctggaatcatgccgatccatggtgaatctgatggacagagacgggaacggcaagctgggactggtcgagtttaacatcctgtggaacagaattaggaattaccttagcatttttaggaaatttgatctggacaagagcgggtctatgtctgcatacgagatgcggatggcaattgaaagcgctggattcaaacttaataaaaagctgtatgaattgattataaccagatactccgaacccgatcttgcagtggattttgataactttgtatgttgtctcgtgcgcctcgagactatgtttcggtttttcaagacattagatacagacctcgatggggtagtgaccttcgatcttttcaagtggcttcagctcactatgttcgcttag

SEQ ID NO: 23216 - DNA, 489 bp, Artificial Sequence
  Description of Artificial Sequence: Synthetic coding sequence
atgagcgaggagatcatcacccccgtgtactgcaccggcgtgagcgcccaggtgcaaaagcaacgagccagagagctgggtttaggccgccacgagaacgcgatcaagtacctgggccaggactatgaacagcttcgagtgagatgcctgcagagcggaaccttgtttagggatgaagctttccctcctgtacctcagagcctggggtataaggacctgggcccgaattcttctaagacctacggaattaagtggaaacgccctaccgaactgctctcaaatccccagttcatcgtagatggagctacaaggacagatatttgtcaaggcgcccttggcgactgctggctcctggccgccatcgctagcctcaccctaaatgatacgctgctgcatagggtggtcccacatggacagtccttccagaacggctacgcgggaattttccactttcaactgtggcaattcggagagtgggttgatgtttag

SEQ ID NO: 23217 - DNA, 2145 bp, Artificial Sequence
  Description of Artificial Sequence: Synthetic coding sequence
atgagcgaggagatcatcacccccgtgtactgcaccggcgtgagcgcacaggttcaaaaacagagagctagggagctggggttgggccgccacgaaaacgccatcaagtacttaggacaggactacgaacaactgagggttaggtgccttcaatccggtacactctttcgtgatgaggcctttccaccggtgccccagtccctcggatacaaggatcttgggcccaattcatccaagacctatggcattaaatggaaacggccaactgagctgctgtctaacccccaattcatcgtagatggagctaccagaacagatatttgtcagggtgccctgggggattgttggcttctggcagctatagccagcctcacactgaatgatacgttgctgcaccgggtcgtgccgcacggtcaatccttccaaaacgggtacgcagggatttttcacttccagctctggcagtttggagagtgggtggatgtggttgtggatgacctgttgccaatcaaggacggcaagctggtgttcgttcacagcgcagaaggtaacgagttctggtccgccctgctcgaaaaagcttatgctaaggtgaatggctcatatgaagctctctcaggcggctccaccagcgagggtttcgaagatttcactggaggtgtgactgagtggtatgagctgcgaaaggcaccgtccgacctgtaccagatcattctaaaggccctagagagaggtagtctgctcggctgtagtattgatatcagctctgtcctcgacatggaggccatcacttttaagaaactggtcaagggtcacgcctattccgttaccggcgctaaacaagtgaactatcggggccaagtggtgtctctgattaggatgagaaacccatggggtgaagtcgaatggaccggagcatggtccgactcgagttccgaatggaacaatgttgatccatacgagcgcgaccagttaagagtaaagatggaagacggcgaattctggatgtccttcagggactttatgagagaatttactcggctggaaatttgcaatctcacaccagacgctttgaagagcaggacgattcgcaaatggaacacaacactatacgagggcacctggcgccgtggctccacagccggcggttgtcgcaactaccccgctactttctgggtcaacccacagttcaagattcgactcgatgaaaccgacgatcctgacgactacggggaccgtgaaagcggttgttcattcgtgctcgcgctgatgcaaaagcacagacgacgagagcgcagatttggaagggacatggagacaataggctttgcagtctatgaggttccaccggagctcgtggggcagcccgctgtacacctcaaaagggacttctttttggcaaatgcctcacgcgctcgcagtgaacaattcatcaacctgagggaagtttctacgcgctttcggttgccccccggggaatacgtggtggtgccaagcactttcgaacccaacaaggaaggtgactttgtgctgagatttttctccgagaagagcgctggaacagtggagctggacgatcaaattcaggcaaacctccccgacgagcaagtgctctcggaagaagagattgatgaaaacttcaaggctctatttagacagcttgcaggcgaagatatggaaataagcgtcaaggagttgaggacaattcttaaccggatcatttctaagcacaaggatctcaggacaaagggctttagcctcgagtcttgcaggagtatggtcaatctcatggacagggacggaaacggcaagttaggacttgtcgagttcaatattttgtggaataggatcaggaattacctttcaatattccgtaagttcgacttggataagtctggatctatgtcggcctacgagatgcgtatggccattgagtccgctgggttcaaactgaataagaaactgtacgagttaatcatcacccgctatagcgagccagatctggctgttgacttcgacaacttcgtgtgttgtctggtgcgactggaaactatgtttaggttcttcaaaaccctggataccgatttagatggcgtcgtgacatttgacttatttaaatggcttcagctcaccatgttcgcgtag

SEQ ID NO: 23218 - DNA, 459 bp, Artificial Sequence
  Description of Artificial Sequence: Synthetic coding sequence
atgagcgaggagatcatcacccccgtgtactgcaccggcgtgagcgcccaggttcagaagcaaagggcccgggagctgggcctcgggaggcatgaaaatgcaataaagtacctgggtcaggattacgagcagctgagggtgaggtgccttcagagtggaaccctttttagggacgaggcgttccctcctgtgccccagtcacttggttacaaagatctcggcccgaactcctcgaagacctacggtatcaagtggaagagacctacagagttacttagcaatccccaatttattgtagatggcgcaacccgcaccgatatctgccagggagctctgggagattgctggcttctggccgcgatcgcaagtctgactctcaatgacaccctccttcaccgtgtcgtgccccacggacagagctttcaaaacggctacgcggggatctttcactttcagtag

SEQ ID NO: 23219 - DNA, 489 bp, Artificial Sequence
  Description of Artificial Sequence: Synthetic coding sequence
atgagcgaggagatcatcacccccgtgtactgcaccggcgtgagcgcgcaggttcagaagcagcgagcccgcgaactcggtttgggccgtcatgagaacgctatcaaatatctgggacaagactatgagcaactccgtgtgcgctgcctccaaagtggcactctgtttcgcgatgaagctttccccccagtcccccaaagtctagggtataaagacctgggccccaattcaagtaaaacttatggcataaaatggaagcggcccacagagctgctgtcaaatcctcagtttatcgtggatggcgccacacgcactgatatctgccagggagccctgggagactgctggctgttggctgctatcgctagtctgacgcttaacgataccctgctgcaccgggtggtgcctcatggacagtctttccagaacggctacgctggtatatttcatttccagctgtggcagttcggggaatgggttgatgtgtag

SEQ ID NO: 23220 - DNA, 492 bp, Artificial Sequence
  Description of Artificial Sequence: Synthetic coding sequence
atgagcgaggagatcatcacccccgtgtactgcaccggcgtgagcgcacaggtgcagaagcagcgcgctcgcgagctcggactgggcaggcacgagaacgccatcaaatacctgggccaggattatgaacagctccgagttagatgcttacagtcaggcacgttattccgcgatgaggccttccctccagtcccccaatctctgggttacaaggacctcggcccaaactcttctaaaacctacgggatcaaatggaagcgccccaccgagctgttgtccaatcctcagtttatcgtggacggggccacccgtactgacatttgccagggggccctgggagactgctggctattggccgccatcgcaagtctgacactcaacgacactttgcttcaccgagtcgtgccgcatggccagagcttccagaatgggtacgcaggaatcttccatttccagctgtggcagttcggggagtgggtagatgtcgtctag

SEQ ID NO: 23221 - DNA, 576 bp, Artificial Sequence
  Description of Artificial Sequence: Synthetic coding sequence
atgagcgaggagatcatcacccccgtgtactgcaccggcgtgagcgcccaggtgcagaagcaacgggccagggagttgggcctcgggagacacgagaatgccattaaatacctgggccaggattacgagcaattaagagtccggtgcctgcagtctgggactctgtttcgcgatgaggcatttccccctgtgccacagtctctggggtacaaggacctggggccaaactcctccaagacgtacggcatcaaatggaagcgtcccacagagttgctgagtaatccgcagttcatagtagacggggccacccgtacggatatatgtcagggcgcactgggtgactgctggctgttggcagcaatcgcttccctgactcttaatgacacactgctgcatcgagtcgtaccccatgggcagtcttttcagaacggctatgccggcatcttccattttcaactgtggcagttcggagaatgggtggatgtcgtagtcgatgacctcctgccaattaaagacggcaagctcgtgtttgttcattccgctgagggaaacgaattctggtcagccctgctgtag

SEQ ID NO: 23222 - DNA, 513 bp, Artificial Sequence
  Description of Artificial Sequence: Synthetic coding sequence
atgagcgaggagatcatcacccccgtgtactgcaccggcgtgagcgcacaggtgcagaaacagagagcacgggagctgggccttggtcgtcatgagaacgccattaagtatctgggccaggattacgagcaactcagggtgcggtgtttgcagtccgggaccttattcagagacgaagcgtttccccccgtgccgcagtctttaggctacaaggacttaggaccaaactcgtcaaagacctacggaatcaagtggaagcggccaactgaattgcttagcaatccccaattcatagtcgatggtgccaccaggacagatatctgtcaaggagctctaggggattgttggctgctcgcagcgattgctagtctaactcttaacgacactctgctccacagagtagtgccccatggacagtcatttcagaacggttatgctggcatttttcattttcaattatggcagttcggcgagtgggtggacgttgtcgtggacgatttgctgccgatctag

SEQ ID NO: 23223 - DNA, 369 bp, Artificial Sequence
  Description of Artificial Sequence: Synthetic coding sequence
atgagcgaggagatcatcacccccgtgtactgcaccggcgtgagcgcacaggtgcaaaagcaaagagctagagaactgggtctcggacgccacgaaaatgccatcaagtacctaggccaggattacgagcaactcagggtaaggtgtctacaaagcggcaccctgttccgggatgaggcgttccctccggtcccacaaagcctcgggtataaagatcttggccccaactcctctaaaacctatgggataaagtggaaacgccctactgagttgctctctaatcctcagtttatcgtggacggtgccaccaggacagacatttgccaaggcgccctgggagactgttggttactcgccgcgattgcttag

SEQ ID NO: 23224 - DNA, 192 bp, Artificial Sequence
  Description of Artificial Sequence: Synthetic coding sequence
atgagcgaggagatcatcacccccgtgtactgcaccggcgtgagcgcccaggtgcagaaacaacgagcacgggaacttggactggggcgacacgaaaacgccataaagtatctgggacaggactacgaacagctcagggtcaggtgtctccagagcggaacgctctttagagatgaagcattccccccatag

SEQ ID NO: 23225 - DNA, 2145 bp, Artificial Sequence
  Description of Artificial Sequence: Synthetic coding sequence
atgagcgaggagatcatcacccccgtgtactgcaccggcgtgagcgcccaggtgcagaagcagagggctagggagttaggtctgggacggcacgagaacgcaatcaagtacctgggtcaggattacgaacagttgcgggtgcggtgcttgcagagcggtacactattcagggacgaggcattccccccagtccctcagtccctcggttataaggaccttgggcctaactcttcaaaaacttacggaatcaagtggaagcgaccaacagagttactgtctaacccacagtttattgttgacggagccactcgcactgatatctgccaaggagctcttggcgattgttggctgcttgccgcaatcgcgtctttgactctgaacgataccttgctgcacagggttgttccccatgggcagtctttccagaacggctatgcaggaatcttccacttccagctatggcaattcggcgagtgggtcgacgttgtggtggacgatctgctgcccataaaggacggaaaattagtctttgtgcattctgccgaaggtaacgaattctggtcagcgcttctcgagaaggcgtatgctaaggtaaacggcagttacgaggcacttagtggcggcagtaccagtgagggtttcgaggactttacaggtggcgtgacagagtggtacgaactgcgaaaggcaccctctgatctgtaccaaatcatcctgaaggccctcgaacggggtagcctgctgggttgtagcatcgacatctcttccgtgctggacatggaagcaataacatttaagaagcttgtcaaaggccatgcttattcagtaaccggagccaaacaggtaaactacaggggacaggttgtctccttgatacgtatgcggaatccgtggggggaggtcgaatggactggagcctggtcagacagcagcagtgaatggaataacgtggacccctatgagagggaccagctccgggtcaagatggaagatggcgagttttggatgtcatttagagacttcatgagggagtttacccgactggaaatctgcaatctgaccccggatgcgcttaaatcccgcactataaggaagtggaataccaccttatacgagggcacctggcgccgcggctctacagcagggggatgcagaaattacccggccacattttgggttaatccgcagtttaagatccggctggacgagacagatgatcctgacgactatggcgaccgggagagtggatgcagtttcgtgttggccctgatgcaaaagcatcggcgccgagagcggcgatttggccgggacatggaaacaattggattcgctgtgtacgaagtgccgccagaattggtgggccagcccgcagttcacctgaagagggatttcttcctggcaaacgcctcccgggctcgatccgagcaatttatcaatctgagggaagtctctacacgtttccgattgccgcctggtgagtacgtggtggtcccttcaacctttgagcccaacaaggagggtgatttcgtcctcagattcttctcagaaaagtccgcgggcactgtcgagttagatgatcagattcaggcaaatctgcctgacgaacaggtactgtcagaggaagagatagacgagaattttaaagcgctgttcaggcaactcgctggtgaagacatggaaatttccgttaaagaacttcgtacgattcttaacagaataattagtaaacataaggacctccgtacaaaaggtttttctctggagtcttgtcgtagcatggtcaacctcatggatagagacgggaatggaaaactcggccttgtcgagttcaatatcttatggaacaggatccggaattacctgtccatttttcgaaaattcgacctggacaagtccggttcaatgtcagcctatgagatgaggatggcaatagaaagcgctggatttaagcttaacaaaaaactttacgagctaataataactcgctactcggagcctgatctggctgtggactttgataacttcgtttgttgtctggtgaggctcgagaccatgtttaggttctttaagacgctggacaccgacttagacggagtggtgaccttcgacctgttcaagtggttacagttaacgatgttcgcttag

SEQ ID NO: 23226 - DNA, 2145 bp, Artificial Sequence
  Description of Artificial Sequence: Synthetic coding sequence
atgagcgaggagatcatcacccccgtgtactgcaccggcgtgagcgcccaggtccagaaacagcgtgcgcgggagctcggcctggggaggcatgagaacgcaatcaaatatttaggccaggattatgagcagctgagagtgcgctgcctgcagtccggcacactatttcgcgacgaggcatttccgcccgtgccgcagtcactagggtacaaagacttgggccccaatagtagtaaaacttacggcattaagtggaagcgcccaacggagctgctgagtaacccacagttcatcgtggacggtgcgacacgcaccgacatttgccaaggggccctgggggactgttggctacttgctgctattgcttcacttacactcaatgataccctcctgcatcgggtggtcccacatggccaatccttccagaacggctatgccggcattttccactttcaactctggcagtttggagaatgggtggatgttgtggtggacgacctgcttccaatcaaagacgggaagctggtgtttgtccacagtgccgaggggaacgaattctggtcagctctcctcgagaaggcatatgctaaagtaaatgggagttacgaggccctgtcgggggggtcaacatctgagggctttgaggacttcaccgggggcgttaccgagtggtacgaattgcgcaaagctccaagcgacctgtatcagatcattttaaaggcgctggaaaggggatccctgctcgggtgttctatcgacatcagcagcgtgctggacatggaggctatcacctttaagaaacttgtgaagggccacgcttattccgtaaccggagccaagcaagtgaactatcgtggacaggtggttagtttgatccgtatgagaaatccttggggcgaggttgaatggactggagcttggtccgactcatctagcgagtggaacaacgtcgacccctatgagcgggatcagctcagggtgaagatggaggacggcgagttttggatgtccttcagagacttcatgagggagtttacacggctggaaatctgtaatctgacccccgatgcattgaagagccgaacaatccgaaaatggaataccacactctatgagggcacttggagaaggggcagcacggccggagggtgcaggaactatcccgcaactttttgggttaacccgcagtttaaaattcgtctggacgagacggacgatccagacgattacggcgatagagagtcagggtgtagtttcgtgttagctcttatgcagaaacatcgcaggcgggaacgccgattcggtcgagatatggaaactatcggcttcgccgtgtacgaagtgccacccgagctggtcgggcagcccgctgtacacctgaaaagggattttttccttgccaatgcttcccgcgctagaagcgaacagtttatcaacttgagggaagttagcacaaggttcaggctaccacccggcgagtatgttgtggtgccttctacttttgagcccaacaaggagggcgatttcgttttgcggttcttttctgagaagagcgcaggaactgtggagctcgatgaccagatccaggccaatctcccagatgagcaggtcctgtccgaggaggagatagatgagaacttcaaagccctattccggcagttggccggggaagacatggaaatttccgtgaaagagctcagaaccattcttaatagaatcattagtaaacacaaggacttacggacgaagggtttcagtctagagagctgtcggtccatggtaaatctgatggatcgagatggaaacgggaaattgggattagttgagtttaatatattatggaatcgcatacggaactatctgagcatatttcgcaagttcgacctggacaaatcaggatctatgtcagcttacgagatgaggatggcaatcgagtccgccggctttaaactcaacaagaaattgtacgagctgatcatcacaagatactccgagcccgatcttgctgtagacttcgacaacttcgtgtgctgtctggttcgactcgaaaccatgttcaggttctttaagaccctggacaccgacctcgacggcgtcgtgacttttgatcttttcaaatggctgcagctgactatgtttgcatag

SEQ ID NO: 23227 - DNA, 447 bp, Artificial Sequence
  Description of Artificial Sequence: Synthetic coding sequence
atgagcgaggagatcatcacccccgtgtactgcaccggcgtgagcgcccaggtgcagaagcaacgagctcgggagctcggtttggggcgacacgaaaacgccattaaatatctggggcaggattatgaacagctgagagttcggtgcctgcagtcaggcacgcttttcagagatgaggcttttccacccgtgccccaaagccttgggtataaggatctgggcccgaattcatccaagacctatggcatcaagtggaaaagaccaacagaactcctgagcaatcctcagttcattgtggacggcgctactaggactgacatatgtcagggcgcccttggagactgttggctcctggcggcgatagcctcactaacactgaatgacaccctcttgcatcgggtggtccctcacggacaatcctttcagaatgggtacgccggtatttag

SEQ ID NO: 23228 - DNA, 411 bp, Artificial Sequence
  Description of Artificial Sequence: Synthetic coding sequence
atgagcgaggagatcatcacccccgtgtactgcaccggcgtgagcgctcaggtgcagaagcagcgggctcgagaattaggattgggccggcacgagaatgccattaaatacttaggacaggactacgaacagctgagggttcggtgccttcagagtgggaccctgttcagagacgaggcgtttcccccagtaccccagtccctcggttataaggacctaggtccaaactcctcgaaaacatatggaatcaagtggaagaggcctacagagctgctgagtaatccccagttcatagtagacggtgccactaggacggacatttgtcagggagccctcggcgattgctggctgctagccgctatagcatccctgactctgaatgatacactgctgcaccgcgtggtcccttag

SEQ ID NO: 23229 - DNA, 2103 bp, Artificial Sequence
  Description of Artificial Sequence: Synthetic coding sequence
atggccggcatcgccgccaagctggccaaggaccgggaggccgccgagggcctaggatcacatgacagagcaattaaatacttgaaccaggattacgaggccctacggaacgaatgcctggaggccggcacattattccaggacccatccttccctgcaattcccagcgcattgggattcaaagaactgggtccatactcatccaaaacccgaggcatcgagtggaaacggcctactgagatctgtgctgaccctcagtttattatcggcggagcaacacgtacagatatttgccagggagcactgggcgactgttggctgttagccgctattgcttctctgactctcaatgaggaaatcctggcccgcgtagtgcctcttaaccagtcattccaagagaactacgccggaatcttccacttccagttctggcaatatggagagtgggtggaggtggtcgttgatgatcgactaccgaccaaagacggagagctgcttttcgtgcactccgcggagggatccgaattctggagcgcacttttggagaaagcttacgccaagatcaatggctgttacgaggccttatcagggggggccactactgagggctttgaagactttaccgggggcatagcagaatggtacgagttgaaaaaaccccctccaaacctcttcaaaatcatacagaaggctttgcagaagggatctctacttggttgcagcatagatataacgagcgccgccgacagcgaagcgataacattccagaaattagtcaaggggcatgcgtatagtgtcactggggcagaagaagtggaatcgaacggctccctgcagaaactgatccgaatcagaaatccgtggggcgaagtagaatggaccggcagatggaatgataactgtccctcttggaatacaatcgatcctgaggagagagaacgcctaacacgtcggcatgaagacggggagttctggatgtcattcagcgacttcttgaggcattactctaggctggaaatttgcaatttgactcccgacaccctgacaagcgacacttataaaaagtggaagctcaccaaaatggatggcaattggcggcgcggaagcaccgctggcgggtgtaggaactatcctaatacattctggatgaatcctcagtacttgatcaagcttgaagaagaggatgaggatgaggaggatggggagagcgggtgtacctttttggtgggattgatccagaagcacagacgacggcagcggaaaatgggagaagatatgcacacaatcgggttcggcatctacgaggtaccagaggaactgagcggtcagactaatatacacttaagtaaaaacttcttcctgacgaacagggcacgcgaacgctctgatacattcattaatctgcgcgaagttcttaaccgatttaaactccctcctggggaatacattcttgtccccagtacgttcgaaccaaacaaggacggggacttctgtattcgcgttttttctgaaaagaaggccgactatcaggcggtggacgatgaaatcgaagctaatctggaagagtttgacattagcgaggacgatatcgacgatgggttccggaggctcttcgcgcagctggccggcgaagatgccgagatttccgcttttgagctgcaaactatcttgcgcagggtacttgccaaaagacaggacatcaagtctgatggatttagtattgaaacctgcaaaataatggtcgatatgctggatagcgacggaagcggcaaattgggtctcaaggagttttatatcctgtggacgaagatccagaaatatcagaagatctatcgcgaaatcgacgtggaccgatccgggaccatgaattcttatgaaatgcgaaaggccctcgaagaggcgggttttaagatgccatgccagttgcaccaagtgattgtagctcgctttgccgatgatcagctgattatcgatttcgataatttcgttcggtgcttagtgcggctagaaaccctctttaagatttttaagcagctcgaccccgaaaatacgggcaccattgaacttgacttgatttcatggctttgttttagtgtgctttag

SEQ ID NO: 23230 - DNA, 2190 bp, Artificial Sequence
  Description of Artificial Sequence: Synthetic coding sequence
gcccccggccccggccgggcccccgccgagcggagcgccgagagcccccgaccattttccgctcagtacggcagacgggaccgctccatggcaggtatcgccgcaaagttagcaaaagatcgggaagccgcagagggtctgggcagccacgacagggccatcaaatacttaaaccaagattatgaagctttgcgcaacgaatgcctcgaggccggtacactgttccaagatccaagctttccggccatccctagcgcccttggcttcaaagagttaggcccttactcctcaaaaacacgcgggatcgagtggaaacggcccaccgaaatctgtgctgatccccagtttataatagggggagctacgcgcaccgatatctgtcagggggccctgggggattgctggctgctggcagccatagctagtctgactttgaacgaggagattttggcacgagtcgtgcccctcaatcagtctttccaagaaaattatgccgggatcttccactttcagttctggcagtatggggaatgggtagaagtagtcgttgatgaccggctgcctacaaaagacggagaactgctgttcgttcatagcgcagaaggatcagaattttggtctgctctcctggagaaggcctacgcgaagatcaatggctgctatgaggccctgtccggcggagcgaccactgaagggtttgaagactttactggagggatcgcagagtggtacgaacttaaaaaaccgccacccaacctatttaagatcatccaaaaggccttacagaaaggctcactgctaggctgtagtattgacataacgtccgctgcagattctgaagcaataactttccaaaaattagtgaagggacatgcctatagcgttacaggagctgaggaggttgagtccaatgggtccctgcaaaagctaatcagaataagaaacccttggggggaggtggagtggactggtcgctggaacgacaattgtccttcatggaacacaatcgatcctgaagagcgcgagcggctgacccgtaggcacgaggatggtgagttctggatgtcattcagtgattttctgcgccattattcccgcctagaaatctgcaaccttacgcctgacacattgactagcgacacgtataaaaagtggaaactgaccaagatggatggaaactggcgcagaggatctacagccgggggatgtagaaactatcccaacaccttctggatgaacccccagtatcttatcaaactggaggaagaggacgaagacgaagaagacggtgaaagcggatgtaccttcctagttgggctaatccagaagcatcgacggcgccagcgaaagatgggagaagatatgcacactatcggattcggaatatatgaagttcacccccagctgtcaggccaaactaacatacacctgagcaaaaatttttttcttaccaaccgtgctcgtgagaggagtgataccttcattaacctgagagaagttctgaacagattcaagctgccccccggtgaatatatcctggtgcctagcaccttcgaacccaacaaagacggggacttttgtattagggtcttttccgagaaaaaagccgattatcaggctgtcgacgatgaaattgaggctaacttggaagaatttgatatcagcgaagacgacatagacgatggttttcgaaggctgttcgcccagcttgccggcgaggatgcagaaatcagcgcattcgagcttcagactatcctgcggagggtactggcgaagagacaagatatcaagagtgacggtttctctattgagacttgcaaaataatggtcgacatgctggatagcgatggcagcggaaaactgggtttgaaggaattctatatcctttggacaaaaattcagaaataccagaagatctatcgcgagatcgacgtggatagatcagggacaatgaacagctatgagatgagaaaagccctcgaggaggccggatttaagatgccatgccagctacaccaagtgatagttgccaggttcgctgacgaccaacttattatcgacttcgataactttgtccgatgtctggttaggctggagacattgtttaagatatttaagcagttagaccccgaaaacaccggtacaatcgagttggacctgatctcatggttatgtttttccgtgctttag

SEQ ID NO: 23231 - DNA, 1869 bp, Artificial Sequence
  Description of Artificial Sequence: Synthetic coding sequence
atggagatctgcgccgacccccagttcatcatcggcggcgccacccggaccgacatatgtcaaggtgctttgggggattgttggctgctggcagctatcgcttccctgacactgaacgaggaaatcctggctagagtggtgcccctgaatcagagcttccaggaaaattacgctggcatttttcactttcagttttggcaatacggagagtgggttgaggtggtcgtggacgaccgcttgcccacgaaggatggagaattactgttcgttcactcagcggaggggtcggagttctggagtgcgctgcttgaaaaagcctacgcaaagattaatggttgctatgaagccctaagtggaggcgcgaccaccgaaggctttgaagatttcacagggggcatcgcagagtggtacgagctcaagaagccccccccaaaccttttcaaaataatccagaaggcactccagaagggtagcctgctgggatgctccattgatatcacctccgcagcggactccgaagctataaccttccagaaactggtgaaaggacatgcctatagcgttaccggggctgaggaagttgaatcaaacggttcactccaaaagttgatccgtatcagaaacccctggggtgaggtggagtggactgggaggtggaacgataactgcccatcttggaacacaatcgaccccgaggaacgcgagcgactaacgcgccgtcacgaagacggtgaattttggatgtcattttccgattttctgcgacactactcccgcctcgaaatctgcaatctgactcctgacactctcacgagtgatacatacaagaaatggaagttgaccaagatggacggcaactggcgccggggctcgaccgcaggaggctgcagaaattatccaaacaccttttggatgaacccccagtacttaataaaattggaggaggaggatgaagatgaagaggacggggaatctggctgtacattcctcgtgggcctcattcagaaacacaggcggagacaaaggaaaatgggagaggacatgcatacaatcggatttggaatatatgaggtacccgaagaattgtctgggcagactaacatccatctgtcgaaaaacttctttctgacaaatagggctcgagagcggtctgacacgtttattaatttgcgtgaggtgttgaatcgattcaagttgcctccaggcgagtatattctcgttccatctacctttgagcctaacaaagatggcgatttttgcattcgggtgttctccgagaagaaggccgattaccaggcagtagacgacgaaattgaggccaatttagaggagttcgacatttctgaagatgatatcgatgatggatttcggcgcctgtttgctcagttggccggggaggacgctgagatctccgccttcgaattgcagaccattttaagacgtgtcctagcaaaaagacaagatattaagtctgacggattttccatcgagacctgcaaaattatggtggatatgttggacagtgatggaagcggcaagctgggccttaaagagttctacatcctgtggactaaaatacagaaataccagaaaatttacagggaaatagacgtggaccggagcgggacaatgaatagctacgaaatgcgcaaagccttagaggaggccgggttcaagatgccttgccagttacatcaggttattgtggcccggtttgctgatgaccagctgatcattgattttgacaactttgtgagatgccttgttcgcctcgagaccctgttcaagatctttaagcagctggatcccgaaaatacgggtaccatcgaactcgatcttatctcctggttgtgcttcagcgtcctgtag

SEQ ID NO: 23232 - DNA, 396 bp, Artificial Sequence
  Description of Artificial Sequence: Synthetic coding sequence
atggagatctgcgccgacccccagttcatcatcggcggcgccacccgtacagatatttgtcagggtgccttgggagattgttggctgctcgctgctattgcttccctaactctgaatgaggagatactggcacgggtggtacccctcaaccagtcctttcaggaaaactacgctgggatttttcactttcagttctggcagtatggagaatgggtggaggtcgttgtggatgacagactccccacaaaagatggagagctactctttgtgcacagcgccgaggggtctgaattctggtccgccctcctagagaaagcatacgccaaaatcaacgggtgctacgaagccctgagcggtggagctactacagaaggttttgaagattttactggctag

SEQ ID NO: 23233 - DNA, 156 bp, Artificial Sequence
  Description of Artificial Sequence: Synthetic coding sequence
atgaagaaccgggaggccgcccgggagtgccggcggaagaagaaggaatatgttaagtgcctcgagaatagagtagccgtgcttgaaaatcaaaataagaccctgattgaggagctaaaggcactcaaggatctctactgtcacaagtccgattag

SEQ ID NO: 23234 - DNA, 984 bp, Artificial Sequence
  Description of Artificial Sequence: Synthetic coding sequence
atgaccatggagagcggcgccgagaaccagcagagcggcgacgccgccgttacggaagccgagaatcagcagatgacagtgcaggctcagcctcaaatcgctacactggctcaagtgagcatgccagctgcccatgccacctcatcagctcctaccgtgaccctggttcagcttccaaacggtcagacagtgcaggtccacggtgtcattcaggcagcacaaccctctgtcattcagagcccccaggttcaaacagttcagatctcaacaattgccgagtctgaagactcgcaagaatcagtggactctgtgaccgacagtcagaaaagacgagagattctgagtcgccgccccagctataggaagattcttaacgatttgtctagcgacgctcccggagtcccacgcatcgaggaggagaaatctgaagaagagacatcagcccccgcaatcacaactgtgactgttcccacgccaatttaccagacatcgagcggccaatacatcgccattacccaaggtggcgcgatccagctagccaacaatggcacggacggagtccagggactgcagactttaactatgaccaatgccgccgcgacccagccggggaccacaattctgcagtacgcacagacgacagatggacagcaaattctggtgccatcaaatcaggtggttgttcaggccgccagcggcgacgttcagacatatcagatcagaaccgcccccacttctaccatcgcacccggcgttgttatggcaagcagccctgccctgcctacacagcccgcagaagaagccgcccggaagcgagaggtcaggttaatgaagaaccgcgaggccgcccgcgagtgtcgcagaaagaagaaagaatatgtaaagtgcttagaaaatagagtcgcagtcctggagaaccaaaacaaaacgctgatagaggaactcaaggccttgaaagatctatactgccacaaaagcgactag

SEQ ID NO: 23235 - DNA, 693 bp, Artificial Sequence
  Description of Artificial Sequence: Synthetic coding sequence
atgaccatggagagcggcgccgagaaccagcagagcggcgacgccgcagtaaccgaagcggaaaaccagcagatgacagtgcaagctcagccccagatcgctaccctcgcgcaggtttcaatgcccgcagcgcacgccaccagctctgccccgactgtcacactggtgcagctgcccaatggtcagaccgtccaggtacacggagtgatccaggctgcgcagcccagtgtcatccagtcgccccaggtccagacggtccagtcaagttgcaaagatttgaagcgcttgttctccggtactcagatcagtacaattgcagaatctgaggacagccaggagagcgtggacagtgtaactgattcccaaaaacgccgcgagatcttgagtcggaggccgtcatacagaaagattctcaacgatctgagctcagacgcacccggcgtgccaaggatcgaagaagaaaagtctgaagaagagacgtctgcgttgccaacccagcctgccgaggaagcagctcgtaagagagaagtaaggctgatgaagaacagggaagccgcgagagagtgccggagaaagaaaaaagagtacgttaaatgcctggaaaacagggttgctgtcctagagaatcagaataaaactttgatcgaggaacttaaagccctcaaggacctgtactgccacaaatctgactag

SEQ ID NO: 23236 - DNA, 240 bp, Artificial Sequence
  Description of Artificial Sequence: Synthetic coding sequence
atgaccatggagagcggcgccgagaaccagcagagcggcgacgccgctgtaacggaagctgagaaccagcagatgactgtacaggcccaaccccagatcgccactctggcacaggtgtctatgccagcggcgcatgccacttcttccgcaccgactgtgacccttgttcaactacccaacggccaaacagtccaggtgcacggcgtgatccaggcagcccagccctcggtgattcagtag

SEQ ID NO: 23237 - DNA, 984 bp, Artificial Sequence
  Description of Artificial Sequence: Synthetic coding sequence
atgaccatggagagcggcgccgagaaccagcagagcggcgacgccgccgtgacagaggcagagaaccagcagatgaccgtccaggcacagccacagattgctacactcgcacaggtcagcatgcctgccgcccacgccacttccagcgcgccgacagtgacactggtgcagctccccaacggccagacagtgcaggtacacggcgtaatccaagctgcccagccctcggtgattcagtcaccccaggtacagactgtccagattagtaccatcgcagagagtgaggactcccaggaatctgtggactccgttaccgacagtcaaaagaggcgtgagattctaagccgacgcccatcctaccgcaagattctgaacgatcttagcagcgacgcaccaggggtcccccgcattgaagaagaaaaatctgaggaagagactagtgccccggccataaccaccgtgacggtgcctactcccatctatcagacctccagtgggcagtacatcgctattactcaaggaggggcgattcagctggctaacaacggcacagacggagtgcagggcctgcagactctaactatgaccaacgcagccgccacgcagcctgggaccacgatcctccagtacgcacaaacaactgacgggcagcagatcctggtgccctcaaaccaggtggtggtgcaagctgcttctggagatgttcagacatatcagattcggacggcccctacaagtacaatcgcacccggggttgtcatggcttcctccccagcactacccacgcaacctgcagaagaggcggcccgcaaacgggaagtgcgtctgatgaagaatcgggaggcagctagggaatgcaggagaaagaaaaaagaatatgtcaagtgcctggaaaaccgggtggccgtcctggagaaccaaaataaaactctgatcgaggaactgaaagccctcaaggacctgtattgccacaagtcagattag

SEQ ID NO: 23238 - DNA, 1026 bp, Artificial Sequence
  Description of Artificial Sequence: Synthetic coding sequence
atgaccatggagagcggcgccgagaaccagcagagcggcgacgccgccgttaccgaagccgaaaaccagcagatgacagtccaggcgcagccccaaattgccacactggcccaggtttctatgccggccgcccacgcgactagctcagcacctaccgttacattggtgcaattgcctaatggtcagaccgtccaggttcacggggtcatccaagcagctcagccatcagtcatccagagccctcaggtgcaaactgttcagtccagctgtaaggatcttaagcgcctgttctccgggacccaaatctcaaccatcgccgaatccgaggatagccaggagtcagtcgacagtgtcactgattcacagaagaggagggagattctgtcacggcgcccctcttatagaaagatactcaacgatctgagtagcgatgccccaggcgtcccccggatagaggaagagaaatccgaggaggaaactagtgccccagccatcacaactgtgaccgtccctacgcccatctatcagacatcttccggccagtatatcgcaatcacgcagggaggcgcgattcaactcgccaataatggtaccgacggtgtacaggggctgcagacgctgacaatgactaatgctgcagccacccagccaggaacgaccattctgcagtatgctcagactactgatgggcagcagatcctcgtccctagcaaccaggtagttgtgcaagcagcaagcggggacgttcaaacatatcaaatccggactgcccccacatctacaatcgctcctggcgtagtaatggcatcatcaccagcgctgccaacccagccagcggaagaagccgctagaaaaagagaggtgcgcctgatgaaaaacagagaggccgcacgcgagtgtcggaggaagaagaaggaatatgtgaagtgtctcgagaatcgggtagccgtcctggaaaaccagaacaagaccttgatagaagagcttaaagcactgaaagacctctactgccataaaagtgattag

SEQ ID NO: 23239 - DNA, 549 bp, Artificial Sequence
  Description of Artificial Sequence: Synthetic coding sequence
atgaccatggagagcggcgccgagaaccagcagagcggcgacgccgccgtgacagaagccgagaaccaacagatgactgtccaggctcaacctcagatcgcaactttagcacaggtcagcatgccggcagcgcacgccacgtcgtccgcgcctaccgtcactctcgtccagctgcctaatggacagactgttcaagtgcacggggtgatccaggcagctcagccatctgtaatccagtctccccaggtacagaccgtgcagagctcgtgtaaagatctgaaaaggctgttctccggcacccagattagcacaatcgcagagtcggaagatagccaggaaagcgtggattcagtgaccgatagccagaagcggcgcgaaattctgtctaggcgaccctcctatagaaaaattcttaacgacctgagctcagacgctcccggggtgcccagaatcgaggaggaaaagagcgaagaggagacttccgctccagcgattacaacagtgaccgtgcccactccgatttaccaaacaagctcaggtcagtactag

SEQ ID NO: 23240 - DNA, 399 bp, Artificial Sequence
  Description of Artificial Sequence: Synthetic coding sequence
atgaccatggagagcggcgccgagaaccagcagagcggcgacgccgcggtgaccgaagccgagaatcagcaaatgacggtgcaggctcagccccagatcgccactctcgcccaggtgagcatgccagcagctcacgccacgtcttctgcacctaccgtgactctcgtacagctgcccaatggccaaaccgtccaggtgcacggcgtcatccaggccgcacagcctagcgtgatccagtctccacaagtgcagacagtgcagagttcttgtaaagacctgaaacggctcttctctggaacacagatctcaacaatagccgagtccgaagactcccaggaatcagtggatagcgtgacagattctcaaaaacgccgcgagatactatctagacggccgtag

SEQ ID NO: 23241 - DNA, 705 bp, Artificial Sequence
  Description of Artificial Sequence: Synthetic coding sequence
atgaccatggagagcggcgccgagaaccagcagagcggcgacgccgctgtgacagaggctgagaaccagcagatgaccgtacaggcacagcctcagattgccacgctggcacaggtatcaatgccagccgcacacgctaccagcagtgctccgactgtgaccctcgtccagctgcctaacggccagaccgtccaggtgcacggtgtaatccaggcggcgcaaccaagcgtgatccagtccccccaggtgcagacagtccagatctctaccattgcagagtccgaggactcccaagaatccgtggattctgtcacagacagccagaaaagaagggagattctgtcccgccgcccttcctaccggaagattcttaatgatctgagttcggatgcacctggagtgccccggatcgaagaggagaagagtgaagaggaaactagcgcccctgcgattactaccgtgaccgtgcccactcccatttatcaaacgagttctggccagtacatcgccattacacagggcggggctattcaacttgctaataacggcacagatggcgtacagggcctgcagaccctcaccatgaccaacgctgctgctacacagccaggaacaaccatactgcagtatgcccaaaccactgacggtcagcagatactggtgccatctaaccaggtagtggtccagggaacccagaagctctag

SEQ ID NO: 23242 - DNA, 462 bp, Artificial Sequence
  Description of Artificial Sequence: Synthetic coding sequence
atgcccgccgcccacgccaccagcagcgcccccaccgtgaccctggtgcagctgcctaatggacaaaccgttcaggtacatggcgtgatacaggctgcacagccgtcagtcatacagtctcctcaagtgcagaccgtgcagagttcctgcaaggacctgaagagattgttcagcggaacccagattagcactatcgcggagtccgaagattcccaggagtcagtcgattccgtgacagacagccaaaagaggagggagatcctgagcaggcggcccagctaccggaagatactcaacgacctgagtagcgacgcccccggcgtcccaaggatagaggaggaaaagagtgaagaggaaacttctgcccctgcaattactaccgtgacagttcctacccccatataccaaacgagctccggtcaatacacttacttgagggatacaacatacagctgccagtag

SEQ ID NO: 23243 - DNA, 1998 bp, Artificial Sequence
  Description of Artificial Sequence: Synthetic coding sequence
atggcccacgagatgatcggcacccagatcgtgaccgagcggctggttgctctcctggaaagcggtaccgagaaggtcctgttaatcgacagcagaccattcgtagaatataacacaagtcatatcctggaggctatcaacattaactgttcgaaactgatgaagcggaggttacaacaagacaaagtgcttatcacggaactcattcagcacagtgctaagcacaaggtagacatagattgctcacagaaagtggtagtgtacgaccagtctagccaggacgtggcaagtctctcttccgactgtttcctcaccgtgttgctggggaaactggaaaaatccttcaacagcgtgcacctgcttgcagggggatttgccgaatttagccgatgctttccagggctgtgtgaggggaaaagtaccctcgtgcccacctgtatttctcagccatgtcttcctgtcgcaaacatcgggcctacgagaatcctgcccaatctctatttgggatgccagagggacgtactcaacaaggagctgatgcagcagaacggtattgggtatgtacttaacgccagcaacacgtgtcccaagccagactttattccggaatcccatttcttgagagtgccagtgaatgattctttttgcgagaagatcttgccctggctggataaatctgttgattttatcgaaaaagctaaagccagcaatgggtgcgtgctcgttcactgtttggccggcatttcacgatccgccacaatcgcaattgcttatattatgaaacgtatggatatgtcgctcgatgaagcttaccggttcgtgaaggaaaaaagacctacgatttcacctaattttaactttttgggtcagttgttggactatgagaagaagataaaaaatcagaccggcgcctccgggccgaaaagcaagcttaaattgttgcatctcgagaagccgaacgagcctgtccccgccgtatccgaaggcggacaaaaatctgaaacccctctgtcgccgccttgcgccgactccgccacatctgaggccgcaggccagcgcccagtacacccagcctctgtaccttcagtgccttctgtccagccatcgttgctggaagattcccccctggtccaggccctatcaggcctccaccttagtgctgaccgcctggaggatagtaataagctgaagcggagcttctcactggacataaagtcagtctcttattcagcctctatggccgcaagcctccatggttttagctctagtgaggacgccctggaatactacaaaccatccaccacactcgacggaaccaacaagctgtgtcaattcagtccggtgcaagaactgagcgaacagaccccagaaacgtcccctgacaaggaagaggcaagtatacccaaaaaactgcagaccgcacgtccaagtgattcccaatctaaacggctccattccgtgagaacttcatcttcgggtactgctcaacggagccttctgtccccacttcacaggagcggttccgtggaggacaattatcacacatctttcctattcggccttagcacctcccagcagcatcttacaaagtcagcgggactgggactaaagggttggcactcagatatcctcgctccacagacttcaaccccatccctcactagctcttggtattttgctaccgagtccagccacttctatagcgcttctgccatttatgggggctctgcctcctattcagcatacagctgctcccaactgccaacatgtggcgatcaagtctattctgttagaagaaggcagaaaccttccgatcgtgccgacagccgccggtcatggcatgaggagtcaccatttgaaaagcagtttaagagaaggtcctgtcagatggagtttggggagtctatcatgtccgagaatcggagccgggaagaactgggcaaagtgggaagccagtcaagcttttcagggtccatggaaattatcgaagtatcctag

SEQ ID NO: 23244 - DNA, 939 bp, Artificial Sequence
  Description of Artificial Sequence: Synthetic coding sequence
atgcggatgctgctggccctgctggccctgagcgccgcccggccctcagcttcggccgaatcccactggtgttacgaagtccaggctgaatcttctaattacccttgtctggtgccagtcaaatggggtggtaattgtcagaaagatagacagtcccccataaacatcgtgacaacaaaagctaaggtcgataagaagcttggcaggttttttttctccggatacgataagaaacagacctggacagtccagaataacggccacagcgtcatgatgctcctcgagaacaaggccagcatcagcggtggcggccttcctgccccatatcaagctaagcagctccacttgcactggtcggaccttccttataagggcagcgagcattcactggacggggagcattttgctatggagatgcatatcgttcacgagaaggagaagggcactagtagaaacgtgaaggaggctcaggaccctgaggacgagatcgctgtgctcgcgtttcttgtcgaggctggcacacaagtgaatgaagggttccagccacttgtggaagcccttagtaatatacctaaacccgagatgtccacaacgatggctgagtctagcttgctggacctcctgccgaaagaggagaagctgcgccattatttcaggtacctggggagcctaacaacgcctacttgtgacgagaaagtggtctggactgtgtttcgggaaccgatccagctacaccgcgagcagatcttggcatttagccaaaagctctattatgataaggagcagaccgtgtcgatgaaagacaacgtgcgcccactgcagcagctgggccagcggacagtgatcaaatccggagcaccagggcggcctctcccgtgggcacttccagctctgctgggacctatgttggcatgtctgttggccggtttcctgagatag

SEQ ID NO: 23245 - DNA, 1380 bp, Artificial Sequence
  Description of Artificial Sequence: Synthetic coding sequence
atggcccccctgtgccccagcccctggctgcccctgctgatccccgcccctgcacctggacttaccgtgcaactgctgttgtctcttttattactggtcccagtgcatccacagagactaccaaggatgcaagaagacagccccctgggtggagggagcagcggcgaagatgatcctctgggtgaagaggaccttccctcagaagaagactccccacgcgaggaggaccctcccggagaggaggacctgccaggggaggaggacctgcccggtgaggaggaccttcctgaagtgaaaccaaagtctgaggaagaggggagcctgaagctggaggacctacccacagtggaggctcccggtgacccccaggagcctcagaataacgcccatcgcgataaagaaggagacgatcagtctcattggaggtacggcggagacccgccctggcctagggtctccccagcatgtgccgggcggtttcagtctcccgtcgacatccgacctcagctcgcagctttctgccccgctttgaggcctctcgagctcctgggcttccagctgcccccactaccagaactccgactccgcaataatgggcactctgtgcagctgactctcccaccgggactcgagatggcccttggacccggacgcgaatacagggccctgcaacttcatctccactggggggcggcaggaaggcccggctcagagcatactgtggaaggacacaggttccccgccgaaatccatgtggttcaccttagtacagccttcgctcgggtggatgaggctttagggcgccccggaggcttagccgtgctggccgcttttctggaggagggccccgaggagaattccgcctacgaacagctgctcagccggctagaggaaatagcagaggaggggagtgaaacccaagtcccaggtctcgatattagcgctctgttgcccagcgactttagcaggtatttccaatatgaggggtctctgacaacaccgccatgcgcccagggcgtgatctggaccgtcttcaatcagaccgttatgctgagcgccaaacagcttcacaccctctctgatacgttgtggggacctggcgattctcggctccagcttaatttcagagcaactcaaccactgaacggccgtgtgattgaagcctcttttcctgcaggcgttgactctagtcctagggccgctgaaccagtacaactcaattcctgtcttgccgcaggcgacatactggctcttgtgttcggcttgctgttcgctgtaacctcagttgcgtttttggtgcaaatgcggcgacagcaccgcagaggcacaaaggggggcgttagctatagacctgcagaggtggcagaaactggcgcctag

SEQ ID NO: 23246 - DNA, 1071 bp, Artificial Sequence
  Description of Artificial Sequence: Synthetic coding sequence
atggcccccctgtgccccagcccctggctgcccctgctgatccccgccccagccccaggattgaccgtgcagttgctgctgagtctgctgcttctggttcctgttcatcctcagcgccttcctcgcatgcaggaagactcgccactcggcggggggagtagtggggaagatgatcctctgggggaagaggatcttccttctgaagaggatagtcctcgcgaagaggatccccccggtgaagaggacctacccggagaggaggatttgcccggggaggaggatctcccagaagtcaagcccaagtccgaggaggaggggtccctcaaactggaggacctgcctactgttgaagcgcccggcgaccctcaggagccacaaaataatgctcaccgagacaaagaaggagatgaccagagccactggcgctatggcggggaccctccttggccaagggttagcccggcctgcgccggcaggtttcaatctcccgtggatattcgcccccaactggctgcattttgccctgcattgaggcctttggagcttttggggttccagttaccccctttgcccgagctgaggctgcgaaataatgggcattccgtgcaactgacccttccaccaggccttgaaatggctcttggccctgggcgcgagtacagagccctgcaattgcatctgcactggggagccgctggcagacctggttccgaacacaccgtggagggccaccggtttcccgccgagatccatgtggtgcatttgtctaccgccttcgctcgggtcgacgaggccttagggcggcctggtggactggcggtgcttgccgccttcttggaggagggccccgaggagaacagcgcttatgagcagctgttgtctcggctagaagagatcgctgaggaaggatcagaaacacaggtgcctgggttggacatctcggcgctcctgccctcagacttctctcgttactttcagtacgagggctccttaacaacccccccttgtgcccaaggggtgatttggaccgtgtttaaccaaactgtcatgctcagcgctaagcagagctag

SEQ ID NO: 23247 - DNA, 2775 bp, Artificial Sequence
  Description of Artificial Sequence: Synthetic coding sequence
atgcccggccccagccccggcctgcggcgggccctgctgggcctgtgggcagccctggggctgggcctcttcggcttgtccgccgttagccaagagcccttttgggctgacctacagcctagggtggcatttgtggagagaggcggtagcctgtggttaaactgcagcaccaactgtcctcgccccgagaggggagggctagagactagcctgcgtcgaaatggaacacagcggggtcttcgctggctggcaagacagctggtggatataagggaacctgagacgcagcccgtttgcttcttccggtgcgcccgacgaaccctccaggcgcgtgggctgatccggacgttccaaaggcccgacagagttgagctgatgcctttaccgccgtggcagccggtcggcgagaattttacactgtcttgtcgagtgcctggcgcaggcccgagggcttcactcaccttgaccctcctgcggggggctcaggaactgatacggaggagcttcgccggcgaacccccaagggcccgcggagcagtgctgactgcgacggtcctggctcgtagagaagaccatggagctaatttctcctgcagggccgagctagacctccggcctcatggtttgggtttattcgaaaacagctccgcacccagagagctgaggactttttccttgagtcctgatgcaccgcgcctagcagcgccccgactgttggaggtcggctccgagcgtccagtgtcatgcacattggatggcctctttcccgcatcagaggccagggtgtatctggcactcggagaccagaacctgagcccagacgttactttggagggggatgccttcgtggcaacagcgacagccacagcctcggcagagcaggaaggcgcgcggcaactggtgtgtaacgtcactcttggaggggagaatcgtgagacccgggaaaatgttactatctactcatttcccgcccccctcctcaccttgtctgagccgtcggtgtccgaggggcagatggtgacagttacgtgcgccgctggcgctcaagcactcgttaccttggagggcgttccagccgcggttccgggccaacccgcacagctgcagctgaatgctaccgaaaatgacgacaggcgctcctttttctgcgacgctactctggatgtggatggggaaactctcatcaagaatcgcagcgccgagctgcgcgtactgtacgcacccagactggatgactccgattgcccacggtcctggacctggccagagggtcccgagcagactctgcgctgtgaggccaggggcaaccccgagccctcagtacactgtgcccgcagcgacgggggagccgttttggccctcggtttactggggccagtgacacgagcgctgtccgggacatacaggtgtaaagccgctaatgaccaaggcgaggctgtaaaagacgtgaccttgacagtggaatacgcccccgccctcgactcagttggatgtccagagaggatcacgtggcttgagggtacggaagcttccctgtcttgcgtagcccacggggttccccctccagacgtcatatgtgtgaggagtggagaactaggggccgtgatcgaagggctgctgcgcgttgccagggagcacgcggggacatatagatgtgaggccacgaacccgcgggggtccgccgctaagaacgtcgccgttaccgtagagtatggaccccggttcgaggaaccatcttgcccaagcaactggacatgggtggagggatccggccgactgttcagctgtgaagtcgacggcaagccccaacccagcgtgaagtgtgtgggaagtgggggtgcaaccgagggtgtgttgctgcctcttgcaccacctgaccctagccctcgcgctccacgcattccgcgcgttctggcccctggaatttacgtgtgtaacgctaccaacaggcacggcagcgtggcaaagaccgtggtggtcagtgcggaatcaccccccgaaatggacgaatccacgtgtccttcacaccagacgtggcttgagggcgccgaagcaagcgcgctggcctgcgccgcacgcggccgaccctctccaggcgtgcgttgctctcgggaggggataccctggccagaacagcagcgcgtaagtagagaggatgcagggacttaccattgtgtcgccactaacgcccacggtactgattcacggactgtgactgtaggcgttgagtacaggccggtggtcgccgagctggcggcctcgcctcccggtggcgttcgcccaggcggaaattttacgctcacctgtcgtgcagaggcatggccacctgcgcagatttcttggagggcccccccaggtgccctgaatattggcctctcgtcaaacaactcgaccctcagcgttgccggagcaatggggtcccacggaggcgaatacgagtgtgcggccactaacgcacatggccgtcatgctcggaggatcactgtccgcgtggctgggccctggctgtgggtggcggtcggcggtgcagcagggggggccgccctccttgccgccggcgctggtcttgccttctacgtccagtctacagcttgcaagaagggggagtataatgttcaggaagccgagtccagtggcgaggccgtgtgcctgaacggagccgggggaggagccggaggcgcagcaggcgcggagggaggacccgaggcggctggcggcgccgcggaatcgccagccgagggagaggtgtttgccatccagcttactagcgcatag

SEQ ID NO: 23248 - DNA, 1263 bp, Artificial Sequence
  Description of Artificial Sequence: Synthetic coding sequence
atggagagccccagcgcccccccccaccggtggtgcatcccctggcagcgactgctactcaccgcctccctgctgacattctggaatccacccacaaccgccaagttgactatcgaaagcactccattcaatgttgcagagggtaaagaagttttgctgctggtgcacaatctgccacagcacctctttgggtactcatggtataaaggcgaaagagtggacgggaacaggcagattatcgggtacgtgatcggcactcaacaagcgaccccaggtccagcctacagcggtcgggagattatttaccccaacgcatccttactgattcagaacataatccagaataagctttcagttgaccattctgaccctgtcatcctgaacgtgttgtatggcccagacgaccctaccatttcaccaagctatacctattacaggcccggcgtcaacctaagcctatcatgccatgcagcttcaaatcccccagcccagtattcctggttgattgacgggaatatccagcaacatactcaagagctattcatttccaacattacggaaaaaaattcagggttgtacacttgccaagctaacaactcagcttcagggcactcccgaaccaccgtgaaaacaataacagtaagcgcagagcttcccaagcccagcatatcttctaacaatagcaagccagtggaggacaaagatgccgtagcatttacatgcgagcctgaggcgcagaacactacctacctctggtgggtcaacgggcaaagcctgcccgtatccccacgtctgcagctttccaatggcaaccggactctgaccctgtttaatgtcactcgaaacgacgcccgggcctatgtatgtggtatccagaatagcgtctctgccaacagaagtgacccagtaacattggatgtgctttatggtcccgacacgcccattatatctccacccgattcgagctacctgtccggcgccaatttaaacctttcctgccactccgcttccaatccttctcctcagtactcctggcggattaatggcatcccacaacagcatacacaggtcctatttattgcaaaaatcactccaaataataacggtacatacgcatgctttgtctccaatctcgcgactggtagaaataactctattgtcaaaagtattaccgtgtcagcctctggcactagccctggcttatctgccggagccacggttggaattatgattggggtcctagtaggagtagcacttatatag

SEQ ID NO: 23249 - DNA, 2109 bp, Artificial Sequence
  Description of Artificial Sequence: Synthetic coding sequence
atggagagccccagcgcccccccccaccggtggtgcatcccctggcagcgcctgctcctgaccgcaagcctgcttacattttggaatccaccaacgaccgcgaagttaacaatcgaatccactccatttaatgtagcagaaggcaaggaagtcctgctgctggtgcataacctaccccagcacctgttcggttattcctggtataaaggagagagagttgacggcaaccgtcaaatcatcggatatgtgattggtacacagcaggctacacccggaccagcatacagcggcagggaaatcatctatccaaatgcctcgctgttaatccagaacatcatccagaatgacactggcttttatacattacacgtcatcaaatcggacctcgtgaatgaagaggctaccggacagttccgagtgtaccccgaactgcccaagccaagcatctcttctaacaattcgaaacctgtagaagataaggacgccgtcgctttcacatgcgaaccggagacccaggatgctacttacctttggtgggtgaacaaccagagtctgccagttagcccaagactgcagctgagtaacggcaaccggactcttaccctttttaatgtcaccaggaatgacaccgcgagctacaaatgcgagactcagaaccctgtgtctgctaggcggagcgatagtgtcattctaaatgtgctgtatgggcctgacgcccccaccattagccccctgaacaccagttacagaagtggggagaatttgaacctatcgtgccacgcggcaagcaacccaccggcccaatactcttggttcgtaaatggaacctttcagcagtccactcaggagttatttatcccaaacataaccgtgaataacagtgggagctatacctgccaggcacacaactctgacaccgggttaaatcgcacgactgtgactacaatcacagtgtacgctgagccacccaaacccttcattaccagtaacaattcgaaccccgtggaagacgaagatgccgtagccctgacttgcgaacctgaaattcagaacactacttacctgtggtgggttaacaaccagagtcttcctgtgtcccctcgcctgcagctgagcaacgacaatagaactctgaccctcctgtctgtcactcggaatgatgtgggcccatatgagtgcgggattcagaacaaactctctgtcgaccactccgatcccgtgatcctgaatgtcctgtacggacctgatgatcctaccattagccctagttacacatactaccgtcctggggtgaacctgtctctctcttgtcacgcagcctctaatccccctgcccaatacagctggctgatcgatggtaatatccagcaacatactcaggagctgttcataagtaacattacggagaagaattccgggctttatacatgtcaggcaaataacagtgcctcaggacatagtcgtaccacggtcaaaacaataaccgttagcgcggaacttcccaaaccctctattagctccaataatagtaaacctgtcgaggacaaagatgcagtggcattcacctgcgaacctgaggcccagaatacaacttacctctggtgggtgaatggtcagagcctcccagtgtctccgcggctccaactttccaacggcaaccgaaccctcacattgttcaacgtcacaaggaacgacgcaagagcctatgtatgtggcattcagaattccgtcagcgcaaatcggtctgatccagttactctggatgttctgtatggccccgatactcctataattagccctcccgacagcagctacctgtctggcgccaatctcaatttgagttgtcatagcgcctcaaatccgtcacctcagtactcttggagaatcaatggaatcccacagcagcatacccaggtcctgttcatcgccaaaatcacacctaacaataatggcacatacgcatgcttcgtttcaaatttggccactgggcggaacaactcaatagtgaaaagtattacggtgtccgcatccggcaccagtcctggcctgagtgcgggcgctacagttggcattatgataggggtactggttggggtggccctgatttag

SEQ ID NO: 23250 - DNA, 1035 bp, Artificial Sequence
  Description of Artificial Sequence: Synthetic coding sequence
atgggcccccccagcgcccccccctgccggctgcacgtgccctggaaagaagtcctgctaactgccagcttgctcactttttggaaccccccaaccacagcgaagctgacaattgagtcaactcctttcaacgtggccgaaggcaaggaagtcctgttgctggcacacaacctcccccagaacaggatcggatactcctggtacaagggggagcgggtggacgggaattcactaatcgtgggatatgtgatcggaacccagcaagccactcctgggccggcctatagcggtagagagaccatctaccccaatgcctctttactgatccagaatgtgacgcagaacgacaccggattctatacgttgcaggtcattaaatctgacctggttaatgaggaagccacaggacagttccacgtgtacccagagctgcctaagccatccatctccagcaacaactcaaaccccgtcgaagataaggatgctgtggcatttacctgcgagcctgaagttcagaacacaacctatttgtggtgggttaatggacagagtttgcctgtctcccccaggctccagctctccaatgggaatatgactctaaccttgttgtctgttaagagaaatgatgctgggtcctacgagtgcgaaattcagaaccctgccagcgctaatagatccgatcccgtgacgctgaacgtgctttacggacccgacggaccaaccatttctccttccaaagcaaactacagaccgggcgaaaacctgaacctttcatgtcatgctgcaagtaacccccccgcccagtacagctggtttatcaacggtacatttcagcagagcacccaggagctctttattcccaacattacggtcaacaatagcggatcgtatatgtgccaagcccataattctgctacagggctcaacagaacgaccgtgactatgattacggtgtcaggttctgcccctgtcttgtccgcagtggcaaccgtgggaatcacgattggcgtactggcccgggtcgctctaatctag

SEQ ID NO: 23251 - DNA, 1977 bp, Artificial Sequence
  Description of Artificial Sequence: Synthetic coding sequence
atggtgccccggctgctgctgcgggcctggccccggggccccgccgtgggcccaggcgcaccctcccgccctctgtccgccggcagtggcccaggccagtatcttcagcgcagcattgtgccaaccatgcactaccaggattctcttcctagattgccaatcccaaaactggaagatactattaggagatacttgtccgcccaaaaaccactcctgaatgatggacagttcaggaagacggagcaattctgcaaatctttcgagaacggtatcggaaaggagttgcatgagcagctggtggcgctggataaacagaataagcacacctcttacatatcaggcccctggttcgacatgtacctcagcgctagagactctgtcgtgctcaacttcaatccattcatggcgtttaatccagatcctaagagtgaatacaatgatcagctgactcgagcgaccaatatgaccgtctcagccatcaggttcctgaaaactctgcgagctggacttttagagcccgaggtgttccatctcaatcctgcgaagtcagataccattacttttaaaagactgatccgattcgtccctagctccctctcgtggtacggcgcatacctggttaacgcctaccctttggatatgtcccagtactttaggctttttaacagcaccaggttgccaaagccctctcgtgacgagttgtttactgacgataaagctagacacctcctcgttctgagaaaaggcaatttttacatctttgacgtgctcgaccaagacggcaatatcgtatctcccagtgagattcaggcccacctcaagtatatcctgtccgattccagtcctgcacccgaatttccactggcgtatctgacatccgaaaatcgcgatatctgggcagagttacggcagaagctgatgagctcaggtaatgaggagtcactgcggaaagtggattccgcagttttttgcttgtgtctggatgacttcccaataaaagatcttgtgcacctgtcgcataacatgttacacggggatggcacaaatcgctggttcgataaaagcttcaaccttatcatagcaaaagacggttctactgctgtccactttgaacatagctggggcgatggggtggcggtgttacgtttcttcaacgaagtgttcaaggactcaacccaaacccccgccgtcacgccccagagtcaacctgcaaccaccgattccacagttaccgtgcagaagctgaattttgaactgacggatgctctaaaaaccgggatcacagctgccaaggaaaaatttgatgctacgatgaagacactaacgatcgactgcgtacagttccagcggggcggaaaagaatttctaaagaaacaaaagttgtcaccggacgccgtggcccagctggcgttccagatggcatttcttcggcaatatggacagactgttgcaacctatgaatcctgtagtactgccgccttcaaacacgggagaactgagacaataaggccagcatccgtgtatacgaaacgatgctcggaggcatttgttcgggaaccaagtcggcatagtgccggtgaattgcagcagatgatggtggaatgctcaaaatatcatggccagctcacgaaagaggccgcgatggggcaaggttttgacagacacctgtttgctctgcgacacttggcggccgccaaaggcatcatacttccggaactgtatcttgaccctgcatacggacagatcaaccacaacgtattgtctacctccactctgtcctcgccagctgttaacttgggcggcttcgctccagtggtgtctgacggattcggcgttggctacgccgttcacgacaattggatcggatgtaacgtcagttcttaccctggaagaaatgcgagagagttccttcaatgcgtcgagaaggccttggaggacatgttcgacgccctggaaggcaaatccattaagtcatag

SEQ ID NO: 23252 - DNA, 1077 bp, Artificial Sequence
  Description of Artificial Sequence: Synthetic coding sequence
atgcgggccacccccctggccgcccccgccggcagcctgagccggaagaaacgcttggaactggatgataacctggatactgagcgtcctgtgcagaagcgtgcccggtcagggcctcagcctagattacccccatgccttttgcccctctccccccctactgcacccgaccgcgccacagcagtcgccaccgcctcccgtttgggaccttacgtcctattggagccagaagagggcggtagggcatatcaagccctgcactgtccaactgggacagaatacacctgtaaagtgtaccccgtgcaggaagccctggctgtgttggagccgtacgctcgcctgccccctcataagcatgtcgccaggccaacagaggtcctagctgggacccagcttttgtacgctttttttacacggacccacggagacatgcacagcctcgttcgcagtcgtcacagaatacccgagcccgaggcagctgtgcttttccggcagatggctacagctctcgctcactgccaccagcacggcttagtcttgcgagacttgaaactgtgcagatttgtcttcgcggacagagagagaaaaaagctggtcttagaaaacttggaagactcctgtgtgctgactgggccggacgatagcttatgggataaacatgcgtgtcctgcctacgtgggtccggaaatcctgtccagcagagcctcctacagcgggaaagcagcagatgtctggtctctgggcgtcgctctctttacaatgttggccggccattatccatttcaggactcggagcctgtgctgctttttggaaagatcagacgaggagcttatgccctgccagcaggactttccgctcccgcgcgatgcctagttagatgtctgctgcgaagggagccagctgagaggttgacagcgacgggaatcctgctgcatccttggttgcggcaggaccccatgccactggctcccacccggagtcacttgtgggaggccgcacaagtagtcccagatggcctgggcctcgatgaggcccgcgaagaagagggggacagggaagtggtgctttatggatag

SEQ ID NO: 23253 - DNA, 1176 bp, Artificial Sequence
  Description of Artificial Sequence: Synthetic coding sequence
atgagcggccccgtgcccagccgggcccgggtgtacaccgacgtgaacactcaccgacctcgggagtactgggattatgagtcccacgtggtcgagtggggcaaccaggatgattatcagctcgtgcgcaagttaggtcgtggaaaatactcggaagtgtttgaggctatcaatatcactaacaacgagaaggtagttgtcaagatcctcaagccggtgaagaagaagaaaatcaaacgggaaataaaaatcttagaaaatctaagaggcgggcctaatatcatcaccttggcagacattgttaaggatcccgtgtctcgaactcctgcactggtgttcgagcacgtgaacaataccgattttaaacagttgtatcagaccctgacggattatgatatcagattttatatgtacgagatcctaaaggcattggattattgtcatagtatgggcattatgcacagggatgtaaaaccccacaacgtgatgatcgaccatgagcacagaaaactgagactaatagattgggggctggccgaattttaccaccccggacaagaatacaacgtgagggtggcctctcggtacttcaaggggcctgagcttctagttgactatcaaatgtatgactatagtttggacatgtggtcgctgggctgcatgctggcttctatgatattccggaaagagcctttttttcacgggcatgacaattacgatcaactggtgcggattgccaaggtgctggggacagaggatttgtacgactacatagataaatacaatatcgaactcgacccacgattcaatgacatcttaggcaggcactcccgcaagcgatgggagcgcttcgtccattccgaaaaccaacatttagtctccccggaggccctcgattttctggataagctcctgcgctacgatcatcagtccagactgacagcccgtgaggcaatggaacacccctacttctatactgtggtgaaagaccaggctcgcatggggagctcttccatgccaggcgggtccacacctgtgtcaagtgctaatatgatgtctgggatttcatcagtgcctacaccctccccattaggcccactggccggtagccccgtgatcgccgctgcaaatccattgggtatgcctgttccagccgcggccggagcccagcagtag

SEQ ID NO: 23254 - DNA, 1194 bp, Artificial Sequence
  Description of Artificial Sequence: Synthetic coding sequence
atgagcggccccgtgcccagccgggcccgggtgtacaccgacgtgaacacacatcggcctcgtgagtattgggactacgaatcccacgtagtggagtggggcaaccaggacgattaccaattggtgaggaaactcggcagaggcaagtactctgaagtgttcgaggcgatcaacattaccaataacgagaaggtcgtggtgaagatccttaaacccgtgaagaaaaagaagatcaaaagggagatcaagattttagagaaccttcgaggagggcctaacatcatcacactggcagatatcgtcaaagaccctgtcagtaggactccagccctcgtctttgagcacgttaacaatacagatttcaagcagctttatcagaccctgacggactatgacatccgcttttacatgtatgaaattctgaaggctctcgattactgccactccatgggaatcatgcatcgagacgtgaagccccacaatgtgatgatcgaccatgagcaccggaagttgaggctgattgattggggactggcggagttctatcaccctggtcaggagtacaatgttagagtggctagccggtatttcaagggccccgagctattagtggactaccagatgtacgactacagcctcgatatgtggagtttaggctgcatgctcgcatctatgattttccgaaaggagcccttctttcacggccacgataactacgaccaacttgtaagaatcgcgaaggtgttgggaaccgaggacctttacgactacatagataaatataatatcgaactcgaccctcgattcaatgacatccttgggcgtcattcgcgcaaacgctgggagcgcttcgtccactcagagaaccaacacctcgtgtccccagaggcactcgactttctggataagctgctccggtacgaccatcagagcagattaactgctcgggaggctatggagcatccctatttctacactgtcgtcaaggaccaggcccgaatgggttcgtccagtatgcctggtggttccactcccgtgagtagcgctaatatgatgtccggaatctcctcagttcctactccttctcctttggggcctcttgcgggcagtcccgtgatcgctgcagcaaatccgttgggatgcctctttcagcttcccctgcggagtgccgtgacagccctgtcagtcagctag

SEQ ID NO: 23255 - DNA, 768 bp, Artificial Sequence
  Description of Artificial Sequence: Synthetic coding sequence
atgtacgagatcctgaaggccctggactactgccacagcatgggcattatgcacagagatgtcaagcctcacaacgttatgattgaccacgagcacagaaaattgcgactcatcgattggggcctggccgaattctatcatcccggccaggagtataacgtccgcgtggcaagccggtactttaagggccccgagctgctagtggactaccagatgtacgactactccctcgacatgtggagcttgggctgcatgctggctagtatgatctttagaaaggagccttttttccacggtcacgacaattatgaccagctagtgagaatcgcaaaagtactggggacagaagatttgtatgattatattgataaatacaatatcgaattagatccaagatttaatgacatcctgggccgccatagtaggaaaagatgggagcgcttcgtgcactctgagaatcagcatctcgtgagccctgaagccctcgacttcctggacaagctgctgcgctatgatcaccagtcaaggttaactgcacgcgaagccatggagcacccctacttttatacggtggttaaagaccaggctcgaatgggcagttcttcaatgccgggcggaagtactcctgtgagcagcgcaaacatgatgtctggtatcagtagcgtacccacccccagcccactagggccattagccggttctcctgtcatcgctgccgctaaccccttgggcatgcctgtgccagcagctgcaggcgctcagcagtag

SEQ ID NO: 23256 - DNA, 1158 bp, Artificial Sequence
  Description of Artificial Sequence: Synthetic coding sequence
atgagcggccccgtgcccagccgggcccgggtgtacaccgacgtgaacacacacagacctcgggaatactgggactacgaaagccatgtcgtggagtggggcaatcaggacgactaccagctcgtgagaaaactggggagagggaaatattctgaagtgtttgaggcgataaatatcaccaataacgaaaaggtggtggtgaagatactcaaaccagtgaaaaaaaagaaaattaaacgggagattaagattttggagaacctgcgcggcggacccaatatcattaccttagccgacatcgtgaaagaccctgtgagccgtacacccgccctcgtcttcgagcacgtgaataacaccgacttcaaacagctgtatcagactctcacagactacgacatcaggttctacatgtacgaaattctgaaggccttagactactgccactccatggggatcatgcatcgcgatgttaagccccacaatgtgatgatcgatcacgagcataggaaactgcgcctgattgattggggattggcggagttctaccatccagggcaggagtataacgttagagtagcctcacgctattttaagggtcctgaactgctggtagactaccagatgtacgactacagcctggacatgtggagcttaggctgcatgctcgcctctatgatctttagaaaagagcccttctttcatggccatgataactacgaccagctagtcaggattgctaaggttcttggtacagaagatctgtacgactatatagacaagtacaacattgaattggaccctaggtttaatgatatactgggacgtcactcaagaaaacgatgggaacggttcgtgcacagcgaaaaccaacacctggtttcccctgaggctctcgatttcctggataaattacttcgatacgaccatcagagtaggcttaccgcccgggaggcaatggaacacccctatttctacaccgttgtcaaggaccaagcccgaatggggagctcttctatgcccggggggagcacccccgttagttcagccaacatgatgtccgaaatgaagttctgtagggtggcccaagccgggcttgaactgttatcttctacagtgtatcccccatggccgccaaaggtgctgcgactcgaagcatag

SEQ ID NO: 23257 - DNA, 1053 bp, Artificial Sequence
  Description of Artificial Sequence: Synthetic coding sequence
atgcccggccccgccgccggcagccgggcccgggtgtacgccgaggtgaactctctgcgctctcgcgaatactgggactacgaggcccacgtacctagttggggcaaccaggacgattaccagctggttaggaaactgggcagaggaaaatactctgaggtgttcgaggctatcaacattactaataacgaacgggtggtagtgaaaatcttgaagcctgtgaagaaaaagaagattaagagagaagtgaaaattcttgaaaacctacggggcggcacgaatataataaagctgattgatacggtaaaagaccctgtgtccaaaacaccggctctagttttcgaatatatcaataacaccgatttcaaacagctctaccagatactgacagattttgatataaggttctacatgtatgagttacttaaagcgctagattactgccattccaaggggatcatgcaccgggacgtcaaaccccataacgttatgatcgatcatcagcagaagaaactaaggctcatagactgggggctggcggagttctaccacccggctcaggagtataacgtgagggtggcttctcgctattttaaggggcctgagcttctcgtcgattaccaaatgtatgattattccctagatatgtggtccttggggtgcatgctagcctcgatgatctttcgccgggaacctttctttcatgggcaagacaactatgatcagctggttcggatagcaaaagtgctggggaccgaagagttatatgggtatctcaaaaagtaccatatcgatttggatccccatttcaacgacatattaggtcaacattcccgaaagaggtgggaaaacttcatccattcagaaaataggcatctcgtcagccctgaagcactcgatctgctggataaattgctcaggtacgatcatcaacagcgacttacggcaaaggaggccatggaacatccttacttttatcctgtggtcaaggagcagagccagccctgcgccgacaacgctgttctgtcttctggattaaccgcagcccgctag

SEQ ID NO: 23258 - DNA, 600 bp, Artificial Sequence
  Description of Artificial Sequence: Synthetic coding sequence
atggaggcccgggacaagcaggtgctgcggagcctgcggctggagctgggggcagaagtcctggtcgaaggactggttcttcagtatttgtaccaggaagggatcttgacagagaatcacatccaagagattaatgctcagacaactggcctcagaaaaacaatgcttctgctcgatattctgccatcacgaggtcctaaagcatttgacacgtttctggacagcctccaggagttcccctgggtccgggagaaactgaaaaaagcccgagaggaggctatgaccgacctaccggctggcgatagactgaccggcatcccttcccacattctcaattcttctccttctgaccggcagataaatcagctggcccaaagactggggcctgagtgggaacccatggttctctcgcttggcctctcacagacagatatttacaggtgcaaggcaaaccacccgcataatgtacagtctcaggtggtggaggcgtttattaggtggcgccagaggttcgggaagcaggccacttttcagagtctgcataatgggctccgcgcggttgaggtggatccatccctgctcctgcacatgttggaatag

SEQ ID NO: 23259 - DNA, 366 bp, Artificial Sequence
  Description of Artificial Sequence: Synthetic coding sequence
atggaggcccgggacaagcaggtgctgcggagcctgcggctggagctaggcgctgaggtcctggtggagggcctggtgctgcagtacctatatcaggagggtattctgacggaaaaccatatacaggaaattaacgcccagactaccggcttacggaaaactatgctcttgctcgatatcctgccttccaggggcccaaaggccttcgacacatttcttgactcgctacaggagtttccttgggtccgcgagaagctcaagaaagcccgagaggaggcgatgaccgacttacccgccgagatgagaaaactgcggccaaaagatagcgtaacctgcctggccagccaattgacatggcgattttag

SEQ ID NO: 23260 - DNA, 600 bp, Artificial Sequence
  Description of Artificial Sequence: Synthetic coding sequence
atggaggcccgggacaagcaggtgctgcggagcctgcggctggagctgggcgctgaggtacttgttgagggtctagtccttcagtacctgtatcaggagggtatccttaccgaaaaccacatccaagagatcaacgcccagacaaccgggttgcgaaagacaatgcttctcctcgatatcttaccctctcggggccctaaggccttcgatacgttcttagattccctgcaggaatttccttgggttagagagaaactgaagaaagctcgggaagaagccatgactgatttaccagctggggatcggctcaccggtatacccagtcatatcctaaactcgagtccctccgacagacagatcaatcagctggctcagcgtttaggccctgaatgggagccaatggtgctgtctttgggactgtcccagacagatatttaccgctgtaaggcaaaccatccccataacgttcaatcccaggtggtggaagcctttataaggtggcggcaacgctttgggaaacaagccacattccagagtttacacaatgggctccgcgcagtagaagtcgatccctcattactcttacacatgctggagtag

SEQ ID NO: 23261 - DNA, 312 bp, Artificial Sequence
  Description of Artificial Sequence: Synthetic coding sequence
atggaggcccgggacaagcaggtgctgcggagcctgcggctggagctcggagccgaggttctggtcgaggggttggtacttcagtatctgtaccaggagggcatccttaccgagaatcatatccaggaaataaacgcccagacaaccggtctccggaagacgatgttgttgctggacatcctcccttcaaggggcccgaaggctttcgatactttcttagattccctgcaagagttcccttgggtacgtgagaagcttaagaaagccagggaggaggctatgactgacctcccagctggttgctggccgtag

SEQ ID NO: 23262 - DNA, 1443 bp, Artificial Sequence
  Description of Artificial Sequence: Synthetic coding sequence
atgagcgccgaggtgatccaccaggtggaggaggccctggacaccgacgagaaagagatgctgctgtttctctgtagggatgtggccatcgacgtggtgccgcccaacgtgcgggacctcctagatatccttagggagcggggcaaactcagcgtgggtgacctcgccgagttgttataccgcgtaagacgttttgatctgttaaaacgtatcctgaaaatggatagaaaggccgtcgaaactcatctcctgcgtaacccccatttagtgtcagactacagagtcctgatggcagaaatcggggaggatttagacaaaagcgatgtgagcagcctcattttcttaatgaaggactatatggggcgcggcaagatcagtaaagagaagagcttcttagacctcgtggtggagctggagaagctcaatttggtggcccccgaccagcttgatctgttggagaagtgtctcaaaaatattcatcgtattgacctgaagacaaagatccagaaatacaaacagagtgtccaaggtgccggcacttcctacaggaacgtgctgcaggctgctatacagaaatctttaaaggacccaagtaataattttaggctgcacaatggacgctccaaggaacagaggctcaaggagcaattgggagcacaacaggaaccagtgaagaagtcaattcaggagagcgaagcctttctcccacaaagtattccagaggagcgctataagatgaaaagtaagccgttaggcatctgcctcatcattgactgcatcggtaacgagactgagttgttgagggatacatttacgagcctcggctacgaggtgcagaaattccttcatttatcaatgcatgggatcagtcaaattcttggacaatttgcatgtatgccggaacaccgggattacgactcctttgtgtgcgtgctggtgtcaaggggtggcagccaaagcgtgtacggggtggatcagacacacagcggtttacctctccatcacattaggcggatgtttatgggagacagttgcccatacctggccggaaagcctaagatgttcttcatacagaattatgtagtttctgagggtcagctagaagatagtagtttactcgaggtagatggcccagctatgaaaaacgtagagttcaaagcgcagaagcggggcctgtgtaccgtacaccgagaagccgactttttttggtctttatgcaccgccgacatgtccctgctggaacagtcccacagtagccccagcctctacctgcagtgtctgtctcagaagctacgtcaagagcggaagcgtcctcttcttgatctgcatatcgagcttaacggctatatgtatgactggaattctcgggtgagcgccaaagagaaatattacgtgtggctccagcatactctgaggaagaagctgattcttagctacacgtag

SEQ ID NO: 23263 - DNA, 1389 bp, Artificial Sequence
  Description of Artificial Sequence: Synthetic coding sequence
atgagcgccgaggtgatccaccaggtggaggaggccctggacaccgatgaaaaggagatgctgctgttcttgtgcagggatgttgccatagatgtcgtacctcctaatgtgcgcgatctactcgacattttgagagagcgcggcaagttgagcgtgggagacctggccgagctactgtacagagtgaggcgcttcgacctgctgaaacgcatcttgaagatggataggaaagccgtggagacacatctgctccgcaatccccaccttgtgtccgattatcgagtgctgatggccgagatcggcgaagacctggataaatccgacgtgtcgtcactcattttcttgatgaaagactacatgggccgggggaagatctcaaaagagaagagttttctggacctggtggtggaactcgagaagctgaatttggtagctcctgatcaactggatctccttgaaaaatgtctgaaaaatatccatcggatagatctgaaaactaagattcagaagtacaaacaatctgtacaaggagcaggcactagttatcgcaatgtgttgcaggccgcaattcagaagtctctgaaagacccttctaataactttcgccttcacaacggcaggagcaaagagcagcggctgaaagagcaacttggagctcagcaggagcccgtaaagaagtcaattcaggaaagtgaagcctttctgccacagagcatcccggaggagaggtacaaaatgaagagtaaaccactaggtatttgcctcatcattgattgtatcggaaacgagactgagcttctaagagacactttcacctcactgggatatgaagtccagaagtttctccacctttccatgcacggtatctctcagattctcggtcaattcgcctgcatgccagagcacagagactatgactccttcgtttgcgtgctcgttagtcggggcggcagtcaaagcgtgtatggagtcgatcagacacatagtgggcttcctctgcaccacatccggcggatgttcatgggggacagctgtccttatctggccggcaaacccaaaatgttttttattcaaaactatgtggtctccgaaggacagctggaggatagcagcctgctggaagtggacggacctgcgatgaagaacgttgagtttaaggcacagaagcgaggactgtgcaccgtccatcgagaagcagactttttctggtctctttgcacagcagacatgagcctccttgagcagtcacactcttcgccctcactctacctgcaatgcctctcccagaagctgcgacaggaacggggtaccatcccaggctcagggattactgaatcgaaggacatgcactttagctcactgggctgcatcctcttagacgtgctttag

SEQ ID NO: 23264 - DNA, 1047 bp, Artificial Sequence
  Description of Artificial Sequence: Synthetic coding sequence
atggccgagatcggcgaggacctggacaagagcgacgtgagcagcttgatcttcctcatgaaggattacatgggtaggggtaagatctctaaggaaaagagtttcttggacctggtggtggagctggaaaagctcaaccttgtggccccagatcagcttgatttgttggaaaaatgtctcaaaaatatacaccgaatcgatttgaagacaaaaattcaaaagtacaaacaaagcgtgcaaggggcaggcacttcttaccggaacgtgctccaggcagctatccagaaatccctgaaggacccttccaacaattttcgagaggaaccggttaagaaatcaatccaggaaagtgaggccttcctgccccaatcaataccagaggaaaggtataagatgaagtctaagccgttaggcatttgtctgatcatcgactgcatcggcaacgagacagagcttctcagagacacttttaccagcctagggtacgaggtgcagaagtttctgcatctgtcgatgcacggcattagccagattctgggccaatttgcatgcatgccagagcatcgggactacgatagttttgtatgtgtgctcgtgagccgagggggcagccagtcagtttacggggtggaccagacacacagtggccttccactgcaccacataaggcgaatgtttatgggagatagctgtccatacctggcaggaaaaccaaaaatgttttttattcagaactacgtggtgagcgaaggccaacttgaagatagcagtctactggaggtcgatggtcccgccatgaagaatgtcgaatttaaagcccagaagcggggtctgtgcaccgtgcacagagaagccgactttttctggtctctgtgtacagccgacatgtccctgcttgaacagtcccacagctcaccctctctgtatctccaatgcttgtcccagaagctccgacaagagcgtgggacaattcctggctctggtataactgaaagcaaagatatgcacttcagctcactgggctgcatcctcttagacgtcctttag

SEQ ID NO: 23265 - DNA, 903 bp, Artificial Sequence
  Description of Artificial Sequence: Synthetic coding sequence
atgagcgccgaggtgatccaccaggtggaggaggccctggacaccgacgaaaaggaaatgttactcttcctgtgcagagacgtcgctatcgacgtagtaccacccaatgtccgggacttgctggacatcctgagagaaaggggtaaactgtctgtgggagatttggccgaacttctatacagggtgagacgtttcgacttgctcaaacggatactcaagatggacaggaaagccgttgaaacgcacttgcttagaaacccccacctcgtgagcgactatagagtgctgatggccgagattggggaagatctggacaaatccgacgtcagttccctgatttttctgatgaaggattatatgggtaggggaaagataagcaaggagaaatcctttctagatttggtggtagagctcgaaaaactgaatctcgtggcacccgaccagctggaccttcttgagaagtgtctgaagaacatccaccggatcgacctgaagacgaagattcaaaaatacaaacagagcgtgcagggggccggcacgagctaccggaacgtacttcaggccgccatccagaagagtcttaaagatccttcaaacaatttccgccttcataatggccggtccaaagagcagcggctcaaggagcagcttggtgcacagcaggaacccgtcaaaaaatccatccaagagagtgaagctttcctgccacaaagcatccccgaagagcggtataaaatgaagagcaagcccctggggatctgcctaatcattgactgtatcggtaacgagacagagaatgcacactcctggattttcaccctgaactctatggcaacatgcatgattggtacggccgagttcctgccgaggcggaatatcatgtccggctgctcgacattatag

SEQ ID NO: 23266 - DNA, 753 bp, Artificial Sequence
  Description of Artificial Sequence: Synthetic coding sequence
atgagcgccgaggtgatccaccaggtggaggaggccctggacaccgacgagaaggaaatgctgctgttcttgtgccgcgacgtcgccattgacgtggtcccccctaacgttcgtgatctgcttgacatcttacgcgagaggggcaagctgtcggttggcgacctggccgaacttttatacagggtccggaggttcgacctcctgaaaagaattctgaagatggatcgcaaagccgtcgaaactcatctgctccgcaatccccaccttgtgtccgactacagggtgctcatggcagagattggggaggacctggataagtcggacgtcagctccttaatatttcttatgaaggattacatgggcagaggaaaaattagcaaggagaaatcattcctggacctggtggtcgagttagagaagctgaacctagtggcaccagaccagctggacttgcttgagaaatgtctgaaaaacattcatcgcattgatcttaaaaccaaaatccaaaagtataaacagtccgggggatggaatggcacatggatgacaaaggcctccttttcactctggctagaaatcgcttctttgtacatactccacatcccagatctgcccacacctctgccctgcatttttatgatttctgcgaaatgctgtcaggctgtgcttaatatatctgttttcaagaaggagagcggtatttgtaccggctggcaatcctacggacacagcggcgtgttgcacgtatgttag

SEQ ID NO: 23267 - DNA, 357 bp, Artificial Sequence
  Description of Artificial Sequence: Synthetic coding sequence
atgagcgccgaggtgatccaccaggtggaggaggccctggacaccgacgaaaaagagatgcttctgttcctgtgtagagatgtggcaatcgacgtagtccctcccaatgttcgagatttgctggacattctgcgggaaaggggcaagctgtctgtgggcgacctggctgagcttttatacagagtgagacgattcgacctactgaaaaggattcttaagatggaccggaaagccgtcgagacacacttgctgcgaaatcctcatttagtatctgattaccgggtgttgatggcggagataggagaggatctcgacaagagtgacgtgtcgagcttaatatttctcatgaaggattag

SEQ ID NO: 23268 - DNA, 1443 bp, Artificial Sequence
  Description of Artificial Sequence: Synthetic coding sequence
atgagcgccgaggtgatccaccaggtggaggaggccctggacaccgatgaaaaagagatgctcttgtttctttgccgagatgtggccatcgatgtggtcccaccaaacgtgcgcgacctgctcgacatccttcgggagcgaggtaagttgagcgtgggcgaccttgcggagcttctgtatcgagtacggcggtttgacctcctgaagagaatccttaagatggacagaaaggcagtggaaacccatttgctgaggaatccgcacctcgtctccgattacagggtgctgatggccgagattggtgaggatctggataaatcagacgtgtcctcattgatctttctaatgaaggactacatggggagaggtaaaattagtaaggagaagtcctttctggacctggtggtggaactggaaaagttaaacttggtcgcacccgatcaattagacctgctggaaaagtgccttaagaatattcacagaatcgacctgaaaactaaaatccagaaatataaacagtcagttcagggcgctgggacttcttatcgaaacgttcttcaggccgccatccagaagtcactcaaagaccccagcaataacttccgactgcacaacggccgatctaaagaacagcgattgaaagaacagctgggggcacagcaagaacctgtcaagaaaagtatccaagagtccgaggcatttctcccgcagtccatccctgaggagcgctataaaatgaaaagcaagccactcgggatttgtttaatcatcgactgtataggcaacgagacagagctcttgagagataccttcactagcctgggatatgaggtgcagaagttcctacacctgagcatgcacggtatctcccagatacttggccagtttgcatgcatgccagagcaccgtgattatgactcgtttgtgtgtgtactagtttcccgagggggctcccagtctgtctacggtgtcgatcagacacatagcggcctgccactgcaccatattcgtcgcatgtttatgggagacagctgtccttatttagcgggaaagccaaagatgttctttattcaaaactatgtggttagcgagggacaattggaagatagctctttactcgaggtggacgggcccgccatgaagaacgtggagttcaaggcacagaaacgtggcctttgtaccgtccaccgcgaagccgactttttttggtccctgtgtaccgctgatatgagcctactggagcaatcacactcaagtccttctctgtacctgcagtgcttgtcgcaaaagctcagacaggagaggaaaaggccgcttttggatctgcacattgagcttaatggctatatgtacgactggaacagtagagtgagcgccaaggaaaagtactacgtgtggttacaacataccctccgcaagaagcttattctcagctatacatag

SEQ ID NO: 23269 - DNA, 189 bp, Artificial Sequence
  Description of Artificial Sequence: Synthetic coding sequence
atgagcgccgaggtgatccaccaggtggaggaggccctggacaccgatgaaaaagaaatgctgcttttcctctgtagagacgtcgcaattgacgtggtccccccaaacgtccgagacctgttggatatcctacgggagagaggaaagcttagcgtcggcgacctggctgagctgttgtatcgcgtctag

SEQ ID NO: 23270 - DNA, 195 bp, Artificial Sequence
  Description of Artificial Sequence: Synthetic coding sequence
atgagcgccgaggtgatccaccaggtggaggaggccctggacaccgatgagaaagaaatgctcctgtttctgtgtcgcgacgttgcgattgacgtggtgccacctaacgtgcgcgatcttcttgatattctgagggaacgtggtaagctgtccgtaggggacttggcagagcttctttatcgcgttagaaggtag

SEQ ID NO: 23271 - DNA, 390 bp, Artificial Sequence
  Description of Artificial Sequence: Synthetic coding sequence
atgagcgccgaggtgatccaccaggtggaggaggccctggacaccgacgagaaggagatgctgctcttcctgtgcagggacgtcgcaattgacgtggtgcctccaaatgtccgggacctccttgacattcttagggagaggggcaagttgagtgttggcgaccttgcagagctcctttaccgcgtcagaaggtttgacctgctcaaacgtatactcaagatggatcgcaaggctgtggagactcacctgctgcgcaacccccatttggtatctgactatagggtgttaatggcagagatcggtgaagatctagacaaatctgatgtgtctagcctgattttccttatgaaagattatatgggcaggggaaaaatctcaaaagaaaagtag

SEQ ID NO: 23272 - DNA, 1155 bp, Artificial Sequence
  Description of Artificial Sequence: Synthetic coding sequence
atggccgagatcggcgaggacctggacaagagcgacgtgagcagcctgatttttctcatgaaagattatatgggccgggggaagatttctaaggaaaaaagtttcctagaccttgttgtggaattagagaagctcaatttagtggcccccgaccagctagacctcctggaaaagtgtctgaaaaatattcatcgcatagatctgaaaaccaagatccagaaatacaagcaatccgtgcaaggagcggggacctcctataggaacgtactgcaagcagcgatccaaaagagcctgaaagatcctagcaataacttccggcttcacaacggcaggtccaaagagcagaggcttaaagaacagctgggagcccagcaggagcctgtaaaaaagagcattcaggaaagcgaggcctttctaccccagtctattcctgaggagcgctacaagatgaaatctaagccgctcgggatctgtctaatcatcgactgcataggtaatgagacagaattgctgcgcgacaccttcacttccctgggctacgaagtacaaaagttcctgcatctttcgatgcacgggatctcgcagattctggggcaatttgcttgcatgccagagcacagagactacgacagttttgtgtgcgttcttgtgagcagaggaggcagtcagtctgtgtacggcgtggaccagacccatagcggcctacctctccaccacattcgccgcatgtttatgggcgactcttgcccatacttggccggcaaaccgaagatgtttttcattcaaaattacgttgtaagtgaagggcaactggaggacagcagcctgttagaggttgatggaccagcgatgaagaacgtggagttcaaagcacagaagagaggcctttgtacagtgcatcgtgaggccgacttcttttggagcttgtgcacagctgacatgtccctcctggagcagtctcactcttcgccgtccctgtacttgcagtgtctgagtcaaaaacttcggcaagagcgtaagcgcccattgctggatctgcacattgaactgaacggctacatgtatgattggaattcacgagtgtcagccaaggagaagtactacgtgtggctgcagcatacactcaggaaaaaactaatcctttcttacacgtag

SEQ ID NO: 23273 - DNA, 666 bp, Artificial Sequence
  Description of Artificial Sequence: Synthetic coding sequence
atgagcgccgaggtgatccaccaggtggaggaggccctggacaccgacgagaaggaaatgctcctctttctgtgtcgcgatgtagcaattgatgtggtacctccaaatgtgcgggacctcctcgacatactgcgcgaacgcggcaagctgtcagtgggggatctggctgagctcctttacagagtccggaggtttgatctcctcaaacggattttgaagatggatcgcaaagcagtggagacccacttgcttcggaacccccatctcgtgtcagactaccgtgtgctgatggcagaaattggagaggatcttgataagtctgatgtgtcctctctgatcttcctgatgaaagattacatgggccgcggcaagatatctaaagagaagtctttcctcgacctggtggtggaactggagaagcttaacctggttgcacctgatcagctggacctcctggagaagtgcctgaagaatatccaccgcatcgatttaaagacaaaaatacagaagtataagcagagtgtccagggtgccggaacgtcttatagaaacgtgttacaggctgcaattcagaagagtctgaaggatccatccaataattttcgcatgattacgccatacgcacactgtccggacctcaaaatactggggaactgttcaatgtag

SEQ ID NO: 23274 - DNA, 1338 bp, Artificial Sequence
  Description of Artificial Sequence: Synthetic coding sequence
atgagcgccgaggtgatccaccaggtggaggaggccctggacaccgatgagaaagaaatgctactctttctgtgccgagatgtggcaatcgacgtcgtcccacccaacgtgagggatctccttgatatactccgcgaacgagggaaattgtccgtaggcgatctcgccgaactgctttatagagtgcgcaggtttgatttgttaaagcgcatcctgaaaatggaccgaaaggcagtcgaaacacaccttttgagaaacccccacctggtttctgattatagagttctgatggcggagattggagaggacttggacaagagcgacgtgtcgtcgctaattttcctgatgaaagattacatgggccgaggcaagatctccaaagaaaaaagtttcctagaccttgtggtggagcttgaaaaattgaacctggtggcccccgatcagttggacctgttggagaaatgcctaaaaaatatacatcgcattgatttaaaaactaagattcaaaagtataaacagagtgtgcaaggcgcaggaacctcctacagaaacgtattgcaggccgcgatacagaagtcacttaaggatccttccaataattttagatcaataccggaagaacgatacaagatgaagtctaaacccctcggtatctgcctaatcattgactgtatcggaaacgagaccgaactactgcgtgatacctttacatccctcggctatgaagtgcagaagtttctacaccttagtatgcatggaatctctcagattctcgggcagtttgcttgcatgcccgagcatcgcgactacgattcattcgtgtgcgtactggtgtcccgcggaggttctcagtccgtgtacggggtcgatcagacacattcaggcctcccactccatcatatcagaagaatgtttatgggagatagttgtccttacctggctggaaaacccaagatgtttttcattcagaattatgtcgtttccgaagggcaattagaagactcaagccttcttgaggtggacggtcccgccatgaaaaatgttgagttcaaggcgcagaaacgggggctatgcaccgtacaccgcgaggccgactttttctggagtttgtgcacggccgacatgagcttactagagcagtcacatagttctccgagcctttaccttcagtgcctgtcccaaaagttgcgccaggagagaaaacgcccgctcctagatttgcacattgaactcaatggatacatgtacgactggaattcaagagtgagcgccaaagagaagtactatgtgtggctgcagcacaccctccggaaaaaactcatcctgtcttatacttag

SEQ ID NO: 23275 - DNA, 1152 bp, Artificial Sequence
  Description of Artificial Sequence: Synthetic coding sequence
atggccgacaaggtgctgaaggagaagcggaagctgttcatccggagtatgggcgaggggacaataaatggccttctggatgagttgcttcagacaagagtgttgaacaaagaggagatggagaaagtaaagcgcgaaaatgccactgtcatggataagactcgtgccctcatcgactccgttattcctaaaggtgcgcaagcctgtcagatatgcattacctatatctgcgaggaggactcttatcttgctggaaccctgggcctttcagctgctccacaggcagtacaagataaccccgccatgcccaccagcagtggctctgaggggaacgtgaaactgtgtagtcttgaagaggctcagcgcatctggaagcagaagtcagccgaaatatatcctatcatggacaagtcctcaagaacgaggctagccctcatcatttgcaatgaggagttcgactcaatccccaggcgcaccggcgccgaagtggacatcacaggcatgactatgctgctgcaaaacctaggctatagcgtggacgtgaaaaagaatctcacggcgtccgacatgacaacagagttggaggcctttgctcaccgccctgagcacaagacaagtgatagtacattccttgtctttatgtcccatgggatcagagagggcatctgtgggaaaaagcacagtgagcaggtaccagacattctgcagctgaatgctatcttcaacatgctgaacacgaaaaattgtccttcactgaaggacaaacccaaggtgattataattcaggcctgtaggggtgacagtcccggagtggtttggttcaaggattcagtcggcgtgtcaggcaatctgtctctgcccacgaccgaggaattcgaggacgatgccatcaagaaagcccatatcgagaaagacttcattgctttttgttcctcaacaccggacaatgttagttggaggcatccaactatggggtccgttttcatcggtagattaatcgagcacatgcaagagtatgcatgttcctgcgacgtggaggaaatcttccgcaaggtcaggttttcctttgagcaaccagatggacgtgcacagatgcccactaccgagcgggtgaccttgacacggtgcttttacctgttcccaggacattag

SEQ ID NO: 23276 - DNA, 792 bp, Artificial Sequence
  Description of Artificial Sequence: Synthetic coding sequence
atggccgacaaggtgctgaaggagaagcggaagctgttcatccggtcaatgggagaggccccgcaggctgttcaggataatcctgcaatgccaacttcttcagggtcagaaggtaatgtcaagctgtgctccctggaggaagctcagcgcatctggaagcagaagtctgcggaaatttacccaattatggataagtcttcacgcacccgcttggcccttataatatgcaatgaagaatttgactccattccccggcggacaggtgcagaggtggatattacaggaatgaccatgctgctgcaaaacctggggtactccgtggatgtcaaaaagaatctgacagctagcgatatgacaaccgaacttgaggcctttgcccaccgtcctgagcataaaacctccgacagcacttttctggtgtttatgagccatggtattcgcgaagggatctgcggcaagaaacactctgagcaagtacccgatattctccagctcaacgctatctttaatatgttaaacacaaagaattgcccttctctgaaggacaaaccgaaggtgatcattatccaggcctgccgaggggataacgtgtcctggagacaccctacaatggggagcgtgtttatcggacggctgattgagcacatgcaagaatacgcctgctcttgcgatgttgaggaaatttttagaaaagtgcggttcagttttgagcagcctgatggaagagcacaaatgccaactacagagcgtgtgacacttacccgctgtttctaccttttcccggggcattag

SEQ ID NO: 23277 - DNA, 267 bp, Artificial Sequence
  Description of Artificial Sequence: Synthetic coding sequence
atggccgacaaggtgctgaaggagaagcggaagctgttcatccggtctatgggggaggacaatgtctcttggagacatcccacaatgggctctgtgttcataggtagattgattgaacatatgcaggagtatgcatgctcttgcgacgtcgaagaaatttttagaaaggttaggtttagtttcgaacagccagacgggagggcccaaatgcccacgaccgagagggtgaccctcacaagatgtttttacctgttccctgggcattag

SEQ ID NO: 23278 - DNA, 1152 bp, Artificial Sequence
  Description of Artificial Sequence: Synthetic coding sequence
atggccgacaaggtgctgaaggagaagcggaagctgttcatccggtccatgggcgaaggaaccattaatgggttgcttgatgagctgctgcagactagggtcctaaataaagaagagatggagaaggtcaaacgtgagaacgccaccgtcatggataagaccagagcactaatcgattccgtaattccaaagggggcgcaggcctgtcaaatctgtattacgtatatttgtgaggaagacagttacttggctgggaccttagggctcagtgcagcccctcaggctgtacaggataaccccgcgatgcccacctcatccggatccgagggaaatgtgaagttgtgtagtttagaagaagctcaaaggatctggaagcagaagagtgccgagatctaccccatcatggataaatcctcccgtacacggctggcgctgattatttgtaacgaagaatttgacagcatcccaagacggaccggagctgaggtggacatcaccggcatgactatgctcttacagaacctggggtacagcgtagatgtgaaaaaaaatcttactgcttccgacatgaccactgaactggaggccttcgcacatagacccgagcacaagacatcggactcaactttcctggtatttatgtcacacgggatcagggagggcatttgtggcaaaaagcactctgagcaagtccccgatatcctgcagttaaatgctatattcaatatgctgaacaccaagaactgcccctcccttaaagataagcccaaagtcatcatcattcaggcatgtagaggcgattcccctggagtcgtctggtttaaggattctgtgggagtgagcggtaatctgtccctgccaacgacagaagaatttgaggatgatgcaatcaaaaaggcccacattgaaaaggacttcatcgctttctgctcttccacccccgacaacgtgtcgtggcgacatccaacaatgggcagcgtgtttatcgggcgtctcatcgaacacatgcaggaatatgcctgtagctgcgatgtggaggaaatattcagaaaggtgagattctcattcgagcagcctgacgggcgggctcagatgcccacaaccgaaagggttacactgacaaggtgcttctacctgttccccgggcattag

SEQ ID NO: 23279 - DNA, 267 bp, Artificial Sequence
  Description of Artificial Sequence: Synthetic coding sequence
atggccgacaaggtgctgaaggagaagcggaagctgttcatccggtccatgggtgaggataacgtgtcttggaggcatcccaccatgggatctgtcttcattggacgcctcatcgagcatatgcaggaatatgcatgttcttgcgacgttgaggagatctttcggaaagtccggtttagctttgagcagcccgacggaagagcccagatgccgactaccgagcgtgtgacgctgacacggtgcttttatttattccctgggcactag

SEQ ID NO: 23280 - DNA, 1215 bp, Artificial Sequence
  Description of Artificial Sequence: Synthetic coding sequence
atggccgacaaggtgctgaaggagaagcggaagctgttcatccggtccatgggtgagggaaccatcaacggcctgctggatgaacttctgcaaactcgggtattgaataaggaggagatggagaaggtcaagcgcgaaaacgctaccgtgatggacaaaaccagggcactcatcgacagcgtcattccaaaaggcgcccaggcttgtcagatctgtattacctacatctgtgaagaagactcttatctcgctggaacgcttggcctcagcgccgaccagaccagcgggaattacctaaacatgcaagactcccaaggcgtactgtcttcatttcccgcgccccaggcagtccaggataaccccgccatgcccacctcctctggatcagaaggaaatgtcaaactatgcagtctcgaggaggcacaaaggatttggaaacagaaatcagccgaaatttacccgattatggataaaagctcacgcaccaggctggctctcattatctgcaacgaagagttcgactcaatcccacgacgcaccggggcagaagtggatatcacgggcatgactatgttgttacagaacctcggttactcagtcgacgtgaaaaagaatctcacagcgagcgacatgaccaccgagttggaggcgttcgcacatagaccagaacataagaccagcgatagtacattccttgtctttatgtcacacgggatcagagagggaatctgtgggaaaaagcactccgagcaggtgccagatattctccagctgaacgcaatttttaatatgttaaacaccaaaaactgtccctcattgaaggataagcccaaggttatcatcatccaggcttgccggggagacagtcctggcgtggtgtggttcaaggatagtgttggagtgtccggcaacctgtccctcccgactacagaggagtttgaggatgacgcgatcaagaaggctcatatcgagaaggactttatcgccttctgttcttcaacccctgacaatgtctcttggcgccacccgactatgggcagtgttttcattggacgactcattgagcatatgcaagaatatgcctgcagctgcgatgtggaggagatttttcggaaagtgaggttctcttttgagcagccagacggacgtgcgcagatgcctacaacagagagagttaccctgactcgatgcttctatctctttccaggtcactag

SEQ ID NO: 23281 - DNA, 792 bp, Artificial Sequence
  Description of Artificial Sequence: Synthetic coding sequence
atggccgacaaggtgctgaaggagaagcggaagctgttcatccggtccatgggcgaagcacctcaggccgtgcaggacaatcctgctatgcccaccagttccggctctgaaggcaacgtgaaattgtgttccttagaggaggcacagcggatatggaaacagaaatcagctgagatttatccgatcatggataagagcagcagaactaggctggctctcataatttgtaacgaggagttcgattcaatccctagaagaacaggtgcagaggtggatatcaccggtatgacaatgctgctgcagaatctgggctatagcgtcgatgtaaagaaaaacctaacagcctccgatatgacaacagagttggaggcctttgctcaccgtcctgagcacaaaacctccgatagtaccttcttggtcttcatgtctcacggaatccgcgaaggaatctgcggcaagaagcactctgaacaagtccctgatattttgcagcttaacgctatttttaacatgctgaatactaaaaattgtccatctctcaaggataagccgaaagtcatcattattcaggcctgccggggcgataacgtaagctggcggcatccaactatgggatctgttttcattggccggttaatcgaacatatgcaggaatacgcatgttcgtgcgacgtcgaagagatctttcggaaagtgcgctttagtttcgagcagcctgacggcagggctcagatgcccacaactgaacgggtgacactgactaggtgcttctacctgttcccaggacattag

SEQ ID NO: 23282 - DNA, 1152 bp, Artificial Sequence
  Description of Artificial Sequence: Synthetic coding sequence
atggccgacaaggtgctgaaggagaagcggaagctgttcatccggtctatgggggagggtaccattaacggtctactggacgagctgctccaaactcgggtgctcaataaggaagagatggagaaggtgaaacgcgagaacgcaactgtgatggacaagactcgcgccctcatcgactctgtgatccccaagggggcacaggcatgccaaatctgcatcacgtatatttgcgaggaggacagctaccttgcgggcacgttgggtttgtcagctgctccccaagccgtgcaggacaatcctgccatgccgacctcttctgggtccgagggtaacgtgaaactgtgctccctggaagaggctcaacgcatatggaagcagaagagtgcagagatctatcccattatggataaaagcagccgaactaggctcgctctgatcatctgtaacgaagagttcgacagcatcccacgccgaaccggagccgaggtggacatcacaggcatgactatgctattgcagaacctgggttactccgttgatgtcaagaagaacctgaccgccagtgacatgacgacagaactagaggcgtttgcccatagaccagaacataaaacttctgacagtacctttcttgtcttcatgtcgcacggtatccgagagggtatatgtggaaagaaacactccgagcaagtgccggacattctgcagctgaatgccatcttcaacatgctcaacacaaagaattgcccctctctgaaagacaaaccaaaagtgatcatcattcaagcttgcaggggtgactcacccggagttgtctggttcaaggacagcgtgggtgtctccgggaatctctctctgccgaccactgaggaattcgaggatgacgccattaagaaagcgcatatcgaaaaggacttcatcgccttctgcagttctacgccggataacgtgtcatggaggcatcccactatgggttccgtttttatcggtaggctgatcgaacatatgcaagagtatgcctgcagctgcgacgtcgaagagatcttcagaaaggttcgcttcagcttcgaacaacccgatgggagagcccagatgccaactacggagcgggtgaccctgaccagatgcttctacctctttccgggccactag

SEQ ID NO: 23283 - DNA, 936 bp, Artificial Sequence
  Description of Artificial Sequence: Synthetic coding sequence
atggccgacaaggtgctgaaggagaagcggaagctgttcatccggtctatgggtgaggctccccaggcggtgcaagacaaccctgcaatgccaacatcttccggcagcgaaggcaacgtgaagctttgctctctggaggaagcacagagaatctggaagcagaaaagcgccgaaatatatcccataatggataagagctcacggacccgtcttgccctcattatttgtaatgaagaatttgattcaattcctcgcaggactggcgcagaggtggatataacaggcatgactatgctcctgcagaatttaggttattccgtggatgtaaaaaaaaacttgaccgcctcagatatgactacggaactggaggcttttgcacacaggccagaacataagactagcgactctacatttctggtgttcatgtctcacgggataagagaaggcatttgcggcaagaagcattcagaacaggtgccggatatactgcagcttaatgccatcttcaatatgctcaataccaagaactgtccaagcctgaaagataagcccaaggtcatcattatccaggcttgtaggggcgattctcccggagtggtgtggtttaaagattctgttggcgttagcggcaatctgagcctccccacaacagaagagtttgaggacgatgcgatcaagaaggcccatatcgagaaagatttcatcgcattctgcagcagcacacccgataatgtttcatggaggcaccccactatgggatctgtttttataggccgactgatagagcacatgcaagagtacgcctgttcttgtgacgtcgaagagatatttcgcaaggttaggttttcctttgagcagccagacggtcgtgcacagatgccgacaaccgagagagttacattgacacgatgcttttatctttttcctgggcattag

SEQ ID NO: 23284 - DNA, 906 bp, Artificial Sequence
  Description of Artificial Sequence: Synthetic coding sequence
atggagaaggtgaagcgggagaacgccaccgtgatggacaagaccagagctctgatcgatagcgttattccaaaaggcgcacaggcctgtcaaatttgtataacatatatctgtgaggaagactcctacctcgccggaacgttggggctgtctgcagaccagaccagtggaaattatctgaatatgcaggatagccagggtgtactgtctagctttcctgctccacaagctgtacaagataatccagccatgcctactagttcaggaagtgaagggaatgtaaaactctgttcgcttgaagaagcccagcggatctggaagcagaagtccgctgagatttatcctattatggataagagttctcggactagacttgctctgatcatatgtaacgaggagttcgattccatccctaggagaacaggcgctgaagtggatattacagggatgactatgctgcttcagaacctgggttactctgtggacgttaaaaagaacctgaccgcttccgacatgaccactgagcttgaggcatttgcgcacagacccgagcacaagacaagcgacagtactttcctggtgtttatgagccacggaatccgggaggggatctgcggaaaaaagcactcagagcaggtgccggatattctgcaactcaacgctattttcaatatgctgaacactaaaaactgccccagcctgaaggacaagcctaaagttatcatcatccaggcctgccgtggcgacagcccaggggtggtgtggtttaaggattctgtaggagtgtctgggaatctgagtttacccactacagaggagttcgaggatgacgccatcaaaaaggcccacattgaaaaggattttatcgccttttgctcatctacgcccggtaaatcgcagtcttag

SEQ ID NO: 23285 - DNA, 333 bp, Artificial Sequence
  Description of Artificial Sequence: Synthetic coding sequence
atggccgacaaggtgctgaaggagaagcggaagctgttcatccggagcatgggcgagggaacaattaacgggttgcttgacgagttgttgcagaccagagtactcaacaaagaggagatggagaaggtgaagcgggagaatgccactgtcatggacaaaacacgtgccctcattgactctgtgattccaaagggggcacaggcttgccaaatttgcattacctacatttgtgaggaggactcttaccttgcaggcaccctggggctgtccgccgatttgtccaataacggccaagtgaagccacacacctcgtgcagtcactacctgcagtag

SEQ ID NO: 23286 - DNA, 267 bp, Artificial Sequence
  Description of Artificial Sequence: Synthetic coding sequence
atggccgacaaggtgctgaaggagaagcggaagctgttcatccggtccatgggagaagataacgtcagctggagacatcccaccatggggagcgtcttcattggaaggctgattgagcatatgcaggagtacgcctgttcatgcgacgttgaagagattttccggaaggttcgtttttcatttgagcaaccagatggaagggcgcagatgccgacgaccgagagagtgaccctcactcgttgcttctatttattcccaggacactag

SEQ ID NO: 23287 - DNA, 1215 bp, Artificial Sequence
  Description of Artificial Sequence: Synthetic coding sequence
atggccgacaaggtgctgaaggagaagcggaagctgttcatccggagcatgggggaagggactatcaatggcctgctggatgagctgctgcaaactagagtgctcaacaaagaagaaatggagaaagtcaaacgcgaaaacgcgacggtcatggacaagacccgcgctcttatcgactcagtgatcccaaagggagctcaggcttgtcagatctgcatcacctacatctgcgaggaggattcatatctggcaggtaccctgggtctcagcgctgaccaaacttctgggaattacctcaatatgcaggatagccagggcgtcctgtcaagctttcccgcccctcaggctgtccaggacaaccccgcaatgccaacctcctcaggttctgagggtaatgtaaagctgtgttctttggaggaagcacagcggatttggaaacagaaatccgccgagatttatccgataatggataagtcttcacgcaccaggctggctcttatcatatgtaatgaggagttcgactctatccctagacgcactggagctgaggttgacatcacaggcatgaccatgttgcttcagaacctcggctactctgtggatgtcaagaagaatctgaccgcatcagatatgactaccgagctggaagctttcgcacatagaccggagcacaagacctcagatagtacattccttgtttttatgagccatggtatcagagagggcatttgtggcaagaagcacagtgaacaggtgcctgacattctgcaacttaacgccatctttaacatgctcaatacaaagaattgcccatccctcaaagacaagcctaaggtaatcattatccaagcttgccgaggggactctcctggagtggtgtggtttaaggacagcgtcggggtcagcggcaatctctctctgcccaccacggaagagtttgaggacgacgcgatcaagaaggcgcatatagagaaagactttattgccttttgctccagcacccctgataatgtgagttggcggcatcccaccatgggatcagttttcatcggcaggctgatcgagcatatgcaggagtacgcatgcagctgcgacgtggaggagatttttagaaaggtccgcttcagctttgagcagccggatgggagagctcagatgcccacaacggagcgggttaccctgactagatgtttttacctttttcccgggcactag

SEQ ID NO: 23288 - DNA, 792 bp, Artificial Sequence
  Description of Artificial Sequence: Synthetic coding sequence
atggccgacaaggtgctgaaggagaagcggaagctgttcatccggtcaatgggtgaggctcctcaagctgtccaggacaatccagcaatgccaacctccagtggctctgaaggtaatgtgaagctgtgcagtttagaagaagcccaaaggatctggaaacaaaagagcgccgagatctatcccattatggacaaaagttccagaacaagactggcccttattatatgcaatgaggaattcgactcgatacctagacgtaccggcgccgaagtcgatatcactggaatgacgatgttgctccaaaacttgggttattctgttgatgtcaagaagaacctgacagccagcgatatgactaccgaacttgaagccttcgcccacagacctgagcacaaaacttcggattctactttcctagtgtttatgtcgcacgggattagagaaggcatttgcgggaaaaagcatagcgagcaggtgcccgatatcctgcagctgaacgcgatttttaacatgctgaacaccaaaaactgtccaagcctcaaagacaagcccaaggttattatcatccaggcctgcagaggagacaatgtgagctggcggcaccctaccatgggctcagttttcattgggagattaatcgaacatatgcaggaatatgcttgtagctgcgacgtggaggaaattttccgtaaggtgagattttctttcgagcagccagatggcagagcccagatgcccacaacagagagggttaccctgactagatgtttctatctattcccaggacactag

SEQ ID NO: 23289 - DNA, 1368 bp, Artificial Sequence
  Description of Artificial Sequence: Synthetic coding sequence
atgaagagccagggccagcactggtacagcagcagcgacaagaactgtaaagtatcttttagagagaagttacttattatcgacagcaacctgggggttcaggatgtagagaatctgaaattcctatgcattggactcgtgcctaacaagaaattggagaagtcctcatcagccagcgatgtctttgaacatctgttggccgaggatctgctgtccgaggaggatccgttctttttggcagagctcctctacataatccgccagaagaagctgctgcagcacctgaattgtacgaaagaggaggttgagcggttgcttccaacacgccaacgggtcagcttgtttcgtaatcttctatacgagttgagcgaaggcattgattccgaaaacctgaaggatatgatattccttttgaaagatagcctgcccaaaactgagatgactagtctgagcttcctcgccttcttagagaaacagggaaaaattgacgaagataacctgacatgcctggaggatttgtgtaaaaccgtcgtgccaaagttgttgaggaacattgagaagtataagcgcgagaaggccatccagatagtgacccccccagtagacaaggaggcggagtcctaccagggcgaggaagaattggtgtcccagactgacgtgaagacttttctggaggctctgccccaggaatcctggcaaaacaagcacgcagggtcgaacgaaattctgtcccacgtcttccagtggcttgggtttacagtgcacattcataataacgtgaccaaggttgagatggagatggtcctacaaaaacagaagtgtaatccagcccatgccgacggcgactgctttgtattctgtatcttgactcacggccgcttcggcgctgtttattccagtgatgaagccctgatcccaattcgagaaatcatgtctcattttactgctctccaatgccctcgacttgctgaaaaacccaagctgttctttatacaggcctgccagggcgaggagatccagccatcggtgtctattgaggccgatgcacttaacccagaacaggcacccactagcctccaggactctattcctgcggaggccgatttccttttaggtctcgctactgttccaggatatgtgagttttcggcacgtagaggagggatcatggtacattcaatctctttgcaatcatcttaagaaactggtgccccggcacgaggatattctgagtatcctgaccgcagttaatgatgacgtgagcagacgagtggataagcaagggactaagaagcaaatgccccaaccagcctttacattgcgaaagaagctggttttcccagtgccactggatgccttgtctctgtag

SEQ ID NO: 23290 - DNA, 1437 bp, Artificial Sequence
  Description of Artificial Sequence: Synthetic coding sequence
atgaagagccagggccagcactggtacagcagcagcgacaagaactgcaaggtgagtttccgggagaagctccttattatcgatagcaatctgggcgttcaggatgtggaaaatctcaaatttctgtgcattgggctggtgcctaacaaaaaactggagaagagctcctcagcttctgatgtttttgagcacctgctcgccgaggacttgctgtcagaggaagacccgttctttcttgccgagctactttatatcatccggcaaaaaaagcttcttcaacatctgaattgcactaaagaagaggttgagcgtcttctgcccactaggcagcgcgtgagtttgttccggaatctattgtatgagctgtcagaggggatcgacagtgagaatctaaaagacatgatttttctgttgaaggattccctcccaaaaactgaaatgacctctctcagtttcttagcatttctagaaaaacagggaaaaatagacgaggacaacctgacttgcctcgaggacttatgtaaaacggttgtgcccaaactcctccgcaatatcgagaaatacaagcgggaaaaagctatccagatcgtgacaccaccagtggataaggaagccgagtcttaccagggggaagaagagctagtgtcgcagacagatgttaagacttttctggaggctctcccaagggccgctgtgtacaggatgaatagaaatcaccgcggcctgtgtgtcattgtgaacaatcatagttttacctcactaaaagatcggcagggaacacataaggacgccgagatcctctcccatgttttccaatggttggggttcaccgtgcacattcacaacaatgtgacgaaggtggagatggaaatggttctccaaaagcagaagtgcaaccccgcacacgccgacggggattgcttcgtcttctgtattctgacgcacggaagattcggcgccgtgtattctagcgatgaggctctaatcccgattcgagaaattatgtcgcatttcactgcccttcagtgcccacgcttagctgaaaagcctaagctgttcttcatccaggcttgccagggcgaagagattcagccgtccgtcagcattgaggcagacgccctgaaccctgagcaggctccaacatcattgcaggactccattccagcagaggctgacttcctgctgggacttgcaacagtccctggctacgtctcatttcgccatgtagaggaaggtagctggtatatccagtctctgtgtaaccatctgaagaagctggtccctcgcatgctgaaatttctagaaaagactatggaaatccggggtagaaaacgcaccgtatggggagctaagcagatctccgccacaagcctgcctactgccatcagtgctcagacccccagaccaccgatgcggaggtggtcctctgtaagctag

SEQ ID NO: 23291 - DNA, 1566 bp, Artificial Sequence
  Description of Artificial Sequence: Synthetic coding sequence
atgaagagccagggccagcactggtacagcagcagcgacaagaactgcaaggtctcctttcgcgagaaactactgatcatcgacagcaatcttggagtgcaggatgtggagaacttaaagtttctgtgtatcggtctcgtgcccaacaaaaagttagagaaatcttcatctgcttcagacgtgttcgagcacctgctggctgaggacttactttcagaggaagacccatttttcctggctgaactgctgtacatcatacggcagaagaagctgctgcaacatctgaactgcacaaaagaggaagtagaaaggctcttacccacaagacagagggtttcactgtttagaaatctgttatatgagttaagcgaaggaatcgattccgaaaacctgaaggatatgatcttcctcttaaaagattctctgccaaagacggagatgacatctctgtctttcttggcttttcttgaaaaacagggcaagattgatgaagacaatctcacatgtctggaggacctatgcaaaaccgtggtgcccaaactgctacggaacatcgagaagtataagcgggaaaaggccatacagatcgtaactcctcctgtcgacaaggaggccgaatcctatcagggcgaggaggagcttgtatcccagaccgatgttaagacattcctcgaagctttgcctcaggagtcttggcagaacaagcacgcaggctcaaacgggaatcgggccacgaacggtgcgccgagccttgtttcccggggcatgcagggcgcttccgccaacactctgaactcagaaaccagcaccaagcgcgcagcagtgtaccgaatgaatcgcaatcatagaggcctatgcgtgattgtgaacaatcacagcttcacctcgttgaaggaccgtcaggggacccacaaggatgccgagatcctgtctcatgttttccagtggttagggtttactgtgcacatacacaataatgtgaccaaagtggagatggaaatggtcttacagaagcagaaatgtaatccagcacacgcagatggtgactgcttcgtgttctgtatcttgacccatggccgtttcggagctgtttacagtagcgacgaggccctgattcctataagagagattatgagccatttcacagcattgcaatgtccgaggctggcggaaaaacccaagttgttttttatccaggcttgccagggagaagagattcagccctctgtctccatagaggctgatgcattaaatccagaacaagcacccaccagcctgcaggattccatacctgcggaagcggactttctacttggactcgcaactgttccaggttatgtgagctttagacacgtggaagagggcagctggtatattcagtccttatgtaatcacctaaaaaagctggtcccgaggatgctgaagttcctcgaaaaaacaatggagatccgtggcaggaagcgaacggtgtggggcgctaaacagatttctgcaacttctcttccaacggctatatctgcgcagaccccgcgcccccccatgcggcggtggtcctcagtgtcttag

SEQ ID NO: 23292 - DNA, 1569 bp, Artificial Sequence
  Description of Artificial Sequence: Synthetic coding sequence
atgaagagccagggccagcactggtacagcagcagcgacaagaactgtaaagtaagttttagggagaagcttctgatcattgatagcaaccttggcgttcaggatgttgagaatctgaagttcctctgcatcggcctggtgcccaataagaagctcgagaagtctagctccgccagcgatgtgtttgaacatttactggcagaggaccttctgtccgaggaggacccatttttcctcgccgagctgctctacattattcgtcagaagaagctgctccagcacttgaactgcacgaaggaagaagtggagaggctgctgccaacacggcagagagtgtccctcttcaggaatttactgtacgagctgtcggaaggaattgacagcgagaacctcaaagatatgatcttcctgctaaaagactctctgcctaaaacagagatgactagcctctccttcttagcgtttctggaaaagcagggcaagatcgacgaggataacttgacatgcttggaagatttatgtaagactgttgtgcctaagctgctgaggaatatcgagaaatataagcgagagaaagccattcagatcgtaacacccccggtagacaaagaagcagaatcttaccagggcgaggaagagctggtatcacagacggatgtgaaaacctttctggaagctcttccccaggagagctggcagaacaaacacgctggctccaacggcaatcgcgcgactaacggcgccccttcactggtcagtagggggatgcagggggccagtgccaatacattgaatagcgagaccagcaccaaacgggctgccgtgtatcgaatgaacaggaatcaccggggactctgtgttattgttaataatcattcatttacaagcctaaaagacagacaggggactcataaggacgcagaaatcctgtcccacgtgttccagtggttgggcttcactgttcatatccataataacgttacaaaggtggagatggagatggtgctgcagaaacagaagtgcaacccagctcacgccgacggagattgttttgtgttctgcatcctcacccacggtagattcggcgcggtttacagctccgatgaggccctcatcccaatcagagagataatgtcacacttcaccgccttgcagtgccctcgcctcgcggaaaaacccaaattgttttttattcaggcttgccagggagaggagatccagccatctgtaagcatcgaagccgacgctctcaatcctgaacaggcccccacatctctgcaggattccatcccggcggaagccgatttcctgctcggccttgcaactgttccgggatacgtgtcttttcggcacgtcgaagagggctcttggtatattcagtctctctgtaaccatctgaaaaaactcgtcccacgtcatgaggatatcctatccatcctgacagccgtgaacgacgatgtgtctagaagggttgacaaacagggaaccaagaagcagatgccccaacctgcatttaccctgcgtaaaaagctggtctttccggtcccactcgacgctctcagcctgtag

SEQ ID NO: 23293 - DNA, 1440 bp, Artificial Sequence
  Description of Artificial Sequence: Synthetic coding sequence
atgaagagccagggccagcactggtacagcagcagcgacaagaactgcaaagttagcttccgcgagaaactgctgattatcgacagcaatcttggcgtccaggatgtcgagaacctaaaattcctgtgtatcggattagtacccaataaaaagctggaaaaatcttcatctgcttctgatgtattcgagcacctactggctgaagatttgctgtctgaggaagaccccttctttctggctgaacttctgtacatcatccggcagaaaaaattgctgcagcacctaaactgcacgaaggaggaggtagagagactcctgccaacccgccagagagtgagtctgttccggaacctgctgtacgagctatctgagggcatagatagcgagaacctgaaagatatgatatttctgcttaaagactcacttccgaaaaccgagatgacatctctgtctttcctagcatttttggaaaagcaaggcaagatcgacgaggacaatctgacatgcctggaagacctgtgtaagaccgttgttccgaagctgcttagaaacatcgagaagtacaaacgcgagaaagcaattcagattgtgactccccctgtagacaaggaggctgagtcttatcagggagaagaggaactcgtgtcgcagaccgatgttaagacattccttgaggctctgcctcgggctgccgtttatcgcatgaataggaatcaccggggcctgtgcgtcatcgttaataatcactcttttacttctctaaaagatagacagggaacccataaggatgcagagattcttagccatgtgttccagtggctgggcttcactgtgcatattcacaataatgtcacaaaggtggagatggagatggtgctgcagaagcagaagtgcaatcccgctcacgctgacggggactgcttcgtgttttgcattctgacccacggacggttcggcgctgtgtattccagcgatgaagctctcattcctattagagagattatgtctcacttcacagcgttgcagtgtcctagactcgccgaaaagccaaaactgttttttatacaggcttgccagggcgaggaaattcagccgagtgtcagtattgaggcagatgccctgaacccagagcaggcccccacctctctgcaggattcaatccccgcggaggctgatttcttgctcggcctggccacagtgccgggatacgtgagctttcgtcacgtggaggagggttcctggtacatccagagtttatgcaatcatctcaagaagctggttcctcgtcacgaagatattctgagtattctgaccgctgtgaatgatgatgtttctagacgagtggacaagcaggggacgaagaagcagatgcctcagcctgcatttactctccgaaagaaactggtttttcccgtaccgctggacgctctctctctctag

SEQ ID NO: 23294 - DNA, 822 bp, Artificial Sequence
  Description of Artificial Sequence: Synthetic coding sequence
atgaagagccagggccagcactggtacagcagcagcgacaagaactgtaaagtatccttcagagagaagctccttatcattgattctaatctcggggttcaggacgtggagaacctgaagtttctctgtattgggctggtgcccaacaagaaacttgaaaagtcctctagtgcgtctgacgtgtttgagcatctcctcgccgaggatctgctcagcgaggaagaccctttctttctggccgagctgctgtacataatccggcagaaaaaattgctacagcacctgaattgtaccaaggaggaggtggagcgtctcctccctacccgccagcgagtcagccttttccggaaccttctctacgaactctccgaagggatcgactccgaaaacttaaaagacatgattttcttgctgaaggacagcttgccaaagaccgaaatgacctccctcagcttcctcgcctttcttgagaaacagggtaagattgatgaggataatctcacatgcctggaagatctgtgcaagaccgttgtgcctaagctcttacggaatatcgagaaatataagagagaaaaggccatccagatcgtgaccccacccgtggacaaggaggctgagtcttaccagggagaggaagagctggtcagccaaacggatgtaaaaactttcctagaggcgctgccacaggaatcttggcaaaataaacatgctggtagtaatgagggctcctgtgtgcaggatgagagcgagccacagcggcccttatgccactgccagcagccccagctttatctacctgagggccagactcgcaatccatag

SEQ ID NO: 23295 - DNA, 1533 bp, Artificial Sequence
  Description of Artificial Sequence: Synthetic coding sequence
atggccgccgccgccctgcgggaccccgcccaggtgcccgtggccgccgatctgctgacggaccacgaagagggctatgtcacgttcgaagacgtggctgtgtacttctctcaggaggagtggcgcttgctggatgacgctcagcggttgctttatcgcaatgtgatgctggagaatttcacactgcttgcatcgctcgggcttgcgtcgagtaagacccatgaaatcactcagttagaatcctgggaggaaccttttatgccggcctgggaggtggtgacctccgccatccctagaggctgctggcacggcgccgaagccgaggaagcaccagaacagatcgccagcgtggggttgctgagttccaacattcaacagcatcaaaaacagcactgtggggagaaaccgctcaaacgccaggaaggccgggtcccggtgctgcggtcatgcaaagtgcacttaagcgaaaaatctctgcagtcgcgagaggtgggtaaggccctactcatctcttcaggagttctaaagcaccaggtgacgcacacaggtgaaaaaagccataggagctcaaagtctagggaggccttccatgccggtaagcgacactataagtgttctgaatgcggcaaggcctttggccaaaaatatctcttggtccagcatcagcgcctccatgccggaaaaaagacgtacgagtgcagtgagtgtggcaaactttttagggacatgtccaatctgtttatccatcaaattgttcatacaggcgaacggccatatggctgctccaactgcggcaagagcttttctcggaatgcacatctgatcgagcaccaaagagtgcacacaggggagaaaccatttacctgctcggaatgcggcaaggcattcagacacaatagcaccctagtccaacatcataagattcacacaggtgttagaccttacgagtgttcggagtgcgggaaactgttctcattcaatagcagcctgatgaagcatcagagaatccacaccggggagcgaccatacaaatgcagcgagtgcggcaaattttacagccacaaaagtaatctgatcaagcattggagagtgcatacaggcgagcgcccctacaagtgcagtgactgtggcaagttttttactcagtgcagcagcctaatgcagcaccagaaagtccataccggagaaaaaccatttaagtgtaacgaatgcggcaggttttttcgtgagaacagtacgctagttagacaccagcgcgtccacacaggtgcaaagccgtacgagtgcagagagtgcggtaaattttttagtcagagttcgaccttgatgcagcacaggaaagtccatattggggaaaagccctttaagtgtaacgaatgcggccgactgtttcgcgagaattcctcactcgtcaaacatcaacgtgtgcacacaggagccaaaccctatgagtgccgcgagtgcggtaagttctttaggcacaactcaagcctgttcaagcatcggcgcattcatactggagagatgcagtag

SEQ ID NO: 23296 - DNA, 729 bp, Artificial Sequence
  Description of Artificial Sequence: Synthetic coding sequence
atgagcaacccccggagcctggaggaggagaagtacgacatgagcggcgcgcggttagcccttatcctctgtgtgaccaaggccagagagggctccgaggaggatctcgacgcacttgaacacatgttcaggcaattaaggtttgagtccaccatgaagcgtgacccaacagcagagcagttccaggaggagttagagaaattccagcaggccattgattcacgagaggatcccgtgtcctgcgcctttgtggtgctcatggcccatggaagggaaggtttcctgaagggcgaagatggggagatggtgaagctcgagaatctgttcgaggccctcaataataagaactgtcaggcacttcgggcaaaaccaaaagtttatattattcaggcctgccggggcgagcagagagaccctggtgaaactgttggtggcgatgaaatcgttatggtcatcaaggattctccgcagaccatccctacctacactgatgctctgcacgtgtacagcacagttgaaggttacatcgcttacaggcatgatcagaagggctcttgctttatccagacacttgtggatgtctttacaaagagaaaaggccacatactcgaactcctgactgaggtcacgcggaggatggcagaggctgagctcgtgcaagagggcaaggctagaaagactaaccccgaaatacagagcacactcagaaaacggctgtacctccagtag

SEQ ID NO: 23297 - DNA, 1359 bp, Artificial Sequence
  Description of Artificial Sequence: Synthetic coding sequence
atggccgcccccagcgccggcagctggagcaccttccagcacaaggagctgatggcagccgacagaggacgtagaatccttggagtgtgtggcatgcaccctcaccatcaggagaccctgaaaaaaaacagggtcgtgttggctaagcaactcctactctctgaattactagagcatctcctggaaaaggatattatcaccctcgaaatgagggagctgatccaagcaaaggtcggctccttctctcaaaatgtcgaactgctgaatttactgcccaagcggggcccacaggcgtttgacgccttttgtgaggccttacgggaaactaagcaaggccatcttgaagacatgctgctgactacgctcagtggcctacagcatgtcctgcctcctctgtcctgtgattacgacctcagcctgccatttcctgtgtgtgaatcttgcccactctataagaagttgcggctctctacagacaccgtagaacactcattagacaataaggatggacccgtgtgcttgcaggtcaaaccctgtacacccgagttctatcagactcattttcaactggcctaccgtctgcagtcgcgacccagaggtcttgctcttgtattgagtaatgtacatttcacaggggaaaaagagttggaatttagatcgggaggcgacgtggaccattcaacactggtcactctcttcaagctgctaggctacgacgtacatgttttgtgcgatcaaacagctcaggaaatgcaagaaaagctgcaaaactttgcccagctgcctgcgcatcgcgtgaccgacagttgcattgttgccctgctgtcccacggcgtggagggagccatctacggcgttgacgggaaactgctacagcttcaagaagtgttccagttattcgataacgcaaactgtcccagcctacagaataagcctaagatgtttttcattcaggcatgcagaggtgacgagactgaccgcggagtagaccaacaagacggcaagaatcacgctggcagtcctgggtgtgaggagagcgatgccggaaaggaaaagcttccaaagatgagactccccacccggtctgatatgatttgcggctatgcctgtctgaaagggacagctgctatgagaaatacaaagcgaggctcctggtacatcgaagcgttggcccaggtgttctcggaacgggcatgtgatatgcacgtcgccgatatgctggtcaaagtcaacgccctgataaaggatcgcgaggggtacgcacccggaaccgagttccacaggtgtaaggaaatgagcgagtactgcagtaccctctgtaggcacttgtatctgttcccaggacatccccccacctag

SEQ ID NO: 23298 - DNA, 327 bp, Artificial Sequence
  Description of Artificial Sequence: Synthetic coding sequence
atggccgcccccagcgccggcagctggagcaccttccagcacaaggaattgatggcagcagaccgtggaaggcggatcctcggcgtgtgtggcatgcacccacatcatcaagagacccttaagaagaacagagtggtcctggccaaacagcttctgctgagcgagcttctggagcaccttctggagaaggacattattactctggaaatgcgggagctcatccaggcaaaggtagggtcattcagccagaacgtggagctgctgaacctcttgcccaagcgcgggccacaagccttcgatgcattttgtgaagccctccacagttag

SEQ ID NO: 23299 - DNA, 942 bp, Artificial Sequence
  Description of Artificial Sequence: Synthetic coding sequence
atgcacccccaccaccaggagaccctgaagaagaaccgggtggtgctggctaaacagctgctgctcagtgaacttcttgagcacttgctggagaaagacatcataacgctggagatgcgggaactcatccaagccaaagtcggtagcttctcacagaatgtggagctgctgaacttgttgccaaagcgaggaccgcaagcgtttgatgcgttctgtgaggccttgcgggagactaaacagggccacttagaggacatgctgctgactacattgagtgggctgcagcacgtgctcccccctctgtcatgtgattatgatcttagtttgccctttcctgtttgcgaatcatgtcccctctataaaaaattgcggctttccaccgatacggtggaacattccttagacaataaggacggtccagtgtgcttgcaggtgaaaccatgcacccccgagttctaccagactcacttccagctggcttacaggttacagagccggccccggggcctggccctcgtactcagcaatgttcatttcacaggtgagaaagaactagagttcagatcaggaggcgatgtcgaccactctacactggtgactttgttcaagctcctaggatatgacgtgcacgtcctgtgcgaccaaacggcccaagagatgcaggagaagctccaaaacttcgctcagctgccggcccacagggtgaccgatagttgcattgtcgcactcctgtcacatggggtggagggcgcaatctatggcgttgatggcaagctgcttcagctgcaagaggtctttcaactctttgataatgccaactgcccaagcttacaaaacaagccaaaaatgttcttcattcaggcctgcaggggagccggagccattggtagcctgggccacctgctgctgtttactgcggccacagcatctctggcactgtag

SEQ ID NO: 23300 - DNA, 993 bp, Artificial Sequence
  Description of Artificial Sequence: Synthetic coding sequence
atgctgaagctgaagaccaagttcggcagctggcagaccctgtgcaagcggtccaacgtctggcaggacaagtgctttttcaaacctttcaacatagaccagatctcgccaaataaaaaagcacatccaaacatggaggccgggccacccgagtctggcgagtccactgacgcactgaagctctgcccccacgaagagtttttgcgactgtgcaaggagagagcagaggagatatacccaataaaggagcgcaataacaggacccggctggcactgataatctgtaataccgagtttgatcacctgccccccagaaacggcgcggactttgacatcactggcatgaaggaattactggagggactggactattcagtagatgtggaagagaacctgaccgcccgcgatatggaatctgcactgcgcgctttcgctacacggccagaacataagagctcggactcaacatttcttgtgctaatgtcgcacggcattctggaagggatttgcggcacagttcatgatgaaaagaagcctgacgtgctgctgtatgacactatctttcagattttcaataataggaactgtctttccctgaaggataagcctaaggtgattattgtgcaggcttgtagaggggcaaacaggggagagctttgggtaagggactcacctgcttcactggaggtggccagcagccagagcagcgaaaatctcgaggaggatgccgtgtacaaaactcacgtcgagaaggacttcatcgccttttgcagctcaactcctcacaacgtgagctggagggactcaactatgggaagtatcttcatcacccagctgattacttgctttcagaagtacagctggtgctgtcacttagaggaggtcttccgcaaagtgcaacaatccttcgaaacccctcgcgcgaaagcacagatgcctacaatagagagactgtccatgacgagatacttttaccttttcccaggaaactag

SEQ ID NO: 23301 - DNA, 444 bp, Artificial Sequence
  Description of Artificial Sequence: Synthetic coding sequence
atggccgagggcaaccaccggaagaagcccctgaaggtgctggagtcactgggaaaggatttcctcactggagtcctcgacaacctagtcgagcagaacgttctcaattggaaggaagaagagaagaagaaatactacgatgctaaaacggaggataaagtaagagtgatggctgattctatgcaggaaaaacagcggatggcaggacagatgctgctgcaaactttctttaatatcgatcagatctctcctaataagaaggcccaccctaacatggaggcagggccccctgaaagcggcgagagcacagatgcactgaaactgtgccctcatgaggagtttctgcgactgtgcaaggagcgcgcagaagaaatctacccaatcaaggagaggaataaccgtacccggctcgccctgattatttgcaatactgagttcgactag

SEQ ID NO: 23302 - DNA, 1134 bp, Artificial Sequence
  Description of Artificial Sequence: Synthetic coding sequence
atggccgagggcaaccaccggaagaagcccctgaaggtgctggagtctcttgggaaggactttctgacgggagtgttagacaacttggtggagcagaatgtcctgaattggaaagaggaggagaaaaagaaatactatgacgccaaaaccgaggacaaggtaagagtgatggcagactctatgcaggagaaacagagaatggctggtcagatgctactgcagacattcttcaacattgaccagatatctccgaataagaaggctcatccaaacatggaggcaggaccccccgagagtggcgaatccacagacgctctaaagttgtgtccacacgaagagtttctgcggctttgcaaggagcgtgccgaggaaatctatccgataaaagagagaaataatagaacccgcctggccttaattatctgcaatactgagttcgaccatttgccaccccggaacggtgcagactttgacatcactggtatgaaggagctgctagaaggcctggattattcagtggatgtggaagaaaatctgactgctagggacatggaatctgcactgcgcgctttcgctaccaggccggaacataagagctccgattcaacctttcttgtcctcatgagtcacggaattctggaggggatctgcgggactgtccacgatgagaaaaaaccagatgtcctactatacgacaccatctttcagatcttcaataacagaaattgtctgtcattgaaggacaaaccaaaagtgatcattgtgcaggcatgccgtggagcgaatcgtggcgagctatgggtgcgcgattctccagcatcattagaggtggcttccagtcagagtagcgaaaacctagaagaggacgcagtctataagacgcatgttgagaaggacttcattgcattctgcagtagtacgccccataacgtgtcgtggcgcgattctacgatgggctctatcttcattacccagctaatcacatgctttcaaaaatattcctggtgctgtcacctggaggaagtctttagaaaggtacagcagagtttcgaaactccaagagccaaggcccagatgcccacaatagagcgattatccatgacacgctatttctacctctttcccggaaattag

SEQ ID NO: 23303 - DNA, 1305 bp, Artificial Sequence
  Description of Artificial Sequence: Synthetic coding sequence
atggccgaggacagcggcaagaagaagcggcggaagaacttcgaggcgatgttcaaagggatcctccaaagcggacttgacaacttcgtgattaatcacatgcttaagaataacgtcgccggccagacatccatacagactctcgtcccgaacacggatcagaagagtaccagtgtgaagaaagataaccataagaagaaaaccgttaaaatgctcgaatatctgggcaaagatgtgttgcatggcgtgtttaattatttggcaaaacatgatgtcctgactctcaaagaggaggagaaaaaaaagtattacgataccaagatagaagacaaagcacttattcttgtggattcactgcgaaagaacagggtcgcacaccagatgttcacacagacactgctaaatatggatcagaagattacaagcgtaaaacccttgctgcagattgaggcagggccccccgagagcgcagaatccacgaacatcctgaagctgtgtccacgtgaggagttcctgagactgtgtaagaaaaatcatgatgagatctatcccatcaagaaacgggaggatcgtagacgcttagccctgatcatctgtaatactaaattcgatcacctgccagcccggaatggggctcattacgacattgtagggatgaaacgcttactgcaggggctcggctacaccgtcgtcgatgaaaagaacctcactgccagagatatggaatccgttttgcgtgcatttgcggctaggcccgaacacaagtcgagcgatagtactttcctcgtgctcatgtcccacggaattctcgaaggcatttgtgggactgcccacaagaagaagaagccggatgtgctgctatatgatacaatcttccaaatttttaacaacaggaattgtctgtctcttaaggataaacctaaggtgattattgtacaggcatgcagaggcgagaagcacggcgagctgtgggtcagagactcccccgcctcactggcgctgatttcttcacagtcttccgagaacctggaagcggattctgtgtgcaagatccacgaagagaaggacttcattgcattctgttcttcaaccccccacaatgtgtcctggcgagatcgaacccgggggtctattttcatcaccgaactcattacctgtttccagaaatattcgtgctgttgtcatcttatggagatctttcgaaaggtgcagaagtctttcgaagtgccccaggcgaaggcccagatgccaactatcgagcgcgccaccctgactagggacttttaccttttcccgggtaattag

SEQ ID NO: 23304 - DNA, 402 bp, Artificial Sequence
  Description of Artificial Sequence: Synthetic coding sequence
atgctgaagaacaacgtggccggccagaccagcatccagaccctggtgcccaataccgatcagaagtctacctccgtgaagaaggacaaccacaagaagaaaaccgtgaaaatgctcgagtacctgggtaaagacgtgctgcacggtgtgttcaactacctggcaaaacacgatgttctgactttgaaagaagaggagaaaaagaagtattacgacaccaagattgaggacaaggcacttattctggtggatagtttacgaaaaaatcgagttgcgcaccagatgttcacacagaccttattgaatatggaccaaaagataacctccgtgaagcaccttagtaataaaaaagagagaggcccacaaacgcctggctcacatcatatgcaatacaaggtctag

SEQ ID NO: 23305 - DNA, 1344 bp, Artificial Sequence
  Description of Artificial Sequence: Synthetic coding sequence
atggccgccgtgccccgggtggagggcgtgttcatcttcctgatcgaagattctggtaaaaagaagcggaggaagaatttcgaggccatgtttaagggaatcctgcagtctgggctggacaacttcgtgattaaccacatgctgaaaaacaatgtggccgggcagacctctatacagacgctggtccctaacacagaccagaaatcgaccagtgttaaaaaagacaaccataaaaaaaaaaccgtcaaaatgctcgagtatttgggcaaggatgtccttcatggtgtattcaactatctcgccaagcatgacgttctcactctcaaagaagaagaaaaaaaaaagtattacgataccaagattgaggataaggcactgatattggttgactcactacgaaaaaatcgtgttgcccatcaaatgtttacacagacccttttgaacatggaccaaaagattaccagtgtgaaacctttactccagatagaagccgggccccccgagagtgctgaatcaaccaatattctgaaattatgtcctcgtgaggaatttctccggctgtgtaagaaaaaccatgacgaaatctaccccattaagaagcgggaggaccggagaaggctggcgcttatcatctgtaacaccaaattcgaccacctccctgcaagaaatggcgcccactatgatatcgtggggatgaaacgccttttacaggggttggggtacactgttgtggatgagaaaaaccttacggcccgcgacatggagagcgtccttagggcgtttgccgctcgacctgagcataagtccagtgactctaccttcctagtcctaatgtcccacgggatccttgaaggtatctgtggtaccgcccacaagaagaagaagcctgatgttctgctgtatgacacaatctttcaaatcttcaataatcgcaactgcctgagcttaaaggacaaaccgaaagtcattatcgtgcaggcctgtaggggagaaaagcacggcgagctctgggtgagggattccccagcttctctagccttgattagttcacagtccagcgagaatctcgaggctgattccgtctgcaagattcatgaagaaaaggacttcattgctttttgtagcagtaccccgcacaacgtgagctggcgggaccgtacaagagggagcatcttcataaccgagctcatcacctgctttcagaagtactcctgttgttgccacctgatggaaattttccgcaaagttcagaaatcttttgaggtacctcaagctaaagcacagatgccgactatcgaacgggccactttaacaagggatttctacctgttcccaggaaactag

SEQ ID NO: 23306 - DNA, 879 bp, Artificial Sequence
  Description of Artificial Sequence: Synthetic coding sequence
atggccgccctgctgcagatcgaggccggcccccccgagagcgccgagagtacaaatatcctgaagctctgtccacgcgaggagttcttaagactgtgcaaaaagaatcacgacgagatctaccccattaagaagcgggaggatagacgacggctggcgttgattatttgcaataccaagtttgaccacctgccagcccgcaacggcgcccactacgatatcgtgggaatgaagaggctgctgcagggcttaggttacactgtggtcgacgaaaaaaatctgactgctcgcgatatggaaagcgttctgcgagccttcgccgcaagaccagaacacaagagtagtgactccaccttcttggtcctaatgtcccatggaatcttagagggaatatgcggcaccgctcacaaaaagaagaagccagacgtgttattgtatgatactatttttcaaattttcaataaccgaaattgcctgagcttgaaagataagccgaaagttatcatcgtgcaggcatgtcgtggcgagaagcacggagaactctgggtcagggactcccctgcttccctcgcactcatttcaagccagagttccgagaaccttgaggccgattccgtgtgtaagatccatgaagaaaaagattttattgctttctgcagtagcacaccccacaacgtgagctggcgcgaccggacaaggggttcgatattcataacagagttaatcacttgcttccagaagtattcctgctgttgccacctcatggaaatctttcgaaaggttcaaaaaagttttgaggtgccccaagccaaagctcaaatgcccacaattgaaagagccacactgactcgcgacttctacctgttcccaggtaactag

SEQ ID NO: 23307 - DNA, 1131 bp, Artificial Sequence
  Description of Artificial Sequence: Synthetic coding sequence
atggccgaggacaaccacaagaagaagaccgtgaagatgctggagtacctgggaaaggatgtgctgcacggcgtatttaactatctggccaaacacgatgtgctcacccttaaggaagaggaaaaaaagaagtactacgacaccaaaatagaggataaggcactgattctggttgatagcctccgcaagaacagagttgcacatcagatgttcacccagacccttttaaacatggaccagaagattacatccgtcaagcccctgctccaaatagaagccgggcctcccgagtcagcagaaagcaccaacatattaaaactgtgccctagagaggagttccttagactgtgcaagaaaaatcacgacgagatttacccaatcaaaaagagggaagaccggcgccgactggccctgatcatttgcaacaccaaatttgaccacctgcctgcccggaacggggctcactacgatattgtgggcatgaagagactgcttcagggcctcggctacaccgtggttgacgagaagaacttgacagcgagggatatggaaagcgtactgcgggcattcgccgctcgaccagagcataagtcatccgattcaaccttcctggtcctgatgagtcacgggattttggagggcatctgcgggactgcacacaagaagaagaagcccgatgttttactctatgacactatctttcaaatatttaataataggaactgcctgtccttaaaggataagcccaaagtgattattgtgcaggcatgccgcggagagaagcacggcgagctctgggtgcgagattcacccgctagcctggcgctgattagctcccagagctctgagaatctggaagctgactccgtttgtaagattcacgaagagaaggattttattgccttctgtagcagcacaccacataacgtgtcctggcgggatagaacacgaggctccatctttatcaccgaactcatcacttgttttcagaaatattcttgttgttgccatcttatggaaatttttcgcaaggtacagaagtcttttgaggtgccccaagcgaaagcacagatgccaactatcgagcgcgccactcttacaagagacttctatctgtttcccggaaattag

SEQ ID NO: 23308 - DNA, 1344 bp, Artificial Sequence
  Description of Artificial Sequence: Synthetic coding sequence
atggccgccgtgccccgggtggagggcgtgttcatcttcctgatcgaagattccggaaaaaagaaacgacgcaagaatttcgaagccatgtttaagggtattctacagtcaggtctggacaattttgttattaatcacatgctgaaaaacaatgtcgctggccaaacatcaattcagaccctcgtccctaacacagatcaaaagtccacgtccgtgaagaaggacaaccataagaagaaaactgtgaagatgctggagtatctcggtaaagacgtgctgcacggcgtcttcaattatcttgctaagcatgatgttctgaccctgaaagaggaagaaaaaaaaaagtattacgatactaaaatcgaggataaagctctgatattagttgatagcctacggaagaaccgggtagcccatcagatgtttacgcaaaccctccttaacatggatcaaaaaataacatcagttaaacctctcctgcagattgaagccggaccaccagagagcgctgagtctacaaacattctgaagttatgtccaagagaggaattcctgaggctctgcaagaagaaccacgacgaaatctatcccattaagaagcgcgaagataggcggcgactggccctgattatctgtaataccaaatttgaccatttgcctgcgaggaacggagctcactatgacatcgtaggcatgaaaaggctgctacagggcctcggctacacagtcgtcgacgaaaagaacctgaccgcccgagatatggaaagcgtgctgagagcctttgccgcccggcctgaacataagtcaagcgactcgacctttttggtgctgatgagtcacgggatcctagaaggcatttgcgggactgctcacaaaaaaaagaaacccgatgtattgctgtacgacactatctttcaaatctttaacaacaggaattgcctgtctctgaaggataaaccgaaggtgattattgtgcaggcctgcaggggagagaaacacggcgaactgtgggttagagattcccccgcttcccttgctctgatttcctctcagtctagcgaaaatctggaagcagatagcgtgtgcaaaattcacgaagagaaagacttcatagccttctgttcgtccacccctcataatgtttcctggcgggatagaacacgaggatcaatctttatcaccgaactcattacttgctttcagaaatatagctgttgctgccacctcatggagattttccggaaagtgcaaaaatcctttgaggttccacaggctaaagcccagatgcccactatcgagagagcaaccctgactcgtgatttctaccttttcccaggtaactag

SEQ ID NO: 23309 - DNA, 879 bp, Artificial Sequence
  Description of Artificial Sequence: Synthetic coding sequence
atggccgccctgctgcagatcgaggccggcccccccgagagcgccgaatctaccaatatcctgaaattgtgcccaagggaagaattcctcagactttgtaagaagaaccacgacgaaatctatccaattaagaagcgagaggataggcggcggctggcacttatcatctgcaacacaaaatttgaccacctgccagcccgcaatggcgcccattatgatatcgtcggaatgaagcggctgctgcagggattgggatacacagtcgtcgatgagaaaaatctcaccgcaagggacatggaatccgttctgagggcgtttgctgccaggcctgaacacaaaagttctgactctacgtttctggtgctgatgagccatgggatattggaggggatttgcggaactgcccacaagaagaaaaagcctgatgtgctgctttatgacacaatatttcaaatcttcaacaaccgaaactgcctgtccttgaaggacaagccgaaggttataatcgtgcaggcttgtcgcggtgagaaacacggagaactgtgggtgagagattcacctgctagccttgccctgatatccagtcagtcaagcgaaaatcttgaagccgacagcgtgtgtaaaattcacgaggagaaggactttattgcattttgctcctctacacctcataacgtgtcctggcgagacaggactcgaggtagtatctttataactgagctgatcacatgtttccagaaatattcgtgttgctgtcacctgatggagatatttcgtaaggttcagaagtccttcgaggtgccccaagcaaaagcacagatgccgacgattgagagggctacactgactcgcgacttttatctgtttccaggtaattag

SEQ ID NO: 23310 - DNA, 882 bp, Artificial Sequence
  Description of Artificial Sequence: Synthetic coding sequence
atgagcagcgccagcggcctgcggcggggccaccccgccggcggcgaagagaacatgacggagacagacgctttctacaaacgtgaaatgttcgaccccgccgaaaagtacaagatggatcatcgacggcgcgggatcgccctgattttcaaccacgagcgcttcttttggcatcttaccctgcctgagcgacgaggaacttgtgctgaccgggacaacctcacgaggcgctttagcgacctcggcttcgaggtgaaatgctttaacgatctgaaagccgaggaactccttttgaaaatccatgaggtcagtactgtgagccatgcagacgcggattgttttgtgtgtgtgttcctgtcccacggggagggaaatcatatttacgcctacgatgcaaaaatcgagatccagacccttaccggcctgtttaagggggacaagtgccacagtttggttggaaaacctaagatattcatcatccaggcttgtcgtgggaatcagcatgacgtgccggtcattcctctcgacgtggtcgataatcagacggaaaaactcgacacgaacataaccgaggtggacgcagcctccgtgtatactctgcccgccggcgctgatttcctgatgtgctacagtgtggctgaaggctattactcacaccgagaaactgtgaatggcagttggtacattcaggacctctgcgaaatgctcggcaaatatggttcatctttagagttcacggagcttctgactctggttaacagaaaggtgagtcagcgccgtgtggatttctgtaaggacccaagtgctatcgggaagaagcaggttccatgttttgcatctatgctgaccaagaagctgcattttttcccaaagagcaactag

SEQ ID NO: 23311 - DNA, 615 bp, Artificial Sequence
  Description of Artificial Sequence: Synthetic coding sequence
atgagcagcgccagcggcctgcggcggggccaccccgccgtgagcacagtgtctcacgcagatgcggactgcttcgtttgtgtgtttctgtcccatggcgagggcaaccacatctatgcctatgacgctaaaatcgaaattcagacattgacaggacttttcaagggagacaagtgccacagcttggtcggaaagcccaagatttttattattcaagcatgcagagggaatcaacatgatgtgcccgtgattcccctagatgtcgtggataaccagaccgaaaagctagacacgaatatcaccgaagtcgatgctgccagtgtgtatactctgcccgccggggccgactttctgatgtgctactctgttgcagaggggtactactctcaccgtgagacagtgaacggcagctggtacatccaagacctctgtgaaatgctggggaagtacgggtctagtttagaatttaccgaactgctgaccctcgtcaatagaaaggtttcccagcgcagggtggacttctgtaaagacccttccgccatcggaaaaaaacaggtgccctgctttgctagtatgctgactaaaaagctgcactttttccccaaaagcaattag

SEQ ID NO: 23312 - DNA, 912 bp, Artificial Sequence
  Description of Artificial Sequence: Synthetic coding sequence
atggccgacgaccagggctgcatcgaggagcagggcgtggaggactctgctaatgaggactctgttgacgccaagcctgatagatccagtttcgtcccatctctgttctctaagaagaagaaaaacgttaccatgcgaagtatcaagaccacacgagatagagtgcccacgtatcagtacaatatgaatttcgagaaactcgggaagtgcattattattaacaataagaattttgacaaagtgactgggatgggcgttcgaaacggtacagacaaagatgccgaggccctgttcaagtgttttcgcagcttgggatttgacgtcattgtttacaatgactgcagctgcgccaaaatgcaagacctactgaagaaggctagtgaagaagatcacactaatgccgcctgctttgcctgtatcctccttagtcatggcgaggaaaatgtgatctatggtaaagacggtgtgacacccatcaaagaccttactgcccacttcagaggcgatagatgcaaaactctgctggagaaacccaagcttttctttattcaggcctgcagagggaccgaactggatgatggaattcaagctgatagtggccctattaatgacaccgacgctaatcctaggtacaagattccggttgaggctgactttctgtttgcgtacagcactgtgcccggatactattcatggcggtcgcctggtcggggaagctggtttgttcaggcactgtgtagcatactggaagaacacggcaaagaccttgagattatgcagatccttacgagagttaacgaccgagttgcgcgtcactttgagtcccaatccgacgacccgcactttcacgaaaaaaaacagattccctgtgttgtaagtatgctcacaaaggagctctacttctcccaatag

SEQ ID NO: 23313 - DNA, 912 bp, Artificial Sequence
  Description of Artificial Sequence: Synthetic coding sequence
atggccgacgaccagggctgcatcgaggagcagggcgtggaggactctgctaatgaggacagtgtggatgcaaaaccagacagaagctctttcgttccaagccttttctccaaaaagaagaaaaacgttactatgagaagcatcaagacgacccgtgacagagtgcctacttaccaatacaatatgaactttgagaaactcggcaaatgcatcatcattaacaacaaaaattttgataaggtgaccgggatgggcgtgcgcaacggcacagataaagatgcagaggccctgtttaagtgcttcagatctttaggatttgacgtgatagtgtacaacgattgctcttgtgcaaaaatgcaggatctcctcaaaaaagcctctgaggaagaccacaccaacgctgcctgcttcgcttgcatacttctgagccacggtgaggagaatgttatctatggcaaagacggggtgacccctataaaagacttgacagctcacttcaggggcgataggtgcaaaactcttttagagaagcccaaattgttctttatacaggcttgcaggggcacggaactagacgatgggatccaggcggatagcggccccattaatgacacagatgcaaacccccggtataaaattcctgtggaggcggacttcctctttgcttattctaccgttcccggatactatagttggcgaagcccaggcagaggctcctggttcgtccaagcactatgttcaatcctggaagaacacgggaaggatttggaaatcatgcagatcctaaccagagtgaacgatcgggtggcccgccacttcgaatcccaaagcgacgatccccactttcacgagaaaaagcagatcccctgcgtggtcagtatgctgacaaaagaactttatttctctcagtag

SEQ ID NO: 23314 - DNA, 663 bp, Artificial Sequence
  Description of Artificial Sequence: Synthetic coding sequence
atggccgacgaccagggctgcatcgaggagcagggcgtggaggactcagcaaacgaggattccgtggacgcaaagcccgacagatcaagcttcgtcccctccttgttttctaaaaaaaagaagaatgttacgatgcgttctattaaaacaacacgagatcgcgtgccaacgtaccaatacaatatgaattttgagaagctgggcaagtgtatcatcataaacaacaagaatttcgacaaagtcacaggtatgggcgtgagaaatggcactgataaggatgccgaggccctgtttaaatgctttcgctcgctggggttcgacgtgatcgtttataatgactgttcagtgacgcaggcaggcgtgcaacgtagagatttgggcaggcttcagccacctcctccaaggttcaagcagtacagttgcctgagtctccttagctcctgggattatcggcacgccccccccagactggcaaatttttgcatatttcgcagagaagggttccgccacgttgggcaggcgggattgaaactgctggcgagttcggatcctccgaccagcggtagtcagtctgcgggaatcacaggtgtgtcacttcacacccaaccgcagattatgaaggttagccttcggcattgcaacacttttatctgctttgcttag

SEQ ID NO: 23315 - DNA, 912 bp, Artificial Sequence
  Description of Artificial Sequence: Synthetic coding sequence
atggccgacgaccagggctgcatcgaggagcagggcgtggaggactccgctaatgaggattcggtggatgcgaaacctgatcggtccagctttgttccgtccttgttttcaaagaagaagaaaaacgtgacgatgcggtctattaagacaaccagggacagagtaccaacataccagtataatatgaacttcgagaagcttggcaagtgcatcatcatcaacaataaaaatttcgacaaagtaacgggaatgggtgtgcggaacggcactgataaggatgccgaagccctgttcaagtgttttagatcattgggcttcgatgtgatcgtatacaacgactgcagctgcgctaaaatgcaggacttgctcaagaaggcgtctgaggaagatcatacaaatgctgcctgtttcgcgtgcattttactgagccatggcgaggagaatgtgatttatgggaaagacggtgtaaccccaatcaaggacctgaccgctcatttccgaggggatagatgcaagaccctgctcgaaaaacctaaactgttcttcattcaggcatgtcgcgggacagaattggacgacggaatacaagctgacagcgggcccatcaacgacaccgacgccaatccaagatataaaatccctgttgaggcagatttcctgttcgcatattcaacggtacctggatactacagctggcggagcccgggtcgcggctcgtggttcgtgcaggctctgtgctcaattctagaagagcatggtaaagatctggagattatgcagattttaactcgggtaaacgatcgagttgcccgccatttcgagtcacaatctgatgacccacatttccatgaaaagaagcagatcccatgtgtggtgagcatgctgactaaagagctgtacttctcccaatag

SEQ ID NO: 23316 - DNA, 663 bp, Artificial Sequence
  Description of Artificial Sequence: Synthetic coding sequence
atggccgacgaccagggctgcatcgaggagcagggcgtggaggactccgccaatgaagacagtgtggatgcaaaacccgacaggtcgtcattcgttcccagtctcttctccaagaagaagaaaaatgtgaccatgaggtcgattaaaactacccgggatagagttcctacatatcagtacaatatgaatttcgaaaagctgggcaagtgcatcatcatcaataataaaaacttcgataaggtgacaggcatgggagttcgcaacggaacggataaggacgcagaggccctctttaagtgctttagatccctgggattcgacgtgatcgtgtataacgattgcagtttcactcaagctggggttcagcggagggatctgggtcgcttgcaacctccccccccgcgttttaagcaatactcttgcctgtccttgctctccagctgggattataggcatgcgccaccacggctggccaacttctgtatcttccgtagagaggggttccggcacgtgggacaggccgggctcaaattgcttgcctcgtcagaccctccgacgagtggcagccagagtgcaggcatcacaggggtgagcctgcatacccagccccagattatgaaggtctccctgcgccactgcaacaccttcatctgctttgcctag

SEQ ID NO: 23317 - DNA, 1011 bp, Artificial Sequence
  Description of Artificial Sequence: Synthetic coding sequence
atggactgcgtgggctggccccccggccggaagtggcacctggagaagaacaccagctgcgggggctcttctgggatatgcgccagctacgttacccagatggctgacgatcagggatgcattgaagaacagggagtggaagactctgccaacgaggatagtgtggacgcgaaacccgaccgaagttccttcgtaccatcactcttcagcaaaaagaaaaaaaatgtgacaatgaggtctatcaagaccactcgtgacagagtgccgacataccagtacaacatgaatttcgagaaactcggcaagtgcatcataattaataacaagaattttgacaaagtcactggaatgggcgtgagaaacgggaccgacaaggatgcagaggccctgttcaaatgctttcgcagcctgggctttgacgtcatagtgtataacgattgctcatgcgctaaaatgcaggacttattgaagaaagcatccgaggaggatcacaccaacgccgcttgcttcgcatgcatccttctgtctcacggcgaggaaaacgtgatttatgggaaagacggagtcacccccatcaaggacctcaccgctcactttcgaggcgacagatgcaaaaccctgctcgagaagcccaagctcttttttattcaggcctgccgggggaccgagctggacgacgggatacaggccgacagcggtccgattaacgataccgacgccaacccacggtataaaattcccgttgaggctgactttttgtttgcttattccaccgtgccaggatattatagctggcggagccccggacgaggaagctggtttgtgcaggccctatgctctatcttggaggaacacgggaaagacctggaaatcatgcagatcctcacaagggtgaatgaccgcgtagcacggcacttcgagtctcagagtgacgacccccactttcacgagaaaaaacaaatcccatgcgttgtgagtatgctgacaaaggagctttatttctctcagtag

SEQ ID NO: 23318 - DNA, 762 bp, Artificial Sequence
  Description of Artificial Sequence: Synthetic coding sequence
atggccgacgaccagggctgcatcgaggagcagggcgtggaggacagcgctaacgaagactctgtggacgctaaacccgatagaagctcatttgtgccaagcttgttctccaagaagaaaaagaatgtcacaatgagatctatcaagaccacccgcgaccgcgtaccaacgtatcagtacaacatgaatttcgaaaaactaggcaagtgtatcatcatcaataacaaaaactttgataaagtgacaggcatgggcgtaagaaatggtactgataaggacgcggaagcccttttcaaatgcttccgcagcttaggatttgacgtgatagtatacaatgattgtagctgtgccaagatgcaggacctgctgaagaaagctagtgaagaggaccacacaaatgcagcttgcttcgcctgcattcttctatcgcatggagaagagaacatggaatcttgtagcgttactcaagccggcgtgcagaggcgggacctaggccggctgcagccaccccctccccggctagccgaaggtccgagtctcatgatggcatcacggcctaccaggggaccgtcaatgactcagatgttaatattggatacccgctctcagtggaaactgacaagctccagccctattcctcggttccaagctataacccggggtggtgcccaggaagaagcgcctggcctatgcaaacccagcgccccatcctggcggtcaaccgagaagacatggaaatcttgccgctcgtcaccagggtag

SEQ ID NO: 23319 - DNA, 669 bp, Artificial Sequence
  Description of Artificial Sequence: Synthetic coding sequence
atggccgacgaccagggctgcatcgaggagcagggcgtggaggacagcgccaatgaagattcggtcgacgccaaaccggacagaagctcattcgtgccatctctgttttccaaaaagaaaaaaaacgttacaatgcgctcgattaagaccacgagagacagagtccccacttaccagtacaacatgaattttgagaaactgggcaaatgcattatcataaataacaagaactttgataaagttacaggaatgggggtgcgcaatgggaccgataaggatgctgaagccctgtttaagtgtttccgatctttaggatttgatgttatcgtttataacgactgctcttgtgccaaaatgcaggatctcctcaagaaagcatccgaagaagaccacaccaatgccgcatgcttcgcatgcattctgctgtcacatggcgaggaaaatgtgatttacggtaaagacggcgttacaccaattaaagacctgaccgctcattttagaggggaccgttgcaaaacattgctagagaagccaaagctgttctttatccaggcctgccgtggaacggagctcgacgacgggatccaggcggactcaggccccataaatgacacggacgctaatcctagatataaaatacctgtcgaagctgatttcctctttgcatag

SEQ ID NO: 23320 - DNA, 795 bp, Artificial Sequence
  Description of Artificial Sequence: Synthetic coding sequence
atggccgacgaccagggctgcatcgaggagcagggcgtggaggacagtgcaaatgaggattcggtagacgcaaagcctgaccgctccagcttcgtgccgtccctgtttagcaagaagaagaagaacgtgacaatgcgctctattaagacaaccagagacagggttcctacttatcagtacaacatgaactttgagaagctggggaaatgtataatcattaacaacaaaaatttcgacaaggtgacgggaatgggggtgagaaacggcaccgataaggacgcagaggctctcttcaaatgctttaggtcactcgggttcgacgtcatcgtatacaacgactgcagttgcgctaagatgcaggacctgctgaaaaaggctagcgaggaggaccatacgaatgccgcttgcttcgcctgcatcctgttttttatccaggcgtgtaggggaacagagttggatgacggtatccaggctgacagtggacccatcaatgacacagacgcaaaccctcggtacaagattcccgtggaggcggacttcctgtttgcgtacagcaccgtccctggctattactcttggcgcagtccgggtaggggctcgtggttcgtgcaggcactctgttcaattctggaagagcacggtaaggatcttgagattatgcagatacttacgcgggttaacgatagagtcgcccggcatttcgagtcccaatctgacgatccacacttccatgagaaaaaacagattccttgcgtagtgtcaatgttgaccaaagaactctatttttcccagtag

SEQ ID NO: 23321 - DNA, 837 bp, Artificial Sequence
  Description of Artificial Sequence: Synthetic coding sequence
atgcagcggggcctgttcagcgacggcgacaccagcaagaagaagaaaaacgtaacaatgcgatccatcaaaacaacccgggatagggtgcccacgtaccagtacaatatgaactttgagaagctgggcaagtgtataatcatcaacaacaaaaattttgacaaggtaaccggaatgggcgtgcgaaacggcaccgacaaagatgctgaggctcttttcaagtgctttaggagtttggggtttgacgtgatagtctacaatgattgttcttgtgcaaagatgcaggaccttctgaaaaaggccagcgaggaagaccacacaaacgccgcctgttttgcttgtatcttgttgtcccacggcgaggaaaacgtgatatacgggaaggacggcgtgactccgattaaggatttaaccgcccacttcagaggagatcgttgtaagacactgctcgagaagcccaaactgttcttcatccaagcgtgtagagggaccgagcttgacgatggcattcaggctgactctggacctatcaatgataccgatgcaaacccccggtataaaatcccggtggaggcagatttcctgttcgcatacagcacggtgccaggctactactcttggcgctcaccggggcggggcagctggtttgtgcaggccctctgttctatattggaagagcacggtaaggacttagaaatcatgcagattctgactagagtcaatgaccgtgtggcaaggcacttcgaatcccagtcagatgatcctcacttccacgagaaaaaacagattccctgcgtagtgtctatgctaactaaagagctatatttctcccagtag

SEQ ID NO: 23322 - DNA, 1188 bp, Artificial Sequence
  Description of Artificial Sequence: Synthetic coding sequence
atggacttcagccggaacctgtacgacatcggcgagcagctggacagcgaggatctggcgagcctgaagtttctgtcccttgactatattccccagcggaagcaggagcctatcaaagacgcactgatgctctttcagcgtttacaggaaaaaagaatgttggaggaaagtaacctatcctttctgaaggagctgctgttcagaataaatagactggacctcctcattacatatttgaacactcgaaaggaggagatggaaagggagctgcaaactccggggcgcgcacaaataagcgcctatagagtaatgctgtatcagatctccgaggaagtctccaggtcagagctgcgatccttcaagttcctcctgcaagaagagattagtaagtgcaagttagatgatgatatgaacttgctcgatattttcattgaaatggaaaaacgggttattctaggtgaaggaaaactggacattctcaagcgggtctgcgctcagattaataaaagtcttctcaaaatcatcaatgattatgaagaattctccaagggggcccttactaccacctttgaggaactgcacttcgagattaagcctcacgacgactgcacggttgaacagatttacgagatactcaagatttaccaactgatggatcactctaatatggactgtttcatatgttgcatcttatcgcatggagacaaaggtatcatatacggcacagacgggcaggaggcccccatctacgagcttaccagccagttcaccggactaaaatgcccaagcctcgccggaaaaccaaaggtgttcttcattcaggcatgtcaaggcgataattatcaaaaaggaatcccagtggagacagactcagaggagcagccttacctggaaatggatttgagtagtcctcagacgaggtacattcctgacgaggccgactttctactgggcatggctaccgtgaacaattgtgtttcctaccgcaacccagccgaggggacttggtacattcaaagcttgtgccagtctctgcgcgaaaggtgtccacggggagatgatatcttgactatattaaccgaggtgaactatgaggtttctaacaaggacgacaaaaagaatatggggaaacagatgccacagcctacgtttactttgcggaaaaagctcgtgttccccagcgactag

SEQ ID NO: 23323 - DNA, 1491 bp, Artificial Sequence
  Description of Artificial Sequence: Synthetic coding sequence
atggacttcagccggaacctgtacgacatcggcgagcagctggactctgaagacctggccagcttgaagtttctttctttggactacattcctcagcggaagcaggagcccatcaaagatgctctaatgctgttccagcggctccaggagaaacgcatgctcgaggaatctaacctttctttcctgaaagagctcctatttagaatcaataggctggacctgttgattacctatctgaataccagaaaagaggaaatggagcgggaactacagacaccaggcagagcgcagatctccgcttatcggttccacttttgtaggatgagctgggccgaagctaactcccaatgtcaaacccagtccgtacccttttggaggcgggtcgaccacctactgattcgagtcatgctgtatcagatcagcgaggaggtcagtcgcagcgagttacgctcctttaaattcctgctgcaagaggaaatcagtaaatgcaaactggacgacgatatgaatttactggatatattcattgaaatggagaaacgagtaatactgggagaggggaagctcgatatcctcaaaagagtttgtgcacagatcaataagagcttgctcaagatcatcaatgactacgaagagttctctaagggtgaagaactgtgcggcgttatgaccatctccgactcacctcgggaacaggacagcgagtcccagacacttgacaaggtttaccagatgaaaagcaaaccgcgcgggtactgccttatcattaataatcacaattttgcgaaggctcgcgagaaggtgcctaagcttcatagcatccgggatagaaatggaacacacctcgacgccggcgccctgactacgaccttcgaggagttgcatttcgaaatcaaaccacatgatgattgcacagtcgaacagatctacgagatccttaagatatatcaacttatggaccattctaatatggattgctttatctgttgcatcctgtcccatggtgataaaggtatcatatatggtacagatggtcaggaagcccctatttacgagctgacttcacaattcaccggactgaagtgccccagtctggcaggcaaacccaaagtgttttttatacaggcatgccaaggcgacaactatcagaaagggatcccggtcgaaaccgactcagaagaacaaccttacttggagatggatctcagctctcctcaaaccagatatatcccagacgaggccgattttctgttgggcatggctaccgttaataactgcgtgtcttaccggaatcccgccgaggggacatggtacatccagagcctgtgccagtcgctgcgagagcgttgccccagaggtgatgatatactgacaatcttaaccgaggtgaattacgaagtctcgaataaagatgacaagaagaatatggggaagcagatgcctcagcccacttttacactgaggaaaaaactggtgtttccctcagattag

SEQ ID NO: 23324 - DNA, 1395 bp, Artificial Sequence
  Description of Artificial Sequence: Synthetic coding sequence
atggacttcagccggaacctgtacgacatcggcgagcagctggacagtgaagacctagcatctctgaagtttctgtcattggattacattccccagaggaagcaggaacccatcaaggatgcgctgatgcttttccaacggcttcaggaaaaaaggatgctcgaagaatcaaacctgtcttttctgaaggaactcttatttcgtattaatcgactggacttgttgattacatatctcaacacccgaaaggaagaaatggaaagagaactccagacccccggtcgggctcagatcagtgcatatcgggtaatgctataccagattagcgaagaagtgtctcggagtgagctccgaagcttcaagttcctgctgcaggaagagatctccaaatgcaaactggacgatgacatgaatcttctggatatcttcattgagatggaaaagagggtcatcctgggcgaaggaaagctggacatcctgaagcgggtgtgtgcccagatcaacaagtcattgcttaaaataatcaacgattatgaagagttctctaagggagaggagctttgtggtgtgatgaccatcagcgacagcccccgtgagcaggatagcgaaagtcagaccttagataaagtttaccaaatgaaaagtaagcctcgtggctattgtctgataatcaacaatcataattttgcaaaggctagggaaaaagtccctaagttacactcaatccgggatcgaaatgggacccacctggacgctggagctctgacaacaacttttgaagagctccactttgaaataaaacctcacgacgactgcaccgtcgaacaaatatatgaaattcttaagatctaccagctcatggatcactccaatatggactgtttcatttgttgtatccttagtcatggggataagggcataatctacggcacagatgggcaggaagcaccaatctacgagttgacttctcagttcacaggcctgaagtgtcccagtctggccggcaagccgaaagtttttttcatccaggcatgtcagggggacaattatcagaagggcatccccgtcgagaccgactctgaagagcagccgtacttggaaatggatctgtccagcccacagacccggtacattcccgacgaggccgattttctgctgggcatggctacagtgaataactgcgtcagctatcgaaatccagctgagggtacttggtacatccagtccctatgtcaatctctgcgagagaggtgccctcgtggggacgatatcttaaccatcctcaccgaagtgaattatgaggtgtctaacaaggatgacaaaaagaatatggggaaacagatgccacagcctacgttcactttgcggaagaaattggtgtttcctagcgattag

SEQ ID NO: 23325 - DNA, 1617 bp, Artificial Sequence
  Description of Artificial Sequence: Synthetic coding sequence
atggagggcggccggcgggcccgggtggtgatcgagagcaagcggaatttctttctcggtgcctttcccaccccctttccagccgagcacgtcgagctgggaagattaggtgattcggagacagctatggttcccgggaagggaggagctgactatattttgctgccattcaagaaaatggactttagccgtaatctctacgacatcggggaacagctcgattctgaggatctcgcttccctgaagtttctgtccttagattatatcccgcagagaaaacaagagccaattaaggatgccctgatgctgtttcagcgcctccaagagaagagaatgctggaggaatccaatctgtccttcctgaaggagttattgttcaggatcaacaggctagatctgttgataacttatcttaatacaaggaaggaagaaatggaaagagagctgcagaccccgggccgtgcccagattagtgcctatagagtgatgctgtatcagatctccgaagaagtatcgcgctccgaactcaggagctttaagttcctgctgcaggaggaaatctccaaatgcaagttagacgacgatatgaacctgttggacatcttcatcgaaatggagaagcgcgtgatactcggagagggaaaactcgatatcctgaaaagagtgtgcgcacagatcaacaaatctcttcttaagattataaacgactacgaagaattctctaaggagagaagctccagcctggaagggtcgcctgatgaattctctaacggggaagagctttgcggggtcatgacaatttctgactcaccgagggaacaggattccgagtcacagacactggacaaggtgtaccagatgaagtctaagccccggggctattgcttgatcatcaataaccataatttcgcaaaagcacgagaaaaggtacccaagttgcacagcatccgcgaccggaatggaacacacttagacgctggcgctctgaccaccaccttcgaggaacttcactttgagatcaagcctcatgacgactgtacagtcgaacagatttacgaaattctaaagatttaccagttgatggatcactccaacatggattgtttcatatgctgtatcctctcccatggggacaaagggatcatctacgggactgatgggcaggaagcacccatatatgagctgacgtctcagttcacaggcttgaagtgtccaagtcttgccggaaaacctaaggtatttttcattcaggcctgccagggcgacaactaccagaagggcatccccgtggagactgattctgaagagcaaccgtacctggaaatggatctgtccagcccgcagacccggtatatcccagacgaagccgacttcctcctgggcatggcgacggtgaacaattgtgtttcatacagaaaccctgccgagggaacctggtacattcaatcactgtgtcaaagcctgagagagagatgccctaggggcgacgacattctcacaattctgaccgaggttaactatgaggtctccaataaagacgataagaaaaatatgggaaagcagatgccacaaccaaccttcaccctgaggaagaagctagtattcccaagcgactag

SEQ ID NO: 23326 - DNA, 708 bp, Artificial Sequence
  Description of Artificial Sequence: Synthetic coding sequence
atggacttcagccggaacctgtacgacatcggcgagcagctggacagtgaagacctggcttcgctgaaatttctgagcctcgattacataccccaaaggaaacaagagccaattaaggacgccctcatgttattccagcgccttcaggaaaaacgcatgctggaagaatctaaccttagttttctgaaagaactgctgtttcgtattaatcggctcgatctgctcatcacgtacttgaacactagaaaggaagaaatggaacgagagctccaaacgccaggacgcgctcaaatctccgcttacagagtcatgctgtatcagatctcagaagaggtgagcagatcagagcttcggagctttaaatttctgctgcaggaggagatctcgaagtgcaagcttgacgacgatatgaacctcctggacattttcatcgagatggagaaacgcgtaatactcggcgaggggaagcttgatatcctgaagcgagtctgcgcccagataaacaaaagcttgttgaagatcatcaacgactatgaggagttttctaaagaaagatcgagctctctcgagggaagtcctgatgagttctccaacgactttggacaatccctcccaaatgaaaagcagacatccgggatcctctcggatcaccaacagtcacagttttgtaaatctaccggggagagcgcccagacgtcacagcactag

SEQ ID NO: 23327 - DNA, 708 bp, Artificial Sequence
  Description of Artificial Sequence: Synthetic coding sequence
atggacttcagccggaacctgtacgacatcggcgagcagctggacagcgaggacctcgcttcactcaaattccttagtctagactacatccctcagcgaaaacaagaaccaatcaaggatgccctgatgctgtttcaacgcctgcaggaaaaacgcatgctggaggagtccaacctctcattcctgaaggaactgctctttcgcatcaatagattagacctccttataacttacctgaatacaaggaaggaggagatggaaagagaactgcagacccccggtagggctcaaatttctgcgtatcgtgtgatgctgtatcaaatttcagaagaggtctctcgcagcgaactgcgaagtttcaaattcttgctgcaggaagagataagcaagtgcaaactggatgacgatatgaacctcctggacatctttattgagatggagaagcgtgtgatcctgggcgaggggaagcttgacatcctcaagagagtgtgtgcccaaataaacaaatccctcctcaagatcatcaacgattatgaagagttttctaaggagcgatcttcttcactcgaaggttcacctgatgaattctctaatgattttggccagagcttacctaacgagaagcaaacaagtggcatcctgtccgatcaccaacagagtcaattctgcaaaagtactggtgagtcggctcagacatctcagcattag

SEQ ID NO: 23328 - DNA, 837 bp, Artificial Sequence
  Description of Artificial Sequence: Synthetic coding sequence
atggacttcagccggaacctgtacgacatcggcgagcagctggactcagaggacctcgcaagtctgaagtttctctccctcgactacatccctcagcggaagcaggagcctattaaggatgcccttatgctcttccaacgtttacaggagaagcgaatgttagaagaatccaacctgtcattcctgaaggagctgctgttccggattaacagacttgatttgctgatcacatacttgaacactaggaaagaggaaatggagagggaacttcagacgcccggaagggcgcagatttccgcctaccgtgtaatgctgtaccaaatctccgaggaagtatcccgcagcgaacttcggtcctttaagtttcttctccaggaggagatttccaagtgcaagctggatgatgacatgaatctgctggacatctttattgaaatggagaaacgggtcatcctcggtgagggcaagctcgacattctgaaaagagtttgcgcgcaaatcaacaagagtctgctaaaaatcatcaatgactacgaggagttcagtaagggagaggagctgtgtggcgtgatgaccatctccgatagcccccgcgaacaggactccgagtctcaaactctggataaagtgtatcagatgaaatccaaaccacgaggatactgcttgattatcaacaaccataacttcgcgaaggctcgagaaaaggtgccgaaactgcattctatccgagaccggaacggtacccacctcgatgcagggagccactcagtggcacaagccggggtgcagtggtgtgatctgagctctctccaacctcctccaccatggttcaagtag

SEQ ID NO: 23329 - DNA, 1395 bp, Artificial Sequence
  Description of Artificial Sequence: Synthetic coding sequence
atggacttcagccggaacctgtacgacatcggcgagcagctggactccgaggatctagccagcctgaaatttctgtctctcgattacataccacagagaaagcaggaacctatcaaggatgccctcatgctgttccagcgcttgcaggaaaaacggatgctcgaggagtccaacctctcgttccttaaagaattgctgtttcggatcaatagactggacctgctcataacatacctgaatactaggaaggaggagatggaaagagaactccagactcctggccgggcacagattagcgcttaccgtgtcatgttataccagatctcagaggaagtgtcccgatctgagctgagaagttttaagttccttctccaggaagagatcagcaagtgtaagctcgatgatgatatgaacttactcgatattttcattgaaatggagaagcgcgtcattctcggcgagggaaagctggatatccttaagcgtgtgtgtgcacagataaacaagtcgctgctgaagattatcaacgactatgaagaattctctaaaggcgaagaactctgcggagtgatgaccatctctgatagccctagagaacaggactcggagtcccagactctggataaagtgtaccagatgaagagtaagccccgtgggtattgcctcattattaacaaccacaatttcgcaaaagccagggagaaggtcccgaaactgcactcaatccgagaccgaaatggaacccacttggacgcaggagctctcacgacaacatttgaggagcttcacttcgaaattaagccacacgatgattgtactgtcgaacagatttacgagattcttaagatctaccaactcatggatcactctaatatggactgtttcatatgttgcatactgagtcatggagataaggggatcatatatggaactgacggccaggaagcacccatctacgagctgacaagccaattcacggggctcaaatgcccctctcttgcgggcaagcccaaagtgttcttcattcaggcctgccaaggagataactaccagaaggggattcctgtcgaaacagattctgaggagcagccctacctggagatggatctgtcttctccccagactcggtatatcccggatgaagcagacttcctgctgggcatggctaccgtgaacaattgtgtgtcgtatcgtaaccctgccgagggcacgtggtacatccagtctctctgccagtctctgagggaacggtgtcctcgcggtgacgatatactcaccatcttgactgaggtcaactacgaggtatcaaacaaagacgataagaagaacatgggaaagcagatgccccagcctacctttacactgcgcaaaaaacttgtgtttccttcagactag

SEQ ID NO: 23330 - DNA, 663 bp, Artificial Sequence
  Description of Artificial Sequence: Synthetic coding sequence
atggacttcagccggaacctgtacgacatcggcgagcagctggacagtgaggacttagccagccttaagtttctgtctctggactatatcccgcagcggaaacaggagcccattaaagacgctctaatgctgttccagcggctccaggaaaaaaggatgctggaggagagcaatctgtcatttttgaaggaacttttgttcaggattaacagactggacttgctgatcacgtacctgaacactcgcaaggaggagatggagcgcgagttacaaactccagggcgagcccagattagcgcttatcgcgtgatgctgtatcaaataagtgaagaggtctctaggagcgagcttagaagcttcaaattcctgttgcaggaggagatatcaaagtgcaagctggacgacgacatgaatctccttgacatattcattgagatggaaaagagagtgatactaggcgaaggaaagctggacattcttaagcgcgtttgtgctcagatcaataagtcactgctgaagatcatcaatgactacgaagaattctctaaggattttggccagtccctgccaaatgaaaagcagacgagcggcattctcagtgatcaccagcaatctcaattttgcaagtccactggcgagagcgcacaaacaagccagcactag

SEQ ID NO: 23331 - DNA, 597 bp, Artificial Sequence
  Description of Artificial Sequence: Synthetic coding sequence
atggacttcagccggaacctgtacgacatcggcgagcagctggactccgaggacttggcgtcactgaaatttctgagccttgactatataccacagagaaaacaggagccgatcaaggatgctcttatgctctttcagaggctccaggaaaaacgcatgctggaggaatccaatctctccttcctgaaggaactgttgttccgcattaacaggcttgacttgttaatcacctatctgaatacccgaaaggaagagatggaacgcgagttgcagactccgggacgggcacaaatatccgcttaccgggtgatgctttatcaaattagcgaggaagtctcgaggagcgaactccgctctttcaagtttctgctacaggaggaaatttccaagtgtaagcttgatgacgatatgaatctcttagatattttcatcgaaatggaaaaaagagtcatattgggggaagggaagctggacatactcaagagagtgtgcgcccaaatcaacaaatccctgttaaaaataataaacgattacgaggagttctctaaagagcggagctctagcctggaggggtccccggatgagttcagtaactag

SEQ ID NO: 23332 - DNA, 351 bp, Artificial Sequence
  Description of Artificial Sequence: Synthetic coding sequence
atggacttcagccggaacctgtacgacatcggcgagcagctggactccgaagatcttgcctccctcaaattcttatcacttgattatataccacagcggaagcaagaaccaatcaaggacgctcttatgctgttccagcgcctgcaggagaagaggatgttggaggagagcaacctcagtttcctgaaagaactacttttccggatcaatcgcttggatctcctaatcacatacctaaacacaagaaaggaagagatggaacgcgagttgcagactccagggcgcgctcagattagcgcttacagggttatgctttatcagatatctgaagaggtgtcacggagcgaatag

SEQ ID NO: 23333 - DNA, 1440 bp, Artificial Sequence
  Description of Artificial Sequence: Synthetic coding sequence
atggacttcagccggaacctgtacgacatcggcgagcagctggacagcgaagacctcgcatcactcaagttcctgtctctggactatattccgcagaggaagcaggaaccgattaaggatgccctgatgctgtttcaacgcctgcaggaaaagcgaatgttggaggaatctaacctgtccttcctgaaggaacttctgttccggattaataggttggatctgcttattacatacctgaatacgcgcaaagaggaaatggagagggagctacaaacacccggacgtgcccagatctccgcctacagagttatgctgtatcagataagtgaggaagtgtcacgttctgagttgcgaagcttcaaatttctgctacaggaagagatcagtaaatgcaagcttgacgatgacatgaacttgctggatatttttatagagatggagaaacgggtaatcttgggtgagggcaagctcgacatactgaaaagggtctgcgcccaaataaataagtccctgctgaagataatcaacgattatgaggagtttagtaaagaacggagttcctccttggagggaagccctgacgagttttctaatggggaggaactctgtggagtaatgacaataagcgactctccacgcgagcaagattcggaatcacaaactctggacaaagtgtaccagatgaagagcaagccacgaggttattgtcttataatcaataaccacaattttgccaaagcccgggagaaggtgcccaaactccactccatacgcgacaggaatggaactcatctggatgcaggcgccctaacaacgacattcgaagagctccacttcgagatcaagcctcatgacgactgcacagttgagcagatttacgaaatactgaagatttaccaattaatggaccatagcaacatggactgttttatatgctgtattttgtcgcatggcgacaagggcataatctacggtacagacggccaggaggcacctatttacgaactcacttctcaattcacaggccttaagtgtccatctctggcgggtaagccaaaagtgttttttatccaagcttgccagggcgacaattaccagaagggaattccagtcgaaaccgactccgaggagcagccttatctggagatggatctgtcttccccacaaacccgctatattccagacgaggccgacttcctccttggtatggccactgtcaataattgcgtcagctataggaatccagcagaggggacttggtatatccagagcctttgccagtctctgagggaacggtgtccgagaggcgacgatatcctaacgatccttacagaggtcaactatgaagtctctaacaaagatgataaaaaaaacatgggtaaacagatgccccaaccaacatttaccttgcgcaagaagcttgtattcccctccgattag

SEQ ID NO: 23334 - DNA, 375 bp, Artificial Sequence
  Description of Artificial Sequence: Synthetic coding sequence
atggacttcagccggaacctgtacgacatcggcgagcagctggacagcgaggatctagcctctcttaaatttttgtcgttggactacatcccacagcggaagcaggagcccatcaaagatgccctgatgctttttcagcgactgcaagagaagcggatgctagaggaatctaacttatcatttctgaaagagctcctgttcagaattaaccggctcgacctcctgattacatacctgaatacccgaaaggaggaaatggaacgggagctacagaccccaggacgtgctcagatctcagcgtacagggtgatgctgtatcagattagcgaggaagtttcgagaagcgaattgcgcagcttcaagtttctactatag

SEQ ID NO: 23335 - DNA, 630 bp, Artificial Sequence
  Description of Artificial Sequence: Synthetic coding sequence
atggacttcagccggaacctgtacgacatcggcgagcagctggactccgaggacttggctagcttgaagtttctaagcctggattatatcccccagcgcaagcaggaaccgattaaagacgccctgatgctgtttcaaagactccaggaaaaacgtatgctggaggagtctaacctgtcattccttaaggaactgctgttcaggatcaatcggcttgatctgttgattacatatctgaacaccagaaaagaggagatggagagggagttgcaaacccctggcagagcgcagatctcagcctacagagtgatgctttaccagattagcgaagaggtgagcagatctgaactccggtctttcaagtttctgctgcaggaagagatatcaaagtgtaagctggacgacgacatgaacttgctggatatattcatcgaaatggagaagagagtcatcctcggtgaagggaagctcgatatcctcaagcgggtttgcgctcaaatcaacaaatccttgctgaagattataaacgactatgaggaattcagcaaagattttggccagagtctcccaaatgagaaacagaccagcggcattctgtcggatcatcaacagagtcagttttgcaagtag

SEQ ID NO: 23336 - DNA, 1251 bp, Artificial Sequence
  Description of Artificial Sequence: Synthetic coding sequence
atggacgaggccgaccggcggctgctgcggcggtgccggctgcggctggtggaggaattacaggtggatcagctgtgggatgccttacttagccgagagctgttccgccctcacatgatcgaggacatccaacgcgccgggagtggttctaggcgtgaccaggcgcgtcagctcattatcgacctcgaaaccagaggctcccaggccctgcccctgttcatttcatgcctagaagatactggtcaggacatgctggctagcttcctcaggactaatagacaggctgctaaactctcgaaacccaccctggagaatctgacccccgtagttctgagaccagaaatcaggaagcccgaagttctccgcccagaaacacccaggcccgtggatattggttccggtggctttggagacgttggggcactggaatccttaagggggaacgcagatcttgcttatatactttctatggagccttgtgggcactgcttgattatcaataatgtaaacttttgccgtgagtcaggcctgaggacccggacaggcagcaatattgattgtgagaaattaagaagaagattttcttcacttcacttcatggtggaggtcaaaggggatctgacggccaagaaaatggttctggcgcttctggagttggcccagcaagaccacggtgcattggattgctgcgtcgtcgtgatcctgagccacggctgtcaagcttcacatctgcaatttcccggagctgtttatggaaccgacggctgtccagtgtccgtagaaaagatcgttaacattttcaatggaacctcctgtccatccctggggggaaaaccaaagttatttttcattcaggcttgcggtggcgagcagaaagaccacggtttcgaggtggcttcgacaagtcctgaagatgagagtcctgggtccaacccagagccagatgctaccccttttcaggaaggcctgcgcacttttgaccagctcgatgctatatcgtctctgccaactcccagcgatatttttgtgtcctatagcacctttcccggattcgtatcctggagggacccaaagtctggaagctggtatgtggagacactcgacgacatctttgagcagtgggctcacagcgaggatcttcagtccttgttgctccgtgtggcaaacgcagttagtgtgaagggaatttacaaacaaatgccggggtgttttaattttttgcgtaagaagttgttcttcaagaccagctag

SEQ ID NO: 23337 - DNA, 801 bp, Artificial Sequence
  Description of Artificial Sequence: Synthetic coding sequence
atggacgaggccgaccggcggctgctgcggcggtgccggctgcggctggtggaggaactccaagtggatcaactctgggacgcccttctgtcccgggaactattcagaccacacatgatagaagatattcagcgcgccggtagtggctcccgccgggatcaggcccgtcagctaatcatcgatctggaaacccgcggctctcaggctctcccattattcatcagctgtcttgaggatacaggccaggatatgttggcttcctttttgcgcaccaatcgtcaggcggccaaacttagcaaaccgactctggagaacctgacgcccgtggtccttcgaccagagattcgtaaaccggaagtgcttcggcccgaaactcctagacctgtggatatagggagtggggggtttggcgacgtcgagcagaaggatcatggctttgaggttgcttccacttccccagaggacgaatcccctggctctaatcctgaacccgatgccacaccatttcaggagggcttgagaacttttgatcagctggacgctatcagttctctccctactcctagcgatatattcgtgtcatactctacatttccggggtttgtatcttggcgtgatccaaagtccggatcctggtacgtggaaacactggatgatattttcgaacagtgggcacacagtgaggacctccagtcattattgctgcgtgtcgccaacgcggtcagtgtgaagggtatctacaaacagatgcccggttgtttcaatttcctacgcaaaaaactgttcttcaagacaagctag

SEQ ID NO: 23338 - DNA, 603 bp, Artificial Sequence
  Description of Artificial Sequence: Synthetic coding sequence
atggagccctgcggccactgcctgatcatcaacaacgtgaacttctgtcgcgagagcggtctccgtacgcgcactggcagtaacatcgactgcgagaaattgcgtcgcaggttttcaagcttacattttatggtggaggtgaagggggacttaacggccaagaagatggtgcttgctctgctggaactcgcccaacaggatcatggcgctctcgattgctgtgtcgttgtgattctgagccacggctgccaggcttcacacctgcagtttcctggtgctgtgtatgggaccgacggctgtcccgtgagcgtagaaaaaatcgtgaacatttttaatgggacaagctgcccttctctgggagggaaacctaaacttttcttcatccaggcgtgcggcggcggatttgtctcctggcgggatcccaaaagtggcagctggtacgtggaaacactcgatgatattttcgaacaatgggcccacagtgaggacttgcaaagcctgctgcttcgtgtggccaatgcagtgagtgtgaaaggcatatacaagcagatgcccggctgttttaacttcctgcgcaaaaagctgttcttcaaaacatcttag

SEQ ID NO: 23339 - DNA, 1002 bp, Artificial Sequence
  Description of Artificial Sequence: Synthetic coding sequence
atgctggccagcttcctgcggaccaaccggcaggccgccaagctgagcaaacctactttagaaaatctgactccggttgtgcttcgtccagaaattcgcaagccagaagtgctgcggccagagacacccaggcctgtggatattggttcggggggcttcggcgatgtgggcgcacttgaatccctacggggcaacgctgacctggcctacatcttgtcaatggagccgtgcggccattgtctgatcatcaacaacgtgaacttttgccgggaaagtggcctcaggacacggaccggaagtaacattgattgcgagaagctgagacgacgattctcatctctgcatttcatggtggaagtcaagggcgatctgaccgccaagaaaatggtcctcgcactcctcgaactggcacaacaagaccatggtgcactggattgctgcgtagtggtgatactctcacatgggtgccaggcctcccatttacagtttccaggggccgtgtatggcaccgatggatgtcccgtgagcgtggagaagatcgttaacatttttaacggtacaagctgcccctccctgggcggcaagccaaagcttttctttatacaggcatgtggtggagaacagaaggatcatggatttgaagttgcaagcacatcgccggaagatgagtcaccaggaagcaaccctgagcccgacgctacacctttccaggagggcttaaggactttcgatcaactggacgcgatcagctccctccccacaccttcagacatctttgtgtcctactccacgttccctgggttcgtgagctggagagaccctaagagtggaagctggtatgtagagacacttgacgatatattcgaacagtgggcccattcagaggacctacagagtctgcttctgcgggtcgccaatgccgttagcgtgaagggcatctacaaacaaatgcctggctgtttcaatttcctcaggaaaaaactgttctttaagaccagctag

SEQ ID NO: 23340 - DNA, 765 bp, Artificial Sequence
  Description of Artificial Sequence: Synthetic coding sequence
atggacgaggccgaccggcggctgctgcggcggtgccggctgcggttagtcgaagagttgcaagtcgaccaactctgggatgctctcctgagtcgggagttatttaggccccacatgatagaagacatacagcgggccggaagcggttcgaggcgtgatcaggctcgtcagctgatcattgatctagaaacccgaggatcccaggccctgcccctcttcatatcttgccttgaggatactggccaggacatgctggcttcattcctgaggactaatcgacaggccgccaagctgagcaaaccaaccctcgaaaacctgactcccgtggtactgcgaccagaaatcaggaaacccgaagtcctgcggccagaaactccgcggcctgttgacatcggatccgggggctttggggatgtgggcgcccttgagtctttgcgtggcaacgccgatctcgcctacatcctctcaatggaaccctgcggccactgcttaataattaataacgtgaacttctgccgggaatctggactcaggaccaggacaggttctaacatagactgcgaaaaactaaggaggcgcttctcttcactgcactttatggtggaggtcaagggcgacctgactgcaaaggcgtcccatctgcaatttcctggggctgtgtatgggactgatgggtgcccagtgagcgttgaaaaaatagtgaacatattcaatgggacctcatgcccgagtttgggagggaaaccaaaactgtttttcatctag

SEQ ID NO: 23341 - DNA, 801 bp, Artificial Sequence
  Description of Artificial Sequence: Synthetic coding sequence
atgctggccagcttcctgcggaccaaccggcaggccgccaagctgagcaaacctactttggagaacctcacaccagttgtgctgcgaccggagatccgcaaaccagaggtcctgagacctgagacgccccggccagtcgatataggctctggtggctttggggatgttggggctctcgagagtcttcggggcaacgcagatcttgcatacattttgagtatggagccatgcggccactgcttgattatcaataacgtaaacttttgtagggaatcgggcctgaggaccaggaccgggtccaacattgactgtgagaaactgcggagaaggttttcttcattacacttcatggtggaagtaaagggagatctgacagctaaaaagatggtgctcgcactgcttgagctggcacaacaggatcatggagctcttgactgctgcgtggttgtcattctgagccacggatgtcaggccagccatttacagttcccaggggcggtgtatggcactgatggctgtccagtctctgtcgagaaaattgtgaacattttcaacggcacttcatgcccatcgctggggggtaaacctaagctcttttttatccaggcttgtgggggtgagcagaaagaccacggcttcgaggtcgcttctacttccccggaggacgaaagccccggctcaaatcctgagcccgacgcgacccccttccaggagggtctgcggacattcgatcaattggatgcgatctcttctctgccgactccctcggatatttttgtctcatatagcacatttccctag

SEQ ID NO: 23342 - DNA, 1266 bp, Artificial Sequence
  Description of Artificial Sequence: Synthetic coding sequence
atggacgaggccgaccggcggctgctgcggcggtgccggctgcggctggtcgaagagctgcaggtggaccaactctgggacgccctgcttagcagagaactgttccgaccacacatgatagaagacatccagagagctggatcaggctccaggcgggaccaggccagacagttgatcattgatctggagacccgcggcagccaggcgctgccattattcatttcttgtctggaggatacaggacaggatatgctggcctccttcctgcgcacgaaccgccaagccgcaaaactgtctaagcctaccctcgagaatctgacccccgttgttcttcggccggaaatccggaaacctgaagttctgcggcctgaaacacctcggccagtggatatcgggagcgggggatttggtgatgtgggggcgctggaaagcctgaggggaaacgccgacctcgcatatattttgagtatggaaccgtgcgggcactgtctgatcatcaacaatgttaacttttgcagagagtctggactaagaacgaggacagggtcaaatatcgattgcgaaaagttgcgaagaaggtttagcagtctgcattttatggtagaagtgaaaggggacctgacggccaagaaaatggtgcttgcattgctggaactcgcccaacaagatcacggcgcacttgactgctgcgtagttgtgatcctcagtcacggctgccaggcaagtcaccttcagtttcctggcgccgtgtatggaacagacggctgcccagtcagtgtagagaaaattgtgaacattttcaacgggacctcgtgcccctccctcgggggtaagccaaaactattttttattcaggcatgcgggggtgagcagaaggatcatggctttgaggtggcctcaacctcacccgaggatgagagccctggctccaacccagagcctgatgccaccccattccaggaaggtctccgaaccttcgatcagttagatgcaatttcctcactgcctactccctccgacatctttgtcagttactcgaccttccccgggtttgtctcatggcgcgaccctaagtctggaagctggtacgtagaaacactggatgacatattcgagcaatgggcacattcggaggatctccaatctctgctccttagagtgagcgctgcgtttctgtgtaaaggagagggaaggcttctgaggggctcagtgtcgtcttggggatggggttttggtgtaagccgggctggacctaatcagggctag

SEQ ID NO: 23343 - DNA, 2721 bp, Artificial Sequence
  Description of Artificial Sequence: Synthetic coding sequence
atgaccgccgtgcacgccggcaacatcaacttcaagtgggaccccaaatctttggaaatccgcacactagctgttgagaggctccttgagcctctggtgactcaagtgaccacactcgtgaacactaattctaaagggccatcgaataaaaagcgcggaagatcaaagaaggcccacgtgctggcggctagtgttgaacaggctaccgaaaatttcctcgaaaaaggagataagatcgctaaagagtcacagttcctaaaagaggagctggtcgccgctgtggaagatgtgagaaagcagggtgatctgatgaaggccgccgctggggagtttgcggatgatccttgctccagcgtaaagagagggaatatggtacgggccgctcgcgcactgctgagtgcagttacccgcctcctgattttagccgacatggctgacgtgtataaactcctggtccagcttaaagtggtagaggacgggatcctcaaacttcgaaatgctgggaatgaacaggatctaggcattcagtacaaggcgctcaagcctgaggtcgacaagttgaacataatggccgccaagagacaacaggaactcaaagacgttggtcacagggaccagatggcggcagctcgcggcatacttcagaagaacgtcccaattctgtacacagcgagtcaggcatgcctccagcaccccgacgtggccgcctacaaagccaatcgcgatctgatctacaaacagctgcagcaggccgtcactggtatcagcaatgcggcccaggcgactgcaagtgatgatgcttcccaacaccagggcggtggtggcggagaactggcatatgccctcaataacttcgacaaacagatcatcgtggatccactctccttttccgaagagcgattccgccccagcctcgaggagcgactcgaatcaatcatctcgggcgccgcgttgatggctgactctagctgtacaagggacgatcgccgggagcgtattgtcgccgagtgcaatgcagtaaggcaagctcttcaggacttattaagtgaatacatggggaatgctggaaggaaggagcgttccgacgccctgaattctgctattgacaaaatgaccaagaagacccgggacctgcgccggcagctgcggaaagccgttatggaccatgtgagtgactcatttttggaaacaaatgtgcccctgctggtcctgatcgaggcagcgaagaatggtaatgaaaaagaagtaaaggagtacgcccaggtgttccgagagcacgcaaacaagcttatcgaagttgcgaacttagcctgtagcatatctaacaacgaggaaggcgttaaactggtccggatgtcagcttcacagctagaagccctgtgtcctcaggtcataaatgccgcgctagccctggccgcaaagccccagtcgaagcttgcccaggagaacatggacttatttaaagagcagtgggagaagcaggttcgagttctgactgatgccgtcgacgatataaccagtatcgatgatttcctggccgtaagcgagaaccatattctagaagacgtgaacaagtgcgttattgcattgcaagaaaaagacgtagacggcttggataggacagccggcgctattcgcggaagagctgcccgcgttatacatgtggtcaccagcgagatggacaattacgaacccggtgtatacactgagaaggtgctggaagcaaccaagctgctgtcaaatacagtcatgccccgattcaccgaacaggtggaggccgctgtggaagcgctgagtagcgatcctgcccagccaatggatgagaatgaatttatcgacgcgtctagactcgtgtacgacggcattcgggacatccgcaaagcagttctgatgattagaacccccgaggaactggacgatagcgacttcgagacagaagattttgatgtcagatcccggacatccgtgcaaacggaggacgatcagttgatagccggccagagcgcacgagctatcatggcccaactgccccaggagcagaaagcaaaaattgccgagcaagtggcgtcttttcaggaagagaagtccaaacttgacgccgaagtcagcaagtgggacgattctgggaacgacatcatcgtgctggcaaaacaaatgtgcatgatcatgatggagatgaccgatttcactagaggaaaaggacctctgaaaaacacgtccgacgtcatttctgctgccaagaagatcgcagaagctggctcaagaatggataagctcgggcgcacaatcgccgatcattgtccagatagtgcttgcaagcaggatctgctggcctacctacagagaatcgccctgtattgccatcaactgaatatatgtagtaaagtaaaggctgaggtgcagaacctgggaggcgaacttgtggttagcggcgtggactcggctatgtccctcattcaagccgctaagaatttgatgaatgccgtggtccagacggtgaaggcctcttacgtcgcttcgaccaaatatcagaaatctcagggcatggcaagtctgaatctgcctgccgtgagctggaagatgaaggcaccagaaaagaaacccctcgtgaagcgcgagaagcaagacgaaacgcagactaaaatcaaacgcgcctctcagaagaaacacgtaaatcccgtgcaggcactgtctgaatttaaagcaatggactcaatatag

SEQ ID NO: 23344 - DNA, 2412 bp, Artificial Sequence
  Description of Artificial Sequence: Synthetic coding sequence
atgaaggccgccgccggcgagttcgccgacgacccctgcagcagcgtgaaaagagggaacatggttcgcgcagctagagccctcctttcggcggttactcgactccttatcttagccgacatggccgacgtctacaagcttttggtgcagctaaaggtcgtggaggacgggatcctgaagctcaggaatgccgggaatgagcaggatttgggcatccaatacaaggctctgaagcctgaagtcgataaactgaacatcatggccgccaagcgccaacaggagcttaaggacgttgggcaccgggaccaaatggccgccgcgcgcggaattctccaaaagaatgtgcccatactgtatacagccagccaggcttgtctgcagcatccagacgtcgccgcgtataaagctaatcgggatctgatttacaagcagctgcaacaagctgtcaccggaatctctaacgctgctcaagcaactgcctccgacgacgcatctcagcaccagggcggaggaggtggagaactggcttatgccctgaacaatttcgacaaacagattattgtcgatcctctgtccttttccgaggaaaggttccgaccatcacttgaggagagactagaatcaataatctctggcgccgctttgatggcagacagcagttgcacacgggacgatcgcagagagagaattgtcgcggagtgcaacgcggtgagacaggccctgcaggacttgctctcagaatacatgggaaatgccggaagaaaggagcgcagcgacgccctgaatagtgctatcgacaagatgacgaaaaagactcgggacctgaggagacagttgaggaaagctgttatggaccatgtaagtgactccttcttggagaccaatgtgccccttttggtgttaattgaagcagcaaaaaatggcaacgagaaagaggtaaaggagtacgcgcaagtttttcgggaacacgccaataagctcattgaggtggccaacctggcctgttcaatttcgaacaatgaggaaggcgtcaagttagtacgaatgtccgcttcccagctcgaggccctttgtcctcaagtgatcaatgctgctctggcacttgccgccaagccgcagagcaagctcgcacaggagaatatggacctgttcaaggagcaatgggaaaagcaagtgagggtgttgaccgatgccgtagacgacattactagcatagacgatttcctggccgtcagcgagaaccatatcctggaagatgtcaataaatgtgtgattgctctccaagaaaaggatgtggacgggttggatagaacggctggggcgatacggggaagagccgcacgtgtgatccacgtcgttacctccgagatggataactatgaaccgggtgtgtacacagaaaaggtcttggaggccactaagttattgtctaacaccgtgatgccacgatttacagagcaggtagaagccgcggtggaggcgctttcatccgatcccgctcagcccatggatgagaacgaatttatcgatgcctcacggctcgtatacgatggcatcagagacatacgaaaggctgtactgatgataaggacccctgaggagctggatgattccgactttgaaactgaagacttcgacgtgcggtccaggacctcagtccaaactgaagatgaccaacttattgcaggacaatctgcccgcgcaataatggcacagctcccccaagagcaaaaggcaaaaatcgcagagcaagtggccagcttccaagaagagaagtctaaattggacgcagaagtatcaaagtgggatgactcaggaaacgacatcatcgtcctggctaaacagatgtgtatgatcatgatggagatgacagattttacaagagggaaggggcctctgaaaaacacatcggacgtcatttctgccgcaaagaaaatagctgaggctggtagtcgaatggataaactggggcgaaccatcgccgaccactgcccagatagtgcatgtaaacaggatcttcttgcttacttgcagaggatcgccctgtattgccaccagttaaatatatgctccaaggtgaaagctgaggtacagaatctgggcggcgagctggtagtgtcaggagtcgattctgcgatgtctctgatccaggccgcaaaaaatctcatgaatgcagtggtgcagactgtgaaggcttcttatgtggcctccacaaagtaccagaagagccaagggatggcttccctgaacctgccagccgtaagctggaagatgaaagctcctgaaaaaaagcctttggtgaaacgggagaagcaggatgagacacagactaagatcaaacgtgcttctcagaagaaacacgtgaatcccgtccaggcactgtctgagttcaaagccatggattctatatag

SEQ ID NO: 23345 - DNA, 357 bp, Artificial Sequence
  Description of Artificial Sequence: Synthetic coding sequence
atgaccgccgtgcacgccggcaacatcaacttcaagtgggaccccaagtctctcgaaatcagaacactggctgtcgaacggctcctggagccacttgtgacgcaggtcactacattggtcaatactaactctaaaggtccatcaaacaaaaagaggggcaggtctaagaaggctcacgtgttagccgcttctgtggaacaggccacggaaaattttcttgaaaagggcgacaagatcgcgaaggaaagtcaattcctgaaggaggagcttgtggccgcagtggaggatgtgcgaaaacagggggaccttatgaaagcggcggctggggaattcgctgacgacccttgctcttcttag

SEQ ID NO: 23346 - DNA, 420 bp, Artificial Sequence
  Description of Artificial Sequence: Synthetic coding sequence
atgaccgccgtgcacgccggcaacatcaacttcaagtgggaccccaagtccctcgagatccgcaccctggccgtcgagcggctgctcgagcctctcgtgacacaagtgaccaccctggtaaatacgaactctaagggcccaagcaacaagaagcgagggaggtcaaaaaaggctcacgtcctcgcggcatccgtggaacaggcaacagaaaattttcttgaaaagggagacaaaatcgccaaagagagtcagtttctcaaggaagagctcgtcgccgccgtagaagacgtgaggaagcagggtgatctgatgaaagcagcagcaggggagttcgccgacgacccatgcagctcagtgaagcggggcaacatggtgcgggctgcccgggccctcttgtctgctgttactaggctgctgtag

SEQ ID NO: 23347 - DNA, 648 bp, Artificial Sequence
  Description of Artificial Sequence: Synthetic coding sequence
atgaccgccgtgcacgccggcaacatcaacttcaagtgggaccccaaaagtctggaaattagaacactggctgttgagcgccttctcgaaccattggtgacacaagtgaccacactggtaaacacgaacagtaaggggcctagtaataagaagaggggacgaagcaagaaggcccacgtccttgccgccagcgtcgagcaggcaaccgaaaattttttggagaaaggtgacaagatagcaaaagagtcccagtttttaaaggaagagcttgttgccgccgtcgaagatgtccgcaaacaaggcgatctcatgaaggccgctgccggcgagttcgccgatgacccttgctccagcgtgaagaggggtaatatggtgcgcgccgctagagccttgctgtctgctgtgactaggctcctcatcttggccgatatggctgatgtgtacaagttgctcgtgcaactcaaggtggtggaggatggcatcctgaagctgcgcaacgccggcaacgagcaagaccttggaatacagtacaaagcgctgaagccagaagtggacaaattgaatatcatggcagcgaagcgacagcaggagctgaaggacgtaggtcaccgtgatcagatggccgcagcacgagggattttgcagtag

SEQ ID NO: 23348 - DNA, 306 bp, Artificial Sequence
  Description of Artificial Sequence: Synthetic coding sequence
atgaccgccgtgcacgccggcaacatcaacttcaagtgggaccccaagagtctggaaattcggactctagctgtggagagactgctggaaccactggtaacacaggtgaccacacttgttaacacaaatagcaaaggcccatctaataagaagcgcggacgctccaaaaaagctcatgtcttagcagctagcgtggaacaagctacagaaaacttcttagaaaaaggagacaaaatcgccaaggagtcacagttcttgaaagaggaactggttgccgccgtggaggatgtacgcaagcagggatag

SEQ ID NO: 23349 - DNA, 372 bp, Artificial Sequence
  Description of Artificial Sequence: Synthetic coding sequence
atgaccgccgtgcacgccggcaacatcaacttcaagtgggaccccaaaagcctagaaatacgtactctcgctgtggagaggcttctggaaccactggtgacccaggtgacaacccttgtgaacactaactccaaaggtcctagtaacaaaaagcgcgggcggagcaagaaagcgcacgttttggctgcttcggtggagcaggctacagagaactttctggaaaaaggcgataagattgccaaggagtcccagtttctgaaggaggagctcgtggcggccgttgaagatgtgagaaaacagggagatctcatgaaggccgcagctggtgaattcgccgacgacccgtgtagttctgtcaaaagaggcaattag

SEQ ID NO: 23350 - DNA, 471 bp, Artificial Sequence
  Description of Artificial Sequence: Synthetic coding sequence
atgaccgccgtgcacgccggcaacatcaacttcaagtgggaccccaaatctttagagattcgaacccttgctgtggaaaggctgctggagcctctcgtcacccaggttaccacacttgtgaacaccaactcgaagggacctagtaacaagaagcgcggtagatcaaagaaggcacatgttcttgccgcctctgtggagcaggccactgagaactttctggagaaaggagacaagatagccaaagaaagccaatttctcaaagaggagcttgtagctgcagtggaggacgtccgaaagcagggagacctcatgaaggcagccgctggcgagttcgcggacgatccatgctcttccgtgaagagaggcaatatggtcagagccgcccgagctttactgtcggccgtcacgaggctcctgattttagctgacatggccgatgtgtataagctattggtccagctgaaagtgtag

SEQ ID NO: 23351 - DNA, 285 bp, Artificial Sequence
  Description of Artificial Sequence: Synthetic coding sequence
atgaccgccgtgcacgccggcaacatcaacttcaagtgggaccccaagagtctggagatcaggacgctggcggtggaacggctgctggagcccttggtgactcaggtcacgactctggtgaacaccaattcaaaaggcccctcaaataagaagcggggccgcagtaaaaaggcccatgtactggctgcctccgtcgagcaggctaccgaaaatttcctagagaagggagataaaatcgctaaagaatcacagtttctgaaggaagaattggtcgccgccgtgtag

SEQ ID NO: 23352 - DNA, 2790 bp, Artificial Sequence
  Description of Artificial Sequence: Synthetic coding sequence
atgaccgccgtgcacgccggcaacatcaacttcaagtgggaccccaaaagtctggagatccgcacgctggccgtggaaaggctcctcgaaccactggtgacccaggtgacaacactggtaaacaccaatagtaagggtccatccaacaaaaagcgcggacggagcaagaaggcccatgttctcgcagcatcagtcgaacaggcaacagaaaacttccttgagaagggggataaaatcgccaaggaatcgcaattcttgaaagaagagttagttgctgccgtggaagatgtccggaagcagggcgatctgatgaaagctgctgcaggggagtttgccgatgatccttgctcatctgtgaaaagggggaatatggtgcgagctgccagagctttgctttccgcggtgactcgcctgttaatcttggccgacatggccgacgtctataaactgctggtgcaattgaaggttgtcgaggatggcattctgaaattaaggaatgccggcaacgaacaagatctaggtattcagtacaaggctctaaaacccgaggtcgacaagctgaatattatggcggccaaacgccagcaggagttgaaggacgtgggtcacagagatcaaatggcagcagctcgaggcattttacagaagaatgtgcctattttgtacaccgcgagccaagcttgccttcaacacccagacgtagctgcatataaagccaaccgtgacctcatctacaagcaactgcaacaagcagtgaccggtatttccaacgccgctcaagccaccgcatcggatgatgcctcacagcatcagggggggggagggggggagctcgcctatgctttaaataactttgataaacagattatcgtcgacccactttcattctcggaagaaagatttcgcccaagcctggaagaaagactggagagtattatttcaggagccgcccttatggctgacagctcatgcacacgggatgaccgtagagaacgaatagtggccgagtgtaacgcggtaaggcaggccctgcaggacctgctttctgagtatatgggcaacgctgggaggaaggagcgctcagatgccctcaatagcgccatcgataagatgaccaagaagaccagagatctgaggcgacagctgcgtaaggctgtgatggatcacgtgtcagactccttcctagagacaaatgtccccctcctggttctcatcgaggctgcgaagaatggcaacgagaaagaagtgaaagagtacgcccaagtgttccgtgaacatgctaataagttaatcgaggtggccaatttagcttgcagcatcagtaacaacgaggagggcgtgaagctggtcaggatgagtgcgagccaactggaagccctgtgcccccaggtgattaacgcagcgcttgctttagctgccaaaccccagtccaagctagcccaggagaacatggatctcttcaaagagcagtgggagaaacaggtgcgggtactcacagatgccgtagatgacatcacctccattgacgatttcctagccgtctcagaaaaccatatcctagaggatgttaataagtgtgttatcgccttacaagagaaagacgtggatgggttagaccgcaccgctggagctattaggggccgggccgcgcgcgtcatccacgtcgtgacttcagagatggacaattacgaacccggcgtatacactgaaaaagtactggaggcaacaaagctcctgtccaatacagtgatgcctcggtttaccgagcaggtagaagcagccgtggaggccttgagttcagaccccgcccagccaatggatgaaaacgagttcatcgatgcctcaagacttgtgtacgacggaatccgggacattcgaaaggcagtgctgatgatccgcacacctgaagagctagatgatagtgactttgaaactgaagatttcgacgttcgctcaaggacttctgtccagacagaggatgatcagctgatagcggggcaatctgctcgagctattatggcccagctccctcaagagcaaaaagccaaaatcgccgagcaggtggccagcttccaggaggagaagagcaaactcgatgccgaagtatccaagtgggacgattctggaaacgatatcattgtgttggcgaaacaaatgtgcatgattatgatggagatgacagacttcacacggggaaagggtccactaaagaatacgagcgatgtgattagtgcagccaaaaaaattgccgaagcagggagccggatggacaagttggggcgaaccattgctgaccactgcccagactctgcatgtaagcaggacctactcgcctacctgcaacgcatcgcgctatattgtcaccaattgaatatctgttcgaaggtgaaggctgaagtgcagaatctcggtggggaactcgttgtgtcagggaattgcgacacttgtggtgcgctgcaggggctgaaggggtggccaccccctctgtgtgctacgcactgggtggactccgccatgtctctgatccaagctgcaaagaatcttatgaacgccgtggttcagaccgtcaaagcaagctacgtggcctccacaaagtaccagaagagccagggaatggctagtttaaatctgccggccgtttcttggaagatgaaagcacccgaaaagaaaccacttgtcaagagagagaaacaggacgagacccagacaaagatcaagagagcctcccaaaaaaagcacgtgaatccggtgcaggctttgagtgaatttaaagccatggattctatctag

SEQ ID NO: 23353 - DNA, 1611 bp, Artificial Sequence
  Description of Artificial Sequence: Synthetic coding sequence
atgaccaagaagacccgggacctgcggcggcagctgcggaaggccgtcatggaccatgtctctgattcgtttctcgaaactaatgttccactactggtactgatcgaggctgctaaaaatggcaacgaaaaagaggtgaaagagtatgcccaagtatttagagaacacgccaacaagctgatagaggtggccaacctggcctgcagcatttcaaataatgaggagggtgttaaactggtacgcatgagcgcgtctcagctggaagccctatgccctcaggtgattaatgctgctctggccttagctgcaaaaccacagtccaaactggctcaggagaatatggatttgtttaaggagcagtgggagaagcaggtccgagtgctgactgacgctgtagacgatattaccagcatcgatgacttcctagccgtgagcgagaaccatatacttgaagacgtaaacaagtgcgtcattgctttacaggagaaggatgttgacggcctggataggacagccggggcaattagaggccgcgctgcgagagtaatccatgttgtgacgtccgagatggacaactacgagccaggcgtttacacagaaaaagtgctcgaagctacgaaactcctttccaacactgtcatgccaaggttcactgagcaggtcgaagctgccgtagaggcactatcatcagaccctgctcaacctatggacgagaacgagttcatagatgcttctcggttagtctacgatggaatacgagacatccgcaaggccgtcctgatgatccgaacacctgaagagctcgatgattcagatttcgaaacagaagactttgacgttcgatcgagaacttctgtacagactgaggatgaccagctgatagctgggcagtctgctcgggccataatggctcagctcccgcaggagcagaaagcgaagatcgcggagcaagtggcctcattccaggaggaaaagagcaagttagacgcggaggtgtcgaagtgggatgacagcggtaacgatatcatcgtgctcgctaaacagatgtgtatgatcatgatggagatgactgattttaccaggggaaaggggcccctgaaaaatacgagcgatgttattagcgccgcaaagaaaatcgctgaggccggatcccgtatggacaaactgggtagaacaattgccgaccattgtcctgacagcgcctgtaagcaggacctgcttgcgtacctgcagcgcattgctctgtattgccaccagctgaacatttgctcgaaagtgaaggctgaggtgcagaatctgggtggcgaactggtggtttccggagtggactccgctatgtccctcatccaggcagcaaaaaacctaatgaacgccgtagtgcagactgttaaggcatcctatgttgctagcacaaaatatcaaaagagtcagggcatggcttctctgaatttaccggccgtgtcttggaaaatgaaggcacctgagaagaagccacttgtcaagcgcgaaaagcaggatgagacgcagacgaagattaagagggcttcacagaagaaacacgtgaaccccgtacaggctctgtccgagtttaaggcaatggactcaatctag

SEQ ID NO: 23354 - DNA, 2676 bp, Artificial Sequence
  Description of Artificial Sequence: Synthetic coding sequence
atgaccgccgtgcacgccggcaacatcaacttcaagtgggaccccaaatcactagaaatcagaacactggctgttgaacgcttgttggaacccctcgtaacgcaggtaaccacccttgtgaatacaaacagcaaagggccttcaaacaagaaaaggggcaggtccaagaaagctcatgtgctcgccgcctccgtcgagcaagccacagagaactttcttgagaagggcgacaagatcgccaaagaaagccagttcttaaaggaggaactggtggcagctgtcgaggacgtcaggaaacaaggggatctgatgaaagcagcagcaggtgagtttgctgacgacccttgctctagcgtgaagagaggaaatatggttagggcggccagggctttgctttcagccgtcacccgactgttgaaggttgtggaggatggtattctaaagttgcggaacgccgggaatgagcaggatttaggaattcagtataaggcactgaaacccgaagtcgataaactaaatatcatggccgccaaacggcagcaggagctgaaagacgtggggcatagggaccaaatggccgcagcacggggtatactccagaagaatgtgccaattctgtacaccgcatctcaagcatgcctccaacaccccgatgttgcggcctacaaggctaatcgcgacctgatttacaagcaactacaacaagccgtgaccggcatatccaacgcggctcaggctaccgcttcagatgacgcttcgcaacaccaggggggcgggggtggagaacttgcttacgctctgaataattttgataaacagattattgttgaccccctctccttcagtgaggagagatttcggccctcactcgaagagcggctggaatccatcatttccggagctgctctaatggcagactcatcctgcacccgggacgaccgtagagagagaatcgtggcagaatgcaacgccgtgcgccaggctctgcaggacctcctgtctgaatacatgggtaacgcgggacggaaggaaaggagcgatgccctgaattcagccatcgataaaatgaccaagaaaacgagggacctgcggagacagttaagaaaggcggtcatggatcatgtctccgactcttttctggagaccaatgtgccgttactggtcctgattgaggctgcgaagaacggtaacgaaaaagaagtgaaggagtatgctcaggtgtttagggaacatgccaataagctcatcgaggtggcgaatctggcatgtagtatctcgaataatgaagagggggtgaaattagtgaggatgtcggccagccagttggaagcgctgtgccctcaagtgatcaatgccgcactcgcactggccgcaaaacctcaaagcaagctggcgcaggagaacatggaccttttcaaagagcaatgggagaaacaggtccgggtgctgacagacgccgtcgacgacattacaagtattgacgactttctcgccgtatcggagaatcacattctggaagatgttaataaatgtgttatcgccttgcaggagaaagacgtggacggcctggatcgcacagccggggctataaggggtagagccgcaagagtcattcacgtggtgacctcagagatggacaattatgagccgggggtgtacacggagaaagtgttagaagctaccaagctgttgtcgaataccgtgatgccccgctttacagagcaggtcgaggcggcagtcgaagccctgtcctctgaccccgcacagccaatggacgaaaatgagttcatagacgccagccggctggtttatgatggaatccgcgatataaggaaagcagtcctgatgatccggacgccagaggagttggatgattctgattttgagacagaggactttgatgtgcggtctcgaacctctgtccagaccgaggatgaccagctaatcgctgggcagtctgctagagccatcatggcacagttaccacaggaacagaaggctaaaatagcagagcaggtggcaagctttcaagaagaaaagtccaaacttgacgctgaggtctctaaatgggatgactctggcaacgacattatcgtattggctaagcagatgtgcatgattatgatggaaatgaccgattttacccgcggcaagggacctctcaaaaatacctccgatgtaatctctgcggccaagaagatcgctgaagccggatccaggatggacaagctggggcggacgatagctgatcattgccccgacagtgcctgtaaacaagatctcctcgcttatcttcagaggatcgccctatactgccaccagcttaatatttgcagtaaggtgaaggccgaagtccagaatctaggcggtgagttggtggtctccggggtagactccgctatgtcactcatccaggcagccaagaatctgatgaatgcagtcgttcagaccgtcaaggctagctatgtcgcctcaacaaagtaccagaaaagtcaaggtatggcatccctgaacctcccggcagtttcatggaaaatgaaagcccccgagaagaagccgctggtgaagcgcgagaagcaagacgaaacacagacaaaaatcaagcgtgcgtcacagaaaaaacacgtcaatcccgtgcaggccctaagtgaatttaaggcgatggactccatttag

SEQ ID NO: 23355 - DNA, 2346 bp, Artificial Sequence
  Description of Artificial Sequence: Synthetic coding sequence
atggccacccaggccgacctgatggagctggacatggccatggagcctgatagaaaagctgctgttagccactggcaacagcagtcttatttggattcggggatccactcaggggccacaaccacagcaccaagcctttctggaaagggcaatcctgaagaagaagatgttgacacttcacaggttctgtatgagtgggagcagggcttttcacagagttttactcaggagcaggtggccgacatcgacggccaatatgccatgacaagagcacagcgggttagggctgcaatgtttccagaaacgctagatgagggaatgcagattccttcaactcagttcgatgccgcccacccaacaaacgtccagagactggccgagccttctcagatgctgaagcatgcagtggtgaatctgatcaattaccaggacgacgctgaactggccacaagggctattcccgagctgacaaagctactgaacgacgaagaccaggtggtcgtcaataaggccgccgtcatggtgcaccagcttagcaagaaagaggccagccgacacgctattatgaggtctccccagatggtaagcgctatcgtaagaaccatgcagaacaccaacgacgtggaaactgctcgttgcactgcaggaactctgcacaatctgtctcaccacagggaaggcctgttagctattttcaagtcaggggggattccagcactggttaagatgctgggatcacctgttgactcagtgcttttttacgctattaccactttacacaatctgctgttacatcaagaaggggcaaaaatggcggtgagactggcaggaggcttgcagaaaatggttgccctgttgaataaaaccaatgtcaaatttcttgcaatcaccaccgactgtctccagatcttagcctatggcaaccaggaatccaagctgattatactggcctcaggcgggcctcaggccctggtaaacatcatgagaacctacacttatgagaagcttctctggacaaccagcagagtactaaaagtgttgtcagtctgtagtagcaataagcctgctatagtagaagcgggcgggatgcaggcacttggactgcacctaacagatccaagccaaaggctggtccagaattgcttgtggacgctgagaaacctgtccgacgctgccaccaaacaggagggaatggaagggctactgggtactctcgtccagctgctgggcagtgatgatattaatgtggttacctgcgccgccggaattctcagcaacttgacctgtaacaactacaagaataagatgatggtttgtcaggtcggcggtattgaggcattggtgcgtacagtccttcgggctggtgatagggaagatattactgagccagctatttgcgccctgcgccacctaacttcccggcaccaggaggcagagatggcccagaacgcagtgcgattacactacggactcccagtagtagtgaagctgctgcatcctccttctcattggcctcttatcaaagctaccgtgggtctgatcagaaacttagccctttgccctgcaaatcacgccccattgagggagcagggtgcgattccccgtctggttcagctgcttgtccgagcgcaccaggatactcagcgtcgcacctcgatgggcgggacacagcaacaatttgtggaaggggttcgcatggaggaaatcgttgagggctgcacaggcgcccttcatatcctggccagagatgtgcacaacagaattgtgatccgtgggctcaatacaatcccactcttcgtacaactgttgtattccccaatcgagaacatccagcgcgtggctgccggcgttctgtgcgaactggcccaggataaggaggctgcagaagcaatagaggccgagggcgccaccgccccactgacagaactcctccatagtcggaacgagggcgtcgccacctatgccgccgctgtgctgttcaggatgagcgaagataaaccacaggactacaagaaacgattatctgtcgagctgacttcctcactcttccgcaccgaacccatggcctggaacgaaacagccgacttaggcttagatataggggcgcagggcgaacctctgggctataggcaggatgatcccagctatcgatcgttccacagcggcggctatggccaggacgcccttggaatggacccaatgatggaacatgagatgggcggtcatcatcctggagccgattatcccgtggacggactaccagacttgggccacgcccaggacttaatggatgggctccctccgggcgactctaaccagctagcttggttcgataccgacctatag

SEQ ID NO: 23356 - DNA, 2346 bp, Artificial Sequence
  Description of Artificial Sequence: Synthetic coding sequence
atggccacccaggccgacctgatggagctggacatggccatggagccggacaggaaagcagctgtgagccattggcagcaacagtcatatttagatagcggaatccactcaggggctaccaccactgcaccatctttgtcgggcaaggggaatccagaggaggaagacgtggacacttcccaggtactttacgaatgggaacaaggattttcccagtcattcactcaggagcaggtggcggatatagacggacagtatgcgatgaccagagcccagagagtccgagctgctatgtttccagagacgctggacgagggaatgcagatcccctccacccagttcgacgcagcccaccccaccaatgtgcagagactggccgagccttctcagatgctcaaacacgccgtggtgaatctgatcaattaccaggatgacgccgaactagcaacaagagctattcccgagctcaccaaactgttaaacgacgaagatcaggtagtggtcaataaagctgctgtcatggttcatcagctgtctaagaaggaggcatcaaggcacgcaattatgagaagtcctcagatggtgtccgctattgttcgcaccatgcaaaacactaacgacgtcgagactgccagatgtacggccggaaccctccataacctatcccatcacagagaggggttattggccattttcaagagcggcggtatcccagcacttgtaaagatgctgggaagcccagtcgatagtgttcttttctatgccatcacaacactgcacaacttacttctgcaccaggaaggagctaaaatggctgtgaggttggccgggggactgcagaaaatggtggctctgttgaacaagacaaacgtgaaattcctcgccatcacaaccgactgtctgcagattctggcatacgggaaccaggagtccaagctgattatcttggccagcggcgggcctcaggcactcgtgaatataatgaggacctatacatatgagaaactgctgtggactacatcccgtgtcctaaaggtcctatctgtctgcagcagtaacaaacccgcgatagtggaagctggcggcatgcaggcccttgggcttcatctgaccgaccccagtcaaaggcttgtgcagaactgtctttggactctaaggaacctgtcggacgcagccaccaaacaggagggaatggagggtctgctcgggaccctggttcaactgttaggctctgatgacattaacgtggtgacctgtgccgctggtatcttgtcgaatcttacctgcaataactacaagaacaagatgatggtatgccaggtgggggggattgaggccctggttcgcaccgtcctgcgagccggtgatagggaggacattaccgaacccgctatctgcgcattaagacaccttacgtcaaggcaccaggaggctgagatggctcagaacgcggtgaggttgcattatggtctccccgtcgtagtaaagcttcttcatcccccaagtcactggccccttattaaggccacagtaggactaattcgtaatttggctctttgtccagctaaccacgctcccttaagggagcaaggcgccataccaaggctagtgcaactgctggtgcgtgcccaccaggatactcagcgccgcacctcaatggggggtacccagcaacagttcgtcgaaggcgtgagaatggaggaaatcgtggagggttgtacaggagccctgcacatcctggccagagacgttcacaatcgtatcgtgatcaggggcctcaatactatccccttatttgtgcagctgctgtattctccgatcgagaacatccagcgcgtggccgcaggtgtcttatgtgagttagcacaggacaaagaggctgctgaagccatcgaagcagaaggcgcaaccgctcccttgaccgaattactgcactcacggaatgagggagtggcaacatacgccgctgccgtgctgtttcgaatgtctgaagacaagccccaggactataaaaagaggctaagcgtggagctgacctcttcgctcttcaggaccgagccaatggcctggaacgaaacagcagatcttggcctggatattggagctcagggcgagcccctgggttacaggcaggatgatccttcctatcgctcttttcactctggcggatatggacaggacgcgttaggaatggatcctatgatggaacacgaaatgggcggccaccaccccggtgctgattacccagttgatggtctcccggacctcggacacgcacaggacctgatggatgggctaccccctggggactcaaatcagttagcctggtttgatactgatctgtag

SEQ ID NO: 23357 - DNA, 2346 bp, Artificial Sequence
  Description of Artificial Sequence: Synthetic coding sequence
atggccacccaggccgacctgatggagctggacatggccatggagcctgataggaaagctgcagtgtcgcactggcagcaacagagctatctggacagtggcatccatagcggcgccactacaaccgccccgtctctgagcgggaagggtaaccccgaggaagaggatgtcgataccagccaggtcttatacgaatgggaacagggctttagtcagtcctttacgcaggaacaagtggctgacatcgatggacagtacgcaatgactcgggcacaaagggtccgcgcagccatgtttcccgaaaccctggatgaggggatgcaaatccccagtactcaattcgatgccgcgcaccccacgaacgtacagcggttggctgaaccaagccagatgctgaaacacgctgtggtgaacctgatcaattaccaagacgatgctgaactggccaccagggcaatcccagagctgaccaaactgctgaacgacgaggaccaagtcgttgtaaataaagctgccgttatggttcaccagcttagcaaaaaggaagcttccaggcacgcaattatgcggtcacctcagatggtgagcgctattgtccgtaccatgcaaaacactaacgatgttgagacggcaaggtgtactgcagggacgctgcataatctgagccaccatcgggagggcttgttagcaatcttcaagtctggcgggatcccagctcttgttaaaatgctcggatcgccggtcgattctgtgcttttctatgcgattacaactctccacaatctgcttttacaccaggagggggcaaaaatggcggtgaggcttgctggaggcctccagaagatggttgcgctgctcaataagacaaatgtgaagttccttgcaatcacaacggattgccttcagattcttgcctacggtaatcaggagagtaagctgattatcctagcctcgggtggcccccaggccctggttaacattatgcgaacctacacttacgagaaattactttggacaacttccagagtgctaaaggtgctgagtgtttgctcatccaacaagcctgcaatcgtggaggctggcggcatgcaagcactcggcctccatctgacagacccatcccagcgcctggtccagaattgcctgtggaccctgcggaacctcagtgacgccgcgaccaagcaggagggaatggaaggcctactcggaactctggtccaacttctgggctccgatgacatcaatgtagtcacttgtgctgcaggcatacttagcaacctgacttgtaacaactataaaaacaagatgatggtgtgtcaggtagggggcatagaagccctagtcagaacagtcctgagagccggagacagggaagacatcacggagccggcaatatgcgccctgaggcacctcacaagcaggcatcaagaagcagagatggcacagaatgccgtccgtctgcattatgggctgcccgtggtcgtgaaattactccacccgccaagccattggcctcttatcaaagctactgtggggcttatccggaacctggctttatgccctgctaatcatgcacccctgagggagcagggcgctatccctagactggtgcagctgctggtgcgagcccaccaggatacacaacgacggacttcaatgggcggaacacagcagcagttcgttgagggagtccggatggaagaaatcgtggaagggtgcacgggggctctgcatattttagctcgggacgtacataataggatagtaattaggggtctcaatacaatccccctgttcgtgcagctattgtattcacctattgagaatattcaaagagttgctgccggcgtgctctgcgagctcgcacaggacaaggaagcagccgaggctatcgaggcagagggagcaacagcacctttaacagagcttctgcattcccgtaacgaaggagttgccacctacgctgccgccgtgcttttccggatgagcgaggacaaacctcaggactacaagaagcgtctctccgtggagctgacctcatctctgtttcgaaccgagccgatggcttggaatgagactgccgacctggggcttgacataggtgcccaaggtgagccacttggttataggcaggacgacccctcatacagatctttccatagcggtggatatggtcaggacgccctggggatggacccaatgatggagcacgagatggggggacatcacccgggcgcagactaccctgtggacggccttcccgacctgggacacgcacaagatttaatggatggtctgccacccggcgactccaatcaactcgcctggtttgacacagatctgtag

SEQ ID NO: 23358 - DNA, 2346 bp, Artificial Sequence
  Description of Artificial Sequence: Synthetic coding sequence
atggccacccaggccgacctgatggagctggacatggccatggagcccgaccgcaaggctgcagtgtcccattggcagcagcaatcctaccttgattccggcatccactccggggcaaccaccacggccccttccctaagcggcaagggcaacccagaagaggaagatgttgacacaagccaggtcctatacgaatgggagcagggattcagtcagagctttacacaagaacaggtggccgatattgatggccagtacgctatgacaagggcacagcgcgttcgcgccgctatgttccctgaaactctcgacgagggaatgcaaattccaagtacccagttcgatgcggcacacccgacaaacgtccaacgcttggctgaaccaagccaaatgcttaaacatgccgttgtgaatctgattaactaccaagacgacgcggaattggccacaagggcaataccggagcttaccaagctcttaaacgacgaagaccaggtagtcgttaacaaggcagctgttatggtccaccagttaagcaagaaggaggccagcaggcacgcaatcatgcggtcaccacaaatggtgtccgcaattgtcaggacaatgcaaaatactaacgacgtggagactgcgcgctgcacagctgggactctgcacaatctgagccaccaccgggagggactgcttgcaatattcaaaagtggcggcattcctgccctagtgaaaatgctgggatctccggttgacagcgttctgttctacgctataacaactctgcacaatctgctcctccatcaggagggcgccaaaatggccgtgaggctggccggcggactccagaaaatggtggccctgcttaataaaaccaacgtgaaattcctcgccatcaccaccgattgcttgcagatcttggcgtacggtaaccaggagagtaaactcataattctggccagtggagggccccaggcactggttaacatcatgcgaacatacacttacgaaaaactcctctggactaccagccgcgtcctaaaggtgctctccgtatgctcgtccaacaagcctgcaatagtggaggcgggaggaatgcaggcactgggccttcatttaactgatccatcccagcgcctggtccaaaactgcttatggacacttcggaacctatccgatgcggccacaaaacaggaggggatggagggtctcctagggactcttgtgcagcttctgggaagcgatgacatcaacgtcgtgacctgcgccgctggaatcctgtctaaccttacatgcaataattacaaaaataaaatgatggtctgtcaggtgggtggaatcgaagccctggtaagaaccgttctgcgagccggcgaccgggaagatataactgaacccgctatttgtgccctgcggcacttgacgtcacgccaccaagaggctgagatggcccagaacgctgtgcgcctgcattatggcctgccagtggttgtgaaactcttacacccaccaagccattggcccctcatcaaagccacagtgggcttaatcaggaacttagccctctgcccagccaatcatgctcccttgcgagagcagggcgcaatacccagactggttcaattgctcgtacgagctcaccaagatacccagcgccgtacaagcatgggtgggacccagcagcagttcgttgagggagtgcgaatggaggagatcgtcgaggggtgcaccggagcccttcatatactcgcgagagatgtccacaacaggattgtcattcgcggcctgaataccataccactgtttgttcagcttctgtattcccccattgaaaacattcagagggtggccgccggtgtgctgtgcgagctagcccaggataaagaggccgctgaggcaatcgaggccgaaggagctacagcccccttaacggaactgctacacagccggaatgagggagtggccacctacgctgcagctgtcctgtttcgcatgtctgaggataagccccaggactataaaaagagactttcagtggaactgacttctagcttgtttcgaaccgagcctatggcctggaacgagaccgccgacttaggtctcgacatcggtgcacagggtgagcccttgggctaccggcaggacgatccatcctatcggtctttccattcaggcggctacggacaggatgctctggggatggacccaatgatggagcacgaaatgggcgggcaccacccgggggctgattatcctgtcgacggccttcccgatctcggccacgcccaggacttgatggatggactccctcccggggattcaaaccaactggcctggtttgataccgatctctag

SEQ ID NO: 23359 - DNA, 453 bp, Artificial Sequence
  Description of Artificial Sequence: Synthetic coding sequence
atggccacccaggccgacctgatggagctggacatggccatggagcccgaccgtaaagcagcagtgagccactggcagcagcagagctatctggactctggaatccactccggggctaccactacagccccttcacttagtggaaagggcaatccagaagaggaggacgtggacaccagccaagtgctttatgaatgggagcagggcttctcccagtcttttacacaggagcaggtagctgacatcgacggtcagtatgccatgacccgcgcccagcgggtcagagcggccatgttccctgagactttggatgagggcatgcagattccgtcaacacagtttgatgctgcccatcctacaaacgtgcagaggttggccgaaccctcacagatgttgaagcatgctgtcgtcaacctgatcaattatcaagatgacgctgagctcgctacatag

SEQ ID NO: 23360 - DNA, 42 bp, Artificial Sequence; identical to SEQ ID NO: 9896
  Description of Artificial Sequence: Synthetic coding sequence

SEQ ID NO: 23361 - DNA, 303 bp, Artificial Sequence
  Description of Artificial Sequence: Synthetic coding sequence
atggccacccaggccgacctgatggagctggacatggccatggagccagacaggaaggccgccgttagtcactggcagcagcaatcatatctggattctgggattcactctggcgcaaccaccactgcaccaagtctctctggcaaaggaaaccctgaggaggaagacgtcgacacaagtcaggtgctatacgagtgggagcaaggtttcagtcagtcattcacccaggagcaggttgcagatattgatggccaatacgccatgacaagagcccagagagtcagggctgcaatgttcccttag

SEQ ID NO: 23362 - DNA, 327 bp, Artificial Sequence
  Description of Artificial Sequence: Synthetic coding sequence
atggccacccaggccgacctgatggagctggacatggccatggagcccgaccgaaaagctgccgtgtcacactggcagcagcagtcataccttgatagcggaattcactccggagcaacaaccacagccccctcactcagcggaaagggtaaccccgaggaagaagatgtagacaccagtcaggtactctacgagtgggaacaaggctttagtcagtcttttacacaagaacaggtggctgacatagacggtcagtatgccatgacccgagctcagagagtccgcgcagccatgtttcctgagacgcttgatgaaggaatgcagtag

SEQ ID NO: 23363 - DNA, 2325 bp, Artificial Sequence
  Description of Artificial Sequence: Synthetic coding sequence
atggagctggacatggccatggagcccgaccggaaggccgccgtgtcacactggcagcagcaatcataccttgactcgggcatccattcaggtgccactaccaccgccccgtccctcagtggcaaagggaatccggaagaagaagatgtggatacctcccaggtgctctatgaatgggagcagggtttttcacaatccttcacccaggaacaggtggctgacatcgatggacagtacgctatgacaagggcacaaagggtgcgtgcagctatgttcccggagacactggacgaaggcatgcagataccctctacacagtttgatgcagcccaccccactaatgtgcagagactagccgaacctagccagatgctcaagcacgcagtcgtgaacctgatcaactaccaggatgacgctgaactagcgacccgtgcaatccctgagctgactaaattattgaatgatgaggaccaggtggtggtgaacaaagccgctgtgatggtccaccagctatctaaaaaagaggcctcaagacacgccatcatgcggagcccccagatggtgtcggccatcgttcgcacaatgcagaacactaacgatgttgagactgcacgatgcactgctgggacgctgcacaatttaagccatcacagagaggggctccttgccatcttcaagtctggaggtatccctgcccttgtgaagatgctcgggtctcctgttgactcagtccttttctatgcaatcactactttgcacaatctgcttctacaccaggaaggagcaaaaatggccgtgcgcctggcaggcggactccagaaaatggtcgccctcctgaacaaaacaaatgtgaagttcctggctattaccacggattgtctccagatcctcgcgtacggaaaccaagagtccaaattgataattcttgcctccggggggccacaagccttagtgaacataatgcgcacctacacttatgaaaaactcctgtggaccacaagccgcgtgcttaaggtactcagtgtgtgctccagcaacaagccagcaatagtggaagcaggcgggatgcaggccctaggtcttcacctgactgacccgtcacagcgcctggttcaaaattgcctgtggaccctgcgtaacctgagtgacgcagccacgaagcaggagggaatggaaggcctcttagggaccttagtgcagctgctcggcagcgacgacatcaacgttgtgacttgcgcagccggcattctgtccaatctcacctgtaataattacaagaataaaatgatggtttgtcaggttggagggatcgaggctttggtgaggactgtcttacgggctggggatcgtgaggacataaccgagccagctatctgtgcactgcgacaccttaccagccgccaccaggaagccgaaatggcgcaaaacgcagtgagattacattacggcctcccagtggtggtgaagctgttgcaccctccttctcattggccgttgattaaagccaccgtaggcctgatacggaatttagccctgtgtcccgcgaatcacgctcccctacgcgagcaaggggcaattccaaggctcgtgcagctactggtaagggcacaccaggacacgcagcgaagaacctcaatgggcggaactcagcaacaatttgtcgaaggggtgaggatggaggagattgtcgaaggctgcaccggagcattgcacatcctcgctagggatgtgcacaacaggatagtcatccgagggctcaatacaattcctctctttgtgcagctcctgtatagcccgattgagaacatccagcgcgtcgccgctggagtgctgtgcgaactggcacaggacaaggaagccgccgaagccatcgaagccgagggagccacagcccccctgacggaactgctacacagccggaatgaaggtgtcgcaacctacgcagctgcggtattattcaggatgtccgaggacaagcctcaagattacaaaaaaagactatcagtggaactgactagcagtctgtttaggaccgagcccatggcgtggaatgagacagcagacctgggtctagacattggagcacagggggagccgctggggtacaggcaggacgaccccagttaccgtagttttcatagtggtggctacgggcaggatgcccttggaatggatcccatgatggagcatgaaatgggagggcatcatcccggcgcggattaccctgtggatgggctgccggacctgggacatgctcaggacctcatggacggcctgccacctggtgacagcaaccagttggcatggttcgacaccgatttatag

SEQ ID NO: 23364 - DNA, 1020 bp, Artificial Sequence
  Description of Artificial Sequence: Synthetic coding sequence
atgtggcagctgtgggccagcctgtgctgcctgctggtgctggccaatgctcgatccagaccttctttccaccctctttccgacgaactggtgaattacgtgaacaaaagaaacacaacatggcaagctggtcacaatttttataacgtggatatgtcctatctgaagcgcctatgtgggacctttctgggtggcccaaaacctccacagagagtgatgtttacagaggatttgaagcttcccgccagtttcgacgctagggagcaatggccacagtgtcctactattaaggagattcgggatcagggcagctgtggcagttgctgggcctttggtgccgttgaagccatctcagaccgaatctgtatccataccaatgctcatgtgtccgtcgaggtgagtgcggaagatctcttgacatgttgcggcagtatgtgtggcgacggctgtaacggaggataccctgcagaggcctggaacttctggaccagaaaaggactcgtctctgggggattgtacgagagccacgtcggctgccggccttattccattcccccgtgcgagcatcacgttaacggtagcaggcctccttgtacaggtgaaggggatacgcccaagtgtagtaagatatgcgagcctggctattcacctacttataagcaagataaacactacggttataattcttactccgtgtcgaactcggagaaggacatcatggccgaaatctacaagaacggccccgtcgaaggggctttttccgtttattcagacttccttctttataaaagtggagtgtaccagcacgtgacaggggaaatgatgggcggccacgcaatacggatcttgggatggggcgtggaaaacgggaccccttactggctggtggcaaactcctggaacaccgactggggtgacaatggattttttaaaatactcagaggacaggatcactgcggtattgagtccgaagtggtagctggcatcccccgtaccgatcagtactgggagaaaatctag

SEQ ID NO: 23365 - DNA, 1020 bp, Artificial Sequence
  Description of Artificial Sequence: Synthetic coding sequence
atgtggcagctgtgggccagcctgtgctgcctgctggtgctggccaacgctcggtctcgaccttcctttcaccctttatcagacgagctcgtaaactacgtgaacaaacgtaacacgacctggcaagccggtcacaacttttacaatgttgatatgtcgtacctcaagcgcctgtgcggaacctttcttgggggtcccaagccccctcaacgagtgatgtttacagaggatctaaaattgcccgcatcgtttgacgcacgggaacaatggccacagtgccccactattaaggaaatccgggatcagggatcatgtggaagctgctgggccttcggggccgtggaggcaatatccgatcgaatctgtatacacacaaatgctcatgtgtctgttgaagtgtcagccgaagatctgctcacttgctgcggatcgatgtgtggtgatggctgcaacggaggctatccagctgaggcttggaatttctggacacggaaaggcctggtgagtggcggcttgtacgagagccacgtcggctgtagaccctactcgatccccccttgcgagcaccacgtaaatgggagtagacctccatgtaccggggagggagacactccgaagtgttcaaagatctgcgagccaggttattcaccaacatacaagcaggataagcattatggctacaattcctactcagtgtcaaattccgagaaggatataatggctgagatttataaaaatggaccggtggagggggctttttcagtgtactccgacttcctgctctacaagtcgggtgtgtaccaacacgtcaccggggagatgatgggcggtcacgcaattaggatcctgggctggggggtcgagaacgggactccatactggctagtggccaactcctggaacacagattggggcgataacgggttctttaaaatacttagaggccaagatcactgcggcatagaatctgaggtggtcgccgggatacccaggacggaccagtattgggaaaaaatatag

SEQ ID NO: 23366 - DNA, 333 bp, Artificial Sequence
  Description of Artificial Sequence: Synthetic coding sequence
atgtggcagctgtgggccagcctgtgctgcctgctggtgctggccaatgctcgctccagaccttcttttcacccactgtccgacgagctggttaattatgttaacaagagaaatactacatggcaggcaggacataatttctacaatgtcgatatgtcctatctgaagaggctgtgtggtacctttctaggggggcccaagccccctcagagagtaatgttcaccgaagatctaaagctgccagcctcctttgacgctcgggaacagtggccccagtgccctacgattaaagaaattcgagaccagggtagctgtggctcttgctggctgtag

SEQ ID NO: 23367 - DNA, 1020 bp, Artificial Sequence
  Description of Artificial Sequence: Synthetic coding sequence
atgtggcagctgtgggccagcctgtgctgcctgctggtgctggccaacgcccggtctagaccctcatttcatccattaagcgacgagttagtgaactacgtgaataagcgtaatacaacttggcaggccgggcataatttttacaatgtagatatgagctatctgaagcgcctttgcgggacatttctgggtggacctaagccacctcagcgagtgatgttcaccgaggacttaaaactccccgcctctttcgatgcacgcgagcagtggccccagtgccctacaatcaaagagatccgcgatcagggatcttgtgggtcatgctgggcatttggcgctgtggaagctatttcggatcgcatttgtatacacaccaatgcccatgtgtccgtcgaggtatcagcggaagacctgcttacctgttgcggctcaatgtgtggggacggctgtaacggcggctaccccgctgaagcgtggaacttttggacacgtaaaggactcgtgagcggggggctgtacgagtctcacgtgggctgtcggccttattctatccctccctgtgaacaccatgtaaacggctccaggcctccctgtaccggggagggagatacacccaagtgctctaagatttgcgagcctggatatagccctacttacaagcaggacaaacactacgggtataattcctacagcgtatcgaatagtgaaaaggacatcatggccgagatttataagaacggccctgttgagggcgccttcagtgtttacagcgattttcttctttacaaaagcggggtctaccagcatgtgactggtgagatgatggggggacatgcgatccggatcctgggctggggtgtggaaaacgggaccccctactggttagtggccaattcttggaacaccgactggggcgacaacgggttctttaaaatcctgagagggcaagatcactgtgggatcgaatctgaggtggtagcaggcatcccgaggacagaccagtactgggagaaaatctag

SEQ ID NO: 23368 - DNA, 1020 bp, Artificial Sequence
  Description of Artificial Sequence: Synthetic coding sequence
atgtggcagctgtgggccagcctgtgctgcctgctggtgctggccaacgccaggagtcgcccaagttttcatcccctctccgacgagcttgttaactacgttaacaagagaaacaccacctggcaggcaggccataacttctacaatgtggatatgtcctacttgaaaaggctctgtggcaccttcctcggcgggcctaagccaccgcagcgggtgatgttcacagaagatctgaagttgcctgcatcatttgacgcgcgcgagcagtggccccaatgtcctaccattaaggagattcgcgaccagggctcctgtggctcctgctgggccttcggcgccgtcgaagctattagtgatagaatctgtatccataccaatgctcatgtgagtgtggaagtgagcgcagaggatctcctgacctgttgtggatcgatgtgcggggacggatgcaacggcgggtaccctgccgaggcttggaatttctggacccgcaaggggctggtgagcggaggtttatacgagtcacacgttgggtgtcggccttacagcatccctccttgcgaacatcatgtgaatggatccagacctccatgcactggcgaaggcgatacccctaaatgcagcaagatatgcgaaccaggctattccccgacttataagcaggacaagcattacgggtataatagctactcagtgtctaattcggagaaggacatcatggccgaaatctataagaacggacccgtggagggcgcattttctgtgtactccgatttcttgttatacaaatctggcgtgtaccagcatgtgaccggcgaaatgatggggggacatgctattcgtattctgggatggggcgtggagaatggcaccccttattggctggttgcgaactcctggaataccgattggggggacaatggtttcttcaaaattctgagaggccaggatcactgcggtatcgagtccgaggttgttgctgggattccaagaaccgaccaatactgggagaaaatatag

SEQ ID NO: 23369 - DNA, 1020 bp, Artificial Sequence
  Description of Artificial Sequence: Synthetic coding sequence
atgtggcagctgtgggccagcctgtgctgcctgctggtgctggccaacgctagatctcgtccttcatttcatcccttgtcagatgaattagttaactatgtaaataagcgaaatacaacgtggcaagccggccacaacttctataatgtcgatatgtcctaccttaagcgcctgtgtgggacttttttaggaggccccaaacctccccagcgggtcatgtttaccgaagatttaaaactcccggcttcattcgacgcccgagaacaatggccacagtgcccgaccattaaggagatacgcgatcaaggcagctgcggtagctgttgggccttcggtgccgtggaagcaatttccgatcgaatttgcatacataccaatgcccacgtgagcgtcgaggtgagtgccgaggacttgctcacatgttgcggctcaatgtgcggcgacggctgcaatggcggatatcctgctgaagcctggaacttctggactaggaagggcctcgtcagcggaggactttacgagtcccatgtgggctgccggccgtatagcattccgccatgtgagcaccatgtaaacgggtcaaggcccccttgtacaggcgaaggagacacacctaaatgtagcaagatctgtgaaccagggtatagccctacctataaacaggataagcactacggatacaattcttatagtgtgagcaactctgagaaagacatcatggccgagatctacaagaacggccccgtcgagggcgcgttttccgtgtattcagatttcctgctgtacaaatcaggagtgtaccaacatgtgactggagaaatgatgggtggtcacgcaattagaattttgggttggggcgttgagaacgggacaccttattggctggttgcgaatagctggaacacggactggggcgacaatggcttcttcaaaatcttgaggggccaagaccactgcggtatcgagtctgaggtggtggctggaatacctaggaccgatcagtactgggagaagatctag

SEQ ID NO: 23370 - DNA, 1020 bp, Artificial Sequence
  Description of Artificial Sequence: Synthetic coding sequence
atgtggcagctgtgggccagcctgtgctgcctgctggtgctggccaacgcacgcagccggccatcattccaccctctgagcgacgagctggtcaattatgtaaacaaacgaaacactacatggcaggcaggacacaacttctacaatgtcgacatgagctacctcaaaagactttgtgggacttttctgggaggccccaaacccccccagcgtgtgatgttcactgaggatcttaagttgcccgcaagcttcgatgctagagagcagtggccacagtgccccaccatcaaagaaattcgggaccagggctcttgtgggagctgttgggcctttggcgctgtggaggcaatatctgaccgtatttgtattcacacgaatgcacatgtttccgttgaagtatctgctgaggacctcttgacttgttgtggctccatgtgcggtgacggatgtaacggcggatacccagctgaagcctggaatttctggacccgcaaggggcttgtttctggtggcctttacgaatcgcacgttggttgtcggccctactcaatcccgccgtgcgaacatcatgttaatggaagtaggccgccatgcacgggcgaaggcgacacacctaagtgttctaagatctgcgaaccgggatactcaccgacctataaacaggataagcattacggatataatagttattccgtgtcgaacagtgagaaggacatcatggccgagatctacaaaaacggacccgtcgagggcgctttttccgtttatagtgattttttactttacaagagcggcgtctaccagcatgtcacaggagagatgatgggcgggcacgcgatcaggatactcgggtggggtgtggaaaacggcactccttattggctcgtagctaactcatggaacacagactggggcgacaacggctttttcaaaatcctcagggggcaagatcactgcggcatcgaaagcgaagtggtcgcagggatcccccggacagaccagtattgggaaaaaatttag

SEQ ID NO: 23371 - DNA, 1020 bp, Artificial Sequence
  Description of Artificial Sequence: Synthetic coding sequence
atgtggcagctgtgggccagcctgtgctgcctgctggtgctggccaacgcccgctcaaggccctctttccatccactgagtgacgagctcgtcaactacgtcaacaagagaaataccacatggcaggctggccacaatttctacaacgtcgacatgagttatttgaaacgcctgtgtggcaccttccttggtggtcccaagcctccccagcgcgtgatgttcaccgaggacctgaagttacctgccagcttcgacgccagagaacaatggccacagtgccctacaattaaagagattcgagaccaaggaagttgcgggtcctgctgggcctttggggccgtcgaggcgataagtgaccggatatgcattcataccaacgcacatgtaagcgtggaggtgtccgctgaagatctcttgacctgctgtggctccatgtgcggcgacggctgtaacggggggtaccctgcagaagcttggaatttttggacgaggaagggcctagtctccggaggcctgtacgagtcacacgtgggctgccgtccctatagtattcctccttgcgagcatcacgtgaacggcagcagaccgccttgtactggagaaggtgacacaccaaagtgttccaagatctgcgagccgggctattctcctacatacaagcaagataaacactatggctacaattcctatagcgttagcaatagcgagaaagatataatggccgagatttataagaatggacccgtcgaaggcgcgtttagcgtgtactctgactttctgttgtataagagcggggtgtaccagcatgtgacaggcgaaatgatggggggccacgccatcagaatacttggatggggagtggaaaatgggactccatactggcttgtggctaattcttggaacaccgactggggcgataatggctttttcaaaatcctcagggggcaagaccattgtggcattgaaagtgaagtggtggcagggatcccacgcacagaccagtactgggaaaaaatctag

SEQ ID NO: 23372 - DNA, 1020 bp, Artificial Sequence
  Description of Artificial Sequence: Synthetic coding sequence
atgtggcagctgtgggccagcctgtgctgcctgctggtgctggccaacgcccgcagccggcccagctttcacccgttgagcgatgagctcgttaactacgttaacaagcgcaatacaacttggcaagccggacacaatttctataacgtagatatgtcgtacctgaagagactctgtggtacgtttttgggcggcccgaagcctccccaacgcgtaatgtttactgaggacctgaagttacctgccagtttcgacgccagagaacagtggcctcaatgccccacaatcaaggaaattagggatcaaggaagctgcgggtcatgctgggcctttggggctgttgaagccatttccgaccggatatgtattcacaccaatgcacatgtatccgtagaggtgtccgcagaagatctgctgacctgttgcggttcaatgtgtggtgatggatgtaatggcggctatccagccgaggcgtggaatttctggacccggaaggggcttgtgagcggagggctctacgaatctcacgtggggtgcaggccttactctattccgccttgcgaacatcatgtgaatggtagcagacccccctgcaccggggagggcgacaccccgaagtgttccaaaatctgcgaaccaggctattcccccacctataagcaggacaaacattacggatataacagttattctgtctccaacagcgaaaaggatattatggccgaaatctacaagaacggaccagtcgaaggagccttcagcgtttattcggattttctgttgtataagagcggggtttatcaacatgtgacaggcgagatgatgggagggcacgcaattcggatactgggctggggcgtggagaacggcaccccctattggctggtagcgaacagttggaacacggattggggcgacaacgggttcttcaaaatccttcgagggcaggatcactgcggcatcgaatctgaagtcgtcgcaggaatcccaagaacagaccagtactgggagaagatttag

SEQ ID NO: 23373 - DNA, 831 bp, Artificial Sequence
  Description of Artificial Sequence: Synthetic coding sequence
atggacatgaaccggcgggccagctgcctgctgcccgacctgtgcggccagggctgggggtggcgcctgttcccagctagctgcgcttatcttggctctgttccctggcgcgtgtggggattggggggcctgctggcacctctcgccgcggcaggtggaggttccactagtgggctgggacatctgggtagcacacaatggtctggtgagctcgtcgttctcttaagtgaggtcttcataagaggctgtcttttcagctgcaatggcggttatccagccgaggcttggaatttctggacacggaaggggctggtgagcggagggctgtatgaaagccacgtcggctgcaggccatattctattcctccttgtgagcatcacgtcaatgggagtagacccccgtgtacgggggagggcgatactcccaaatgtagcaaaatatgtgagcctggttattcaccgacctacaaacaagataagcactatggctacaatagctattctgtgtccaattctgagaaagacattatggctgaaatatataagaacggacccgttgagggcgcattttccgtatacagtgactttctgctttataagagcggtgtataccaacatgtgaccggcgagatgatgggaggccatgctattagaatcctgggctggggagtggagaacgggaccccctactggctggtcgccaacagctggaacaccgattggggagataatggcttctttaaaatcctacgggggcaggaccattgcggaatcgagagcgaggtggtggctggtattccgcgtacagaccagtattgggagaaaatttag

SEQ ID NO: 23374 - DNA, 738 bp, Artificial Sequence
  Description of Artificial Sequence: Synthetic coding sequence
atgcccggcgccggccccctgagcatcccctgccggatgagctgggctttcggtgctgttgaagccatctctgatagaatttgtattcacactaatgctcacgttagtgtcgaggtgagcgctgaggacctgctgacctgctgcggctctatgtgcggcgacggatgtaatggtggctaccccgctgaggcctggaatttttggactcgtaagggcttggtgtcagggggactctacgaatcacacgtcgggtgtcgcccatattccatccctccttgcgagcaccacgtgaacgggagcagacccccatgtacaggcgagggcgacactccaaaatgtagcaaaatctgtgaaccaggctactcacccacttataagcaagacaaacattatggctacaactcctatagcgtgagcaattccgaaaaagatataatggcggaaatttacaaaaacggaccggtcgaaggcgctttttccgtgtactctgatttcctcctgtacaagtctggcgtatatcaacacgtgaccggagaaatgatgggaggtcacgccatcaggattctcggatggggcgtcgaaaatgggactccctactggctggtagctaacagttggaacaccgactggggcgacaatgggttcttcaagattttgcggggccaggatcactgtggaatcgagtcagaggttgtggctggtatacctaggaccgaccagtattgggaaaagatttag

SEQ ID NO: 23375 - DNA, 1239 bp, Artificial Sequence
  Description of Artificial Sequence: Synthetic coding sequence
atgcagcccagcagcctgctgcccctggccctgtgcctgctggccgcacctgccagcgctctggtgcgcattcccctccacaagtttacctctatacgcagaacaatgtctgaagtaggcggaagcgtggaagacctgatagctaagggccccgtgagtaaatactcccaagctgtgcctgcagttaccgaaggtcccattccggaggttctgaaaaactatatggacgcccaatactatggcgaaattgggattggaacaccgccacagtgttttaccgtcgtgtttgacacaggatccagcaacctgtgggtaccgtctatccattgcaaattactggacattgcctgctggatccaccataaatataactctgataaatccagcacctatgtcaagaatggcacatcttttgatatccactatgggtctgggtccctttctggctatctcagccaggacactgtatccgtgccttgtcagtctgcgtcttctgcctcagcactgggcggggtgaaagtagagaggcaagtgttcggtgaggccacgaaacagcccggcatcacgttcattgccgccaaattcgatggaattctgggtatggcatatccgagaatatctgtcaataatgttctgccagtgttcgataaccttatgcagcagaagctggtcgaccaaaatatcttttcattctatctttcccgagacccagacgctcagcccggtggcgaacttatgctgggcggaaccgactcaaagtactacaaggggagcctttcatatttaaacgtaaccagaaaggcttactggcaggtacatctcgaccaggttgaggtagctagcggtctgacattatgcaaggagggatgcgaagccatcgtggacacgggaacaagcctgatggtgggcccggtggatgaagtgcgcgaactgcaaaaagccattggtgctgttcccctgattcaaggcgaatatatgattccctgcgagaaggtgtctactctgccggctataacattaaagttgggagggaaggggtacaaactctctccagaggattatacgctgaaggtaagtcaagccgggaaaaccttgtgtttgtcaggcttcatgggcatggatatcccaccgccctctgggccactatggatccttggtgacgtcttcattggacgctactacaccgttttcgacagagataataatagagtcggattcgcggaggctgctcgtctctag

SEQ ID NO: 23376 - DNA, 1002 bp, Artificial Sequence
  Description of Artificial Sequence: Synthetic coding sequence
atgaaccccaccctgatcctggccgccttctgcctgggcatcgccagcgccacactcacatttgatcactcgcttgaggcccagtggaccaaatggaaagcaatgcacaaccggctatatgggatgaacgaggaggggtggcgcagggcagtctgggaaaaaaacatgaagatgattgaactgcacaaccaggagtatcgagagggcaaacacagctttaccatggccatgaatgccttcggggacatgaccagcgaggaatttcggcaggtgatgaatgggttccaaaacaggaagccccgaaaagggaaggtttttcaagagccgctgttttatgaagctccccggtccgtcgattggagagaaaagggttatgttaccccggttaagaatcaggggcagtgtggcagctgttgggcgttcagcgccacaggggctctggagggccagatgttcaggaagacagggcggctcatatcactgagcgaacagaacctagttgactgctctggtccgcaggggaacgaaggttgcaatgggggtctgatggactatgcgtttcaatatgtgcaggataacggcggtctggatagcgaggaaagctacccatatgaagctacagaagagtcatgcaaatacaatccaaagtactcggtcgctaacgacactggattcgtggatatcccaaaacaggaaaaggctctgatgaaagccgtggccacagtcggtcccattagtgtggctatcgatgctggtcacgaaagtttcttgttctacaaggaagggatctactttgaaccagattgttcatccgaagacatggaccacggcgtgctggttgttggatatggcttcgaatcgactgaaagcgataacaataaatattggctggtcaaaaattcctggggagaggagtggggcatgggtggatacgttaaaatggctaaagaccgccggaatcactgcggcatcgcgagcgcggccagctacccaaccgtgtag

SEQ ID NO: 23377 - DNA, 678 bp, Artificial Sequence
  Description of Artificial Sequence: Synthetic coding sequence
atgaaccccaccctgatcctggccgccttctgcctgggcatcgcctctgcaacattgacctttgatcactctctggaggcccagtggactaagtggaaggcaatgcacaaccgcttgtatggcatgaatgaagaggggtggcggcgggccgtgtgggaaaagaatatgaaaatgatagaactccataatcaagaataccgcgaaggtaaacattcattcaccatggccatgaatgcttttggagacatgacctctgaggagtttcgacaggtgatgaacggctttcagaatcggaaaccaaggaagggcaaagtgtttcaagaacccttattctacgaggccccgagatccgtcgattggcgtgagaaggggtatgtgacacccgtaaaaaatcaggggcagtgtgggtcttgttgggcgttctctgcaactggcgctctggaagggcagatgttcaggaaaaccgggaggctcatttcattgagtgaacagaaccttgtcgactgttccggtccacagggaaacgagggctgcaacggaggactgatggattatgcatttcaatacgttcaggacaacggcggcttagactctgaggagagctacccatatgaggccacagtgtccggagctccatgccatcattctagctcggcatttgggcggtggaccctgtag

SEQ ID NO: 23378 - DNA, 1002 bp, Artificial Sequence
  Description of Artificial Sequence: Synthetic coding sequence
atgaaccccaccctgatcctggccgccttctgcctgggcatcgccagtgcgacactgacattcgatcactctctcgaagctcaatggaccaagtggaaggccatgcacaaccggctgtatgggatgaacgaggaaggctggaggagggcggtgtgggaaaaaaatatgaagatgatcgagctgcacaaccaggagtaccgggaaggaaagcacagttttacaatggcgatgaacgcttttggagatatgactagcgaggagttccggcaggtcatgaatgggtttcagaatagaaagccacgcaagggaaaggtgttccaagagcctctgttctatgaagctcccagatccgtcgattggagagagaagggatatgtcacaccagtgaagaaccaaggacagtgcggatcctgttgggctttcagtgccacaggtgcattggagggacagatgttcaggaagacgggaagactgattagtttaagtgaacagaatctcgtcgactgcagcggcccacaagggaacgagggttgcaatgggggactgatggactacgcctttcagtacgttcaggataatggaggccttgattccgaggaatcatacccctatgaggccacagaggaatcatgcaagtacaacccaaagtattcggtggcaaatgacactggatttgtagacatccccaaacaggagaaggctttaatgaaggctgtcgcaactgtgggacccatatcagttgcgattgacgccggtcatgaaagctttctattctataaggagggcatctacttcgaacccgactgttcaagtgaggacatggatcacggcgtcctcgtggttggctacggatttgaatctaccgaaagtgataataacaaatactggctcgtaaagaattcatggggcgaggaatggggaatgggtgggtacgttaagatggctaaagaccggcgtaatcactgcggaatcgcaagtgccgcaagctacccgaccgtgtag

SEQ ID NO: 23379 - DNA, 120 bp, Artificial Sequence
  Description of Artificial Sequence: Synthetic coding sequence
atgaaccccaccctgatcctggccgccttctgcctgggcatcgcctcagccaccctcacattcgaccacagtctggaagcacagtggactaaatggaaggctatgcacaacaggttatag

SEQ ID NO: 23380 - DNA, 444 bp, Artificial Sequence
  Description of Artificial Sequence: Synthetic coding sequence
atggccgacgagctgagcgagaagcaggtgtacgacgcccacaccaaggagattgacctggtgaatcgagacccaaagcacctgaacgatgacgtcgtaaaaatcgactttgaggatgtgattgcagagccagaaggcacgcatagttttgatgggatttggaaagccagctttacaacatttaccgtgacaaagtattggttctataggctactttccgcgttgtttggcatcccaatggcactgatctggggcatttactttgcaattcttagcttcctgcatatctgggctgtggtaccctgcattaagagcttcctcattgaaatccagtgcatttctagggtgtatagcatatatgtgcacacggtgtgtgaccccttatttgaagccgtgggcaaaattttctccaatgtgcgaattaatctccagaaggaaatttag

SEQ ID NO: 23381 - DNA, 444 bp, Artificial Sequence
  Description of Artificial Sequence: Synthetic coding sequence
atggccgacgagctgagcgagaagcaggtgtacgacgcccacaccaaggagatcgatctggtcaacagggatcctaagcacctgaatgatgacgtggtgaagatcgatttcgaggacgttatcgccgagccagaaggaacacattcattcgatggaatatggaaagcctcttttacaactttcactgtcaccaagtattggttttacagactactgtctgccctgttcggcatccctatggctcttatatgggggatatactttgccatcctttccttcctacacatctgggctgtggttccatgtatcaagagtttcctgatcgaaatccagtgcatctctcgcgtgtacagcatctatgttcacactgtgtgtgatcctctttttgaagctgtgggcaagattttctccaacgtaagaatcaatctgcagaaagagatatag

SEQ ID NO: 23382 - DNA, 537 bp, Artificial Sequence
  Description of Artificial Sequence: Synthetic coding sequence
atgagcggcggcaagtacgtggacagcgagggccacctgtacaccgtccctatccgggaacaagggaacatatataaacccaacaacaaggctatggccgatgaactaagcgagaaacaggtttatgatgcccacacaaaggagattgaccttgtaaatcgagatcccaaacacctcaatgacgatgtcgtaaagatagatttcgaggatgtgatcgctgagcctgaaggaacccattcttttgatgggatttggaaagccagcttcactacattcaccgtgactaagtactggttttatcggctgctgagcgcgttgtttggtatccctatggccttgatttgggggatttacttcgccatcctgtctttccttcacatttgggccgtcgtaccttgcattaaatctttcttaattgaaatacaatgcatttcaagggtctactcgatctacgtgcacaccgtgtgcgaccccctgttcgaagccgtgggaaaaattttcagtaacgtcaggattaatttgcaaaaagagatctag

SEQ ID NO: 23383 - DNA, 345 bp, Artificial Sequence
  Description of Artificial Sequence: Synthetic coding sequence
atggccggcggcaaggccggcaaggacagcggcaaggccaaggccaaggcagtttcccgcagccagcgagctggcctgcagttcccagtaggaagaatacaccgtcatttaaaaaccagaactaccagtcatggccgcgttggcgctaccgccgcggtgtattctgccgccatactggagtatctgacagcggaggttcttgagctggctggaaatgccagcaaggatctcaaggtgaaacggatcacacccaggcacctgcagctcgccataagaggcgacgaggagctggattccctgattaaagccacgatcgctgggggagagaagcggcgctgcagctag

SEQ ID NO: 23384 - DNA, 339 bp, Artificial Sequence
  Description of Artificial Sequence: Synthetic coding sequence
atgggcctggagaccgagaaggccgacgtgcagctgttcatggacgatgacagttactcccatcatagtggcctcgagtacgcagatccagaaaagttcgccgatagcgatcaggacagagatccccacaggctgaattctcacctgaaggattttaacgctttttgtaaggatttgcctaatgggtccgcgttttcagccgacaacatggaagagtgcgacaggtgttaccattgctcgatcgtctatgaacgcaggaccatgctgctcttttgccaacctgcaaccgagcctgggctaaatacttggaccccaggcctcgaaatcggcattttatag

SEQ ID NO: 23385 - DNA, 342 bp, Artificial Sequence
  Description of Artificial Sequence: Synthetic coding sequence
atgggcctggagaccgagaaggccgacgtgcagctgttcatggacgacgatagctactcccaccatagcgggttagaatacgcggaccctgaaaaatttgccgacagcgatcaggatagggatccacaccgtctgaactcccacttgaaattgggatttgaagatgtaattgcagagcccgttaccactcacagctttgataaggtgtggatatgcagtcatgccctttttgaaatttcaaaatatgtgatgtacaagtttctgacagtgtttctcgccatccccttagcattcatcgcgggaatcctgttcgccacactgtcctgcctacatatttggtag

SEQ ID NO: 23386 - DNA, 1038 bp, Artificial Sequence
  Description of Artificial Sequence: Synthetic coding sequence
atgcagcggctggtggcctgggaccccgcctgcctgcccctgccccctcctccccccgcctttaaaagcatggaagtcgcaaatttttattatgaggcagactgtcttgctgcagcatacggtggtaaagccgccccagcagctcccccagccgccagacccggccctcgtccgcccgctggcgagctcggatctatcggtgatcatgaacgcgctatcgacttttctccttacctcgagcccttgggggccccacaggcccctgcccctgccacagcaacagacaccttcgaggctgctccccctgcccccgctcctgcccccgctagctcaggtcagcaccatgactttctgagcgacttgttttctgatgactacgggggcaagaattgcaaaaagcccgcagaatacggctacgtgagcctgggtcgtcttggagccgccaagggcgccctacaccctggatgctttgcccctctgcatccaccgcctccaccaccacccccacccgccgaactgaaagcagaacctggtttcgagcccgcggattgcaagagaaaagaggaagcaggtgcacctggcgggggcgccggcatggcagccggatttccgtatgccctccgagcatacctggggtatcaagcagttccctctggctcttctggaagtctgagtacgtcaagttccagctccccaccaggaaccccttctcccgcagacgcgaaagcgccgcctaccgcctgctatgccggagccgctccagctccgtctcaagtgaagagcaaagccaagaagaccgttgacaagcattccgacgaatacaaaatccggcgcgagcgaaataacatcgccgtgcggaagagccgcgataaggccaaaatgcgaaacctggaaactcagcataaagtgctcgagttaactgctgaaaatgagcgattgcagaaaaaagtcgaacagcttagtcgggagctctctactctgcggaacctgtttaaacagctgcccgaacctctgctggctagtagcggacattgttag

SEQ ID NO: 23387 - DNA, 2184 bp, Artificial Sequence
  Description of Artificial Sequence: Synthetic coding sequence
atggagggcgacgccgtggaggccatcgtggaggagagcgagaccttcatcaaaggaaaagaacgcaaaacctatcagaggaggcgggaggggggtcaggaagaggacgcttgtcaccttcctcagaatcagacagatggaggtgaggtagtccaggacgtgaattcgtctgtgcaaatggtgatgatggaacagctggaccctacactcttgcagatgaagaccgaagtgatggaaggtactgtagcacctgaagccgaggctgccgtggacgacacacagataatcactctgcaagttgtcaatatggaggaacagcctattaacatcggggagctccagctggtccaggtgcctgtgccagttacggtgccagtggccacaacctccgtggaagagctccagggcgcctacgagaacgaagtcagcaaggaaggcctcgcagagtccgagccaatgatctgccacacactccccctgcctgagggttttcaggtagtgaaggttggagcgaacggggaggtagaaacgttagagcagggagagttacctcctcaggaagatccttcctggcaaaaagacccggactaccagcctcctgctaaaaagacaaaaaagacaaagaaatcgaagctgagatacaccgaggaaggcaaggacgttgacgtttccgtgtacgactttgaggaagagcagcaggagggcctgctgagcgaagtaaacgcagagaaggtcgtcggtaacatgaaacctccgaagcccactaaaatcaaaaagaagggagttaagaagacatttcagtgcgaattgtgcagctatacctgtccgagaaggagcaacctggataggcacatgaaatctcacaccgatgagcggccacataagtgccatctctgcggacgagcctttaggactgtgactttgttacgcaatcacctaaatactcataccggcacccggccgcataagtgcccagactgtgatatggcctttgtaacttctggtgagttggtgcgccacaggagatataaacatactcacgaaaagccgttcaagtgttctatgtgtgattatgcttctgtggaagtatctaagctaaaacgccacattcgcagccacactggggaacgacccttccagtgcagcttgtgcagttatgcctctagggatacttataagctcaagcgccatatgagaacgcactccggcgagaagccctatgaatgctatatatgtcatgctcgattcacccagagtggcactatgaaaatgcacatactccagaaacacaccgagaacgttgcgaagtttcactgcccgcactgcgacactgtcatagcaagaaagagcgacctaggcgtgcatttaaggaaacagcactcttacatcgaacagggtaagaaatgtagatactgcgacgccgtgtttcatgagaggtacgccctgatacagcaccagaaatctcataagaacgaaaagcgatttaagtgcgaccagtgcgattatgcttgtcggcaggagcgccatatgatcatgcacaaaagaacacacactggggaaaagccttacgcttgttcccactgcgacaagacctttcggcaaaagcagctgctggatatgcactttaagcgctatcatgacccaaactttgtgcccgccgccttcgtgtgcagtaagtgcggcaagaccttcactcggcgcaacactatggccagacacgcagacaactgcgctgggccagatggagtggagggcgagaatggcggagaaaccaagaaatccaaaaggggtcgaaagcgcaaaatgcggagcaaaaaggaggattcatccgatagcgaaaacgccgagcctgatctagatgataacgaggacgaagaagagccagctgtcgaaatcgaacccgagcccgagccacagcccgtaactcctgcccctccacctgcaaagaagcgccggggccgtcccccaggccgtacaaaccaacctaagcaaaaccagccaaccgcgattatccaagttgaggaccagaatacaggggctatcgaaaacattatcgtggaggtgaaaaaagagccggacgcagaacccgcagagggtgaggaagaagaggctcagccggccgctacagacgctcccaacggtgatctgacccccgagatgatcttgtccatgatggaccgatag

SEQ ID NO: 23388 - DNA, 1200 bp, Artificial Sequence
  Description of Artificial Sequence: Synthetic coding sequence
atggccttcgtgaccagcggcgagctggtgcggcaccggcggtacaagcacacacacgaaaagccatttaagtgttctatgtgcgattatgcgtccgtggaggtgtctaaattgaagcggcatattagatcccacactggagaaagaccgtttcaatgctctctgtgcagttacgcctcccgcgacacttataaacttaagcggcacatgcgtacgcatagcggcgagaaaccatatgagtgttatatttgtcatgcgcggttcacacagagcggcacgatgaagatgcacattctccagaagcacaccgaaaacgtcgcaaagtttcactgcccgcattgcgacaccgtcatcgctagaaaaagtgacttgggagttcacctgcgtaagcagcattcttatattgaacaggggaagaagtgccgttactgcgatgccgtgtttcacgagaggtatgcgctcattcagcaccagaaatcccacaagaacgaaaagagattcaagtgtgatcagtgcgattatgcctgtcggcaagaacgtcatatgattatgcacaagcgcacccacacaggggagaagccatatgcctgcagccactgtgataagacttttcgacagaaacagttgctggacatgcacttcaaaagataccatgatcctaacttcgtacccgccgcattcgtttgttcaaagtgtgggaagacgttcacccgcagaaacacgatggcgagacatgccgacaactgcgccggacctgacggagtggaaggggaaaatggcggcgaaactaaaaaatcgaagcgaggacgaaaaaggaagatgaggtcaaagaaagaagactcaagtgactctgagaatgcagaacccgacctcgacgataacgaggatgaggaggagcccgctgtcgagatcgaaccggagcctgagcctcagcctgtgacacccgctccacctcccgccaaaaagcggagaggacgtcccccagggagaactaaccagcctaagcagaaccagcctaccgctatcatccaagtggaagatcaaaatacaggcgccatagaaaacatcattgtggaggtcaaaaaagagcctgatgcggaaccagccgagggggaggaggaggaggctcagccggccgctactgatgcaccaaacggagacctgacacctgagatgattctgtcaatgatggatcggtag

SEQ ID NO: 23389 - DNA, 1128 bp, Artificial Sequence
  Description of Artificial Sequence: Synthetic coding sequence
atggagcgggccagctgcctgctgctgctgctgctgcccctggtgcatgtgtctgcaacaacccccgagccgtgtgagttggatgacgaggacttccggtgcgtgtgtaatttttccgagccacagccagactggtccgaggcatttcagtgtgtctcagcggtggaggttgaaatccacgcaggcgggctaaatctcgaacccttcctcaagcgggttgatgcagacgctgatcctaggcaatatgctgatacagtaaaggctcttcgagtgagacggctgaccgtgggtgctgctcaggtccccgcgcagctgctagtgggcgccttacgtgtcctagcctactcccggctgaaggaactcacactcgaagatcttaagatcactggtacgatgcctcccctgcctctcgaggctaccggactcgcactgagtagcttgaggctaagaaacgtgtcctgggctaccggcaggagctggctggccgagctccagcagtggctgaagcccgggttaaaagtcctgagcattgcccaggcacacagtcccgccttctcatgcgaacaagtcagagccttccctgccctgacctctttggacctctctgataaccccgggctgggggaacgaggcttaatggccgcactgtgtccgcataaattccccgcaattcagaatttggcactgagaaacaccggcatggaaacacctactggagtctgtgccgcactcgctgctgccggagtccagccccattctctcgatctttcacataattcactgagggccacggtgaatccatctgctccccgctgcatgtggtcctccgcgctcaattctctaaatctttcctttgctgggctggaacaggtcccgaaggggcttcccgccaagcttcgagtgctcgatctaagctgcaatagattaaatagagccccacaaccggacgagcttccagaggtcgacaacctgactctggacggtaacccctttctggtaccgggtacagcgttaccccacgaaggctcgatgaatagcggtgtggtgcccgcatgcgcccggagcaccctgtctgtcggcgtgtccggaacgctggttctgttgcagggcgcacggggttttgcctag

SEQ ID NO: 23390 - DNA, 1128 bp, Artificial Sequence
  Description of Artificial Sequence: Synthetic coding sequence
atggagcgggccagctgcctgctgctgctgctgctgcccctggtgcatgtctcagccacaacacctgaaccatgtgaactcgatgatgaggacttccggtgcgtgtgcaacttttccgaaccacagcctgactggtctgaagctttccagtgcgtttctgccgtggaggtggagattcacgccgggggactaaacctggaaccatttctgaaaagggtggatgccgacgctgacccccggcagtatgccgatacggtgaaggcactacgcgttcggcgcctcacagtgggggctgcacaagtcccagctcagcttttggtgggagctctgagggttctcgcctactcacggcttaaagagttgacactggaagacttgaagattacaggcaccatgccacctctccctctcgaggccaccggcctggctctgagtagtttgcggttgcggaatgtgtcatgggctactggccggagctggctcgctgaactccagcaatggctgaagccgggcttgaaagttttaagtattgctcaggctcatagcccagctttttcctgcgaacaggtgcgtgcattccccgctttgacatccctagatctctctgacaatcctggactgggggagagaggcctgatggcggccctatgcccgcacaagtttccagccattcaaaacctggccttacgtaatacaggcatggagacacccactggggtatgcgctgcccttgcagccgctggagtgcagcctcacagtctagatttatctcacaattcacttcgcgccactgtcaatccaagcgcgcccagatgtatgtggagtagcgccctgaattcactgaacctgagtttcgccggcctcgaacaagttcccaagggcctgccagcaaagctccgtgtccttgacctgtcgtgtaatagattgaaccgagcgccgcaacccgatgaactccctgaagtagacaacttgactctggacggcaaccccttcctggtcccaggcacagccctgccccacgagggttctatgaacagcggagtggtgccggcctgtgcccgaagcaccttgtctgtgggcgtgtctgggactctggtccttctccagggcgcaaggggctttgcctag

SEQ ID NO: 23391 - DNA, 402 bp, Artificial Sequence
  Description of Artificial Sequence: Synthetic coding sequence
atgagcttcccctgcaagttcgtggccagcttcctgctgatcttcaacgtgagcagtaaaggtgcggtctcaaaggaaatcaccaacgccctcgaaacctggggggcgttaggccaggacatcaacttggacatcccaagctttcagatgtccgatgacatcgatgacataaagtgggaaaagacctccgataaaaagaagattgcccagttccgcaaggaaaaggaaaccttcaaagaaaaggacacctacaagctgtttaaaaacggaactttgaagataaaacatcttaagaccgatgatcaggacatttataaggtttcaatttatgacaccaagggcaagaacgtcttggaaaagatcttcgacctgaaaatccaaggaaagtgcagtttcccatag

SEQ ID NO: 23392 - DNA, 1056 bp, Artificial Sequence
  Description of Artificial Sequence: Synthetic coding sequence
atgagcttcccctgcaagttcgtggccagcttcctgctgatcttcaatgtgagtagtaagggtgcagtaagcaaagaaataaccaatgcactcgaaacctggggcgcgttggggcaggacattaacctggacatcccttcttttcagatgtcagacgatattgacgacatcaaatgggagaagacaagtgacaaaaaaaagattgcccaattccgcaaagaaaaggaaacgttcaaagagaaagatacctacaaactgttcaaaaacggaacgctgaaaatcaagcacttgaagacggatgatcaggatatttacaaggtctctatttacgacactaagggcaagaatgtactggagaagatttttgacctgaagattcaggagcgagtgtctaaaccgaagatctcctggacctgtattaacacaacactgacctgcgaggtcatgaatggcacggaccccgagttgaacctgtaccaggatggaaagcatctgaaactcagtcaacgggtcattacgcataaatggacaacatctctcagtgcaaaatttaagtgcacagctggaaacaaggtgagcaaagagtccagtgtagagcccgtttcctgtccggagaagggtctggatatttacctgataatcggtatctgtggcggcggatcacttctaatggttttcgtcgccttgctggtgttttacatcacaaaacggaaaaagcagcgctcaaggcgcaacgacgaggagttggagaccagagctcatcgcgttgccacagaagagaggggacgaaagcctcaccagatccccgctagcactccgcagaaccctgctacctcacaacatcccccgccaccccctggtcaccggtcacaggctccctcccataggcctccacctccgggccacagagtgcaacatcagcctcagaaaagacccccggcgccatcaggaactcaggtgcaccaacaaaaagggcccccgttgcctcgtcccagagttcaacccaagccgccgcacggcgccgctgagaacagcctctctcccagttctaactag

SEQ ID NO: 23393 - DNA, 2544 bp, Artificial Sequence
  Description of Artificial Sequence: Synthetic coding sequence
atgcacctgctgggcccctggctgctgctgctggtgctggagtacctggcgttcagcgatagctccaagtgggtcttcgaacatcctgagaccctctacgcttgggaaggagcctgtgtgtggatcccttgtacataccgcgccctcgatggcgacctggaatcgttcatcctttttcacaatcccgagtataacaaaaatacaagtaagttcgacggcaccaggctatacgagtctactaaagacggcaaggtcccctccgaacagaaacgcgtgcagttcctgggcgacaagaacaaaaattgtaccctgtccatacaccctgtccatcttaacgacagcggacagctcggccttcgcatggaaagcaagacagagaagtggatggagagaatccatctcaacgtctccgagcggccattccccccccacatccaactcccgcccgaaattcaggagagccaggaggtgactctcacctgtcttcttaacttcagctgttatgggtatcccatccagctgcagtggttgctggagggtgtgccgatgcgacaagctgcagtgacgagcaccagcctaaccataaaaagcgtttttacacggagcgagttaaaattctctcctcagtggtcccaccatggaaaaattgtgacatgtcagctgcaggacgcagacgggaagtttttgtccaatgataccgtgcagctgaacgtcaagcacacacctaaactggagatcaaagtgacaccctccgacgctatcgtgagggagggagattctgtcaccatgacctgcgaagtgtcaagctcaaaccctgagtacacaacagtgagctggctgaaagatggtacctctctcaaaaaacaaaatactttcaccttgaacctgcgcgaagttacgaaggatcagagcggcaaatactgttgtcaggtaagcaacgacgtcggccctgggcggtctgaggaagtttttctgcaggtgcaatacgctccagagccaagcactgtgcagatattgcactcccctgcagtcgagggctctcaggtggagttcttatgcatgagtctggctaaccccctgcccactaattacacctggtaccacaacggcaaggagatgcaggggcgcactgaggagaaagtccacattcctaagatcctgccttggcacgcagggacctattcttgcgtggccgagaatattcttggtactggacaacgcgggccaggtgctgaactggacgtgcagtacccgccgaagaaagttaccaccgtcatccagaatcccatgcctatcagagaaggcgatacggtcacccttagttgtaactataacagcagtaatccttcagtcaccagatacgaatggaagccgcacggagcctgggaggaaccgagcctgggagtacttaagattcaaaacgtgggatgggacaacacaacaattgcctgcgctgcctgcaactcctggtgttcctgggcctcacccgtggctctcaacgtgcagtacgccccccgcgacgtgcgggtcagaaagatcaaacctcttagtgagattcacagcggtaactccgtaagtctccagtgcgatttctccagctcccacccaaaagaagtgcaattcttctgggagaagaacggtcgactcctgggaaaggaatcccaactgaatttcgattcaatctccccagaggacgccgggagctactcctgctgggttaacaattctatcggacaaactgcaagcaaagcatggactctggaggtcctgtatgctcctcgacggctaagagtgtctatgagtcctggggatcaggtaatggagggcaaatctgccaccctgacttgtgagtcagacgccaaccctcctgtaagccactacacctggttcgattggaacaatcagagtctgccttaccacagtcagaagctgagactcgaacctgtgaaagttcagcactctggagcatattggtgccagggcacaaattccgtgggcaaaggccgctctccactctcaactctgaccgtctactacagccctgagacaataggtcgaagagtagctgttggtctggggagctgcctggcgattctgattcttgccatctgcggcctgaaactacagaggcgatggaagcgaacacaaagtcagcagggactacaagaaaatagctccgggcagtccttctttgtaagaaacaagaaagttcggcgagcccctctctcggaaggaccacacagcctggggtgttacaaccctatgatggaagatgggattagctacaccacactcagatttccagagatgaacatccctcgcaccggcgatgccgaatcaagtgagatgcaacgacctccaccagactgtgatgacaccgtgacgtacagtgcactccacaagagacaggttggagattatgagaacgtcattcctgactttccggaagacgaaggcattcactattcagagctgatccagtttggggtcggcgagcgtcctcaggcacaggagaacgtagactacgtgatactcaagcattag

SEQ ID NO: 23394 - DNA, 1989 bp, Artificial Sequence
  Description of Artificial Sequence: Synthetic coding sequence
atggagagcaagaccgagaagtggatggagcggatccacctgaacgttagtgagagaccatttccaccgcatatccagttgcctccagagatacaggagtcccaggaggtgacattgacctgtctcctgaacttctcctgttatggttatcctatccagctgcagtggctccttgagggggtccctatgaggcaggccgctgtaacctctaccagtctgacaatcaaaagcgtgtttacccgttccgagctgaagttctctcctcagtggagtcaccacggaaaaattgttacctgccagctccaagacgccgacggaaagtttttatccaatgacactgtccagcttaacgtcaaacatacacctaagctggagattaaagtaacacccagtgatgctattgtgagagaaggtgattcagtgaccatgacatgcgaggttagttcaagcaaccccgagtatacaaccgttagttggttgaaggacggtacctccctgaagaaacagaatacctttactctaaatctccgtgaggttacaaaggaccagtccggtaagtactgttgccaggtctcaaatgacgtgggccctgggagatctgaggaggtgtttttgcaggtgcagtatgcccccgagccatcaacggtccaaatcttgcactcacccgcggttgaaggaagccaggtcgaatttctctgcatgtccctggctaatccgctacccaccaactacacctggtaccacaacggaaaagagatgcagggtagaacggaggaaaaggtgcacatcccgaagatactgccttggcacgccggcacatactcctgtgtggctgagaacatcctgggtactgggcagaggggccctggggccgaacttgacgtccagtatccacctaaaaaagttacaacagtcatccaaaaccccatgccaattagggagggcgataccgtgaccctgagctgtaactacaattccagcaatccgtctgtgacccggtacgaatggaaaccgcacggcgcttgggaagaaccaagtctgggggtgctgaaaatccagaatgtgggatgggacaataccacaattgcatgtgccgcttgcaacagctggtgtagctgggcgtctcccgtggcgctgaacgtgcaatacgcaccgagagatgtgcgagttagaaaaatcaaacccctgtccgagatccatagtggcaactcggtgagtctccagtgtgatttctcttcaagccatccaaaggaggtgcagtttttctgggagaaaaatggaagactgctcggaaaggagtcccagctaaacttcgattctattagtccagaggacgcgggctcttactcgtgctgggtcaacaatagcataggccagaccgccagtaaagcctggaccctcgaagtgctatacgctccgcggcgcctccgggtatcaatgagcccaggagatcaggtgatggaaggcaagagtgccactctgacatgtgagtcggacgccaatccccccgtttcccactacacatggtttgattggaacaaccagtccctcccttaccatagccagaaactgcggctggagcccgtgaaggtgcagcactctggggcatattggtgccaaggcactaacagcgtgggcaaagggcggtctcccttatccactctcacagtgtactattccccggaaaccatagggcgccgggtggccgttgggcttggcagttgcctggccattttgattctggccatttgcggcctcaagctgcaacgaagagatgcggagtcttctgagatgcaaagaccaccccctgactgcgacgataccgtgacgtacagcgcactgcataaacgccaggtaggggattatgagaacgtaatcccggacttcccagaagacgagggcattcactactccgagctgatccagttcggcgtgggggagagaccccaggcccaggaaaacgtggattacgtgatactgaagcattag

SEQ ID NO: 23395 - DNA, 2013 bp, Artificial Sequence
  Description of Artificial Sequence: Synthetic coding sequence
atgcacctgctgggcccctggctgctgctgctggtgctggagtacctggcattttcagactcatccaaatgggtgtttgagcatcctgaaaccctgtacgcctgggagggagcctgtgtgtggattccatgtacgtaccgggccttggacggggacctggagagcttcatcctattccataatcctgagtataacaaaaatacttctaagtttgacggcacacgtctctacgaatcaacaaaggacggcaaagtcccttccgagcagaaaagagttcagtttctaggagataagaacaagaattgtacactgtctatccaccctgtgcatctgaatgactcaggccagcttggtctgcgcatggagtccaagacggagaagtggatggagcggatccatctcaatgtctcagagcggccatttccacctcatattcagctcccccctgaaatccaggaatcgcaggaggtcaccctgacgtgtttgctcaacttctcctgctacggatatccgatccagctacagtggctcctagagggtgtgcccatgaggcaggctgcggtgaccagcactagcttgacaattaagagtgtgtttacacggagtgaactgaaattttccccacagtggagccatcatggcaagatcgttacctgtcaattgcaggatgccgacggcaagttcctgagcaacgacaccgtgcagctcaacgttaagcacccccctaagaaggtcaccactgttattcaaaacccaatgcctattagagagggtgataccgtgacacttagttgcaactataacagctccaacccctctgtgacaaggtatgaatggaagcctcatggcgcctgggaggagcccagccttggcgtcctcaagatccaaaatgtgggatgggataataccaccattgcctgcgccgcctgtaattcctggtgtagctgggccagccctgttgccctcaacgtgcaatatgctccccgggacgtacgggtcaggaagataaaaccgctcagcgagatccattcaggaaactctgtcagcttgcagtgcgacttcagctcttcccaccctaaagaggtgcagttcttttgggagaaaaacgggcggttgctcgggaaagaaagtcaactcaacttcgactctatcagccctgaggacgccgggtcctactcctgttgggtgaataactcaatcggacagaccgcctccaaagcctggaccctggaggtgctgtacgccccaaggaggttgagagtctctatgtctcctggcgatcaggttatggaaggtaaatcagccacactgacctgcgagtccgacgccaaccctcctgtgtctcactacacctggttcgactggaataaccagtcgttaccctaccatagtcagaaactacggctggaacccgtgaaggttcagcactctggcgcttactggtgccagggcacgaacagcgtgggcaaggggagatcccccttgagcaccctcacagtatattacagtcctgaaacaataggccgacgcgtggctgtcggacttgggagttgtctcgcaatcttaatccttgctatttgtggacttaaacttcagagaaggtggaagcgcacacagagccagcagggactgcaggaaaacagcagcggccagtccttttttgtgagaaacaagaaggtccgtcgcgctccactgagcgagggaccccatagtcttggctgctataatcctatgatggaagatgggattagctacacgactctgaggttccccgagatgaacattcccaggacaggagatgccgaaagcagcgagatgcaacggcctcccccagattgtgacgatacagtgacctattctgccctgcacaaacgccaggtgggcgactacgagaacgtgatcccagatttcccggaggacgagggcatacattatagtgagctcatacagttcggcgttggcgagagacctcaggcgcaggaaaatgtcgactacgttatcctcaaacattag

SEQ ID NO: 23396 - DNA, 2028 bp, Artificial Sequence
  Description of Artificial Sequence: Synthetic coding sequence
atgagcctgtggctgctggagggcgtgcccatgcggcaggccgccgttacaagcacatcccttacaatcaagtccgtctttactaggagtgaactcaaattctctccacaatggagccaccatggaaagatagtgacatgccagttacaagacgccgatggaaagtttctaagcaacgacaccgtccagctgaatgtaaaacacactcccaaactcgagatcaaagtcacaccatccgacgctatagtgagagagggggactcagtgactatgacttgcgaagtttcaagctctaacccagaatacaccactgtctcttggctcaaagacgggacaagtctgaaaaaacagaacactttcactctgaatctcagggaagttaccaaggatcagtctggcaaatactgttgtcaggtgagcaatgacgtaggcccaggccgatctgaagaagtgttcctccaggttcagtacgccccagagcccagcacagtgcagatcctgcacagtccggcagtcgagggtagccaagtcgagttcctctgcatgtctctggctaatcctctgcccaccaattacacctggtaccataatggcaaggaaatgcagggccgaactgaggagaaagtccatattcctaaaatcctaccctggcacgccggaacctacagttgtgtcgctgaaaacatcttagggacaggacagagggggccaggcgccgagctggatgtacagtatccacctaaaaaggtgacaacggtgatacaaaaccctatgcccatcagggagggcgacactgtgactctgtcatgtaactacaatagctcgaacccttctgtaaccagatacgaatggaagccacatggagcttgggaagagccaagcctcggagtgctcaaaattcaaaacgtcgggtgggacaataccaccatcgcctgtgcagcttgtaactcctggtgtagctgggcaagccccgtggccctgaacgtgcagtacgccccgcgcgacgtgagagtcagaaagattaagcctcttagcgagattcattcagggaactccgtgtccctccagtgcgatttctcttcttcacaccccaaagaggttcagttcttttgggaaaagaacggcagactgctcggcaaagagagccagctaaacttcgactctatcagcccagaggacgcaggttcatattcctgttgggtcaataattcaatcggccaaactgcctccaaggcctggaccctggaagtgctttacgcaccaagacggctcagggtatcaatgtccccaggggaccaggtaatggagggcaagtctgcaaccctcacttgtgaaagcgatgccaaccctccagtcagccactatacttggttcgactggaataatcagagcttgccatatcactcacagaaactgcgtctagaacctgtcaaggttcagcatagtggggcatattggtgccagggcaccaacagcgtagggaagggcagatcacctttgtccacgctcacagtatattactctcctgagaccatcgggcggagggtcgctgtcggcctgggttcctgcctagcaatactcattttagcaatttgcggactaaagctgcagagaaggtggaaacggacacagtcccagcaggggttacaagaaaattcttcagggcagagctttttcgtaagaaacaaaaaagtccgccgagcgcctttatccgaggggccccattcactggggtgttacaaccctatgatggaggacgggatatcatacaccactttaaggtttcccgaaatgaatattcctagaaccggcgacgccgagtcaagcgagatgcagcgccctccgccggactgcgatgacacagtcacttacagcgccctgcacaagagacaggtgggcgactatgagaacgtaatccctgacttccctgaagacgagggtatccactattccgagctgatacaatttggagtgggcgagagaccccaggcacaggaaaacgttgactacgtgattttaaaacactag

SEQ ID NO: 23397 - DNA, 2280 bp, Artificial Sequence
  Description of Artificial Sequence: Synthetic coding sequence
atgcacctgctgggcccctggctgctgctgctggtgctggagtacttggcgtttagcgacagctctaagtgggtgttcgagcaccctgagaccctctacgcatgggaaggggcctgtgtgtggatcccatgcacctaccgggctttggatggggacctggaatcttttatcctgttccacaatcctgagtacaataaaaatacgagcaaatttgacggtactcggttgtacgagtcaacaaaggacggaaaagtcccatccgagcaaaagcgggttcagttcctgggagacaagaacaaaaattgtaccctgtccatccaccctgttcatctgaatgactccggacagctggggctgcgcatggagagcaaaaccgagaaatggatggaacgaatccaccttaatgtgtctgagcgcccctttcccccacacatccagctgccaccagagatccaggagtcccaagaggtcacactgacttgtcttctcaatttttcctgttacgggtatccaatacagttgcaatggctgttggagggggtcccgatgagacaggccgccgtgacaagtacgagcttgactattaagtctgtgtttacaagatctgagctgaagttctctccacaatggtcacatcacggaaagatagtgacctgccaactgcaggatgccgatggtaagtttctgtctaacgatactgtccagcttaatgtcaaacacacaccgaagcttgaaataaaggtcaccccttccgatgcgatcgtgagggaaggggactccgtgacaatgacgtgtgaggtatcatcctccaaccctgagtataccaccgtgtcctggttgaaagacgggacatcactgaagaagcagaataccttcaccctcaatttgcgggaggtgactaaggaccagagcggcaagtattgctgtcaggtcagcaacgacgtgggcccagggaggagcgaggaggtgttcctgcaggttcaatatccccctaaaaaggtgacaacggtcatccagaacccgatgccaatccgagaaggagacactgtcacactttcttgtaattacaacagttccaatccatcagtaacacgctatgagtggaagccgcacggagcctgggaagagcctagtctaggggtacttaagatacagaacgtggggtgggacaacaccacaattgcctgtgccgcctgcaatagctggtgcagctgggctagtcctgtcgcactgaacgttcagtacgccccaagagacgtccgggtgagaaaaatcaagcccctgtccgaaattcatagcggaaatagcgtgtccctccagtgcgattttagcagcagccatcccaaggaggtgcaatttttctgggagaagaacggacgccttctggggaaagaatctcagttaaattttgattccataagcccagaagatgcaggctcttactcttgttgggtgaacaattccatcgggcagactgcgagcaaagcgtggaccttggaggtgctgtatgcaccgcgccgactgagggtgagcatgtctcctggagaccaggtgatggaaggtaaatcggctaccctgacgtgcgagagcgatgccaatccacctgtcagccactacacatggttcgactggaataatcagagtctgccttaccacagccaaaaactgcgcctggagccagtgaaagttcagcactctggagcatattggtgccagggaacaaatagtgtggggaagggccggtctcctctgagcaccctaacagtctactactccccggaaacaattggccggcgcgttgctgttggcctggggtcatgtcttgctatacttatactagccatttgtggcctcaagctccagcggcggtggaaacgcacacagagccaacaagggttacaggagaactccagtggccagtcctttttcgtaagaaacaagaaagtacgtagggctcccttgtccgagggacctcacagcctaggatgctacaatcctatgatggaagatggaatctcatatacaacactaaggttcccggagatgaacatcccaaggacgggagatgcagagtcctcagagatgcagagacctccccccgactgtgatgacactgtgacctatagcgctctgcacaaaagacaagtgggagactacgaaaacgtgatcccagatttcccagaggacgagggtatccactatagtgagttgatccagtttggcgtcggagaacggccccaggcacaggaaaatgtcgactatgtcatactcaaacactag

SEQ ID NO: 23398 - DNA, 2256 bp, Artificial Sequence
  Description of Artificial Sequence: Synthetic coding sequence
atgcacctgctgggcccctggctgctgctgctggtgctggagtacctggcattcagtgattctagtaaatgggtcttcgagcatcctgagaccctgtatgcttgggagggcgcatgcgtgtggatcccctgcacttatagggctctcgacggtgatttagaaagttttatcttatttcacaatcccgaatataacaaaaacacatccaagttcgatggaacccggttatatgagagcaccaaagacggcaaagtgccatccgaacaaaagcgagtgcagttcctgggcgacaaaaacaaaaactgcaccttgtcaattcatcctgtgcatctaaacgactctgggcagctgggcctgaggatggagtcaaaaacagaaaagtggatggaaaggatccatctgaacgtctcagagcggcctttcccaccccacattcagctaccccccgagattcaggagtcccaggaggtcacgctgacatgcctgctaaatttttcgtgttatgggtatcctattcaactgcagtggcttctcgagggagtacctatgcggcaggccgcagtcacttctacatcactgacaataaaatctgtcttcacaagatctgagttgaagttctctcctcagtggtctcatcacgggaaaattgtcacatgccagctgcaagatgcagatggaaaattcctgtcaaacgatacagtccagctgaatgtgaaacacacccctaaactggaaatcaaggttacccctagtgatgccattgttcgtgaaggtgactcagtcacaatgacttgtgaggtttcctcttctaaccccgagtacacaaccgtttcttggctgaaggacggtacttcattaaagaagcagaacacctttactctaaatctcagggaggttactaaggatcagtccggcaagtactgctgtcaggtgtctaacgacgtgggtcctgggagatccgaggaagtattccttcaagtccagtatgcccctgaaccttcaaccgttcaaattttgcattctcctgcagtcgagggcagccaggtggagttcttatgtatgagcctcgccaatccattgcctactaactatacttggtatcataacgggaaagaaatgcagggccgtactgaagagaaagttcatattcctaaaatcctaccctggcacgctggtacgtacagctgcgtggctgagaacatcctgggtaccggacagcgcgggccgggggctgagttggacgtacagtacccacccaaaaaagttacaaccgtgattcaaaaccccatgcctatccgcgagggcgatactgtcaccctttcatgcaactataactctagtaacccttctgtcacgagatatgagtggaagccgcacggagcatgggaagaaccctctctgggggtgttaaagattcaaaacgttggttgggacaacaccactatcgcatgtgccgcttgcaattcctggtgctcatgggctagtcccgtcgcactcaacgtacagtacgccccaagggacgtgcgcgtgaggaagattaagcctctttccgagatccacagcgggaacagtgtgtccttgcagtgtgatttctccagcagtcaccccaaagaggtgcaattcttctgggagaaaaacggcaggctgctgggaaaggaatcccaactcaacttcgactctattagtccggaagacgccggctcctactcttgctgggttaacaatagcattggccagaccgcctcaaaggcatggactctggaagtcctttacgcgcctcggcgcctgcgagtctctatgtccccaggtgaccaggtgatggaggggaagtcagctacactcacgtgcgagagcgatgccaacccccccgtatcccattacacctggtttgactggaacaaccagagccttccctaccactcccagaaactccgactggagccagtcaaagttcagcactccggggcgtactggtgccaggggaccaattcagtcggcaagggacgcagtccccttagtactctcacagtatactattctccagagaccattggcaggcgtgttgctgtgggcttgggcagctgtttggccattcttattctagctatctgcggtttaaaattacagcgcagatggaaacgaacgcagtcccaacagggactgcaggaaaactcgagtgggcagtctttctttgttcggaataaaaaacgttgtcgggtgctgcgcgacgcggagacctcaccaggattgagatag

SEQ ID NO: 23399 - DNA, 783 bp, Artificial Sequence
  Description of Artificial Sequence: Synthetic coding sequence
atggcccggccccacccctggtggctgtgcgtgctgggcaccctggtagggttgtctgctactccggcacctaagtcatgtccagagcggcattactgggcccaaggcaagctgtgctgtcagatgtgcgagcccgggactttcctggtcaaggattgtgatcaacatagaaaggcagcccaatgcgacccctgtattccgggagtgtcctttagccccgaccaccacactagaccccattgtgaatcttgcagacattgcaactccggtctgctcgtgagaaattgtaccatcaccgccaatgctgagtgtgcctgtagaaacggatggcaatgccgcgataaagaatgcaccgagtgcgacccactgcctaatccgtcactgaccgccaggtcctcacaagcactctctccccatcctcagcctacccacttgccatacgtgtctgagatgcttgaagcccgaacagcagggcatatgcaaaccctggccgacttcagacaacttcccgcccggaccctttcaacccactggcctccgcagagatcattgtgttccagcgatttcatccggatacttgtcattttttctggcatgtttctagtttttactcttgcgggggccctgttcctccaccaacgccggaagtataggtctaacaagggagaaagtcccgtggagccggccgaaccctgccactattcttgtccccgggaggaagaaggctcgaccatccctattcaggaagattataggaaaccagaacccgcatgcagcccttag

SEQ ID NO: 23400 - DNA, 1158 bp, Artificial Sequence
  Description of Artificial Sequence: Synthetic coding sequence
atgctggtgcggcggggcgcccgggccggcccccggatgccccggggatggacggcattgtgtctgctttccttattgccttccggctttatgtccctcgataacaacgggacagccaccccagagttaccaacacaggggacattctctaacgtgtccactaacgtatcttaccaggagactactactccaagtacgctggggagcactagccttcaccctgtaagtcagcatgggaatgaagctaccacaaacatcaccgaaactaccgtgaagttcacttcgacatcagtgattacatccgtgtatggcaacactaacagtagcgtgcagtcacagacgtccgtgatctccactgtgttcacgacacccgccaacgtgagtactccagagacaaccctgaagccttcgctttctcctgggaatgtgtctgatctgtccaccacgtccacgtctctcgctaccagccctactaaaccctatacctcatcaagtcctatattgagtgatataaaagccgaaatcaaatgctctggcatccgcgaagtcaaactgacacaagggatctgtttggaacaaaataagacatcctcgtgtgccgaatttaagaaggaccggggcgaggggttggcgcgcgtgctgtgcggagaagagcaggcagatgctgatgccggcgctcaggtctgttccctgctcctggcccagagcgaggtgaggccccagtgcctactccttgtgctggccaacagaaccgagattagcagtaaacttcagcttatgaaaaagcaccagagcgatctcaaaaagctggggatcttagactttactgagcaagacgtggcttcacaccaatcttacagccaaaaaactctgatcgcactggttacaagtggagcactgctggctgtgctgggtatcactggctactttctcatgaacagaaggagctggagtccgacaggagagcgcctgggtgaagacccctattacacggaaaatggaggcggacagggttattcatccgggccgggcacttcccctgaggctcagggcaaggcctccgttaaccgcggtgcgcaggagaacggaacaggccaagccacttcccgtaatggccactctgctagacagcacgtcgtcgctgacacagagctttag

SEQ ID NO: 23401 - DNA, 987 bp, Artificial Sequence
  Description of Artificial Sequence: Synthetic coding sequence
atgctggtgcggcggggcgcccgggccggcccccggatgccccggggatggacagccttatgcctgctgtccttgcttccttcagggttcatgtcccttgataataacggcactgctactcccgaactgcctacccagggcacattctcaaacgtcagcaccaatgtaagttatcaggagaccactactccatctacactaggcagcacctctctccaccctgtgtcacaacacggcaacgaggctaccactaatatcaccgagactaccgttaaattcaccagtacctcagtgatcacgtccgtttatggtaacacaaacagctcagtacagagccagacaagcgttatcagtaccgtgtttaccacacctgcaaacgtgtccacgccagaaacgaccttaaaaccttccctatcacccgggaatgtgtcagatcttagtactaccagtacaagcctggccaccagtccaactaaaccctacacttccagctccccaattctgtccgatatcaaagccgaaattaagtgctccgggatccgggaagtgaagcttacccaggggatctgtcttgagcagaacaagacatctagttgcgcagaattcaagaaggatcgcggtgagggtttggcaagagtcctctgcggcgaggaacaggcagacgccgatgccggagcacaggtatgctctctgctcctggcccagtcagaagtgcggccccagtgccttcttttggtgcttgcaaaccgcaccgagatttcttctaaacttcagcttatgaagaagcaccaatccgacctcaaaaagctaggcattctcgattttaccgaacaggatgtcgcaagccaccagtcctattcgcaaaaaacactgattgccctggttacatccggcgcccttctggccgtacttggcatcaccgggtactttttgatgaaccggcgctcctggagccctaccggcgaacgactggagcttgagccctag

SEQ ID NO: 23402 - DNA, 684 bp, Artificial Sequence
  Description of Artificial Sequence: Synthetic coding sequence
atggacttcggccccggccggctgttccggttcttcagctactgcgttgtggcccatatccagctggccgtcttcttcttttccgtggggatcctcgaaaccagaattctccttgctgatggggcagaatttaaaaaggacagaggagaggggctcgcacgggtgctgtgcggcgaggaacaggccgacgccgacgccggggcccaagtgtgcagcctcctgctggcgcagtcggaagtgagacctcagtgtcttctcctagtcctcgccaatagaacggagatctcaagcaaacttcagctgatgaagaaacaccagagtgaccttaaaaagctgggcatcctggatttcacagagcaagatgtggccagccaccagagctattcgcaaaaaaccttaatcgccctggtcaccagtggcgcgctgctggcggtcctcggtataaccggatactttctgatgaaccgtaggtcatggtctcctacaggagagcgcttaggagaagatccatactatacagagaacggaggcggacagggatattcaagtggacctggcacaagcccagaagcacagggcaaagcatccgtgaatagaggcgcccaggaaaatgggactggccaggcaaccagccggaatgggcacagcgcacggcagcacgtggttgccgatactgagctgtag

SEQ ID NO: 23403 - DNA, 1068 bp, Artificial Sequence
  Description of Artificial Sequence: Synthetic coding sequence
atgagcctggacaacaacggcaccgccacccccgagctgcccacccagggtaccttctctaatgtatctacgaatgtctcttaccaggaaactactactcccagcacgctcggaagcactagcctgcatcccgtgagtcaacacggcaacgaggccaccacaaatatcactgagacaacagtgaaattcacttcaaccagtgtcatcacatccgtctatgggaataccaactcctcagttcaaagccagacgtccgtaatctcaactgtgttcacaacgcctgctaacgtaagtacaccagagactaccttgaaaccttctttgagcccaggaaacgtctctgatctgtcaactacatcaacctccctcgctacttctcctacaaaaccctatacctcttccagtccaatcttaagtgatatcaaggccgaaatcaagtgctcagggattcgcgaggtgaagttgactcagggaatttgtctggaacagaacaaaaccagttcctgcgcagagttcaaaaaagacagaggtgaaggtctggccagagtcctctgcggcgaagaacaggcagatgccgacgcaggggctcaggtctgcagtctcctactcgcgcagtccgaggtgcggccccagtgcctactcctagttctggccaaccgcactgagatatcctccaagctgcagcttatgaaaaagcaccagagtgacctcaaaaaactggggattcttgattttaccgagcaggacgtagcctcccatcagagctattcacaaaagacactgattgcgctggtcaccagtggtgctttactcgccgttttgggcattacgggttacttcctgatgaaccgtagatcgtggagccctacaggggaaaggctcggcgaggacccttactatacagagaacggaggaggtcagggctacagttctggccctgggactagccccgaggcgcaggggaaagctagcgtaaaccgcggcgcacaggaaaatgggacagggcaagcgacatcacgaaatgggcattccgcccggcagcacgtggtcgcggacacagaactctag

SEQ ID NO: 23404 - DNA, 753 bp, Artificial Sequence
  Description of Artificial Sequence: Synthetic coding sequence
atgttcctgcagatgtaccccaccaagaagctgcagcacctggtgcctttagaggtgccggcctgtacactgtgcttgaacatggcaatgcggcctcagcagacctcacaggctgaaattaagtgcagcggcattagggaggttaaactaacccagggtatctgcctcgaacagaacaaaacgtcaagttgtgctgagttcaagaaggaccgaggggaaggtctggcccgggtgctgtgcggagaggaacaggctgatgctgacgccggtgctcaggtttgttcactactgctcgcccagtccgaggtaagaccccagtgcttgctgttggtgctcgcaaatcgcaccgagatatcctcgaaactgcagttgatgaaaaaacatcagtcggacctcaaaaagctcgggattctggattttacggagcaggacgtggctagccatcagagctatagccaaaagacactgattgctctcgtgacatccggcgccctgttagctgttctgggaatcactggctattttttaatgaatcggcgatcctggtccccaactggcgaacgcctcggtgaagacccgtattatactgagaacggaggaggtcaagggtactcaagtggtcctggcacctcacctgaagcacagggcaaggcttctgttaatcgcggcgcacaggaaaacggaaccggacaggcgacgtcacgtaacggacacagcgcaagacagcatgtggtggcggatacagagctttag

SEQ ID NO: 23405 - DNA, 516 bp, Artificial Sequence
  Description of Artificial Sequence: Synthetic coding sequence
atggagcacagcaccttcctgagcggcctggtgctggccaccctgctctcccaagtgagccctttcaagatacccatagaggagctggaggatagagtgttcgtgaattgtaatacctcaattacttgggtggagggcactgtgggcacattgctgagtgatatcactcgcctcgatctgggcaagcggatcctagacccccggggaatctacagatgtaatgggacggacatctataaagataaagaatctacagttcaggtccattaccgcatgtgtcaaagctgcgtcgagttggatcccgctacagtggctgggattatcgtgactgatgtgatcgcaacactcctgctggcccttggtgtcttttgttttgcgggacacgaaacaggccgcctgtccggagcagccgatactcaggcgttgttaagaaatgatcaagtctatcagcccctgcgagaccgggacgacgctcagtacagccatctgggcggtaattgggcgaggaataagtag

SEQ ID NO: 23406 - DNA, 384 bp, Artificial Sequence
  Description of Artificial Sequence: Synthetic coding sequence
atggagcacagcaccttcctgagcggcctggtgctggccaccctgctgtcccaagtgtctccgttcaaaattcccattgaggagctggaagatcgggtcttcgtgaattgcaatacgagtattacttgggttgaggggaccgtgggcaccctactgtcagacataacaagactggacctgggcaaaaggatcctggacccacgaggaatttatcggtgtaatggcacagatatctacaaagacaaggaatccaccgtccaagtgcattataggaccgcggacacccaggctctcctgcggaatgatcaggtttaccagccactgagggacagagacgatgcgcagtactcacatctgggaggtaactgggctagaaataagtag

SEQ ID NO: 23407 - DNA, 1377 bp, Artificial Sequence
  Description of Artificial Sequence: Synthetic coding sequence
atgaaccggggcgtgcccttccggcacctgctgctggtgctgcagttggccctgctgcctgcggcaactcagggaaagaaggtcgttctcggcaagaagggcgacacggtggagctgacctgcacggcttcacagaaaaagtcaatccagtttcactggaaaaattctaaccagattaagattctcggcaaccagggctcctttttaactaaggggccctcaaagttaaacgacagggctgacagtaggcgctccttgtgggaccaagggaacttccctctcattatcaagaacttgaagatcgaagatagcgatacatacatttgtgaagtcgaggaccagaaggaagaggttcaattgcttgtgtttggactgactgccaattctgacacacatctcctccagggtcagagtctgactctaacccttgagtctcctcccggaagcagcccctctgttcagtgccggtcgccccgcggaaagaacatacaagggggcaagaccctcagcgtcagccagctggagctgcaggactctgggacatggacctgtaccgtgctccagaaccagaaaaaagtggaattcaagattgatatcgtcgttcttgcttttcagaaggcctccagcatagtttacaaaaaagagggagagcaggtggagtttagtttccctctggctttcacagtagagaagttaaccggcagcggcgaattgtggtggcaggccgaacgtgctagctccagcaaaagctggatcacctttgatttgaagaacaaggaggtgagcgtgaagagggtcactcaagatcctaagcttcagatgggaaagaaactgccgctgcacctaaccctgccccaggcactgccccaatatgcaggttccggaaacctgaccttagcgttagaggccaagactggcaagctgcaccaggaggtcaaccttgtcgtcatgcgggcaactcagctccagaaaaatctgacttgcgaggtgtggggaccaacgagcccaaaactgatgctctcgctcaaactggagaataaagaggcaaaggtgtctaagcgggaaaaagctgtctgggttctgaatcctgaggctggtatgtggcagtgcctattgtcagactctggccaggttctgctggaaagcaatatcaaggtattgcccacttggtccacccccgtgcagccaatggccttgatcgtactgggaggtgttgcaggactgttactattcatcgggctagggattttcttctgtgtacgctgtcggcaccgccgaagacaggccgaacgcatgagccagattaagcggctgcttagcgagaaaaagacctgtcagtgcccgcacaggttccagaagacgtgtagtccgatctag

SEQ ID NO: 23408 - DNA, 723 bp, Artificial Sequence
  Description of Artificial Sequence: Synthetic coding sequence
atgatcgagacctacaaccagaccagcccccggagcgccgccaccggtttgccaatctctatgaaaatcttcatgtacctcttgacagtctttctcatcactcaaatgattggatccgcgctgtttgcagtgtatttgcatcgccgtctcgacaagatagaggacgaaagaaacctgcatgaagatttcgtcttcatgaaaactatccagcgctgcaacaccggagagcggtccctctcacttctgaactgcgaggaaatcaaaagtcagtttgaagggtttgtgaaggatatcatgttgaacaaagaagagacaaagaaggagaatagttttgagatgcaaaaagttcttcaatgggctgaaaagggctattatactatgagtaacaacctcgtcactctcgagaatggcaaacagctgacggttaaacgtcaaggactctactacatttatgcgcaggtcactttctgctccaatcgcgaagcgtcgtcacaggccccttttatcgctagcctgtgtctgaagtccccggggcgttttgagagaattctactgcgcgccgcaaacactcactctagcgccaaaccttgcggacagcagtcaatccacttagggggcgtgttcgaattgcaaccaggtgcaagtgtttttgtgaacgtgacagacccgtcacaggtgtcccatgggaccggattcacgtcctttgggctgctgaagctgtag

SEQ ID NO: 23409 - DNA, 786 bp, Artificial Sequence
  Description of Artificial Sequence: Synthetic coding sequence
atgatcgagacctacaaccagaccagcccccggagcgccgccaccggtttgcctatctctatgaagatcttcatgtaccttctcactgtttttctgattacccagatgatcggttctgccctgttcgcagtgtacttgcaccgtcgtctggataaaatcgaagacgagcggaatctccatgaggatttcgtgtttatgaagacaatacagcgctgcaacaccggcgaaagaagtctcagcttgctcaactgcgaagagatcaaaagccagtttgaggggttcgtgaaagacatcatgctcaataaggaggagacaaaaaaggagaactcattcgaaatgcaaaagggagatcagaacccacagatcgcggcacatgtgatttctgaagcctccagtaagactacctcagtgttgcagtgggccgagaaaggatactatacaatgagcaacaatctggtcaccctggagaacggaaaacaattgacagttaagagacagggcctgtactacatttatgcccaggtgacgttctgctccaatcgtgaagctagcagccaggccccgtttatcgcttctctatgcctgaaaagtcctggaaggtttgagcgaattctgctcagagcagcgaatacccacagcagtgccaaaccctgtgggcagcagtctattcaccttggcggcgtgttcgagctgcagccgggcgcatccgtgttcgtgaatgtaacagacccgagtcaagtgagtcacggcaccggttttaccagttttgggcttttgaaattgtag

SEQ ID NO: 23410 - DNA, 612 bp, Artificial Sequence
  Description of Artificial Sequence: Synthetic coding sequence
atggtgcggctgcccctgcagtgcgtgctgtggggctgcctgctgacagccgtgcacccagagcccccaaccgcctgtagagagaagcaatatttaatcaacagccagtgttgttcattgtgtcaacctggacagaagctggtgtcggactgcaccgaattcacagagacagagtgcttgccttgcggcgagtctgaattcctggatacttggaaccgggagactcactgccaccaacacaagtactgcgaccccaacttgggactgagagttcagcagaaagggacctctgagacggacactatctgcacatgcgaggagggctggcactgtacttccgaggcgtgcgaatcctgcgtcctgcaccgcagctgtagtccaggattcggtgtgaaacagattgccacaggggtcagcgacacgatctgtgagccatgccccgtcggatttttttcgaacgtatcatcagcttttgaaaagtgccatccctggactagaagccctggaagcgccgaatctcccggcggagacccgcaccacctcagggatccagtatgccatccccttggcgccgggctatatcagaagggaggccaggaagcgaaccagtag

SEQ ID NO: 23411 - DNA, 786 bp, Artificial Sequence
  Description of Artificial Sequence: Synthetic coding sequence
ggccggagccccctgcggacccgggaccgggtgctgaccaactgggaagacgggcttactgtcgcttatggcgccgtgaagctcattcagtctctgtcactgcaacctgttggctggcaacaaaattggggcctctcttcgcccccaaccatgcttctcccaagcagggctcagtcccccacagaattaccccttgcccctcttgcagaacctaacacaggctgctcttccctcctgagctggcactccaccaggggggaacttcacctgtgggcgttggggttgggccagatgggcggtagcaaatgcgggtctccgctctctcctctggcacctactttggaagcactcagacggccgtggtgtggccagcagggagcaggcggcacacgaggtatctctacagaccccccaagcggaaaaggggggcgcgcgtggggccgcgaccccctccctagggaaggcttattgagaggtaccgcggcccccgcggctggcggggaccttactccctgcctgtctagaccgccaacaccttccaggaatccaaggcggtccatcttccctaccatcttcctggcccctacattactgttgcaatgtcggagattatatatggatgccaatagaagcccgaggcgtatggccaaaagagtggcaagccagtgccgcagagatagcgaggcagcccctacccaggaatgtggccacgtcgggaagcaggccgtagggcagcgcgcctggtgctgttgctgctgcggagttcgtgtgaggggatggcattag

SEQ ID NO: 23412 - DNA, 834 bp, Artificial Sequence
  Description of Artificial Sequence: Synthetic coding sequence
atggtgcggctgcccctgcagtgcgtgctgtggggctgcctgctgacggccgtgcatcctgagccccctacagcatgtcgcgagaagcagtatctcatcaattcacagtgctgctccctgtgccagcccggccagaagcttgtgtccgattgtacggaattcaccgagaccgaatgtcttccctgtggtgagagcgagttcttagacacatggaatcgggagacccactgccatcagcataaatactgtgacccaaatctgggtcttcgcgtgcaacagaaaggcacgtcagagaccgataccatctgcacatgtgaggaaggttggcattgcacttccgaggcatgcgaatcgtgtgtcctgcatcgatcttgtagtccaggattcggggtaaagcagatcgctacaggagtttcagacaccatttgcgaaccctgccccgtgggatttttctcgaacgtctcctcagctttcgagaagtgccatccctggacttcttgcgaaacgaaagatctggttgttcaacaggccggcaccaataagaccgacgtcgtctgtggacctcaggataggctgcgggctcttgtcgtgatccccattatcttcggaatactcttcgccatcctgctggtgttagttttcatcaagaaagtagctaaaaagcctacaaacaaagccccccatcccaaacaggaaccacaggagatcaattttcctgatgatctgccaggatccaatacagccgcacctgtccaggaaacgctgcacggttgccagcctgtcacccaagaggatggcaaggagtctaggataagtgttcaagagagacaatag

SEQ ID NO: 23413 - DNA, 1086 bp, Artificial Sequence
  Description of Artificial Sequence: Synthetic coding sequence
atggacaagttctggtggcacgccgcctggggcctgtgcctggtgccactcagcctggctcagatcgatttgaatattacatgtagatttgccggagtcttccacgtcgaaaaaaacggacgatattctataagcagaaccgaggcggcagacttgtgtaaagcttttaattctaccttgcctaccatggcccaaatggagaaggccctttcaatcgggtttgagacctgcaggtacgggttcatagagggacatgttgtaatcccaagaatacaccccaattccatttgtgctgcgaacaatacgggcgtgtacatcttgacctctaacacttcccagtatgacacttactgcttcaacgcttctgcgccacccgaggaggactgcacttcagtcacagatctgcccaatgctttcgatgggcccattaccattacaatagtgaacagggacggaactaggtacgtgcagaagggcgaataccgaacaaacccagaagacatatatccttcaaaccccactgacgacgacgtgtccagtggttccagctctgaacgtagtagcacaagtggtggatacattttctacaccttttcaaccgtgcatccgatccctgatgaagattcaccctggattactgattccacggaccggatccctgccacccgggaccaggacacgtttcaccccagcggaggcagccacactacccatggctccgaatcggacggacatagccatggcagtcaggagggaggagctaatactacatctggcccaatcagaaccccccagattccagaatggctgatcattctggcgtcactactagcactggccctgatcctagctgtctgtatagccgtgaactcacgcagaagatgtggacagaaaaaaaagctcgtgattaactccggaaacggtgcagtcgaggaccggaagccaagcggactgaacggcgaggcctctaagtcccaggaaatggtgcacctcgtgaacaaggagagctctgaaacccccgatcagtttatgacagccgacgaaacccggaatcttcaaaatgtggatatgaagatcggtgtttag

SEQ ID NO: 23414 - DNA, 420 bp, Artificial Sequence
  Description of Artificial Sequence: Synthetic coding sequence
atggacaagttctggtggcacgccgcctggggcctgtgcctggtgcccctttctctcgcccagatcgacctcaatattacctgcaggttcgcaggagtgttccacgtcgagaagaacggccgatatagtatctctagaacagaggcagctgatctgtgtaaagcctttaattcaactttgccaacgatggctcagatggaaaaggccttgtctatcggcttcgagacgtgcagcctgcactgtagccaacagtcaaaaaaagtgtgggcagaggagaaagcttctgaccagcagtggcaatggtcatgcggaggccagaaggctaagtggacacagaggagaggacaacaggtatccggtaatggcgccttcggggagcaaggcgtcgtgaggaactctcggcctgtgtacgactcatag

SEQ ID NO: 23415 - DNA, 1023 bp, Artificial Sequence
  Description of Artificial Sequence: Synthetic coding sequence
atggacaagttctggtggcacgccgcctggggcctgtgcctggtgcctctgagtttggctcaaattgacctgaatataacctgccggtttgctggagtttttcatgttgagaagaacgggcgctacagtatatcccgcactgaggctgccgatctctgtaaagccttcaattcaactctccccacaatggcccagatggagaaggctttgagcatcgggttcgaaacgtgtcgctatggatttattgagggccatgtggtgatccctcggattcaccccaactcaatctgtgccgccaataacacaggggtttacatactgaccagcaacacttcacagtatgatacctactgcttcaacgcgagtgcgcctcctgaagaagactgcacttctgttacagacctgcccaacgcattcgatggcccaattacaattaccatagtgaacagggacgggacgcgatatgtccagaagggtgagtacagaaccaatcccgaggacatctatcctagtaatccaaccgatgacgacgtctcgtctggttcatcctccgagcgctcttctacctctggcggctacattttttataccttcagcactgtgcacccaatcccagacgaagactccccctggattaccgactcaactgaccgaattcctgcgactcgacatagccatggatctcaggaaggcggtgcaaacaccaccagcggcccaatcaggacaccgcagatccccgaatggttaatcatcttggctagcctactggcactcgctctcatcctagctgtatgtattgccgtgaactcccgtcgccgctgcggccagaagaaaaagttggtgattaatagcggcaacggcgccgtggaggacagaaaaccatcaggactaaacggggaggccagcaaaagtcaagagatggtccaccttgtgaataaagagtctagcgaaacccccgaccagttcatgaccgctgacgagacaagaaatctccagaacgtggatatgaagatcggcgtctag

SEQ ID NO: 23416 - DNA, 1191 bp, Artificial Sequence
  Description of Artificial Sequence: Synthetic coding sequence
atggacaagttctggtggcacgccgcctggggcctgtgcctggtgccgctgtctcttgcgcaaatagacctcaacattacctgccggtttgcaggcgttttccacgtggagaaaaacggccggtatagtatttcaaggacggaagccgccgacctgtgcaaagctttcaattcaacattgccgaccatggctcaaatggagaaggcactcagcattggatttgagacttgtaggtatggcttcatcgaaggccacgttgtaatccccaggatccaccctaactcaatctgcgccgctaacaatacgggcgtctacatcttgacaagcaacacatcgcaatacgatacttattgttttaatgcatccgctccacccgaggaggattgtacatcagtcactgacctccccaatgcgttcgacgggcccataaccattactatagtcaatcgggatggcacccgatacgtccaaaagggggagtatcgcaccaatcctgaggatatctaccctagtaacccgaccgatgatgacgtgtcaagcgggagctctagcgaacggtcatccacgagcggaggatatatcttctatacctttagtacggtgcaccccatacccgatgaagattccccctggattactgactccacagacagaatccctgccaccaatatggacagcagccactccatcaccctgcagcctaccgctaaccctaatacaggtctggtggaggatctggaccgaaccggccccctgtctatgactacccggcgggaccaagatacatttcacccctctgggggctcgcacaccacacacggatctgaatccgatggccactcccacggcagccaggagggcggggccaatacaactagtggccccattaggaccccccagattccagaatggctgataatcctagcctctcttttggcattggccctgattctcgctgtgtgcattgccgtgaattccaggcgcaggtgtggccaaaagaaaaaactcgtcatcaactccggtaacggggccgttgaggatagaaaaccctccggcctgaacggcgaggcttccaagtcccaggagatggtccatctggtcaataaggagtcatcagagacaccagatcagtttatgactgccgatgagacaagaaacctacagaatgtggatatgaaaatcggagtctag

SEQ ID NO: 23417 - DNA, 2100 bp, Artificial Sequence
  Description of Artificial Sequence: Synthetic coding sequence
atggacaagttctggtggcacgccgcctggggcctgtgcctggtgccactctcattggcccagattgatttaaatattacctgcaggtttgcaggtgttttccatgtggagaagaatggtcgctattccatttcacgaacagaagcagcggacctgtgtaaggcttttaactccacactgccaaccatggcccagatggagaaggccctaagcataggatttgaaacctgtcgatacggcttcatcgagggccacgtggtgatcccccgcatccatccgaacagtatctgcgccgcgaataatactggcgtatacattctcacctcgaacacgtcccagtacgacacttactgttttaacgcttccgccccccctgaagaagactgcacctcagtgacagaccttcccaacgctttcgatggaccaattacaattacgatagtgaatcgggacggaactagatatgtgcaaaagggagaatatagaaccaaccctgaggatatctatcccagcaatcccactgacgatgacgtttccagcggatcctcgtctgagaggtcgagtacatctgggggctacattttttacactttttctacagtgcaccccatacccgacgaggactccccttggataactgattccacagaccggatcccggctacttctacctctagtaacaccatttcggctgggtgggagcctaacgaagaaaatgaagatgaaagagacaggcatctgagtttttctggatccggaatagacgacgatgaagactttatatctagcactattagtaccaccccacgcgctttcgatcacacaaagcagaatcaggattggacccaatggaacccgagccactcaaaccctgaggtgctgctccagaccactacacggatgaccgacgtagaccgcaacggcaccacagcatacgagggtaattggaaccctgaggcccaccctccactgattcaccatgagcaccacgaagaggaagagactcctcattcgacctctactatccaggccaccccatcgtctactaccgaagaaactgcaacgcagaaggagcagtggttcggaaatcgttggcacgagggctacagacagacaccgaaggaagactcccacagtaccactggcacagcggcagcctctgcccatacttctcaccccatgcagggaaggaccacaccttctccagaggactcaagttggactgactttttcaatccgatcagccatcccatgggtcggggacaccaagccggtcgtagaatggatatggatagcagtcattccattacattgcagccaaccgctaatcccaacacagggttggtggaggatctcgacagaacgggcccactctcaatgaccacacagcagagcaacagccagtctttcagcacctcccatgaaggtctggaggaagacaaggaccacccgacgaccagcacgttgaccagctccaatagaaacgatgtcaccgggggccgaagggatcccaaccactccgagggctccacaacccttctcgaggggtataccagccattacccccacacaaaagagagcaggactttcatccctgtgacatccgctaagaccgggtcctttggcgtgacagccgtgacagtgggcgatagtaacagcaatgtcaatcgcagtctgtccggagaccaggatacctttcacccatctgggggcagccacacaacccacggttccgaatcagacggacatagccacgggtcccaggaagggggggctaatacaacaagcggtcctatacggactccacagatcccagagtggctgatcatcctggccagcctactagctctggcacttattcttgccgtgtgtattgcggtcaacagtcgacggagatgcggtcagaagaaaaagctggtgattaactctggaaatggcgccgtcgaagatagaaaaccaagtgggctaaatggcgaggccagtaagtcacaggaaatggtacacttagtgaacaaagaatcctcggagactcccgatcaattcatgacggccgatgaaactcgcaacctccaaaatgttgacatgaagatcggagtgtag

SEQ ID NO: 23418 - DNA, 243 bp, Artificial Sequence
  Description of Artificial Sequence: Synthetic coding sequence
atggacaagttctggtggcacgccgcctggggcctgtgcctggtgcccttgagccttgcacagatcgatctcaacattacatgcagatttgccggagtttttcacgtcgaaaaaaatggcaggtattctatcagtcggacagaagcagcagacctctgcaaggcttttaattccactctgcctaccatggctcagatggagaaggctctgagcatcgggttcgagacctgttcatctacttag

SEQ ID NO: 23419 - DNA, 2229 bp, Artificial Sequence
  Description of Artificial Sequence: Synthetic coding sequence
atggacaagttctggtggcacgccgcctggggcctgtgcctggtgcccctgtccctggcacaaatcgatctcaacatcacatgtcgatttgccggtgtcttccatgtggaaaaaaacggacgctactctatctcacggaccgaagcagctgatctctgcaaagcattcaattcgacgctgcctaccatggctcagatggaaaaagcattgtccataggtttcgaaacctgcagatacggctttattgaaggccacgtggtcattcccaggatccacccaaattccatttgcgccgccaacaacaccggggtgtacatcttaacatctaacacctcccagtacgacacgtattgtttcaacgcttctgcccccccagaggaggactgtacgtccgtcaccgacctgccgaatgccttcgatgggcccatcacaattactattgttaacagagatggcactaggtatgttcagaaaggagaataccgcaccaaccccgaggatatctacccttcaaaccctacagacgatgatgtaagcagtgggtcgagctctgagcgatcctctactagcggagggtatattttttatacctttagcactgtgcatccaatccctgacgaggattctccgtggataaccgattccactgacaggataccagccacaacccttatgtccacctcagcaacagcaactgagacagccaccaagagacaagaaacatgggactggttcagctggctgtttttgccctctgaatccaagaatcatctccacacaacaactcagatggcagggacaagctccaacactataagcgcgggttgggagcccaacgaagagaatgaggatgagagagatcgtcacctgagcttctccggctctggtatcgatgatgatgaggattttatctctagcacaattagcactactccacgagcgttcgaccacacaaagcagaaccaggattggacacagtggaatcccagccattccaatcccgaggtcctgctacagaccaccaccaggatgaccgatgtcgaccgaaacggaacaactgcttatgaaggcaattggaacccagaggcacacccacccttgatccaccatgagcatcatgaggaagaagagacgcctcacagtacctcaactatacaggccaccccctcatctacaacagaggaaacagccacacaaaaagaacagtggtttggaaacaggtggcatgaaggctatcgtcagacacccaaagaggattctcactccacaactggcaccgcagcagctagcgcccacacatcccaccctatgcaaggcaggaccacaccaagccctgaagacagctcctggactgatttctttaatccaatctcacaccccatgggcagaggtcaccaggcgggtcgacggatggacatggacagctcccattccattaccctgcagcccactgcgaacccaaatactggcctggttgaggacctcgatcgcaccgggcctctttcaatgacaactcagcaatctaatagccagagcttctccacttctcatgaaggtctggaggaagataaggatcaccccacaacttcaacactgacctcctcaaacagaaatgacgtcaccgggggtcgtagggatcccaaccacagtgagggatctacgaccctcctcgaggggtacactagtcattacccccatactaaggaatccaggaccttcattccggtgacctcagcgaagacaggttctttcggggtgaccgccgtcacagttggagattctaactcgaacgtcaacagatctctaagcggagaccaggataccttccacccgagcggtgggtcacacaccacgcacgggtccgaatctgatggacatagtcatgggtctcaggagggtggggctaatactacttctgggccaattcgcacgccccaaatccctgaatggctgatcattctagcttctttgttagctctggctttaattcttgcagtctgcattgcagtcaactcccggcgtcgctgtgggcagaagaaaaaactggtaataaactctgggaacggtgctgtcgaagaccgtaaaccttccggcttgaacggggaagcaagcaaaagccaggagatggtgcacctggtgaataaagagagttctgagacaccagaccagtttatgactgctgatgagacgaggaaccttcaaaatgtggacatgaaaatcggcgtgtag

SEQ ID NO: 23420 - DNA, 2145 bp, Artificial Sequence
  Description of Artificial Sequence: Synthetic coding sequence
atggacaagttctggtggcacgccgcctggggcctgtgcctggtgcccctttcactggcccagatagacttgaacatcacctgccgatttgctggcgtctttcatgttgagaaaaacggccgctactccatcagccgtactgaggccgctgacctctgtaaggccttcaacagcacactgcctacgatggcacaaatggagaaagccttgtccattggctttgagacctgtaggtatggctttatcgaaggtcatgtggtcatccctaggattcatccaaatagtatctgtgctgctaacaatactggggtctatatcctgacttctaacacttctcagtacgatacatattgtttcaacgcttccgcccccccagaggaggattgtactagcgtgaccgacttgccaaatgcctttgacggacccatcactattaccatcgtcaacagagatggtactcgctatgttcagaagggcgagtaccgtacgaatccagaagatatttacccaagtaatccaacagatgacgacgtctcttctggctccagcagcgagagatccagcacttcagggggttacatcttttacaccttctctacggtgcacccaatccccgacgaggatagcccttggattactgatagtacggacagaatcccagctaccacattgatgtccacgtccgccactgcaacagaaaccgctactaaacgacaagaaacctgggattggttctcttggttgtttttgccttctgaatccaagaatcacttacacactaccactcagatggccggaactagttcgaataccatcagtgcaggctgggagccgaacgaggagaacgaagatgaacgggaccgccatctcagcttttcgggcagtggaatcgacgacgatgaggactttatttctagcactatcagtaccactccaagagctttcgatcacactaagcagaaccaagactggacgcaatggaacccttctcactccaatcccgaggtacttttgcaaacaaccactaggatgacggctgatgtggataggaacgggaccaccgcctacgaagggaattggaaccccgaggctcacccccctttaatccatcacgagcaccatgaggaagaggaaactccccacagtacatccacaatccaggctactccaagcagcactaccgaagaaacagcaacgcaaaaagaacagtggtttggaaacagatggcatgagggctatcggcagactcctaaggaggattcacacagcactaccggcactgcggccgcctccgcgcacacttcccatcccatgcaaggtcgcactaccccatcccctgaggacagttcttggaccgacttctttaacccaatctcccaccccatgggccgaggccatcaagcaggtaggcgtatggatatggactcctctcattctatcaccctgcaaccaaccgctaatcctaataccggcctggtggaggacctagatcggacaggaccacttagcatgactacacgaaatcggaatgatgtgacagggggacgcagggatcccaaccactctgaaggtagcacgacgcttttagagggctatacctctcactatccgcatactaaagaaagccgcacttttattccagtgacttctgctaaaaccggcagcttcggagtgaccgctgtcactgtgggcgacagcaattctaacgtgaaccgctctttgagtggcgaccaggataccttccatccgtcgggcggaagccatacaacccatggctctgagagcgacggacatagtcatggctcacaagaaggaggcgcaaataccacttcagggcccatcagaacaccccagatacctgaatggcttataattctggcctctctcctggccctagcattgatcttggccgtgtgtattgcagtcaattcgcgtagacgatgcggacaaaagaagaagctcgttataaactctggaaacggcgctgtggaggacagaaaaccttcaggactgaatggggaggccagcaagagtcaggaaatggtacaccttgtgaataaggaatccagtgagacgccagatcagtttatgacagccgacgagactcgcaacttgcagaacgtcgatatgaagatcggtgtctag

SEQ ID NO: 23421 - DNA, 1482 bp, Artificial Sequence
  Description of Artificial Sequence: Synthetic coding sequence
atggacaagttctggtggcacgccgcctggggcctgtgcctggtgcctctaagccttgcacagattgacctcaacatcacatgcaggtttgctggcgtgttccatgtggaaaagaacggaaggtacagcatcagccggacggaggcagccgacctatgtaaagctttcaattccacgcttcccaccatggcccagatggaaaaagccttgtccattggctttgaaacctgtcggtatggtttcatcgagggccacgtggtaatcccccggattcacccgaattcaatttgtgcagccaacaacaccggcgtgtacattttgacatcaaacacctcacagtacgacacttactgttttaatgcctccgcccctccagaggaggactgtacctccgtaacggacttgcctaatgcctttgacggccccataactattaccattgttaaccgggatgggacacgctacgtccagaagggcgaatatcggaccaacccagaggacatctacccaagtaatcctactgacgatgacgtctcgtccgggagctcgtccgaacgatctagcacatctggagggtacatcttctatacattttctactgtgcacccaatacctgatgaagattctccctggatcactgacagcaccgaccgtatccctgccaccaacatggacagctctcattctattaccttgcagccgacagccaatccaaacactggcctcgtagaagatctggaccgcaccggccccttgtctatgaccacccagcaaagcaattctcaaagtttcagcacctctcacgagggtctggaggaggacaaggatcacccaaccaccagtaccctgacctcttccaatcggaacgacgtcaccggaggccgtcgcgacccaaaccacagcgagggatctacaactctgctcgaaggttacacgagccattaccctcacactaaagagtctcgtacattcatccccgtcacctctgcgaagacaggcagttttggcgtaactgccgtgacggttggggatagcaattctaatgtcaaccggtccctatccggagaccaggacacattccatccatcagggggctcccacactacgcacggaagtgaatccgacggccacagccacggatcccaggaggggggggccaatacaacgtccgggcccatacgtaccccacagattccagagtggctgattatactcgcctctctgctagcactcgcacttattctggcagtgtgcatcgccgtaaacagccggcggaggtgtggccagaagaaaaagttagttattaactccggtaacggggctgtggaggacagaaaacctagcggcctgaacggcgaggcatccaagtcacaggaaatggtgcacctagtgaacaaagaatcctccgagactccagaccaatttatgaccgctgacgaaacgagaaacctgcaaaacgtggatatgaagatcggagtatag

SEQ ID NO: 23422 - DNA, 1290 bp, Artificial Sequence
  Description of Artificial Sequence: Synthetic coding sequence
atggacaagttctggtggcacgccgcctggggcctgtgcctggtgccacttagtctcgcccagatagatctcaacatcacatgtcgctttgcaggcgtgttccacgtggaaaagaacggcagatactcaatttctcgaaccgaagccgccgatctgtgcaaagccttcaactccacactgcccaccatggcccagatggagaaggccctttctattggattcgaaacatgtcggtacgggttcatagagggacacgtcgtcatccctaggatacatccgaattcaatctgtgcagcaaacaacaccggtgtgtatattctcaccagcaatactagccagtatgatacctactgcttcaacgcaagcgcccctccagaagaggactgcacgagtgtgacagaccttccaaacgcattcgatgggcctatcaccatcaccatcgtgaatcgcgacggcacacgatatgtccagaagggtgaataccggacgaacccagaagatatatatccatccaaccccaccgatgacgacgtttctagtggttcctccagcgaacggtcctccaccagtggtggttacatcttttacaccttttctaccgtccatcccataccagacgaggactctccatggatcactgattccactgacaggatccccgccacaaataggaatgatgtcactggcgggcgcagggatcccaaccacagtgagggctcaacgactctgctggagggctacactagccattacccacatactaaggagagtcgaactttcattcctgtgacgagtgctaagacgggctcctttggagtcactgcggtcaccgttggcgatagtaatagcaatgtgaatagatcactctcaggcgaccaagacacattccacccctccgggggttctcatactacccatgggtctgaaagtgacggccattcgcacggctcgcaagagggtggcgccaacaccacgagcggaccaatcaggaccccacagatacccgagtggctcatcatcctcgcctccctgctggcactggccctgattctggctgtctgtatcgcagtgaactcacgacgccgttgcgggcagaaaaagaagctggtgatcaattccggcaacggtgcggttgaagaccgaaagccctcagggctgaacggtgaagcttccaagtcccaggagatggttcatctcgtcaacaaggagagcagcgagacccctgaccagtttatgacagcagacgagacacggaatctgcagaatgtcgacatgaaaatcggagtgtag

SEQ ID NO: 23423 - DNA, 2025 bp, Artificial Sequence
  Description of Artificial Sequence: Synthetic coding sequence
atggacaagttctggtggcacgccgcctggggcctgtgcctggtgccattgtctctcgcacagatcgatctcaatattacatgccggtttgccggcgttttccatgtcgagaaaaatgggcggtattctatcagcaggaccgaagccgccgatctctgtaaagcctttaactcaaccctccctaccatggctcaaatggagaaggccctgtctattggattcgagacctgccggtacggattcatagaagggcatgtggtgataccacgtatccaccccaatagcatctgtgctgccaacaatactggagtatacatcctgacttccaacacttcacagtacgacacctactgtttcaatgcatccgcgccgcccgaggaggattgtacttccgtgaccgaccttcccaacgcttttgatgggccaatcacgattactattgttaaccgggacggaactcgctacgtacagaagggagaatatcggacgaatcctgaagatatctaccctagcaatcctaccgatgacgacgtatccagcggtagtagttcagaacgctcctcaaccagtggcggctatatcttttacacgttttcaacagtgcaccccattccagatgaagacagtccatggataaccgactctaccgatcggattcccgctactacgcttatgtcaaccagcgctaccgccaccgagactgctacgaagcgccaggagacgtgggattggttctcttggttgtttctgccttccgaaagtaagaaccaccttcacaccacaacgcagatggcggggacatcctccaatacaatttcggcggggtgggaacctaacgaagagaacgaagacgaaagagataggcatcttagcttctctgggagcggtatcgatgacgacgaagactttatcagcagcaccatcagcacaacaccccgagccttcgatcacaccaagcagaatcaggactggacacagtggaaccctagtcactctaaccctgaagttctgctgcagacaacaacccgcatgactgacgtggatcggaatggaactactgcctacgagggtaactggaacccagaagcgcatcctcctctgatccaccacgaacaccatgaggaggaagagacccctcactcaaccagtacgattcaggcaaccccctcctcaaccaccgaagagaccgccacacagaaagaacagtggtttggtaaccgatggcacgagggataccggcaaaccccaaaggaggactcccactccaccacagggaccgccgcggcatccgctcatacctcccatcctatgcaggggcgcacaactccttctcccgaggattcttcctggacagatttctttaatccaatcagtcacccgatgggtcgtgggcaccaagctggccggcgcatggacatggacagttcacacagcatcactttacagcctaccgccaatccaaatactggcctggtcgaagacctggacagaaccggaccactatcaatgactacgcagcagtcaaacagtcagagtttctcaacctctcatgaggggctggaagaagacaaagatcatcccacaacctcaacgcttacctctagtcgggaccaggacactttccaccccagtgggggctcgcatactacacacggatcggagtcagacggccacagtcacggcagtcaggaaggaggagccaatactaccagcggacccatccgtactccccagatcccagagtggctcattattctagcaagtttgctggccctggccttgattctcgccgtgtgtatcgcggtgaactcccgaagaaggtgcgggcagaaaaaaaagcttgttattaattctggcaatggagccgtagaggaccgcaaacccagtggcctaaatggcgaagcctccaagtcacaagagatggtacacttggtgaataaggaatctagcgagactcccgatcagttcatgacagcagatgagacccgcaacctgcagaatgtcgacatgaagattggcgtttag

SEQ ID NO: 23424 - DNA, 2100 bp, Artificial Sequence
  Description of Artificial Sequence: Synthetic coding sequence
atggacaagttctggtggcacgccgcctggggcctgtgcctggtgcccctgagcttggcacagattgacctcaatatcacctgcaggtttgctggtgtgttccacgtcgagaaaaatggccgctacagtatctcccggacggaggcagctgacttgtgcaaggcattcaatagtactctccccacaatggcccagatggaaaaagccctctctataggcttcgagacatgccgttatggattcatagagggccatgtggtgatcccacgtatccatcccaattcaatttgcgctgcgaacaataccggcgtctatattctcacatctaacacttcacagtacgacacctactgctttaatgcgtcagctccccctgaggaggattgcacctccgtgactgacctgccgaatgcattcgacgggcctataaccatcaccatcgtgaacagggacggaacccggtatgtgcagaaaggtgaatacaggacaaatcccgaagacatttacccaagtaatccgaccgatgacgatgtgtcctctgggtcctcaagtgagaggtcatcaacctctgggggttacatattttacacattcagcactgtccatccaataccagatgaggattctccctggatcactgattctaccgacaggatcccggcgaccaccctgatgtccacctccgcgaccgctactgaaacggctactaagcgccaggaaacctgggattggttcagttggctgtttctgccctcagaaagtaagaaccatcttcatacgacaactcagatggctggaacctcttccaacacaattagtgccgggtgggagccaaacgaagagaatgaggatgaaagagatagacatctgagcttcagtggctcgggaatcgacgacgacgaagactttatatctagcaccatctccacgaccccgcgcgctttcgatcataccaagcagaaccaggactggactcagtggaatccctctcacagtaaccctgaagtactgcttcagactacaactcggatgacggacgtggatcggaacggaactacagcatatgaaggaaactggaaccccgaggcccatccccctctgatacaccacgaacaccacgaggaagaagaaacaccccactctacatctaccaccgcatcggcacacacatcacatcctatgcaagggagaacgacccctagccctgaggactcttcatggactgattttttcaacccaatctcacaccctatggggcgaggacatcaagccggacggcgcatggacatggactcaagccactcaattaccctccagccaaccgccaatcccaacacaggcctggtagaagacctggataggacaggcccccttagcatgacaacccagcagtctaactctcagtcattctcaaccagccacgaaggcctcgaggaagataaggatcatccaacgacgagcaccctgacctcatctaatagaaacgatgttaccggcggtaggagggatcctaaccacagcgaagggtctacgaccctattagaaggttacaccagtcattacccgcacaccaaagagagcaggactttcattcccgtgactagcgccaaaaccggctcatttggagtcacagcagtcacagttggtgattctaattcaaatgttaatcgcagcctgagtggtgaccaagacactttccatccaagtggcggctcccacaccactcacggatctgagagtgacggccactctcacgggagccaggagggaggagctaacacaacaagcgggcccattcggacgcctcagattcccgaatggctgataatcctggcgtcactactggctcttgccctgatcctggctgtgtgtatcgccgtgaacagcaggagaaggtgcggacagaagaaaaaactggtgataaactctggcaatggggccgtggaagataggaagcccagtggactgaatggggaggcatccaagtcacaagagatggttcacctggttaacaaggagagctctgagaccccagatcagttcatgactgctgacgaaactcggaatctccagaatgtagatatgaagattggagtgtag

SEQ ID NO: 23425 - DNA, 237 bp, Artificial Sequence
  Description of Artificial Sequence: Synthetic coding sequence
atggacaagttctggtggcacgccgcctggggcctgtgcctggtgcccttgtcgctggcgcaaatcgacctcaacattacctgcaggttcgccggcgtttttcacgttgagaagaatgggagatatagtatttcaagaactgaggcagccgacttatgcaaagcgttcaactctactttgccaacaatggcccagatggagaaggccttgtcaattggattcgagacatgccgctag

SEQ ID NO: 23426 - DNA, 885 bp, Artificial Sequence
  Description of Artificial Sequence: Synthetic coding sequence
tgagacaagttctggtggcacgccgcctggggcctgtgcctggtgccactttcactggctcagatcgacctgaacataacctgtcgctttgccggcgtattccatgtagaaaaaaacggaaggtattccatttcacggaccgaggccgctgatctgtgcaaagctttcaattcaacactccctactatggcccaaatggaaaaggctctgagtattgggtttgagacctgtcgatacggctttattgagggccatgtggtcattcccagaattcatcccaattctatctgtgctgcaaataacactggagtttatatccttacatccaacacatcacaatacgacacctattgttttaacgcctccgcccctcctgaagaagattgtacttctgtcaccgacctccctaacgcctttgatggccccattacaatcaccatcgtaaatcgcgacggtactaggtacgtgcaaaaaggcgaatatcgtacaaaccccgaggacatttacccttcaaaccctactgatgatgatgtttcttccggctcatccagtgagagatcatcaacaagcggaggatatattttctacacattcagcaccgtccaccctatcccagacgaggactctccttggatcacagatagtaccgacagaatccccgctacacgagaccaggacactttccacccctcagggggatcccacactacccatggctccgaaagtgatggtcactcccacgggtcgcaagagggcggcgccaatacgacctccggccccattagaacccctcagataccggagtggctgatcatactggcttccctgctggcgctggcgctaatccttgccgtgtgtattgccgtgaactcccgaaggagttag

SEQ ID NO: 23427 - DNA, 918 bp, Artificial Sequence
  Description of Artificial Sequence: Synthetic coding sequence
atgtggcccctggtggccgccctgctgctgggcagcgcctgctgcggatccgcccagctgctttttaacaagaccaaatctgtcgaattcacattctgcaatgacactgtggtgatcccatgtttcgttaccaatatggaagcacagaacactacggaggtctacgtcaaatggaaatttaagggccgcgatatttacacattcgacggggcgttgaacaaatctacagtgcctacggattttagcagtgctaaaattgaggtctcacaactgttaaaaggagacgcctccctcaagatggacaagagtgatgcagtctcccacaccggcaactacacatgtgaggttactgagctaaccagggaaggagagaccattattgagctgaagtaccgggtggtaagttggttctcacccaacgaaaatattctcatcgtgatcttccccattttcgctatcctgctgttctggggacaattcgggataaagacactcaaatacagatccgggggcatggatgagaagactattgcacttctggtagccggtctagtcatcaccgttatcgtgatagttggagcgatcctgttcgtgcccggtgaatatagtctgaagaatgcaacgggactggggctgatcgtaacgtctactggtatcctgattctgctacattactatgtattttctaccgcaataggcttaacaagtttcgttattgctattctggtgatccaggttatcgcctatatcctggcggtcgtcggactctccctatgtatcgccgcgtgtattcctatgcacggcccattgcttataagtggcctgtctatcctggctcttgcccagctactgggcctggtttacatgaaatttgtggcgagcaatcagaagacaattcagccccctcgcaacaactag

SEQ ID NO: 23428 - DNA, 972 bp, Artificial Sequence
  Description of Artificial Sequence: Synthetic coding sequence
atgtggcccctggtggccgccctgctgctgggcagcgcctgctgcgggagcgcacagctccttttcaacaagacaaagagcgtcgagttcactttctgtaacgatactgtggtaattccctgtttcgttacaaacatggaagcacaaaatactaccgaggtgtacgtaaagtggaaattcaagggtagagatatctatacttttgacggtgctcttaacaagtctactgtacccacagacttcagttccgctaaaatcgaagtatcccagctccttaagggagatgcttctctgaaaatggacaagtctgacgctgtgtcacacacagggaactatacttgcgaagttaccgaacttacccgagagggagaaacaattattgagcttaaatacagggtcgtgtcctggttctcgccaaatgaaaacatcctcatcgtaatcttcccaattttcgccatcctgctgttttggggccagtttgggattaagacattgaaatatcggtccggtggcatggatgaaaagaccatcgcactcctggttgcaggtttggtgatcacagttattgtgatcgtaggtgcgatccttttcgtgcctggcgaatattctcttaagaacgccaccggactaggtctgattgtaacctccacggggatcctcatcctcctacactactacgtgttctccaccgccatcgggctgacgtcgttcgtgattgccattttagtcatccaggtgatagcatacatcctggcagtcgtggggctgtcactgtgtatagccgcatgcatccctatgcacgggcccctgcttatcagcggcttatctatactggctttggcccaactactcggcttagtgtacatgaaattcgttgcatccaaccaaaaaacaatccagccccctcggaaagcagtagaggaacccctgaacgcctttaaggaatccaaaggtatgatgaatgatgagtag

SEQ ID NO: 23429 - DNA, 1488 bp, Artificial Sequence
  Description of Artificial Sequence: Synthetic coding sequence
atgcccatgggcagcctgcagcccctggccaccctgtacctgctggggatgctcgtggcctcgtgcctgggtcgactttcttggtatgaccctgattttcaagctagactcactaggtcaaattcaaagtgtcaggggcagctggaggtgtacttgaaggatggttggcacatggtatgttctcagtcctgggggcgctcgtccaagcagtgggaagacccttcgcaggcctcgaaggtgtgccagagattgaactgcggcgtgcctctgagtctggggccctttcttgtgacttacacccctcagagctctatcatttgctacgggcagcttggctcttttagcaactgtagccactctcgtaatgatatgtgtcacagcctcgggcttacctgcctggaaccacaaaaaaccacaccccccaccactagacccccccccactacaactccagaacccaccgccccaccgaggttgcagctcgtggcccagtccggaggacaacattgcgccggcgtagtggagttttactccgggtccctaggtggtactatctcctatgaggcacaggataaaacgcaagaccttgagaatttcctgtgcaacaacctgcagtgcggcagttttctgaagcatctgccggaaaccgaggcaggaagggcacaggacccgggcgaacctcgggagcaccaaccgctgcccatacagtggaaaatccaaaactcctcttgtactagcctagaacattgcttccgaaagataaagccccagaagtctggccgtgttctggctcttttgtgcagcggttttcagccaaaggtgcagtcaagactggtgggaggaagctccatttgcgaaggcaccgttgaggtgcgccagggcgcccagtgggccgccctatgtgactccagttctgctcgcagcagtctcaggtgggaagaagtttgcagggagcagcagtgcgggtccgtgaactcctacagggtgctggacgccggcgaccccaccagccggggtctgttttgcccacatcagaagttgagccagtgccacgaactatgggagaggaactcttattgcaagaaggtattcgtcacctgtcaagatccgaatcccgcggggttggccgcgggtaccgtcgcaagcattatcctcgctctcgtgctgctggtggtactgctcgttgtgtgtggccccctggcctataaaaagcttgtcaaaaagttccgccagaagaaacagcgacaatggattggtccaaccggtatgaaccagaacatgtccttccacaggaatcatactgctaccgtgagaagtcacgctgagaatcccacagcgagtcacgtagataacgagtactcccagcctccgaggaatagccacttgtctgcgtatcccgccttggaaggcgcgctgcaccgttctagcatgcagccagacaactcaagcgactccgactatgatttacacggcgcgcagcgactgtag

SEQ ID NO: 23430 - DNA, 582 bp, Artificial Sequence
  Description of Artificial Sequence: Synthetic coding sequence
atgcccgaggagggcagcggctgcagcgtgcggcggcggccctacggctgcgtgctgagggccgccctagtgccactcgtcgctggactcgtgatatgtcttgtagtatgcatccagagattcgcacaggctcaacagcagctgcccctcgagtcattaggatgggatgtggccgaactgcagcttaatcacacaggccctcaacaggatcctagactctattggcaggggggtccagctctgggacggagcttcctccatggccctgagctagacaagggccagctccggatccacagagacggcatctacatggtgcatatccaggtgaccctcgcaatatgctctagcactaccgccagcagacatcaccctaccaccttggctgtgggcatttgctcaccggcttccagatctatcagcctcctgaggctgtcttttcaccagggatgcaccattgcctctcagagactgactccactggctcgcggggacactctttgcacaaatctgacaggtacgctgctaccatcgagaaacactgatgagacattcttcggggtccagtgggtgcgtccatag

SEQ ID NO: 23431 - DNA, 627 bp, Artificial Sequence
  Description of Artificial Sequence: Synthetic coding sequence
atgcccgaggagggcagcggctgcagcgtgcggcggcggccctacggatgcgtactaagggcagcactggtccccctggtggccgggttggtcatctgcctggtggtgtgtattcagagattcgcccaggcccaacaacagttgcccttggaaagccttggttgggatgtggctgagctgcagctcaatcatacagggccccagcaagacccaaggctgtactggcagggcggccccgccctgggtcgctcattcctgcacggtcctgagctggataagggacagctgcggatccatagggacggaatctacatggtgcacatacaagtgaccctggctatatgctcctcaaccactgcctcacgccatcaccctaccactctggcggtaggaatctgttctccagcgtccagatcgatttccctgctgcggttgtcctttcaccagggcctgtttggcttctggaattggggcctgaaagttaagtgcttccttcgccacttaatctggacagctcactgcttcatccctctcacccaactggttttcatgcaagctctacagtcatggcgaaaccaccattgttcacacttcacggacgaagagaataggggggtcaacagatag

SEQ ID NO: 23432 - DNA, 1305 bp, Artificial Sequence
  Description of Artificial Sequence: Synthetic coding sequence
atgagcgccgacggcgccgaggccgacggcagcacccaggtgaccgttgaggaaccagtgcagcaaccaagcgttgtggatcgcgtggcctccatgcccctcattagcagcacatgcgacatggtgagcgcggcatacgcctccactaaggaaagttaccctcatatcaagaccgtttgcgacgctgccgaaaagggggtgcgcactcttaccgctgcggcagtcagcggcgcacagccgatcctaagtaagttggagccacagattgccagcgcctcggagtatgcccacagagggttagataaactggaagagaatcttccaatcttgcaacagcctacagaaaaggtcctcgctgataccaaagagctggtctcctccaaggtgagcggtgcccaggaaatggttagcagtgcaaaagataccgtggcgacacagctgtccgaggctgtagatgctactaggggagccgttcagtcaggtgtggacaaaaccaaatctgtcgtgacaggaggcgttcagtcagtcatgggatccaggttgggccaaatggtgttgtcgggagtggacaccgttctgggcaaatccgaagaatgggcggacaaccacctcccccttactgacgccgagctggcacgtattgctacctcacttgatgggtttgacgtggcatctgtccagcagcaacggcaagagcagtcctatttcgtaagactaggatctctttccgagcggctgagacagcatgcctacgagcacagcctcggcaagctgcgggccaccaagcagagggcccaggaagcacttttacagttgagccaggtactgagccttatggaaactgtgaaacagggcgtcgaccagaaactggtcgaagggcaggaaaagctccatcagatgtggttatcatggaaccagaaacagcttcagggccctgagaaggagccaccaaagccagaacaggtggaatcccgagccctcacgatgtttagggatatcgctcagcagctacaggccacatgtactagtttgggatcaagtatccagggtctgcctaccaacgtgaaggatcaagtgcaacaggccagacgtcaggtcgaagacttgcaggctaccttctcatccatacacagctttcaggacctgtccagctccattctcgcccaaagtcgagagagagtagctagcgccagggaagccctggatcacatggttgagtatgtagcccaaaatacccccgtcacctggcttgtgggcccttttgcccccggaataactgagaaggctccagaggagaagaaatag

SEQ ID NO: 23433 - DNA, 567 bp, Artificial Sequence
  Description of Artificial Sequence: Synthetic coding sequence
atgcccggcggccccggcgtgctgcaggccctgcccgccaccatcttcctgctattcctgctgagcgccgtataccttgggccaggatgccaggctctgtggatgcacaaggtacccgcctcattaatggtgtccctgggggaggacgcccacttccagtgtccccataattcgtccaataatgcaaacgtgacatggtggcgggttctgcacggtaactacacttggccccctgagttcctcggccccggagaggacccgaatgagccacccccccgacccttcctagacatgggcgagggaacaaaaaatagaatcatcacagcagaaggcatcatcctgctgttttgcgcagtggtgcctgggacgctgctccttttccgcaaaagatggcagaatgaaaaactcggcctagatgcaggggatgaatacgaggacgagaacctgtacgaagggttgaacctggatgattgttccatgtatgaggacatcagtcgcggactgcaaggcacctatcaggatgttggaagccttaatataggagacgtgcagctggagaaaccctag

SEQ ID NO: 23434 - DNA, 867 bp, Artificial Sequence
  Description of Artificial Sequence: Synthetic coding sequence
atgggccacacccggcggcagggcaccagccccagcaagtgcccctacttaaatttctttcaactgctggtgctggcagggctgtcccacttctgctcgggcgtcattcacgtgacaaaggaggtgaaagaagtggccactttatcatgtggccacaatgtttctgtcgaggagctcgcccagaccagaatctattggcagaaggaaaagaagatggtgctgacgatgatgtccggtgacatgaatatctggcccgaatataagaatcggaccatctttgatattacgaacaatctgtctatcgtcatcctggcactcagaccaagtgacgagggaacgtacgaatgcgtagtcctgaaatacgaaaaagacgctttcaaacgtgaacaccttgccgaggtgactttgtccgttaaagcagatttccctactccatctatctcagattttgagattcctactagtaatatccgacggataatttgcagcacatcaggaggctttcctgagccgcacctttcttggctggaaaacggcgaagaacttaatgctattaacacgacggtgtctcaggatccagaaacagagctgtacgctgtgtcctccaagcttgacttcaatatgactaccaaccattcctttatgtgtcttattaaatacggccacttgcgggttaatcaaacatttaactggaatactacaaagcaggagcatttcccggacaacttgctgcccagctgggctattactcttatatcagtaaacggcatatttgtgatttgttgccttacctattgttttgcaccccggtgtcgggagcggcggaggaacgagcgtttacgacgcgaatctgtaagacccgtttag

SEQ ID NO: 23435 - DNA, 489 bp, Artificial Sequence
  Description of Artificial Sequence: Synthetic coding sequence
atgggccacacccggcggcagggcaccagccccagcaagtgcccctatctgaacttttttcagctgctggtactcgctggcctgagccatttttgctccggcgtgatccacgtaactaaagaggtgaaagaagttgctaccctctcttgcgggcacaacgtcagcgtggaagaacttgcacagactcgcatatactggcagaaggaaaagaaaatggtgcttacaatgatgtctggtgatatgaatatttggccagaatataagaaccgcaccatctttgatataacaaataatctgagcattgtaatcttggccctgcgtccatctgatgagggcacttatgagtgtgtggtgcttaagtacgaaaaagacgcctttaaacgcgagcacttggctgaggtgaccctgtcagtcaaaggcttcgccccccggtgtcgggagcgaagaagaaacgaaagattaagacgggaaagcgtgcgccctgtgtag

SEQ ID NO: 23436 - DNA, 771 bp, Artificial Sequence
  Description of Artificial Sequence: Synthetic coding sequence
atgggccacacccggcggcagggcaccagccccagcaagtgcccctacctgaattttttccaactcctggtgctggctggcctgtcccacttttgcagtggcgttatacacgttaccaaggaggtgaaagaggtggccactttatcctgtggccacaacgtcagcgtcgaagaactggctcaaacccggatatactggcagaaagagaaaaagatggtcttgactatgatgtcaggcgacatgaacatttggcccgagtataaaaatagaactattttcgatattacaaacaatctgagcatcgtgattttggctctcagacccagtgatgagggtacatatgagtgtgtcgtcctgaagtacgagaaggatgcttttaagcgcgaacacctggccgaagtaacactctccgtgaaagccgacttccctacacccagcatcagcgactttgaaatcccaactagcaatatacgacgaatcatctgcagcacctcaggaggattccctgaacctcacctgtcttggctcgaaaacggagaagagctgaatgccatcaacacgacagtcagtcaggaccccgaaaccgagctctacgcagtgtcaagcaagctggacttcaacatgaccactaatcatagctttatgtgcctgatcaagtacgggcatctgagggtcaatcagacatttaactggaacacaagctttgcgcctcgatgccgggaacggaggagaaacgagaggttacggagggagtcagttcgccccgtttag

SEQ ID NO: 23437 - DNA, 867 bp, Artificial Sequence
  Description of Artificial Sequence: Synthetic coding sequence
atgggccacacccggcggcagggcaccagccccagcaagtgcccctacctgaacttctttcagctgctcgtgctagcaggactgtctcacttctgctcgggggttatccatgtcactaaggaagtcaaagaggtagccactctgtcttgcgggcacaacgtgagcgtagaagaattggcccagacgcggatttactggcagaaagaaaagaaaatggtccttaccatgatgtctggggacatgaatatttggcccgagtataaaaaccggacaatctttgatattactaataacctgagcattgtcattctagccctccgaccatccgacgaagggacatacgaatgcgtagttcttaagtatgagaaggacgcgttcaagagagaacacctcgcagaagtgaccctgtccgtgaaggctgatttcccaactccaagcattagcgatttcgagatacctacctctaacatccgaaggattatctgtagcacatcagggggctttcccgaaccccatctgtcttggctggagaacggggaagaattgaacgctattaacactaccgtctcacaggaccccgaaactgagctatacgcagtctcttccaagctggactttaatatgaccacaaatcattccttcatgtgcttgatcaagtacggccacctgagagtgaaccagaccttcaactggaacactacaaagcaggagcattttccagataatctcctcccttcctgggccattaccctgattagtgtaaacggtattttcgtgatctgttgccttacctattgttttgccccacgctgccgggaaaggaggcgtaacgaacgcctgcggcgcgagtcagtgcgccctgtgtag

SEQ ID NO: 23438 - DNA, 456 bp, Artificial Sequence
  Description of Artificial Sequence: Synthetic coding sequence
atgagcatccccttcagcaacacccactaccggatcccccagggcttcggaaatctgctggagggtcttacccgggaaattttgcgagagcagccagataacattcctgcctttgccgcggcatatttcgagagcctgctggagaaacgagaaaagactaacttcgaccctgctgagtggggctcaaaggtcgaagatagattttacaacaatcatgcgtttgaggaacaagaacctcctgaaaagtctgatcctaagcaggaggaaagtcagatttcaggtaaggaggaagagacctcagtaactattttggactcatcagaggaagataaggaaaaggaggaggttgccgctgtgaagatccaggctgcattcagaggtcacatcgcaagggaagaagccaaaaaaatgaaaactaatagtctgcagaacgaagaaaaggaggaaaacaagtag

SEQ ID NO: 23439 - DNA, 729 bp, Artificial Sequence
  Description of Artificial Sequence: Synthetic coding sequence
atgggcagcgcctgcatcaaggtgaccaagtacttcctgttcctgttcaatctcatcttcttcattctgggcgccgtcatactcgggttcggcgtctggattttggcggacaaatcatcctttatctccgttctccagacctcgtccagctctcttaggatgggcgcttacgtgtttattggggtgggagcagtcacaatgctgatgggattcctggggtgtattggggctgttaacgaggtacggtgcctgttaggattgctcaagcaagaaatgggcggtattgttaccgagctgatcagagattataatagcagtagagaggatagcctgcaggacgcttgggactacgtccaggcacaagtgaaatgttgtggatgggtgagtttctataactggactgacaacgcagaactcatgaatcgacccgaggttacatacccatgtagctgtgaagtgaaaggagaagaagacaacagtctgagtgtacgaaaggggttttgcgaggcgcccggtaacagaacccagtcgggcaaccaccccgaagactggcccgtttaccaagagggctgcatggagaaagtgcaggcctggctgcaggaaaatctggggattattttgggtgttggcgtcggggtcgctattattgagctgctcggcatggtgctgtcaatttgcctgtgtcggcatgtccactcagaggactactctaaggtgcctaagtactag

SEQ ID NO: 23440 - DNA, 207 bp, Artificial Sequence
  Description of Artificial Sequence: Synthetic coding sequence
atgggcagcgcctgcatcaaggtgaccaagtacttcctgttcctgttcaacttgatatttttcatactgggcgccgtgatcctcggtttcggagtttggattctcgccgataaatcctccttcataagtgtgctgcagacgagctcatcatccctccgaatgggtgcatacgtttttatcggggtcggggcagtcactatgctgtag

SEQ ID NO: 23441 - DNA, 117 bp, Artificial Sequence
  Description of Artificial Sequence: Synthetic coding sequence
atgggcagcgcctgcatcaaggtgaccaagtacttcctgttcctgtttaatttaatattctttatactcggggccgtgattctcggattcggcgtctggattttggccgacaagtag

SEQ ID NO: 23442 - DNA, 318 bp, Artificial Sequence
  Description of Artificial Sequence: Synthetic coding sequence
atgggcagcgcctgcatcaaggtgaccaagtacttcctgttcctgttcaatctcatcttcttcatactgggtgccgtcattcttggtttcggtgtgtggattctggccgataagtcttcgttcatcagtgttctacaaactagttccagctcccttcggatgggggcctatgtgtttatcggggtcggagccgtcacaatgctgatgggcttccttggatgtatcggcgcggtcaatgaggttcgttgcctcttgggactttacttcgcctttttgctgttgatcctcatcgcccaggttactgctggggcgctatag

SEQ ID NO: 23443 - DNA, 327 bp, Artificial Sequence
  Description of Artificial Sequence: Synthetic coding sequence
atgggcagcgcctgcatcaaggtgaccaagtacttcctgttcctgtttaatctaatttttttcatcctcggagcagtgatccttggattcggggtatggatcctggccgacaagtctagcttcatatcagtgttgcagacatctagtagcagcctcagaatgggggcatatgtgtttatcggcgtgggcgcagtcaccatgctgatgggatttcttggatgcattggggccgtgaatgaggtccgctgcctcctaggactgtactttgcatttctgctgctcatcttgattgcacaggtgaccgccggtgcactgttttacttttag

SEQ ID NO: 23444 - DNA, 708 bp, Artificial Sequence
  Description of Artificial Sequence: Synthetic coding sequence
atggccctgcccgtgaccgccctgctgctgcccctggccctgctgctacacgcagcccggccatcccagttcagggtcagtcctctggatcgcacatggaacctaggcgagacagtggagttaaaatgccaagtattactgagcaacccgacttctggttgctcgtggttgttccagcctcggggcgccgcagcctccccgacttttttactgtacctcagccagaacaagccgaaagccgccgaagggcttgacacccagcgtttcagcggcaagcggctgggagatacctttgtcctaacgctctccgacttccgacgcgagaacgaaggatactacttctgctctgcactgagtaactccatcatgtacttttcccattttgtgccagtgttcctccctgctaaacccaccacaaccccagcccccagaccgccaaccccagccccaacgattgcatcacagcccctctcactacgcccagaggcttgtaggcctgcggccgggggggccgtccacacccgaggactcgatttcgcttgcgacatttacatttgggcccccttagctgggacatgtggagtgctgctactgtcgctggtgattactctctattgcaaccatcgcaatcggcgaagggtttgcaaatgtcccagacccgttgttaagtcgggtgataagccgtcacttagcgcacgttacgtgtag

SEQ ID NO: 23445 - DNA, 597 bp, Artificial Sequence
  Description of Artificial Sequence: Synthetic coding sequence
atggccctgcccgtgaccgccctgctgctgcccctggccctgctgctccacgccgcccgaccaagccagtttcgggttagcccgctggaccgaacctggaatttgggagagacagtggaactaaaatgccaggtcctgctttctaaccccacaagcggttgttcttggctttttcagcctaggggtgcggctgcatcgccaacatttctgctttacttaagtcagaataaaccaaaggctgccgaagggctagacacacagcggttctcaggaaaaaggttaggtgacacttttgttctcacacttagcgacttcaggcgggagaatgaaggctattatttttgttccgccctgagcaacagcattatgtactttagccatttcgtccccgtctttctccccgccaagcccaccaccactccagctcccaggcctccaaccccagccccaacaatcgcttcccagcctctttcattacgcccggaagcttgcagacccgccgccggcggcgccggcaacagaagacgggtttgcaaatgtccaaggcctgtcgtgaaaagcggcgataaaccaagcctgagtgcccgctatgtgtag

SEQ ID NO: 23446 - DNA, 708 bp, Artificial Sequence
  Description of Artificial Sequence: Synthetic coding sequence
atggccctgcccgtgaccgccctgctgctgcccctggccctgctgctgcatgcagcacgcccttcgcagttccgcgtcagccccctggaccggacctggaatcttggggagactgttgagctgaagtgccaggtcctactatctaatcccactagtggctgtagctggctcttccaaccccgcggcgcagccgctagtcccaccttccttctgtacttgagtcagaataaaccaaaggcagctgagggccttgatacacaacggttcagtggcaaacggcttggagacaccttcgtactcacgctgtccgacttccgtagagaaaatgagggatactatttttgctctgccctgagcaactccatcatgtacttcagccatttcgtcccagtctttttgcctgcaaagccaaccactacaccggccccgcggcccccaacacccgctcctacaatagcatcgcagccactttcgttacgaccagaggcatgccgccctgccgctggcggagcggtccacactcgtggcctggactttgcttgcgacatctacatttgggcacccctcgccggaacgtgtggcgttctgctcctttctttagtaattactctgtactgtaaccacagaaaccggcgacgcgtgtgtaagtgcccacgcccggtcgtaaaatctggagataaacctagcctgagtgcccgttacgtatag

SEQ ID NO: 23447 - DNA, 597 bp, Artificial Sequence
  Description of Artificial Sequence: Synthetic coding sequence
atggccctgcccgtgaccgccctgctgctgcccctggccctgctgctgcatgccgctcgcccgtcacagttcagggtttcccccctggacagaacttggaacctgggagagacagtggaacttaaatgccaggtgctgctctctaatccaactagcggatgttcttggttatttcaacctagaggagcggcagccagtcccacctttctgctatacttatcacagaacaaaccaaaggcggctgaaggattggatacacagaggttcagcggcaagaggttaggtgacactttcgtgctcacattaagcgattttcggagggagaacgaaggctactacttctgctcggctttgtccaactctatcatgtattttagccatttcgtacctgtctttctgcccgtgcacacacgaggtctggattttgcatgcgacatctacatttgggccccattagcaggaacctgcggggtgctccttctttccctggttattaccttatattgcaaccatagaaatcggagacgcgtttgtaagtgccctcgcccggtggtgaagtctggagacaaacccagcctgtcagccaggtatgtctag

SEQ ID NO: 23448 - DNA, 663 bp, Artificial Sequence
  Description of Artificial Sequence: Synthetic coding sequence
atggccctgcccgtgaccgccctgctgctgcccctggccctgctgcttcacgcagctaggccatcacaatttagggtgtcccctctcgacaggacctggaatcttggcgagacagtcgagctgaaatgtcaggtgctacttagtaatcccacttcgggatgctcttggctcttccagccacgcggggcagcggcaagcccaacgttcttgctgtacctatctcagaacaaacctaaagctgccgaggggctggacacccttagcgactttaggagggaaaacgagggctattatttctgcagtgcgctatcaaattccatcatgtatttctcacactttgtgccagtgttccttcctgccaagcccacaaccacccccgccccaagaccgccaacaccagccccaacaattgccagtcagccactgagccttagacccgaagcttgtcgccctgccgcaggaggcgcggttcacactcgaggattggatttcgcgtgtgatatttacatctgggccccattggccggaacatgtggagtcctgcttttgtcattagttatcacactgtactgcaaccatcgtaatcgccggcgagtgtgcaagtgcccacgtcctgttgttaagagtggtgataaacctagcctaagtgctcgctacgtttag

SEQ ID NO: 23449 - DNA, 597 bp, Artificial Sequence
  Description of Artificial Sequence: Synthetic coding sequence
atggccctgcccgtgaccgccctgctgctgcccctggccctgctgctgcacgccgcccgccccagccaatttcgagtctcaccactcgaccggacgtggaacctcggagaaactgttgaactgaagtgtcaggtgctactgtctaaccctaccagcggctgttcttggctgttccagcccagaggagcagcagcctcccctacgtttctgctgtacttatcccaaaacaagccaaaagcagcagagggcctggacacccaacgctttagcggcaaacggctgggagacacgttcgttcttactctgagcgatttccgcagggagaatgaaggttactacttttgttcggccctctccaatagcattatgtatttcagtcatttcgtgcccgtatttttacccgctaagccaacaacaacacccgctcctcgccctcctacaccggctccaacaatcgctagccagccgctgagtctccggcctgaggcatgccggcccgctgccggcggagcagggaacaggcggagggtgtgcaagtgcccacggcctgtggtcaagtcgggagacaagcccagtctttctgcgagatatgtatag

SEQ ID NO: 23450 - DNA, 831 bp, Artificial Sequence
  Description of Artificial Sequence: Synthetic coding sequence
atgcggaaccaggcccccggccggcccaagggcgccaccttcccccccagacgacctacaggctccagagcaccccccctggctccagagttgagagctaagcagcgccctggggaacgcgtgatggcactaccagtcacagccttgctgctcccactcgcattactcctgcatgcggcacgcccgagtcaattccgtgtctctcccctcgatagaacttggaatctcggagagaccgttgaacttaaatgccaggtcctgctttcaaatccaacatctggttgttcctggttattccagcctagaggcgctgctgcaagtcccacattcttactctatctgagccagaataagcccaaagcagccgaggggctcgatactcagaggttttccggtaagcgcttgggtgacaccttcgttcttactctttccgatttcagaagagaaaatgagggatattatttctgcagcgccctttccaatagcattatgtacttctcccattttgtaccagtgttcctgcctgcgaagccaacaaccactcctgcccctcgtccacccaccccagcccctactatcgcttcacagccattgagcttgcggccagaggcctgtagacctgccgcaggcggtgccgtccacactcgcggattggatttcgcctgtgatatttatatttgggcaccactagccggcacgtgcggtgtgcttctgttatcattagtaattaccctctattgtaatcacaggaatcggaggcgagtttgcaaatgcccacgaccagtggtgaaatcaggcgataagccttccctgtctgcccgctatgtgtag

SEQ ID NO: 23451 - DNA, 240 bp, Artificial Sequence
  Description of Artificial Sequence: Synthetic coding sequence
atgagccacaagcagatctactacagcgacaagtacgacgacgaggaatttgagtaccgacacgtgatgctgcctaaagatattgccaagctggtccctaaaacccacctgatgagtgagtcagaatggcggaacctgggcgtgcaacagtcacaagggtgggtacactacatgattcatgaacccgagccccacattttgctctttaggcggcccttacccaaaaaacccaaaaagtag

SEQ ID NO: 23452 - DNA, 204 bp, Artificial Sequence
  Description of Artificial Sequence: Synthetic coding sequence
atgagccacaagcagatctactacagcgacaagtacgacgacgaggaattcgaatatcgccacgtgatgctgccgaaggatattgctaaactggtgcctaagactcacttgatgagcgaatccgagtggcggaacctaggcgtacagcaatcgcagggctgggtccattatatgatccatgaacccgggcagtgcacagggtag

SEQ ID NO: 23453 - DNA, 192 bp, Artificial Sequence
  Description of Artificial Sequence: Synthetic coding sequence
atgcggacccggcacgtgatgctgcccaaggacatcgccaagctggtgccaaagacccatctgatgtccgagagcgagtggcgcaacctcggagtgcagcagtcccagggttgggtgcactacatgattcacgaacccgagcctcacatcttactgttccggcggcctctgcctaagaaacctaagaagtag

SEQ ID NO: 23454 - DNA, 240 bp, Artificial Sequence
  Description of Artificial Sequence: Synthetic coding sequence
atggcccacaagcagatctactacagcgacaagtacttcgacgagcattacgagtaccgccacgttatgctccccagagagctgagcaagcaggtgcctaaaacacacctgatgtcagaggaagaatggcgaagacttggcgtgcagcagtcattgggttgggtacattacatgatacacgaaccagagcctcatattcttttgtttagacggccccttcccaaggatcagcaaaagtag

SEQ ID NO: 23455 - DNA, 1533 bp, Artificial Sequence
  Description of Artificial Sequence: Synthetic coding sequence
atgcaccccctgcagtgcgtgctgcaggtgcagcggagcctgggctgggggccactggcctccgtgtcttggctgagtttacgcatgtgccgggctcactcttcactaagtagcacgatgtgccctagccctgagcgacaggaggatggcgctaggaaggacttctcatcacgactggctgccggccccacatttcagcacttcctgaagagcgcctccgccccccaggaaaaacttagcagcgaggtggaggatcccccaccttacttgatgatggacgagctgctcgggcggcagagaaaggtatatttggagacatacggttgtcagatgaacgtgaacgacacagaaatcgcctggtctatattacagaaatcgggctatctgcggacgtccaaccttcaggaggcagacgttatcctgctggttacgtgttctattcgggagaaggcggagcaaacaatttggaaccgtctgcatcagctgaaagcactgaagacacggcgtcctaggtcaagagtaccattgcggataggcattctgggctgcatggctgagaggttgaaagaagagattttaaaccgggagaaaatggtagacattcttgctggccccgacgcataccgggatctaccccgacttctggctgtggctgagagtggccagcaggcagcgaatgtcctcctttctctggatgagacgtacgctgacgtgatgcctgtgcaaacttcggccagcgccacatctgcctttgttagcataatgagaggctgtgataacatgtgttcttattgcattgtacccttcacccgagggcgagagagaagtcgtccgatagccagcattctcgaagaggtaaaaaagctgtcagaacaagttctgcaacttatacacgagcgggacaacatttgcaagcagattcatttgccagctcagtcaggcagctctcgcgtacttgaagctatgaggaggggatacagccgagaagcctacgtggaactggtacaccacatcagggaatcaatacccggcgtgtccctgagttccgattttattgccggcttctgcggagagaccgaggaagaccacgtgcagactgtctccctacttcgtgaagtgcagtataatatgggctttttgttcgcctacagcatgcgccagaagaccagggcttatcatagactgaaggatgacgtacccgaggaggtcaagctaaggcggttagaagagctcatcactatcttccgggaggaagcgactaaggcgaatcagacctccgtgggttgtacccagctcgttcttgtcgagggcttaagtaaacgctccgctacagatctgtgcgggcggaatgacggtaacctgaaagtaattttccccgatgcagagatggaggacgttaacaacccagggttgcgcgtgcgtgctcagcctggcgactacgtcctggtgaagatcacatccgcatccagccaaacacttcgaggtcacgtgctgtgtcgcacaaccctaagggacagctccgcgtactgctag

SEQ ID NO: 23456 - DNA, 1764 bp, Artificial Sequence
  Description of Artificial Sequence: Synthetic coding sequence
atgcaccccctgcagtgcgtgctgcaggtgcagcggagcctgggctggggccccttggcaagcgtctcatggctgtccctgcgcatgtgtcgagctcacagttcccttagctcaaccatgtgtcccagtcccgaacggcaggaagacggcgccaggaaggatttcagttcacgcctcgcagctggccctacattccagcacttcttgaagagcgctagcgccccccaggagaagttatcttcggaggtggaggacccacccccttaccttatgatggacgaactcttaggaagacagcgtaaagtgtacctggagacgtacgggtgccagatgaacgttaatgatacagaaatcgcgtggtccatcctgcagaaaagcggatatcttagaacaagcaatcttcaggaagcagatgtgatcttgttggtaacatgctctatccgggagaaggctgaacagacaatatggaatagacttcaccagctcaaagctttgaagacccgcaggcctagaagtcgggtgcccttgcgtattggaattttagggtgcatggccgagaggttgaaagaggaaatcctgaatagagagaaaatggtggacattctggcaggacccgatgcctacagagatctgcccagattactcgcagtcgccgagtccgggcagcaggcggccaatgtactcctttcactggacgagacatatgccgatgtcatgccagtgcagacctcagcgtcagctacctcagcatttgtaagtatcatgcggggctgcgataacatgtgctcctactgcatcgtgcccttcacacgcggtagagagaggtcaaggccgattgcatctattctggaggaggtgaagaagcttagcgagcagggcctcaaggaggtcacccttctgggccagaacgtgaacagctttcgagacaactcagaagtccagttcaacagcgctgtacccaccaatctttcacggggtttcaccacaaactataaaaccaagcagggcggccttcggtttgcccacctgctcgaccaggtctcaagggtggacccggagatgaggattagattcacctctccacaccccaaagactttcctgacgaagtcctgcagttgatccacgagagggataatatctgtaaacaaattcacctccccgcccagagtggcagctctcgggtccttgaggcaatgaggaggggatatagcagggaggcgtacgttgaactcgtacaccatatcagggagtcaatacctggcgtgtccctatctagtgactttatcgccggtttctgcggtgaaaccgaggaagatcacgtgcaaactgtctctctgctcagagaggtacagtataatatgggttttctgttcgcatattccatgcgtcagaagacaagggcctatcatcggctgaaggacgacgtccctgaggaggtcaaactgcgcaggcttgaggaattgattaccatcttcagggaagaagctaccaaggccaatcagacctccgtcggttgcacccagttagtactcgtggagggactctcaaaaagaagtgcgactgacctttgcggcagaaatgacggtaatctgaaggtcatctttcctgatgctgaaatggaagacgtgaacaaccctggactgcgtgtgcgggcgcaaccaggcgactacgtgttggtgaagatcacttctgcctctagtcagacactgagagggcacgtgctgtgcagaacaactctgcgcgattcctctgcctactgctag

SEQ ID NO: 23457 - DNA, 1806 bp, Artificial Sequence
  Description of Artificial Sequence: Synthetic coding sequence
atgcaccccctgcagtgcgtgctgcaggtgcagcggagcctgggctggggtcccctggcctccgtcagctggcttagcctgagaatgtgtcgagcgcattccagtctctctagcacaatgtgcccctccccagaacgccaggaggacggcgcgagaaaggacttctcgtcaaggctggcagcaggaccgacttttcagcacttcttaaaatctgcttcagccccacaggaaaaactcagctctgaggtggaagaccctccaccatatttaatgatggacgagttactgggccgccagcgtaaggtgtacttggagacgtacggatgccagatgaatgtcaatgacacagagatcgcttggtccattctacaaaaatctgggtacctgaggaccagcaatcttcaggaggccgatgtcatcttgctggtcacctgcagcatccgggagaaggctgaacagacaatctggaatcggctgcaccagctgaaggcacttaagacccggcgtcctcgaagcagggtccccctcagaattggcatactcgggtgcatggccgagagactgaaggaggaaatcctgaaccgcgagaagatggtggacatcctcgcaggcccagacgcctacagggacctcccgcgcctgctcgccgtggccgaatccgggcagcaggctgccaacgtacttctgtctctggacgagacctacgccgacgtgatgcccgtgcagacgtcagcttcagccacaagcgcctttgtgtccatcatgaggggatgcgataacatgtgttcctattgcattgtcccttttacacggggcagggaaaggtccagacctatcgccagcattttggaggaggtaaagaaacttagtgagcaggtgtttcttccacccagacccccaaaggtgttggggcttcagggcctgaaggaagtgactctgctgggacagaacgtaaacagcttccgagacaattctgaggttcagttcaactctgcggtgcccaccaatctgagtagaggatttaccaccaattacaagactaaacaaggcggccttaggttcgctcatcttctggatcaggtctccagggtggatccggagatgcggattaggttcacatcaccccatccaaaggactttcctgacgaggtactgcagctgatccacgagcgtgacaacatctgtaagcagatccatctgcctgcccagagcggctcttccagagtactggaggcgatgcggcgggggtattccagggaggcgtatgtggagctggtgcaccatatcagagagagcatcccgggtgtcagtctttcatctgactttattgctggcttctgtggtgagaccgaggaggatcatgtgcagacggtgtcgttgctgagggaagtgcaatataacatgggattcctgtttgcatatagtatgcggcagaagacacgcgcataccatagattgaaggacgatgtgcccgaggaagtaaaactgagacgcctcgaagagctgataaccattttcagggaggaggcaacaaaggcaaatcagacgtcagttggctgcacccagctggttctggtggagggtctgtcaaagcgctcagctaccgacctctgcgggaggaacgacgggaacctaaaagtgatctttcccgatgcagagatggaggacgtaaacaaccctggacttagggtgcgtgcccaacccggcgattacgtactcgttaaaataacatctgcctccagccagacccttaggggacatgttctttgtaggaccacactaagggactcgtccgcttactgttag

SEQ ID NO: 23458 - DNA, 984 bp, Artificial Sequence
  Description of Artificial Sequence: Synthetic coding sequence
atgaacgtgaacgacaccgagatcgcctggagcatcctgcagaagagcggatacctccgcacttccaacctccaggaggccgacgtgatccttctggtgacttgctccattagggaaaaggcagaacaaactatctggaacagactgcatcagctgaaagcactcaagacgcgacggccgaggagccgagtcccactccggatcggcatcctgggttgcatggccgagaggctgaaggaggagatcttaaaccgggagaaaatggtggacatcctcgcaggcccagatgcctatagagacctgccacgtctactcgctgtagcggaatccggtcagcaagctgcaaacgtcctcctctcactggacgagacttatgccgacgttatgcctgtgcagacatcggcttcagctacctccgcttttgtgtacagccgggaagcctatgtcgagctcgttcaccacatccgggaatccatcccaggggtttccttaagctctgatttcatcgccggcttttgcggggaaaccgaagaagaccatgtgcaaaccgtcagtcttctgagagaggtccagtataacatgggctttctgtttgcctatagcatgcgacagaagacacgtgcttaccaccggctgaaagatgacgttcccgaagaggtcaaactgcggaggctcgaggagctgataaccatctttagggaagaggccactaaggcaaaccaaacctctgtcggatgtacccagttagtccttgtggagggtttgagcaaaagaagcgctactgatctttgcggcagaaatgacggcaatctcaaggtgatcttcccagatgccgaaatggaggatgtcaacaatccaggcttgcgcgtgagggcgcagcctggcgattacgtgctggtcaagattaccagcgcctcttctcagaccttgcgtggtcacgtgctctgcaggactaccctgagagacagctctgcctactgctag

SEQ ID NO: 23459 - DNA, 1494 bp, Artificial Sequence
  Description of Artificial Sequence: Synthetic coding sequence
atgatggacgagctgctgggccggcagcggaaggtgtacctggagacctatgggtgtcagatgaacgtcaacgacactgaaatcgcatggagcattcttcaaaagtctggatacctcaggaccagtaatcttcaggaggctgacgtgattctgttggtgacctgtagcatcagggagaaggccgagcagacgatctggaatcgcctgcatcagctgaaagctctgaaaactcgaaggcctcggagccgggtgccattgcgtataggaatcttgggctgtatggcagagcggttgaaggaggaaattcttaatcgcgagaaaatggtcgacattctagctggccccgatgcctaccgggatctgcctaggttgctggccgtggctgagtcagggcagcaggctgctaatgtgctactgagcctcgacgagacttatgctgacgtaatgccagtacaaaccagtgccagcgcgacatctgcttttgtctcaatcatgagggggtgcgacaacatgtgctcctactgtatcgtccctttcacgcgcggcagggagcggtctcgcccgatcgcttccatcctcgaggaggtaaaaaagctctccgagcaggggcttaaagaggtcacccttttagggcagaatgtgaattcattccgggataactccgaagttcagttcaacagtgccgtgcctaccaacctcagccgtgggttcacaaccaattacaaaaccaaacaaggaggcctgcggtttgcccaccttctggatcaggtcagccgtgttgaccctgagatgcgcatcaggttcaccagcccccaccctaaggacttccctgatgaggtcctccagctgatacatgagcgggataacatttgtaaacagatccatctgccggctcagagtggatcttctcgggttctcgaggctatgcgtcgtggatactctcgggaggcgtacgtggagcttgtgcaccacatcagggagtcaatcccaggcgtgtccctcagctctgatttcatcgctggattttgtggcgaaacggaagaagaccacgttcagaccgtaagtcttttgcgagaggtccagtacaacatgggcttcctgttcgcttatagcatgcggcaaaagacccgtgcttaccaccgcctaaaggacgacgtaccagaagaagttaaactgcggcgcctggaggagctaatcacaatttttagagaagaggccacgaaggctaatcagacatcagttggctgcactcagctggtgctggttgagggactgagcaagcgaagtgcgactgatctctgtggtcgtaatgatggcaacttaaaggtgatttttccagatgccgagatggaagatgttaacaatccaggactgcgggttcgggctcaaccaggcgactacgtgctcgttaaaattaccagtgcatccagtcagacactccgggggcacgtgctgtgcaggaccacgctaagagattcctcagcctattgctag

SEQ ID NO: 23460 - DNA, 1281 bp, Artificial Sequence
  Description of Artificial Sequence: Synthetic coding sequence
atgcaccccctgcagtgcgtgctgcaggtgcagcggagcctgggctgggggcccctggcatccgtatcctggctgtccctgagaatgtgcagagctcattctagcctttcgagcaccatgtgtccaagtcccgaaagacaggaggatggcgctcggaaagacttcagttcgcgtctggctgctggccccacatttcagcactttctgaagtccgccagcgcccctcaggagaaattatcttctgaagtagaggacccacccccctacctgatgatggatgaattgcttgggcggcagcggaaggtgtacctagagacatatggttgtcaaatgaatgtcaacgataccgagatagcctggagcatcttgcagaaatccggatacctccggacgtccaacctgcaggaggccgacgtaattttactggtcacttgctctatacgagaaaaggctgaacagaccatatggaacaggctacaccagctgaaggcccttaagacaagaagaccacggtcacgagtgcctctgaggattggaatactcgggtgcatggcggagaggctgaaggaggagatcctgaatcgcgagaagatggtggacatcctcgccggtcccgacgcttatcgcgacctgcccaggctgctcgccgttgcagagtccggacagcaagccgccaacgtcctgttgtctctcgatgaaacctatgctgatgttatgcccgtccagacaagcgcctccgccacctcagcattcgtgagcatcatgaggggctgtgacaacatgtgttcttactgtatcgtacccttcacacggggaagagaacgatctcggccgattgccagcatcctcgaggaagttaaaaagctgagtgaacaagggctgaaagaggtaactctcctcggccagaatgttaatagtttccgggacaactccgaagtccaattcaactccgccgttcccactaacttgagccgcggctttaccactaactacaagaccaaacaaggcggcctgagatttgcacacctgctggatcaagtaagccgagtggaccccgaaatgcggataagattcacgagtcctcatcctaaagactttcctgatgaagtcctgcaactaatacacgagagggataatatttgtaagcaaattcatttgcctgcacagtctggatcatcccgggttctggaagcgatgagaaggggatactctcgcgaagcctacgtagaactcgttcaccacatacgcgagtccatcccagaagataccgggattagctag

SEQ ID NO: 23461 - DNA, 1122 bp, Artificial Sequence
  Description of Artificial Sequence: Synthetic coding sequence
ggcgacggccagaacctgttcaccaaggacgtgaccgtgatcgagggagaggtcgccaccatcagctgccaggtcaacaagagcgacgactccgtgattcagcttctgaaccccaatcgtcagacaatctatttcagagacttccgacccctcaaagactcacgcttccaattgctgaacttctctagctctgaacttaaagtgagccttaccaatgtgtccattagtgatgaggggaggtacttctgccagctgtatacagatccgccccaagaatcttacactactatcacagttttagtccccccgagaaatctaatgattgacatacagaaggataccgcagtcgaaggagaagaaatcgaggtcaattgcaccgcaatggcgagcaagccagctaccacaatcaggtggtttaagggtaatacagagctgaaaggtaaaagcgaagtagaggagtggtcagatatgtacacagtaactagccaactgatgctgaaggttcacaaggaggatgatggcgtgcccgttatctgccaggtggaacatccagcggttaccggcaacctccagactcagaggtatctcgaagtacaatacaaaccacaagttcacattcagatgacctatcctctgcagggccttactagagagggtgacgcactcgagctaacatgcgaggccatcggcaaaccacagcctgtgatggtgacctgggttcgagtggacgacgagatgcctcagcacgcagtgctgtcagggccgaacttgttcatcaataacctcaataaaactgataacggtacctaccgatgtgaagcatctaatattgtagggaaagctcacagcgattacatgctgtacgtgtatgattcgcgagcaggagaggaaggttccattcgcgccgtcgatcatgcggtgataggcggggtggttgctgtcgtggtttttgctatgctgtgcttgttgatcatcctcggccgttactttgcaagacataaaggcacctacttcactcatgaggccaaaggagctgacgatgccgccgatgccgataccgctattattaacgccgaaggaggacagaacaactcagaagagaagaaggagtactttatctag

SEQ ID NO: 23462 - DNA, 1329 bp, Artificial Sequence
  Description of Artificial Sequence: Synthetic coding sequence
atggccagcgtggtgctgcccagcggcagccagtgcgccgccgccgccgcagcagccgcacctccaggtttaagactgcgtctgctattactgttattcagcgctgctgctctcatccctacaggggatggccagaatttgttcactaaagacgttactgtgatcgagggggaggtcgccactatcagctgtcaagtgaataagagtgacgacagtgtcattcaactgctcaacccaaatcggcagaccatttacttcagggacttcagacccctcaaagattcacgattccagctcctcaatttctcctccagcgagctgaaggtctctcttaccaacgtgagcataagcgatgaggggcgctacttttgccagttatacacagatccacctcaggagtcctacaccaccatcactgtcctcgttccgccaagaaacctcatgatcgacatccagaaagataccgcagtggaaggagaggaaatagaagttaactgtacagccatggcaagtaaacccgctacaacaattaggtggttcaagggaaataccgagttgaaaggtaagtcggaggtcgaagaatggagtgatatgtacaccgtgacatctcagctgatgctcaaggtacataaagaggacgacggggtaccggtcatttgtcaggtggaacaccctgcagtcacgggcaacctgcagacccaacggtatctggaggtccagtacaagccacaggtgcatatccagatgacctaccccctacaagggctgactcgggagggagacgctctggaactgacatgtgaggcaatagggaagccacagccagtgatggttacctgggtacgtgtcgatgacgagatgccacagcatgccgttctgtctgggcccaatctgtttatcaacaacctgaataagactgataatggaacctatagatgcgaggcctcaaatattgtcgggaaggcacattccgactatatgttgtatgtgtacgacccgcccactaccatcccgcctccaactacaacaacaacaactacgacaaccactaccacaacaatactgactatcataaccgatagcagagcaggtgaggagggttccatccgggctgtggatcacgcggtgatcgggggggtggtcgctgtggttgtgttcgcaatgctctgcctgctcataatattggggcgctattttgcgagacacaaaggaacatattttacacatgaagccaaaggggcagatgacgcggctgacgcagacacagccatcatcaatgcagagggcgggcaaaacaacagtgaagaaaaaaaagaatatttcatctag

SEQ ID NO: 23463 - DNA, 384 bp, Artificial Sequence
  Description of Artificial Sequence: Synthetic coding sequence
atgctgtacgtgtacgacccccccaccaccatccccccccccaccaccaccactaccactacgacgaccaccactactacaattttgactattatcaccgacaccaccgctaccacagagccggcagtccacgacagccgcgcaggcgaggagggcagtatcagagccgttgaccacgccgtgatcggtggtgtggtagccgttgtggtatttgcaatgctgtgtctgctgatcattctggggcggtactttgccagacacaaaggcacctactttacccacgaagctaaaggcgctgatgatgccgcagatgccgataccgctatcataaacgcggaaggtggtcagaataattctgaggagaaaaaggagtactttatttag

SEQ ID NO: 23464 - DNA, 1245 bp, Artificial Sequence
  Description of Artificial Sequence: Synthetic coding sequence
atggccagcgtggtgctgcccagcggcagccagtgcgccgccgccgcagccgcagctgcacctccagggctacggctaagactcctcttactgctgttttccgccgctgcactgattcccaccggagacggccaaaatctgttcacaaaggacgtgacagtcatcgaaggtgaagtggccactatcagttgtcaggtgaacaagagcgacgattccgttattcagcttctgaatccaaacaggcagacaatttacttccgagattttcgtccccttaaggacagtcgcttccagttactgaatttcagctcctccgagctcaaggtgagcttgacgaacgtgtctatctctgacgaggggaggtacttttgtcagttgtacaccgatccgcctcaagaaagctacacaaccatcaccgtactcgtccctccccggaatttgatgattgatatccaaaaagataccgccgtcgagggcgaagagattgaggtgaattgcacagcaatggcgagtaaacccgccactaccattcggtggttcaaaggaaacacagagctgaagggcaagtcagaggtggaagagtggtctgatatgtatacagtcacgagccaactgatgctgaaagtccataaagaggacgacggcgtcccagtgatctgtcaggtggaacaccccgctgtgactggcaatttacagacccagcgatacctcgaggttcagtacaagcctcaagtgcacattcagatgacctaccctctgcaggggctgacccgggagggagatgccctggagctgacctgtgaagctattgggaaaccccaacccgtgatggttacctgggtccgtgtcgatgacgagatgccccagcatgccgttctcagtggtcccaacttattcattaataatcttaataagactgacaatgggacgtaccggtgtgaggcctcaaacatcgtgggcaaggctcattctgactatatgctgtatgtgtacgactctcgcgcaggggaggaagggagcatcagggccgtggatcacgcggttatcggcggagtcgtggccgtggtagtatttgccatgctctgcctcttgatcatcctgggccggtactttgcccggcacaaaggtacttacttcacccacgaggccaaaggcgctgatgatgctgccgatgccgacacagcaatcattaacgccgagggcggccagaataactcagaagagaagaaggagtacttcatctag

SEQ ID NO: 23465 - DNA, 5346 bp, Artificial Sequence
  Description of Artificial Sequence: Synthetic coding sequence
atgaccacctaccgggccatccccagcgacggcgtggacctggccgcttcctgtggcgctcgggtgggtgacgtgttaccaggcccacacactggggactacgctcctctcggcttctgggctcagaacggttctatgtcacagcccctaggcgagagtccggcaaccgcaactgccacggcaacagcaacaacacgcccaagcccaaccactcctgcgatgccgaaaatgggggttcgtgctagggtcgctgactggccccccaaacgggaagctttgcgcgaacacagcaacccctccccatctcaagacacagacggtaccaaagctactaaaatggcacattcaatgaggagcatccagaacgggcagccccccacttctacaccggcttcttccggttccaaggcctttcaccgtctgagtagacgacgcagcaaggacgtggagttccaggacgggtggccgaggtctcctggccgggccttcctgccactgagacacagatcaagctcggagattacactcagtgagtgtgacgccgaagatgccggtgaacctcgaggcgcaagacacaccggagcattaccccttttccgcgagtatgggtctacaagtagcattgacgtgcagggtatgcctgagcaaagtttcttcgatatccttaacgaattcaggtctgagcaacctgatgctcggggttgccaggccctgaccgagctcctccgcgcagatcccggcccacacttgatgggaggaggcggcggggcaaagggtgactcccataatggccagccggccaaggattctctgctccctttacagcccacaaaggagaaagagaaggcacggaaaaaaccagccagaggcctcggaggcggggataccgtcgatagttccatcttcagaaaactgcgcagctctaagcctgagggggaagctggaaggtctccgggggaagcagacgaagggaggtctccgcccgaagcttcccggccatgggtgtgtcaaaaaagcttcgctcatttcgacgttcagagtatgctgtttgatttaaacgaggcggccgcaaacagggtgtcagtgtctcagaggcgaaacaccacaacaggtgcttcagctgctagtgccgcgtccgcaatggcttctctgacagcctctagagctcacagtctcgggggtctggaccctgctttcacgagtacagaggacctgaattgtaaagaaaatctcgagcaggatctgggagatgacaatagcaacgatctcctgctctcatgcccacacttccgtaacgagatagggggagaatgtgaacggaatgtgtcattcagtagggcatcagtggggtcacctagtagcggtgaggggcacctagctgaacctgcgcttagtgcctaccgcacaaacgcctccatttcagttctcgaagtgcccaaagaacaacagaggacgcaaagccggccacgacaatacagtatagagcacgtggatctgggggcacgctactaccaggactattttgtcgggaaggagcatgcaaactattttggcgtagatgagaaacttggtcctgtcgccgtgtccatcaagcgggagaagctggaggatcataaggagcacgggccccagtatcagtacagaataatctttagaactagggagctcattacacttaggggttccatcctggaggacgcaacccccaccgctacaaagcatggcaccggacgcggattaccactgaaagacgccctcgaatacgtaatcccagagcttaatatccactgccttcgattggcgctgaatactcctaaggtgaccgaacagctgctcaaacttgacgaacagggtttgtgtcgaaagcacaaggtcggtattctttattgcaaggccgggcagtccagtgaggaggagatgtataataatgaagaagccggccccgcatttgaagagttcctctctcttattggtgagaaggtgtgtcttaaagggttcacaaagtacgctgcgcaattagacgtgaaaactgactcaaccggcactcactccctgtacacaatgtaccaggactatgagatcatgtttcacgtaagtacactgctgccatacactcctaacaataggcagcagctgctcaggaagcgccatattgggaacgatattgtgacaataatttttcaggagcccggggcgctgccatttactcctaaaaatatcagaagccattttcagcatgtcttcatcatcgttagagtgcataatccttgcactgacaacgtctgctactctatggccgttacgagatctaaagacgcccctccgtttgggccgcccatacctagcggaacaacatttagaaagagtgacgttttccgcgattttctgctggcaaaagtcattaacgcagaaaacgccgctcataagtccgataagttccatacaatggccacacgaactagacaggagtatcttaaagatctggctgaaaactgtgttagtaacaccccgatcgattctactggaaagttcaacttgatttcccttacttcaaaaaaaaaagagaagaccaaggcgagggccggtgcagagcagcactctgcaggggctattgcttggcgcgttgtcgcacaggactatgcgcaaggcgtagaaatagactgtatcttaggaatctctaacgaatttgtggtgctcttggacctgcgcaccaaagaagtggttttcaattgttactgtggggatgttatcggctggacaccagatagcagcactttgaagatcttttatgggcgcggcgatcatatctttttgcaggcaactgagggaagcgtagaagacattagagagatcgtccaaagactgaaggtgatgacctcagggtgggagaccgtggacatgacactgaggcgtaatgggctcgggcagctgggattccacgtaaagtacgatgggacagtggcggaggtagaggattatggctttgcttggcaggctgggctgaggcagggttccaggttagtggagatttgtaaagtggctgtagtgacattaacccatgaccaaatgatcgatctgctgaggaccagtgtgacagtcaaagttgtgattataccccctttcgaggacggcacgccacggagaggatggcccgagacctatgatatgaatacctctgagcccaagacagaacaagaaagcataacaccaggtggccgccccccttacaggtccaacgctccttggcagtggtcggggcccgcctcccataatagtcttcccgcgagcaagtgggccacacctacaaccccaggacatgcacagtcgctgtcaagaccgctcaaacagacacctatcgtaccattccgcgagagtcagccactacatagtaagaggccggtgtcctttcccgagaccccctacaccgtttcacccgccggggccgacagggtgcctccttaccgacagccctctgggtctttttcaacgcccggtagtgccacttatgtccgatataagccctccccagagcggtacaccgctgccccccacccgctcttgagcctggatccccatttttctcatgatggtacatcttctggcgactcaagcagtggcgggctgacctcccaggagagcaccatggagaggcagaaaccggaaccgctgtggcatgttcccgcccaagcaaggctgagcgccatcgctgggtcctccggcaacaaacatccaagccggcaagatgctgctggcaaagattcgcctaatcggcattccaaaggggagcctcagtatagtagccatagctctagtaatactcttagctcaaacgctagtagctcacattctgatgataggtggttcgaccccctggatcccctagaacctgagcaagatcctctgtctaagggaggttctagcgatagcggcatcgacacgaccctgtatacatcttccccaagctgtatgagcctcgccaaggctccgagaccagccaagccccacaagcctccaggctctatgggactatgtgggggcgggcgagaggcagccggccggtctcaccatgccgacaggcggagagaggtcagtcccgcccccgccgtggccggacagagcaaggggtatcgcccaaagctgtacagcagcggatctagcacacctactggcctcgccggcggctcaagggatccccctcggcagcctagtgacatgggctcccgggtcggttaccctgctcaagtctataagactgccagtgctgaaacacctcggccgagccaactggcccagcctagtccattccaactttccgcatccgtgccgaagtcatttttttctaagcagcccgttcgcaataagcacccaacaggctggaagcggaccgaggagccaccccctcgccctctgcccttcagcgatccaaagaagcaggtcgacaccaacactaagaacgtctttgggcagccaagacttcgcgcctcactgagggacctgcggtctccaagaaaaaactacaagtctaccatcgaagatgacctgaagaagctgatcatcatggataacctcggacctgaacaagaacgagacacaggacagtcccctcaaaagggactgcagagaactttaagcgacgagagcctatgtagcgggcgtcgtgagccctcattcgcatcccctgctgggctcgagcccggtctcccatctgacgtcctgtttacatctacctgtgcgtttcctagcagcaccctccccgcacggcgacagcaccagcatcctcaccctcctgtgggaccaggtgccacccccgcagctggatcaggctttcccgaaaagaagagcactatctccgcgagcgagttatcactggccgatggaagagaccggccattacggcggctggaccctggtttaatgcccctgcccgacactgccgcaggtctggaatggtcctccctggtgaatgcagctaaggcctatgaggtgcagcgcgccgtcagcctgttcagcctgaatgaccctgcgttaagcccagatatcccacccgctcattcacctgtccatagccacttgtcactagagagagggcctcccacaccgaggactaccccgacgatgagtgaggaaccaccccttgatctgaccggaaaagtttatcagttggaggtcatgttgaagcagttgcatacggatctacagaaggagaagcaagacaaggtggtcctgcagtctgaggtagcaagcctgagacagaacaaccagagactgcaggaggagtcccaagctgccagcgagcagctgagaaagttcgccgagatattttgccgcgagaaaaaggagctatag

SEQ ID NO: 23466 - DNA, 660 bp, Artificial Sequence
  Description of Artificial Sequence: Synthetic coding sequence
atggaggccgcccgggactacgccggcgccctgatccggcccctgacattcatgggcagccagactaagcgggtcctttttacccctctgatgcaccctgcacgcccatttcgggtaagcaatcacgatcgctctagccgaagaggcgtgatggcttccagcctgcaggagctgatctctaagaccctggatgcgcttgtgatagcaaccggtctggtgaccctggtgctagaggaggatgggaccgtggtggatacagaggagttctttcagacattgggagataatacacattttatgatcttggaaaagggtcagaagtggatgccgggatcccagcacgtgccgacatgctcccctccgaaacgatccggtattgcacgcgttacctttgacctctatcggctcaatccaaaagacttcattggctgtctcaatgtgaaggcaacgatgtacgagatgtactccgtgagttacgacattcgatgcacaggcctgaaggggttactccggtcattattgaggtttctaagttatagcgcacaagtgactggacagtttctgatctacctgggtacatatatgttacgggtcctggatgacaaggaagaacggccttcactcagaagccaggctaaggggcggttcacatgtggctag

SEQ ID NO: 23467 - DNA, 660 bp, Artificial Sequence
  Description of Artificial Sequence: Synthetic coding sequence
atggagtacctgagcgccctgaaccccagcgacctgctgcggagcgtgagtaacatcagctcagaatttggcagacgggtatggacatcagcgcctccaccccagagaccatttcgagtgtgcgaccacaagcggacaattaggaaaggactcaccgcagctaccagacaagagctgctggccaaggcccttgagactctcctgctgaatggcgttttgacactggtccttgaagaagacgggacagcagtcgattctgaagacttctttcagctgttggaggacgacacgtgcttaatggtgctccagtcagggcagtcatggtctcctacaagaagtggggtgctgtcatatgggctgggaagggagaggcccaaacatagtaaagacatcgccaggttcacattcgacgtgtacaagcagaacccaagggatctcttcgggagtttgaacgtaaaggctaccttctatggcctgtacagtatgagttgcgatttccagggtctgggacccaagaaagtcctgcgtgagcttcttagatggacaagtacactgttgcaaggcttaggtcatatgctgctgggcattagcagtacattacgacatgccgtcgaaggagccgaacagtggcagcagaaggggcggctgcattcttattag

SEQ ID NO: 23468 - DNA, 660 bp, Artificial Sequence
  Description of Artificial Sequence: Synthetic coding sequence
atggagtacctgagcgccctgaaccccagcgacctgctgcggagcgtctccaacatctcatctgagtttggtcggcgtgtctggaccagcgcccctcctccgcagaggccattccgcgtttgcgatcataaacgcacaattcggaaaggtttaacagcggccactcgccaggaactgcttgctaaggctcttgagactctgttgttgaatggcgtgctgaccctagtgcttgaggaggacggtactgcagtcgacagtgaagacttttttcaactgctcgaagacgatacgtgcctcatggtgctgcagtctggtcagagctggagccccacccggtctggggtgttgtcctacggcctggggagagaacgccccaagcactccaaggacatcgcgcgctttactttcgatgtttacaagcaaaatcccagggacctttttggcagcctgaatgtcaaagctaccttctatggcttgtacagtatgagctgcgacttccagggacttggaccgaagaaagtcctgcgggagcttctgagatggacgtcaacattgctacagggccttggacacatgcttctcgggatttccagcactttaagacacgctgtagaaggggctgagcagtggcagcaaaaaggcaggttgcattcttattag

SEQ ID NO: 23469 - DNA, 660 bp, Artificial Sequence
  Description of Artificial Sequence: Synthetic coding sequence
atggagtacctgagcgccctgaaccccagcgacctgctgcggagcgtcagcaatattagtagtgaatttggcagaagggtatggacatcagcacctccgcctcagaggcccttccgcgtatgcgaccataagcgtacaattcgaaagggcctgactgctgctacccggcaggagttactagccaaggcactcgaaactctcctgttaaacggtgtccttacactggtgttagaagaagatggtacagcggtagacagcgaggatttcttccaactccttgaagacgacacatgtctcatggtgctgcagagcggtcagagctggtcaccaacacggtctggggtgctgtcctatggccttggccgggagagacctaaacacagcaaagacatcgctagattcacatttgacgtctacaaacaaaaccctcgcgatctctttggcagcctgaacgttaaagcaactttttacgggctatactcaatgagctgtgatttccagggactgggcccaaagaaggtcttacgggagctcttacgctggaccagcacattgctccagggtctgggacacatgctgctcggtatcagctctacactcaggcacgctgtggaaggcgcagaacagtggcagcagaaaggccggctgcactcttattag

SEQ ID NO: 23470 - DNA, 660 bp, Artificial Sequence
  Description of Artificial Sequence: Synthetic coding sequence
atggagtacctgagcgccctgaaccccagcgacctgctgcggagcgtgtctaacatctcctcagaatttgggcgtcgcgtctggaccagcgcccccccccctcagagaccatttcgagtgtgtgaccataaacgcacaatcaggaagggcctgactgccgctaccagacaagagctgctggctaaggccctcgaaacacttcttctgaacggcgtgctgacattggtgctggaggaggacggcactgctgtggacagcgaggatttcttccaacttctggaggacgatacttgtttaatggttctgcagagcggacagtcctggtctcctactcggtctggagtgctgtcctacgggttaggtcgggagagaccaaaacattctaaagacatcgcgagattcacattcgatgtgtataaacagaatcctcgggatttgtttggatcactgaatgtcaaggcaactttctatggtctgtattctatgtcttgcgatttccagggtctggggcccaaaaaggtgctaagggagctcctccgttggacctcaacccttttgcagggactggggcacatgctgctcggcatatcctcgactcttcgacatgctgtggaaggtgctgagcagtggcagcaaaaggggcgcctgcattcttattag

SEQ ID NO: 23471 - DNA, 1860 bp, Artificial Sequence
  Description of Artificial Sequence: Synthetic coding sequence
atgaacctggagcggctgcggaagcgggtgcggcagtacctggaccagcagcaataccagtccgctctgttttgggcagataaggtggcaagccttagtcgtgagcctcaggatatatactggttggcgcagtgcttgtacctgacggcacagtatcacagggcagcccatgcgctccggtcgaggaagttagataagttgtacgaggcttgccgatacctggctgcccgatgtcattacgcagccaaagagcaccagcaggctttggacgtgctcgacatggaagaacccatcaataagcggctgttcgagaagtacctgaaagacgaaagcggctttaaggatccatccagcgactgggaaatgtctcaatcgtcaattaagtcatcaatctgcttgctcaggggcaaaatttacgatgcactcgacaataggaccctcgctacctacagctacaaggaagcactaaagctcgatgtgtattgttttgaagcattcgacttgctcacctcccatcacatgctgaccgctcaggaagagaaagagctgctggagtctttgccactgagcaaactctgcaatgaggagcaggaattgctacgttttctattcgagaacaaactcaaaaagtacaacaagccctcagagaccgtgatccctgaaagcgtcgatggcttgcaggaaaatttggatgttgttgttagcctggccgagaggcattactataactgtgactttaagatgtgctacaaacttacaagcgtcgtgatggaaaaagatcccttccacgcttcctgtctacctgtacacattggtacgctcgttgagctgaataaggcaaatgaactgttttatctgtcgcacaagttagttgacctgtatccaagcaacccagtgtcatggttcgccgtgggatgctactatctgatggtgggccacaagaacgaacacgcccgcagatacctgagcaaggccactaccctcgaaaagacctacgggccggcctggattgcctacggccatagtttcgccgtggaaagtgaacacgatcaggctatggccgcctactttacagctgcacagctgatgaagggatgccatctgcctatgctctacataggactagaatacgggctcacaaacaactccaagctggcagagcgcttcttcagtcaagcgctcagtatcgcaccagaggaccctttcgttatgcatgaggtcggcgttgtcgcctttcaaaatggtgagtggaagactgcagagaagtggtttctggatgccttagagaagatcaaggctataggaaatgaagtaaccgtcgataaatgggagcctctgcttaacaatttgggtcacgtgtgcaggaagctgaaaaagtacgccgaggctttagattatcacaggcaggcgttagtccttattccccagaatgcctcgacatactcagctataggctacattcatagtttgatgggcaacttcgagaatgccgtcgactatttccacacagcacttggccttcgcagggacgatacattcagcgtgacaatgctaggccactgtattgaaatgtacattggcgacagcgaagcctacatcggcgcggacattaaggataagctaaagtgctatgattttgacgtccataccatgaagaccctgaagaacattatcagccctccctgggatttccgagaattcgaggtggagaaacagaccgctgaagaaaccgggctaacaccactggagacttctagaaagacaccagatagccgcccaagcttagaggaaaccttcgagatcgagatgaacgaaagcgacatgatgcttgagacatccatgtcagaccacagtacttag

SEQ ID NO: 23472 - DNA, 1428 bp, Artificial Sequence
  Description of Artificial Sequence: Synthetic coding sequence
atggaggagcccatcaacaagcggctgttcgagaagtacctgaaggatgagagtggatttaaagacccttcgagcgactgggagatgtctcaatctagcattaagagcagtatttgcctcttgcggggcaaaatctacgatgcactggacaacagaacactggccacatactcttacaaggaagccctgaagttagacgtatactgtttcgaagctttcgacctacttaccagccatcacatgctcactgcacaggaggaaaaggaactgctggaaagcctgcccttgagcaagctctgtaatgaagagcaggagctgctgagattcctgtttgagaataagctcaagaagtataacaagcctagcgaaacagtgattcccgaatcagttgacggtctgcaagaaaacttggacgtggttgtgagtctagcggagcggcactactacaactgcgacttcaaaatgtgctacaagcttacaagcgtggtgatggagaaggatcctttccacgcttcgtgtctcccagtccacatcggaaccctcgtggaactcaataaggccaacgagctgttctacctctcccataaactcgtggacttgtatcccagtaatccagtgtcttggttcgccgtcgggtgctactatttgatggtggggcacaagaatgaacacgccaggcgctatttatccaaagcaactacattggagaaaacctacggaccagcctggatcgcgtacggtcacagtttcgccgtggagagcgaacacgaccaggctatggcggcctacttcacagcagctcaactaatgaagggctggaaaacagccgaaaagtggttcctcgacgctctcgagaaaatcaaggccatcggaaatgaagtaaccgtggacaagtgggaacctttactaaacaatctcggacacgtttgcagaaagctcaagaaatacgctgaggcacttgactaccaccggcaggctctcgtgctgatcccccagaacgcctccacctacagtgcaatcggatacatccacagcttgatgggcaactttgagaacgcggtggactactttcacaccgctctggggctcagacgagacgatactttctccgttaccatgctagggcactgcattgaaatgtacataggtgattctgaagcctacattggtgccgacattaaagacaaactcaaatgctatgacttcgatgtgcatactatgaagaccctcaagaatatcatatcacctccctgggattttcgcgagttcgaagtcgaaaagcagacggccgaagagaccggcctgactcccctggaaacctctagaaagacccccgatagtaggccttctttagaggaaaccttcgagatcgaaatgaatgagagtgacatgatgctcgagacgtcaatgtctgaccattctacttag

SEQ ID NO: 23473 - DNA, 1863 bp, Artificial Sequence
  Description of Artificial Sequence: Synthetic coding sequence
atgaacctggagcggctgcggaagcgggtgcggcagtacctggaccagcagcagtatcagtcagcccttttctgggccgataaggtggctagtctctccagggaagaaccccaagatatatactggctcgctcagtgcctctacttgacggctcagtaccatagggctgctcacgccctgcggagccgcaagctcgacaaactgtacgaagcctgtaggtacctcgcggcccgctgccactatgcagctaaggaacatcagcaggcactggacgtgctcgatatggaggaaccaattaacaagaggctgtttgagaagtatcttaaggacgagtccgggtttaaggacccaagctccgattgggaaatgtcacagtccagcatcaagtcttcgatctgcctgttgcgcggcaaaatatacgatgccctggacaatcgcaccctcgcaacctacagctataaagaggccctgaaactggacgtgtattgcttcgaagcatttgacctcctgacatcccaccatatgcttacagctcaggaggagaaggaactgttggagtcactcccgctgtccaagctttgtaacgaagaacaggaacttcttcggttcctatttgagaacaagttgaagaagtacaataagccttccgaaacagtcatccccgagtcagtggacggcttacaagagaacttggatgtcgtagtcagcttggccgagcgtcattattataactgtgacttcaagatgtgttacaaactcacttccgttgtgatggaaaaagatcctttccacgcatcctgtctgccagtgcacatcggaactctagtggaactcaataaagctaatgaacttttttatctttcacataagctggtggacctgtacccaagtaaccctgtgagttggtttgcagtcgggtgctattacttaatggtgggtcacaaaaacgagcacgcccgtcgctatcttagtaaggctactacgctcgagaaaacttacgggccagcctggatcgcatacggccatagctttgccgttgaatcagaacatgatcaggctatggccgcatatttcactgccgcccagctcatgaagggctgccacctgcctatgctttacattgggctggaatacggactgaccaacaactctaaactggccgagcgctttttctcacaggctttatctattgcgcctgaagaccccttcgtgatgcacgaggtgggggtggtcgccttccagaatggggaatggaagacagccgagaaatggtttctcgacgccctcgaaaagattaaagccatcggcaatgaagttaccgtggacaaatgggagcctctgctgaataatttgggccatgtgtgccgcaagttgaagaagtatgcggaagccctcgactatcacagacaggccctggtactcatccctcagaacgcatcaacttacagtgccatagggtacattcatagcctcatgggaaactttgaaaatgctgtggactattttcacactgcactcgggctaagaagggatgacacattcagcgttactatgctcggacattgcatcgaaatgtacattggcgacagcgaagcttacatcggcgcagacattaaggacaaactgaaatgctacgacttcgatgttcacactatgaaaaccctgaaaaacattatcagccctccttgggatttccgagaattcgaggtggagaagcaaactgccgaagagacgggtcttactcccctcgagacaagcagaaaaacgccagattcacgtcccagcctcgaggaaacctttgagattgagatgaacgaaagtgacatgatgttggaaacaagtatgagcgatcacagcacttag

SEQ ID NO: 23474 - DNA, 1863 bp, Artificial Sequence
  Description of Artificial Sequence: Synthetic coding sequence
atgaacctggagcggctgcggaagcgggtgcggcagtacctggaccagcagcagtatcagtcagctttgttctgggcggataaggtggcgtcactcagtagggaggaaccacaggacatctactggctggcgcagtgtttatatttaaccgcacaatatcatagggcagcccatgcgctcaggtctaggaagttggacaaattgtacgaagcatgccggtacctggcggctaggtgccactacgccgccaaggagcatcagcaggccctcgacgtgttggacatggaagaaccaattaataaacgcttattcgaaaaatacctgaaggacgaatcaggatttaaggacccatcatcagactgggaaatgtcccagtcctccatcaagtcatccatttgcctacttcggggcaagatatatgatgcccttgacaaccgcactctcgccacctattcctacaaggaagccctgaaactggacgtttactgcttcgaggcctttgatttgcttaccagccatcacatgctgaccgctcaagaagaaaaggaattgctagaaagtctcccattatcaaagctttgcaacgaggaacaggagttactgcggtttctttttgagaacaaactgaaaaagtataacaagcctagtgaaacggtgatacccgaatctgtcgatggcctgcaggaaaacctagacgtcgtagtatcacttgccgagcggcattactataactgcgattttaaaatgtgctacaagctgacctctgtggtaatggagaaggatccattccatgcttcgtgtctcccagttcatattggaacactcgtggaactgaacaaagcgaacgagctcttttatctcagccacaagctggtcgacctgtacccctctaatccagtgtcctggttcgcagtcgggtgttattatctaatggtggggcataagaatgaacatgcccgcaggtacctatctaaggcaactacgttagagaaaacctacgggcccgcatggatagcctatgggcactcatttgcggtcgagtcggagcacgaccaggccatggccgcatattttacagccgctcaactaatgaaggggtgccatctgcccatgctgtatatcgggctagaatacgggttgaccaacaacagtaaacttgccgaaaggttcttttcgcaagccttgtccatcgcaccagaggacccattcgtcatgcacgaagtgggcgtggtggcctttcagaatggcgagtggaagactgccgaaaaatggttcctcgatgccctagaaaaaatcaaggcgattgggaatgaggtcacagtcgataaatgggagcctctgctgaacaatctaggccatgtgtgtaggaaactaaagaagtatgcagaggctcttgattaccaccgacaggctctggtcctgatccctcagaacgcatccacctacagtgcaatcggctacattcattcgctgatgggcaacttcgagaacgccgttgactacttccacaccgcactcgggctccgaagagatgatacattctcggttaccatgctgggacactgtattgaaatgtacatcggcgactccgaggcttacatcggcgccgacataaaggataaactcaaatgctatgactttgatgtgcacaccatgaagacactcaaaaacatcatcagccctccctgggatttcagggagttcgaagtcgagaagcagactgccgaggaaacaggtctgacccctctggagacctccaggaagacccctgactcgcgtccctccttggaagagacctttgagatcgagatgaacgagtccgacatgatgttggaaacgagcatgagcgaccacagcacctag

SEQ ID NO: 23475 - DNA, 1581 bp, Artificial Sequence
  Description of Artificial Sequence: Synthetic coding sequence
atggaggagcccatcaacaagcggctgttcgagaagtacctgaaggatgagtctggattcaaagatccctcctcagattgggagatgtcacagtcttctatcaaatcctctatatgcctgcttcgaggaaagatctacgacgccctggacaaccggacgcttgccacgtacagctataaggaggccttaaaactagatgtctattgcttcgaggccttcgatctgctcacgtcccaccatatgttgaccgcgcaggaggaaaaagagctcctcgagtcactgccactgagcaagctttgcaacgaggaacaggagctcctgcgtttcctgtttgaaaacaaactgaaaaagtacaataaaccgtctgagaccgtgatccctgaatctgtcgacgggctgcaggagaacttagacgtcgtggtgagtctcgccgagcgccattactacaactgcgatttcaaaatgtgttacaagctcacgtctgttgtgatggagaaggatccattccatgcaagctgcttgcccgtgcacatcggcactctcgtagagttaaacaaggcaaatgagctcttctacctgtcacacaaactggttgatctctaccctagcaatcctgtgtcctggttcgccgtgggctgttactatctaatggtcggacataagaatgaacatgccaggcgttatctgagcaaagccacgacactcgagaaaacttacggacctgcgtggatagcctacgggcattcttttgccgtggagtccgaacacgaccaggcgatggccgcctatttcactgccgcacaactgatgaaaggatgtcacctgcccatgctctatatcggcctggaatacggcctcaccaataattccaaacttgcagaaagattcttcagtcaggccctctccatagcacccgaggacccatttgtgatgcacgaagtgggagtcgtggcctttcagaacggcgagtggaaaaccgcagagaaatggtttctcgatgcccttgaaaaaattaaagctataggtaacgaggttacagtggacaaatgggaaccattactgaacaatttaggccatgtgtgtaggaagctgaagaaatacgcagaagccctggactaccacagacaagcgctggtgctgattcctcagaacgctagcacttatagcgccataggttacatccattcacttatggggaatttcgaaaatgctgtggactacttccatacggcgttagggttgcggagagatgacaccttctctgtgaccatgctcgggcattgtatcgagatgtacatcggggattctgaggcatatatcggagccgacatcaaagacaagttaaagtgctatgatttcgatgtccataccatgaagaccctcaagaacattatcagcccaccttgggactttcgcgagtttgaggtggaaaagcagactgctgaagagaccgggctgacacctctcgaaacaagtagaaagaccccagacagtcgacccagtttggaagagacttttgagattgagatgaacgagagtgatatgatgctcgagacatcgatgtccgatcacagcacgtag

SEQ ID NO: 23476 - DNA, 1581 bp, Artificial Sequence
  Description of Artificial Sequence: Synthetic coding sequence
atggaggagcccatcaacaagcggctgttcgagaagtacctgaaggatgagtccggctttaaagacccttcttcagactgggagatgtcccagtcttctatcaaaagctccatttgcctgctacgtggaaaaatctacgatgccctggacaacaggacactggcgacatatagctataaggaggctctgaagttggacgtgtactgtttcgaggcatttgatctcctgaccagtcatcatatgttaacggctcaagaagaaaaggaactgcttgaaagcctacccctgagtaagttgtgcaacgaggaacaggaacttctaagatttctgttcgagaacaagttaaagaaatataataaacctagtgagaccgtgatcccggaatccgtggacgggctccaggaaaacctcgacgttgttgtaagtcttgctgaacgacactattataattgcgattttaagatgtgttacaaactaacctctgtggtgatggagaaagaccccttccacgcctcctgtctacctgtccatatagggaccctggtggaacttaacaaagccaacgagctgttctacttgagccataaactggtcgacctgtacccctccaaccccgtatcttggtttgcagttggatgctattatctgatggtggggcataaaaacgaacatgcacggagatacttgagcaaagctacaaccttagaaaagacatacggccccgcatggatcgcatacggtcatagcttcgccgtggaatcggaacatgaccaagcaatggccgcttactttaccgctgctcaactcatgaagggctgccacttacccatgctctatatagggttggaatacgggctcacaaataactcaaagctggcagagcgcttcttctctcaggcacttagcatcgcccccgaagacccatttgtcatgcatgaggtgggggtggtagcgttccaaaatggggaatggaagaccgcagagaagtggttcctggatgccctcgaaaagatcaaagctatcggaaacgaggttaccgtggataagtgggagccattactgaacaatctcggacacgtttgtcgcaaactgaaaaaatatgccgaggctttggactaccataggcaggccttagttctgatcccacaaaacgcctctacctacagtgcgatcggctatatccactcactcatggggaactttgaaaacgccgttgattattttcataccgccttaggcttgcggagagatgacacttttagcgtaaccatgctgggccattgcatcgagatgtatattggagactcggaggcctatatcggggcagatatcaaggacaaattgaagtgctacgatttcgacgtgcacacaatgaaaactcttaagaatataattagtcccccttgggactttcgcgaatttgaggtggagaagcaaacagcggaggaaaccggcctaacccctctggagacctcgcggaagacaccggactctaggccatctctcgaagagaccttcgagatcgagatgaacgaaagcgatatgatgctggaaacgagtatgtcagaccacagcacatag

SEQ ID NO: 23477 - DNA, 1428 bp, Artificial Sequence
  Description of Artificial Sequence: Synthetic coding sequence
atggaggagcccatcaacaagcggctgttcgagaagtacctgaaggacgagtctggattcaaggaccccagctccgactgggaaatgagtcagagctccatcaagagttctatctgcctgttgcgcgggaagatatatgatgcacttgataaccgcactctcgcaacgtatagttacaaagaggccttaaagctggacgtttactgttttgaggcttttgacttgttgacaagccatcacatgcttacagcccaggaggagaaggaactgttggagtccctgcctttgagtaaactctgtaacgaggagcaggaactccttcgttttctattcgaaaacaaactgaagaaatacaacaagccctctgagaccgtgataccagaaagtgttgacgggctccaggagaacctggatgtggtggtatctttggccgagaggcactattacaattgtgacttcaaaatgtgctataagctgacgagcgtggtgatggagaaggatccatttcacgcttcgtgcctaccagttcatattggtactctggttgagttgaacaaagccaacgaactcttctaccttagccacaagctggttgacctttatccaagcaacccagtgtcttggttcgccgtgggttgctattatcttatggtgggtcacaaaaacgaacacgcgcggaggtatctgtcaaaggctacaactctagagaaaacctacggaccggcctggatagcatacggacactctttcgctgttgaaagcgagcacgaccaggccatggctgcctacttcaccgcagctcagctgatgaaggggtggaagaccgctgagaagtggtttctcgatgctctggaaaaaatcaaagccattggcaacgaggttactgtggataagtgggagcccctactcaataacctcggccatgtctgccgcaaactgaagaagtatgccgaagcacttgactatcaccgccaggctctcgtactgataccacagaatgcatctacgtactcagccataggatacatccattcattgatgggcaatttcgagaatgctgtggactactttcataccgctctgggtttacgacgggacgatacattcagcgtgacgatgttgggccattgtattgagatgtacattggagacagcgaggcctacataggcgccgatatcaaggataagctgaaatgttacgacttcgacgtacacaccatgaaaaccttgaaaaatattatatcgccaccttgggatttccgggaattcgaagtggagaagcaaactgccgaggaaactggcctgaccccacttgagactagccgcaaaacacctgactcaagaccctctctggaagagacttttgaaatcgaaatgaatgagtctgacatgatgctggaaacttctatgtcagaccatagcacgtag

SEQ ID NO: 23478 - DNA, 1500 bp, Artificial Sequence
  Description of Artificial Sequence: Synthetic coding sequence
atggcccagttcgccttcgagagcgacctgcacagcctgctgcagttggatgcacctattccgaacgcgcccccagcccgttggcaaagaaaagcaaaagaggccgccggcccagccccttccccaatgagagccgctaatcgaagtcatagtgccgggcgcaccccaggccggaccccgggcaagtcgagctccaaggttcaaaccacgcccagcaaaccggggggcgatagatatattcctcaccgaagcgctgcacagatggaggtcgcctcctttctcctgagcaaagagaatcaacccgagaacagccaaactccaacaaaaaaggaacatcagaaagcttgggcccttaatctgaatggctttgacgtcgaagaggccaagatcctgaggctctctggtaagccacagaacgctcccgaagggtaccagaaccgtttgaaggtcctgtactcccagaaagcaactcctgggtcaagtaggaagacttgtcggtacattccatccttgccggatagaattctggatgcccccgagattcggaacgattactacctaaacttggtcgattggagcagtgggaatgtcctggcggttgccctcgataactcagtttacttgtggagcgcctccagcggggatatcctgcaacttctgcagatggaacaacctggagagtatatatctagtgttgcctggattaaagaaggcaattatttggcagtcgggacaagctcagctgaagtgcagctgtgggatgtgcaacagcagaaaagactgaggaacatgacaagccacagtgcaagggtgggcagtttgtcttggaattcctacattctgagtagtggctctcggtccggccacatccaccaccacgatgtgcgggttgctgaacaccacgtggccaccctgagcgggcacagccaagaagtgtgtgggctcagatgggcaccagacgggcgacatctcgcaagcggaggtaacgacaatttggtgaacgtatggccttccgccccaggtgagggagggtgggtgccgctccaaacattcacccagcaccagggcgcggtgaaggctgtcgcctggtgcccatggcagtctaatgtcttggcaacaggtggcgggacaagcgatagacacatcaggatttggaatgtgtgtagtggagcctgtctcagcgcagtggacgctcacagccaagtctgttccatcttatggagtccacattataaagaactcattagcgggcacggatttgcccagaatcagctagtgatctggaaatatccaacgatggccaaagtggccgaactcaagggtcatacgagccgggttctgagcctcacgatgtcacccgacggagctaccgtcgcttctgccgcagcagacgaaaccctccggttgtggcgctgctttgagctagaccccgcaagacgccgcgagcgggagaaggcaagcgccgcaaagtccagtctgattcaccaaggaatcaggtag

SEQ ID NO: 23479 - DNA, 1500 bp, Artificial Sequence
  Description of Artificial Sequence: Synthetic coding sequence
atggcccagttcgccttcgagagcgacctgcacagcctgctgcagctcgatgctcccatccctaatgcgcctcccgctaggtggcaaaggaaggcaaaggaagcggccggacccgcgccatctcccatgagagccgctaaccgaagccactccgccgggcgtacccccgggcgaaccccgggcaagtcgagctctaaagtacagacaactccgagcaagccggggggcgaccggtacattccacatcggtccgccgctcagatggaagtagcctcatttcttctgtccaaagagaatcagccagagaatagccagactccaaccaagaaagaacatcagaaggcttgggccctgaatctgaatggattcgacgttgaggaagcgaagatattaaggctgagtggcaaacctcagaatgccccagaaggttaccaaaaccggctgaaggttctatacagtcagaaggcaacaccgggtagtagcaggaaaacgtgtcgttatataccttcattacctgaccgcattctagatgcccctgaaattcgaaacgactactaccttaatctagtggactggtcgtccgggaatgtgctcgccgtagcactcgataactccgtgtatctctggtcggccagtagcggggacatcctgcaactcctgcagatggagcagccaggggagtatatatcaagcgtggcatggattaaagaaggtaactacctcgctgtgggcacgtcctccgcagaggtacaactctgggatgttcagcagcagaaacggctgaggaatatgacgtcgcattctgcgagggtggggtccttgtcatggaactcgtatattcttagtagtggatcccgcagcggtcatattcatcaccacgacgtgagggtggctgagcatcacgttgcaactttaagcggacactcccaggaagtttgtggactgcggtgggcgcctgacgggcggcacttagcctccggtgggaatgacaatctcgtgaatgtctggcctagcgccccgggcgagggtggctgggtgcccttgcagaccttcactcagcaccaaggggcggtcaaagccgtggcttggtgcccctggcagtctaatgtgctggctacaggcggaggaactagcgatcggcatatcaggatttggaacgtctgctcaggagcctgtttgtccgccgtcgacgcccattcacaagtgtgctccatcctgtggtcccctcactataaggagctgatctcggggcatggtttcgcacagaaccagctcgtaatttggaaatatcctaccatggccaaggtggccgaattgaagggccacacctccagagtcttgagtcttactatgtctcctgacggcgccaccgtggcttcggcagccgccgacgagacactcaggctgtggagatgtttcgaattagacccggctagaagacgagagcgcgagaaggctagtgccgctaagagcagtctcattcatcagggaattcgctag

SEQ ID NO: 23480 - DNA, 1428 bp, Artificial Sequence
  Description of Artificial Sequence: Synthetic coding sequence
atggcccagttcgccttcgagagcgacctgcacagcctgctgcagctagatgcccctatccctaatgctccccccgcaaggtggcagcgcaaagcaaaggaagccgcaggacccgcaccgtcccctatgagggccgcaaacaggtcacacagcgccggcagaacccccggaaggactccagggaaaagttcctcaaaggtgcagacaaccccctccaaagagaaccagcctgagaattcccaaacaccgacgaagaaagagcaccagaaggcctgggctcttaacctaaacgggttcgacgttgaagaagctaagattctcaggctctccgggaagccacagaacgcccctgagggataccagaataggctgaaggtgctttactcacagaaagcaacacctggaagttcccgaaagacctgcaggtatattccctccctccctgacagaattctggacgctccggaaattcggaacgactactatctaaaccttgtcgactggagctctggcaacgtcctggccgttgcactcgacaatagtgtgtatttgtggtccgcatcatccggcgacatccttcaacttttacagatggaacagcccggtgaatacatatcaagcgtggcctggatcaaggaaggaaactacttagcagtgggaacatcatcggctgaggtccagctctgggatgtccagcaacaaaagaggctcagaaacatgacgtctcactctgctcgtgtcggtagtttgtcttggaattcctatattttaagctctggcagtcgctccgggcacattcaccatcatgatgttagggtagctgagcaccacgttgctacactctccggccattctcaggaagtgtgcgggctgcgatgggcaccagacggacggcatcttgcatccggaggtaacgataacctggttaatgtttggcccagcgctccgggtgaggggggatgggtgcctctccagacattcacccagcaccagggagctgtcaaggctgtggcctggtgtccgtggcaaagcaacgtgctcgctactggcggaggtacgtctgaccggcatatacgtatctggaatgtatgctccggcgcttgcctcagcgccgtggatgcacactcccaggtctgcagcattttatggtcccctcactacaaggagctgattagtggccatggattcgcccagaaccagctggttatttggaagtatcctaccatggcgaaggtcgcggaactgaagggacatactagcagggtcttgagtcttaccatgagccctgacggcgccacagtggcgagcgcggcagctgacgaaacacttcgcctgtggcgctgttttgagttggatcctgctcgacgaagggaacgagaaaaagcctccgccgcaaagagctctttaatccaccaaggcattcgatag

SEQ ID NO: 23481 - DNA, 1422 bp, Artificial Sequence
  Description of Artificial Sequence: Synthetic coding sequence
atgagcaccgagctgttcagcagcacccgggaggagggcagcagcggttcaggaccctcatttcgtagcaatcagaggaaaatgttaaatcttctgctcgagcgcgatacatcttttaccgtgtgtccggatgtgccaaggacccctgttgggaagttcttgggtgatagtgccaacctgagcatcctcagtgggggtactcccaaaaggtgcctcgatctgagtaatctgagctcaggggagataacggcaacacaactgacaacgtctgccgatctcgatgagactggtcatctagacagctcagggctacaagaggtccacctggctggtatgaatcatgaccagcatctgatgaagtgcagcccagcccagctgctgtgttctaccccaaatggattggatcgcggtcataggaaacgcgatgcgatgtgctcttcatcagccaacaaggagaatgataacggaaatctcgttgactccgaaatgaagtatctgggatctcctattacgacagtgccaaagctcgacaagaacccaaaccttggagaggaccaggccgaagaaataagtgacgagctgatggagttttcccttaaagaccaggaggcaaaggtgtctagatctggcctgtatcgctccccttctatgccggaaaatctgaatcggccaaggctgaaacaagtagaaaaattcaaagacaacaccattcccgacaaagtgaagaaaaaatattttagtggccaaggcaaactgagaaaggggctatgcctgaaaaaaacagttagtctgtgcgacatcactattacccagatgctggaggaagactcaaatcagggccatcttatcggggacttcagcaaggtatgcgccctgcccacggtgtcgggaaaacatcaggacctgaaatacgtgaacccagaaaccgtggctgcactgctgtccggcaagtttcaagggctgattgagaagttctatgtcatcgactgccggtatccctatgaatacctcgggggacatatccaaggcgcactgaacttgtacagtcaggaagaacttttcaattttttcctcaagaagccgatcgttcccctagatacccagaagagaattatcattgtgttccactgcgaattcagtagcgaaagagggccgcggatgtgtcgctgtttgcgggaggaagaccgaagtttaaaccaataccccgcactatattaccccgagctatatattctgaagggcggatatcgggacttttttccagagtacatggaattgtgcgaaccccagtcctactgtcccatgcaccaccaggaccacaagacagagttactcaggtgccgatctcagagcaaagtgcaggagggcgagaggcagctgagggaacaaatcgcgctcctggtgaaggatatgagtccatag

SEQ ID NO: 23482 - DNA, 1203 bp, Artificial Sequence
  Description of Artificial Sequence: Synthetic coding sequence
atgagcaccgagctgttcagcagcacccgggaggagggcagcagcgggagtggtccaagctttcgcagcaatcagagaaaaatgttaaatctcttgctcgaacgcgacactagtttcacggtctgccccgatgtgccccgtaccccagtcggcaagtttttgggggattccgcaaacctctctatacttagcggctcaccaggctttttcaggacttcgggctccgctttctcatgggatgacaacgggaacctggtcgatagcgagatgaagtatcttgggagccccattactactgtgcccaagttggacaagaatcctaatctgggtgaggaccaagccgaggaaatcagtgatgaactgatggaattttcactcaaggaccaggaggcgaaggtttcccgaagtggcctgtacaggtcgcccagcatgccagaaaatctgaatcggccaaggttgaagcaggtggagaagtttaaggataacacaattccagacaaagtgaaaaaaaagtatttttctgggcagggcaaactgcgaaagggtctttgccttaaaaaaactgtgtccctgtgtgacataacaattacacagatgcttgaggaggacagcaatcagggtcacctgatcggagatttttccaaagtgtgcgctctgcctactgtgtctggaaagcaccaggatctgaagtacgttaatcccgagaccgtggccgctttgctttcaggcaagtttcagggattgatcgagaagttctatgtaatcgactgcaggtacccctatgagtatctgggtggtcatattcagggtgctctaaatctctattcccaggaggagttatttaacttcttcctcaaaaagcctattgttcccctcgatacacagaagcggatcattatcgtgtttcactgtgagttctcctcggagagaggcccccgaatgtgtcgctgcttgagggaggaagacagaagcctgaatcaataccctgctctgtactacccagagctttacattctgaaaggcggctacagagatttcttcccagagtatatggaactctgcgagccccagtcatattgtcccatgcaccatcaggatcataagaccgagcttctgcgatgcagatctcaatcaaaggtgcaagagggcgaaaggcagctgcgcgagcagatcgcgctcctggtgaaggatatgagtccttag

SEQ ID NO: 23483 - DNA, 1332 bp, Artificial Sequence
  Description of Artificial Sequence: Synthetic coding sequence
atgagcaccgagctgttcagcagcacccgggaggagggcagcagcggatccggcccctctttcagatcgaatcagaggaaaatgctcaacctccttcttgagcgggacaccagcttcacagtgtgtccagacgttccacgcaccccagtggggaagtttctgggagatagtgccaatctctccattttgtctggcggcacccccaagagatgcctcgatctaagtaatctgtcttctggggaaatcaccgccacgcagctcacaactagcgccgacctggacgagaccggccatctcgattcctctggcctgcaggaagtgcatctggccggaatgaaccacgaccagcacctaatgaaatgtagccctgacaacggaaacctggttgacagcgaaatgaagtaccttggcagccccatcaccaccgtacctaaattggacaagaaccctaacctgggcgaggatcaggcggaggaaatatctgacgaactcatggagttttcactgaaagaccaagaagcaaaggtgtccaggagtgggctctacaggtcaccttccatgccagagaacttgaaccgacctcgcctcaagcaggtcgaaaaattcaaggacaataccatacccgacaaagtgaagaaaaaatactttagcggccaaggtaagcttcggaagggcctctgtctgaaaaagactgtgtcgttatgtgatattacgatcacccaaatgctggaggaagattccaatcagggacatctcataggtgacttcagcaaggtctgcgcactccccacagtgtctggtaagcatcaagatctgaagtatgttaatccagagaccgtagctgcactgttatcaggaaagttccaggggctgatcgagaagttctacgtaatcgattgccgatacccatacgaataccttggagggcacattcaaggggccctgaacctgtatagtcaggaggaactttttaatttttttttaaagaagccaatcgtgcccctggacacacagaagcgtatcatcatagtgtttcactgcgagttttcgtcagagcgtgggcccagaatgtgtaggtgcctcagggaagaagaccgatctttgaaccaatatccagccctctattatcctgaactctacatcttaaaaggagggtaccgagatttcttcccagagtacatggaactgtgcgagccccaatcttactgccctatgcaccaccaggaccacaagaccgagctgctgaggtgccggtcacaatctaaagtgcaagagggggagagacagctgcgcgagcagattgcgctgctagtcaaggacatgagtccctag

SEQ ID NO: 23484 - DNA, 1293 bp, Artificial Sequence
  Description of Artificial Sequence: Synthetic coding sequence
atgagcaccgagctgttcagcagcacccgggaggagggcagcagcggcagcggaccttcatttcgaagcaaccagcgtaagatgttgaatcttttgttggagagagacacgtctttcaccgtgtgcccagacgtgcctagaacccctgttggcaagtttctgggagattctgccaacctgtccatcctttctggcagcccagggttctttcggacatcgggctctgccttttcttgggatgcgcagttgctctgctctaccccaaacggactggatcgcgggcaccgaaagcgtgacgccatgtgttctagctctgcgaataaagagaacgacaacggcaacctggtcgactcggagatgaaatatctgggctcccctatcactacagtacccaagctggataagaaccccaacctgggtgaagaccaggccgaggaaatttcagacgaacttatggaattttcattgaaggaccaagaggccaaggtgagccgctctggcctgtaccgctccccatctatgcctgagaatctaaaccggccccggctgaaacaggtcgagaagtttaaggacaataccatccctgataaagtcaagaaaaagtatttcagtgggcagggaaagcttaggaaggggttatgccttaaaaagactgtcagtctctgcgatatcaccatcacccagatgttggaggaggatagcaaccagggacatctgattggcgatttcagcaaagtgtgcgcactgcccaccgtttccgggaagcatcaggacctgaagtatgtaaaccccgagactgtagcagcccttctgtcaggcaaatttcagggtttgattgagaagttctatgtcatcgactgccgatacccttacgagtacctcggaggccatatccagggggcgctcaacctgtatagccaggaggagctgttcaactttttcttgaagaagcccattgtgccacttgatacccaaaaacggatcattatcgtgtttcattgcgaattttcaagtgagagggggcctagaatgtgccggtgtctgcgtgaagaagaccggagtttgaatcagtacccagccctttactatccagagctctatattcttaaggggggatatagggatttttttcccgagtatatggagctatgtgagcctcagagctattgcccaatgcatcaccaagaccacaaaacagagctcctgcgttgccgatctcagtctaaggtgcaggaaggagaacgccagctccgcgagcagatcgcccttctagtgaaggatatgtctccctag

SEQ ID NO: 23485 - DNA, 1203 bp, Artificial Sequence
  Description of Artificial Sequence: Synthetic coding sequence
atgagcaccgagctgttcagcagcacccgggaggagggcagcagcggatctgggccatcttttagatcgaatcaacggaagatgctcaatctgcttctggagagggataccagtttcaccgtgtgccccgatgtgccgagaactcccgtgggcaagttcctcggcgactctgccaatcttagcatcttatctggatctcccgggttcttcagaacgtcaggctctgcgttcagctgggatgataatggaaacctggtggactccgaaatgaaatatcttggctctcctatcactactgtcccgaagctcgataaaaatcccaacctcggtgaagaccaggccgaagaaatttcagacgagcttatggaatttagtcttaaagatcaggaggcaaaggtgtcgcggagcgggctctatcgatcacctagcatgccggagaacttaaatcgtcccagactgaaacaggtagagaagttcaaggataataccatccccgataaggtcaagaagaaatacttctccggtcagggtaaactgagaaaaggtctgtgccttaagaaaaccgtgagtttatgcgatattacaatcacacagatgctggaggaggactccaaccagggacacctcatcggggatttctcaaaagtttgtgcgctgcctactgtgagtggaaagcaccaagacctgaaatacgtcaaccccgaaacagtggctgcacttctgtcaggtaaatttcagggcctcattgagaaattctatgtgatcgactgccgctatccgtatgaatacctcggtggccatatccagggtgcgcttaatttatactcccaggaggaactgttcaatttcttccttaagaaacctattgtccctttggatacgcagaaacggataataatcgtatttcattgtgaattctcatctgaaagaggtccacggatgtgtcggtgcctgagggaagaggataggagtctgaatcagtacccagcgctgtactatcccgaactttacatcttgaaggggggctatcgcgactttttcccggagtacatggagctgtgtgagcctcagtcttactgtcccatgcatcaccaggaccacaaaaccgaactgctgaggtgcagatcccagagtaaggtacaggaaggcgaaaggcagctaagagaacagatcgccctgcttgtgaaagatatgtcaccatag

SEQ ID NO: 23486 - DNA, 750 bp, Artificial Sequence
  Description of Artificial Sequence: Synthetic coding sequence
atgagcaccgagctgttcagcagcacccgggaggagggcagcagcggatcgggacccagtttccgctccaatcagcgcaagatgctgaacctgcttttggagcgtgacacttcttttaccgtctgtcccgacgttcctcgtactcctgtcggcaaattcctgggagatagcgcaaacctctccatcctaagtggcgggacaccaaaaaggtgcctggacctctccaacctgagctcaggcgaaataacggctacccagctaactacaagtgccgaccttgatgagaccgggcatctggactcctctggtctgcaggaagtgcatctggccgggatgaaccacgaccagcacctgatgaaatgcagtcccgcacagctcttgtgtagcactcccaacggattagaccgtggacataggaaacgtgacgccatgtgcagctcttccgccaataaagagaacgacaatgggaacttggtggacagtgaaatgaaatatctgggatcaccgattacaacagtccccaaacttgacaagaatcccaatctcggagaggaccaggcagaggagatctctgatgaactgatggagttctccctcaaggatcaggaggccaaagtctcacgaagcggactttaccggtccccctccatgccggaaaacctgaatcgcccaagactcaagcaggtcgaaaaattcaaggacaatacaataccagacaaggttaagaaaaagtacttctccggccaatag

SEQ ID NO: 23487 - DNA, 1422 bp, Artificial Sequence
  Description of Artificial Sequence: Synthetic coding sequence
atgagcaccgagctgttcagcagcacccgggaggagggcagcagcgggagcgggccaagttttcggtcgaatcagcgtaagatgctaaacctcttgctcgagcgtgacaccagcttcaccgtttgcccagatgtcccaaggaccccagtgggcaaatttctgggagatagtgctaatttgtcaattctgtcaggcggcaccccgaaacgatgcctcgacctgagcaatctgtcaagcggtgagattacggcgacccagctcacaacctctgcagatcttgatgagacaggtcatcttgacagctccggtttacaggaggttcacctggctggcatgaatcacgaccagcacctcatgaagtgctctcctgcccaactgctatgttcaacacccaatggcctcgaccggggccaccggaagcgcgacgctatgtgtagcagctcagcaaacaaagaaaatgacaacgggaacctcgtggacagcgaaatgaaatacctgggctctcccatcacgacggtgcccaaactggacaagaatcctaacttgggagaagatcaggcagaagagatcagtgatgagcttatggaattctctctcaaagatcaggaggctaaggtctccaggtccggcctctaccggtcacctagtatgcctgaaaatttgaatagaccgagattaaaacaggtggagaaattcaaggacaacaccattcccgacaaagtcaagaagaaatacttttcggggcagggcaagctcaggaagggcctctgtctgaagaaaaccgtgtctttgtgtgacatcactatcactcagatgctcgaagaagattccaaccaaggtcatttgatcggcgatttcagtaaggtatgtgcacttcccacagtgtccgggaagcatcaggacctaaagtacgtcaaccctgagacagtggccgctctcctctccgggaagttccagggactcatcgaaaagttttatgttatcgactgccggtacccatatgagtacctgggaggacacatccagggggcgcttaatctctacagtcaggaggagctcttcaatttttttctcaaaaagccaatcgtaccactggatacccagaagcggattatcatcgtgttccattgtgaattcagctcagaacggggtccacgtatgtgcagatgtctgcgtgaggaggaccgatccttgaatcaataccctgcgctttactaccccgagctatacattctgaaaggcgggtaccgcgatttctttcctgagtacatggagctgtgcgaaccccagtcttattgtccgatgcaccaccaggaccataaaaccgagctgctaaggtgtagatcccagtctaaagtccaagaaggggagaggcagctgcgggaacagattgccctcctcgtgaaggacatgtcgccatag

SEQ ID NO: 23488 - DNA, 1473 bp, Artificial Sequence
  Description of Artificial Sequence: Synthetic coding sequence
atgagcgaggaggcccggttctgcttcagccccggcgagaacagcaaaactatgtcgaccgaactgttttcctctaccagggaagaaggctccagtggtagcggacctagctttcgatcaaaccaacggaagatgcttaaccttctccttgagcgagacacctcctttaccgtgtgtcctgatgtcccccgcacccctgtcggtaagtttctgggcgattcagcaaatctgtcaatcctgtccggtggcaccccaaaaagatgtctcgacctcagcaacctcagcagcggcgaaatcactgcaacccaactgaccacatctgctgatttggatgaaactggtcatttggatagctcaggtctccaggaggtccacctggctggcatgaaccacgatcaacatctgatgaagtgtagccctgcacagctcctttgtagtactcccaatgggctcgataggggtcatagaaaaagagacgcaatgtgctcttcttccgccaataaagagaatgataacggaaatttggtcgatagtgaaatgaagtatctgggcagtcctatcaccacagtgcccaaactggacaaaaaccctaacctaggagaggatcaggcggaagaaataagtgatgagctcatggagttcagtctcaaagatcaggaagccaaagtttctaggtctggtctatacagaagtcctagcatgcctgagaacctcaaccgccctagactgaagcaggtcgagaagttcaaggacaacaccattcctgacaaagtaaaaaagaagtatttcagtggacagggcaagctccgtaaaggcctgtgtttgaaaaagaccgtgtcgttgtgtgatatcaccattacccaaatgcttgaagaagactctaaccagggtcacctcatcggggacttcagtaaggtctgcgccctaccaacagtttcgggcaaacaccaagacctgaaatacgtgaaccctgaaacggttgcagcccttctgtccgggaagttccaggggctcattgagaagttttatgtgatcgactgccggtacccctacgagtatctgggaggacatatccagggggccctgaatctatattctcaggaggaactgttcaattttttcctgaaaaagccaatcgtccccctcgatacccaaaagagaatcatcattgtattccactgcgaattcagctccgaaaggggcccccggatgtgccggtgtctccgggaagaggacaggagcttaaatcagtaccccgcactgtactaccctgagctgtatatcctgaagggaggctatcgcgacttttttccagaatacatggagttgtgtgagcctcaaagttactgcccaatgcaccatcaagaccataaaaccgaattactgaggtgcagaagccagtctaaggtgcaggaaggagaaagacaactccgagagcagattgccctgttggttaaagacatgtccccatag

SEQ ID NO: 23489 - DNA, 288 bp, Artificial Sequence
  Description of Artificial Sequence: Synthetic coding sequence
atggagggcggcttcggcagcgacttcggcggcagcggcagcggcaagctggacccaggcctaataatggagcaagtcaaagtccagattgcggttgccaacgcccaggagctcctgcaaaggatgacagacaaatgctttcggaagtgtatcggaaagcccggcggctccctggacaactcagagcagaagtgcatcgcaatgtgcatggataggtatatggatgcatggaatactgtgtcccgtgcttacaactcacgattgcagcgtgagagggccaatatgtag

SEQ ID NO: 23490 - DNA, 576 bp, Artificial Sequence
  Description of Artificial Sequence: Synthetic coding sequence
atgcagaccatcaagtgcgtggtggtgggcgacggcgccgtgggcaaaacgtgcctgctcatcagctataccactaataaattcccgagcgaatacgtgcccactgtgtttgataactacgccgtgaccgtcatgatcggaggagagccatataccctgggcctgtttgatacagctgggcaggaagactacgaccggctccggcctctcagttacccacagaccgatgtgttcctcgtttgcttttctgtggttagtccctcatctttcgaaaacgtgaaagagaagtgggtgcctgagatcacgcaccactgtcctaaaacaccattcctgttggtgggcacacagatcgacctcagagatgaccctagtacaatcgaaaagctggccaagaacaagcaaaagccaattactcctgagaccgcggaaaagcttgctagggatctgaaggctgtgaaatacgttgaatgtagtgcactgacgcagcgcggattaaaaaacgtgtttgatgaagccatcctggctgctctggaaccacccgagactcagcctaagagaaagtgttgcatcttctag

SEQ ID NO: 23491 - DNA, 576 bp, Artificial Sequence
  Description of Artificial Sequence: Synthetic coding sequence
atgcagaccatcaagtgcgtggtggtgggcgacggcgccgtgggcaagacatgcttactgatctcttatactaccaacaaatttccttccgagtacgtgcctacggtattcgacaactatgccgttactgtcatgatcggtggagagccctatactctgggcctttttgacactgcagggcaggaggactacgaccgcctccggcccctcagctatccacagactgatgtgtttctggtgtgcttctctgtcgtgagcccctcaagcttcgagaacgttaaggaaaaatgggtccccgagataacgcatcactgtcccaagacaccatttcttttggtcgggacacaaatcgatttgcgggatgatccaagcaccatcgaaaagctggccaaaaataagcagaagcccataactccagaaactgccgaaaagctggctcgcgatctaaaagccgtcaaatatgttgaatgcagcgctctaactcagaagggcctgaaaaacgtgttcgatgaggccatcctcgcagccctcgaacccccagagcccaaaaaaagcaggcgatgcgtgctgctatag

SEQ ID NO: 23492 - DNA, 576 bp, Artificial Sequence
  Description of Artificial Sequence: Synthetic coding sequence
atgcagaccatcaagtgcgtggtggtgggcgacggcgccgtgggcaagacttgcctcctgatttcatatacaaccaataaattcccatcggagtacgtgccgacagtttttgataattacgccgtaaccgttatgattggcggggagccttatactctgggtctgtttgacacagccgggcaagaagattatgaccggctccgccccctgagctatccccagaccgacgtgtttctggtctgtttctccgtggtaagtcctagctcgttcgagaatgtcaaagaaaagtgggtgccggaaattacacaccactgccccaaaacgccttttcttttagtgggcactcaaatagatcttcgagatgatccaagcaccattgaaaaactcgctaagaataagcagaaaccaataaccccggagacagcagagaagctggcgcgagaccttaaagcggttaaatacgtggagtgttccgctctcacccagaaaggtctgaagaatgtctttgacgaggcaatcttagccgcactggagcctccggagccgaagaagtcaagaagatgcgttcttctgtag

SEQ ID NO: 23493 - DNA, 411 bp, Artificial Sequence
  Description of Artificial Sequence: Synthetic coding sequence
atgcagaccatcaagtgcgtggtggtgggcgacggcgccgtgggcaaaacgtgtctgctcataagttatacaaccaacaaatttccttccgaatatgtacccactgtatttgataactatgctgtcaccgtaatgatcggcggggagccctacacactggggctctttgacacggctggtcaagaagactatgatcgcctgcgtccgctgagttacccccagacagatgtgttccttgtttgtttctcggtcgtaagtccttcctccttcgaaaatgtgaaggaaaagtgggtgccagaaattactcatcattgtccaaaaactcccttcttgctggtgggcacccagattgatctcagggacgacccctccaccatcgagaaattggctaagaataagcagaaaccctag

SEQ ID NO: 23494 - DNA, 702 bp, Artificial Sequence
  Description of Artificial Sequence: Synthetic coding sequence
atgagccccgacatcctgcacaacaagcagatcagcatcggcatctgcacagattacttggatttcagttgggtgaattatattcatttcaaacagctgaagaatcagtggaaggtcaggcggggtgatacaggctttgccagatctgccggcaggcagaacagctctcgacaagattccaatgagtggtggtctcagtttggcgaagtgtgtcccacctcatggaacgaagtgtttgataattacgcagtcactgtaatgattggaggtgagccctatactttgggcttgtttgacactgcgggccaggaagactatgaccggctccgcccactgagctaccctcagactgatgtgttccttgtgtgcttctccgtggtcagcccatccagctttgaaaacgtgaaggagaagtgggtacctgagattactcatcactgtcccaagaccccgttccttctggtgggcacccaaattgatttgcgagacgaccccagcaccatcgaaaagctcgccaaaaacaaacaaaagcccatcacaccagaaactgccgagaaactagctcgcgatcttaaggctgtgaaatacgtggaatgcagtgccctgactcagaagggcttaaagaatgtgtttgacgaggcaatcctggccgccttagaaccccctgaaccaaagaaaagtaggcgatgtgttttgctctag

SEQ ID NO: 23495 - DNA, 1269 bp, Artificial Sequence
  Description of Artificial Sequence: Synthetic coding sequence
atgaacagcggccacagcttcagccagacccccagcgccagcttccatggggctggtggcgggtggggaagacctagaagtttcccccgagccccaactgttcatggtggcgcagggggagctcggattagcctaagcttcaccacacgatcatgccctcccccgggtggctcttggggatcaggccgctcctctccactgttaggggggaatggcaaggctaccatgcagaaccttaacgaccggcttgccagttacctagagaaggtgagagccctggaagaggccaacatgaagctggagtcacggattcttaaatggcatcaacaaagagatccaggcagtaagaaagattactctcagtatgaggagaatattacccatcttcaggaacaaattgtggatggcaagatgaccaacgcccagattattctccttatagacaatgcccgcatggctgtggacgattttaatctgaagtacgagaacgaacactcattcaagaaggacctggaaattgaggtggagggactgcgccggacacttgataatctgacaatagtgaccactgatctggagcaagaagtggagggcatgaggaaggagttgatactgatgaaaaagcaccatgagcaggaaatggagaaacatcacgtaccctcagacttcaacgttaacgtgaaggtcgatactgggcctcgcgaggatctcatcaaagtcctggaagacatgaggcaggaatatgagctgatcattaagaaaaaacacagagatttggacacctggtataaggagcaaagtgccgcaatgagtcaggaagctgcctcccctgctacagtgcagtctcgacaaggggatatccacgaactgaaacgcacctttcaggctctcgaaattgacctgcagacacagtattctaccaagtctgccctggaaaatatgctcagtgaaacacagagccgatattcctgtaaactgcaggacatgcaggagatcatttcccactacgaggaagagctgacccagctgaggcatgaactcgaacggcagaacaatgaataccaggtcttgctaggcataaaaacacatctggaaaaggaaatcaccacgtataggcggctgctagaaggtgaatccgaaggtacacgcgaggagtctaaatcatccatgaaggtgtcagcaacccctaagattaaagctattacacaggagaccatcaatggccgcttagtattatgccaggtgaatgagatacaaaaacacgcgtag

SEQ ID NO: 23496 - DNA, 1596 bp, Artificial Sequence
  Description of Artificial Sequence: Synthetic coding sequence
atggccgacgtgctgagcgtgctgcggcagtacaacatccagaagaaagagatcgtggttaagggtgatgaagtgatctttggagaattttcatggcctaagaacgtcaaaacaaactatgtagtgtgggggaccggaaaggagggacagccacgggaatactatacccttgatagcatcttatttttgcttaacaacgtccacctctcgcatccggtgtatgttagacgggccgccactgagaacattcctgtggttcgccggcctgaccgcaaagatttactaggctacctcaacggggaggccagcacttctgcgtctattgataggtctgcccctctcgagataggtctgcaacgaagcacacaggtcaagagggccgctgacgaagtcctggccgaagccaagaagccgagaatagaggacgaagaatgcgtgaggttagacaaggagcgccttgctgcaaggcttgaggggcataaggaaggtatcgtgcagacggaacaaattaggtccttgagcgaagccatgagcgtagagaagattgctgcaataaaagctaaaatcatggccaagaaacggagcacaattaagacagatcttgacgatgacatcactgctctcaagcagaggagtttcgtggatgctgaagtggatgtgaccagagacattgtctcccgagaacgggtatggcggacccgcactaccattctgcagtccacaggcaagaatttctccaagaacatcttcgcgatcctgcagtccgtaaaagctcgtgaggaaggcagagccccggagcagcgccctgcccctaatgccgcccccgttgaccccacgctgcggaccaaacaacctataccagcagcctacaatcggtacgaccaggagcgctttaagggcaaggaggagaccgaaggctttaagattgataccatgggtacctaccacggaatgacgttgaaaagcgtgaccgagggggcgtccgcccgcaaaacccagacacctgccgctcagcccgttcccaggccagtatctcaggctcggcctcctcctaatcagaaaaagggcagcaggacacctattattattattcccgcagccacgactagcctgatcactatgctgaacgccaaggatcttctccaggacctgaaatttgttccatcggacgaaaagaaaaagcaaggatgccagagagaaaatgaaaccttaatacagcgccgcaaggaccagatgcagcctgggggcaccgctatctctgttaccgtcccatacagggtcgtggaccagcctctcaaattgatgcctcaggactgggaccgggtggtcgctgtcttcgtacagggccccgcatggcagtttaaaggctggccatggttattacccgatggttctccagtcgacatatttgccaaaatcaaggcctttcatttgaagtacgatgaggtgagactggacccaaacgtgcagaaatgggacgtcaccgtacttgagttgtcctaccacaagcgacatctcgaccgcccagtgttcctgcgattctgggaaacgctagatcgctacatggtgaagcacaaatcacatctgcgtttttag

SEQ ID NO: 23497 - DNA, 951 bp, Artificial Sequence
  Description of Artificial Sequence: Synthetic coding sequence
atggccgacgtgctgagcgtgctgcggcagtacaacatccagaagaaggaaatagttgtcaagggggatgaagtgatctttggagagttctcttggcctaaaaacgtcaagacaaactatgtagtgtggggcaccggcaaggaggggcagccccgggaatactataccttagattccatcctgttcctgcttaataacgttcatctctctcacccagtttatgtgagaagagccgctacagagaacataccagtcgttaggcggccagacagaaaagacttgcttggttatctgaatggggaggcatctacatcagcgagcatcgatcggagcgcccctctcgagattgggctccagagaagtacccaggtgaaacgcgcagccgatgaagtgttggccgaggctaagaagccccgaattgaggatgaggaatgcgtgcggctcgacaaagagaggctggctgccaggctggagggacataaggaaggtattgtgcagaccgaacagatcaggtccctttccgaagctatgagtgtcgaaaagatcgctgctataaaagctaagattatggccaaaaagcgaagtaccatcaagacagacctggacgatgacattactgcgctgaaacaaagaagttttgtggatgcggaggtcgatgtgactcgggacattgtgagccgcgagagagtgtggcgcacccgcacaacgatcttgcaatccaccgggaagaacttctccaagaatattttcgctattcttcaaagcgtcaaggctagggaagagggcagagccccggaacagaggcccgccccgaacgccgctcccgttgacccaacattgcgtaccaagcagccaattcccgccgcctataaccgatacgatcaggagagaatttcaaacacacattatcacaatagttgcagttatcatctgttcaataatcatgcctag

SEQ ID NO: 23498 - DNA, 1317 bp, Artificial Sequence
  Description of Artificial Sequence: Synthetic coding sequence
atgggcggctgcgccggcagccggcggcggttcagcgacagcgagggtgaagagacagtgccagaaccccgactccccttactggatcaccagggagcccactggaagaatgcagtgggcttctggcttctcggcctgtgtaataacttttcctatgttgtgatgcttagcgccgctcatgacatcctttctcataagcgcacttcaggtaaccaatctcatgtggacccagggcctactccaatcccacacaattcctcatcacggtttgattgcaactctgtgtcgacagcagccgttctgctggcggacatactccccaccctggtcattaagctgttggccccactcgggctgcacctgctgccctatagccctagagtgctggtctcagggatttgtgccgctggatcctttgtgcttgttgcattttctcactcagtggggacctccctgtgcggcgtggtgtttgcatcaatctcctcggggcttggcgaggtgacattcctcagcctgactgctttctaccccagagccgtgataagctggtggagttcagggaccggaggggccgggctgttgggggccctgagttatttgggactgacccaagccggcctatcaccccaacagactctgctgagtatgctcggaatccctgcgcttctattggccagctatttcttgctgctgacatcaccagaagcccaggacccaggcggagaagaggaggcagagagcgccgctcgacagcctttgatcaggacagaggccccagagagtaagcccggttctagctcttcactctcgctaagagagcggtggaccgtgttcaaaggactcctctggtatatcgtgcctctggtcgtcgtttatttcgccgagtactttattaatcaaggacttttcgaactgttattcttctggaacaccagcctgagccatgcccagcagtatagatggtatcagatgctgtatcaagcaggggtctttgcctcacggagctccctgcgctgctgtcgaatcagattcacttgggccctggcccttctgcaatgccttaacctagtatttctgctggcagacgtgtggttcgggttcctgcctagcatctacctggtattcctaatcatcctctatgagggcctactcggcggtgccgcttatgtgaacacttttcataacatcgcactcgagacatcggacgagcaccgcgagtttgccatggcagcaacctgtatctcagacaccctgggaatcagcctctctgggttacttgcactccccctccacgatttcctgtgtcaactcagctag

SEQ ID NO: 23499 - DNA, 504 bp, Artificial Sequence
  Description of Artificial Sequence: Synthetic coding sequence
atgggcggctgcgccggcagccggcggcggttcagcgacagcgagggagaagaaactgtgcctgagccgaggctcccccttctggatcaccagggagcacattggaagaacgctgtcgggttttggctcttggggctgtgcaacaatttcagttatgtcgtaatgctcagtgcagcccacgacattctgtcccacaagcgaactagcggaaatcagtcgcaccctccaggaagccggcagtgggatttgtgctgctggaaactccggcccggctgtttattcagcttttgtggcgatcagccggtgtgctatttcctcttgcttacgagtcccgaagcccaggatccaggtggggaggaggaagcggagtcggccgccagacagcctttgatcaggaccgaagcacccgagagcaaacctggctcctcctccagcctgtctctgcgggaaaggtggactgtttttaaggggctcttatggtacatcgttcctcttgtcgtgtag

SEQ ID NO: 23500 - DNA, 1266 bp, Artificial Sequence
  Description of Artificial Sequence: Synthetic coding sequence
atgggcggctgcgccggcagccggcggcggttcagcgacagcgagggtgaggagaccgtacccgaacctagactgcctttgcttgaccatcagggggcacattggaaaaacgcagttggattttggctgcttggtctgtgtaacaattttagctacgtcgtgatgctcagcgccgcacatgacattctttcccataaacgaacaagcggaaatcaaagccatgtggaccccggccccacgcctatcccccacaacagcagcagcagatttgactgtaattctgtctccaccgctgctgtccttctggccgacatactcccgactttggtcattaagctgcttgctcccctgggattacacctgctcccatactcccctcgagtactggtctcagggatctgcgccgctggctcctttgtcctagtggccttttctcactctgtcgggacctcactttgtggcgtcgtcttcgcaagtataagcagtggcctcggcgaggttacgttcctttcccttaccgccttttaccctcgcgcagtgatatcctggtggtccagtggaaccgggggagccggccttctcggagccttaagttaccttggcctcacccaggccggcttatccccacagcagacattgctgagtatgctgggaatacccgcattgcttctcgcctcttacttcttactcttgaccagtcccgaggcccaggatccaggcggggaggaagaggctgagagcgcggcccgtcagccacttatcaggactgaggcacctgagtcgaagcctgggtcttcttctagcctatcactccgagagaggtggaccgtgtttaaagtccggatgatggccgggtttgaactgctctttttctggaataccagcctcagtcatgcacaacagtacagatggtaccagatgctgtaccaggccggtgtatttgcttctcggtcatcgctgagatgttgtcgtatcagatttacctgggcattagctttgcttcagtgcctcaacctggtgttcctgctagcagacgtctggtttggctttctaccaagcatctatctggtcttcctcataatcttatacgaaggtttactgggtggcgccgcctacgtgaatacgttccataacatcgccttagagacatccgacgagcaccgagagttcgcaatggcggcgacctgtatttccgacacgctgggcatttccctcagcggcctgctggcacttccactgcacgattttctgtgccagctctcttag

SEQ ID NO: 23501 - DNA, 1173 bp, Artificial Sequence
  Description of Artificial Sequence: Synthetic coding sequence
atgggcggctgcgccggcagccggcggcggttcagcgacagcgagggcgaagagaccgttccggagcccagacttccactgctggaccaccagggggctcactggaagaacgcggtgggcttctggctccttggactgtgcaacaacttttcctatgttgtgatgttatcagccgcacatgacatcttaagccacaaaaggaccagcggaaatcagagccatgtcgatccaggtcctacccctatccctcacaactcgagctcccgttttgattgtaatagcgtttcaactgctgctgtgctgctagccgatatcctccctactctcgtgatcaagctcttagccccactaggtttgcacctactcccttacagcccccgggtactagtgtccggtatttgtgcggctgggtcattcgtgttagtggccttttctcactccgtcggcacgtccctgtgtggtgtggtgtttgcctccatctcttcgggcctgggggaagttactttcctctctctcaccgccttctatcccagttactttctcctgctgacgtctcctgaagctcaagatcctggaggggaagaggaagccgagagcgccgctcgacaaccactcataaggaccgaggcacccgagtctaaaccagggtcgtccagtagtctttcacttcgcgaaaggtggacggtcttcaagggtctgctctggtacattgtaccgctggtggttgtgtattttgccgagtattttattaatcaaggcctgtttgagctgcttttcttttggaacacctcactctctcacgcccaacagtatcgctggtatcaaatgctgtaccaggctggagtgttcgcatctcgttctagcctgaggtgctgtagaatcagatttacatgggccctggctctgctccaatgtctgaacctggtgttccttctcgctgacgtatggttcggctttctaccttctatttacctcgtgtttctcatcatcctgtacgagggcctgttaggaggcgccgcctatgtgaacacatttcacaatattgccctcgaaacaagcgacgagcatcgagagttcgcaatggctgctacttgcatctccgacacactgggcatctccctgtccggcttgctggctctgcccttgcatgactttctgtgccagctttcctag

SEQ ID NO: 23502 - DNA, 762 bp, Artificial Sequence
  Description of Artificial Sequence: Synthetic coding sequence
atgggcggctgcgccggcagccggcggcggttcagcgacagcgagggagaggaaaccgtaccagaacctaggctgccattattggatcatcagggtgcgcactggaagaacgctgttggtttttggctgctcggcctctgtaacaacttctcatatgttgtgatgttgtcagctgcacacgacatcctgtcacataagcgtacttctgggaatcagagtcatgtggaccctggtcccaccccaatcccccacaattcttcatcacgatttgattgcaactcagtgagtacagccgccgtgctgctggcggatatcttacctactctggtaattaagctccttgcccctctcggcctccacctgctaccctatagcccccgagtactcgtatcaggcatctgcgccgctggcagtttcgtactggtggctttttctcatagtgtgggtacaagcttgtgcggctcatcctcctcattgtccctcagagaacgttggacagtgttcaaaggcctgctctggtacattgttcccctggtggtcgtatatttcgccgaatatttcatcaatcagggactgtttgagctgttatttttttggaacacctctctgagccacgctcagcagtacagatggtatcaaatgctgtaccaggccggggtgttcgccagccgatctagtctgaggtgctgcagaattcgattcacctgggctctggctctacttcagatggagtccagatcggtggcacaggccgggatgtag

SEQ ID NO: 23503 - DNA, 1020 bp, Artificial Sequence
  Description of Artificial Sequence: Synthetic coding sequence
atgggcggctgcgccggcagccggcggcggttcagcgacagcgagggagaagagactgtcccagaacccagactgcctttgctggatcaccaaggggctcattggaaaaacgctgtcggcttctggctgctgggattatgcaacaactttagctacgtggtcatgctctctgccgcgcacgacattctgtcgcataagagaacatccgggaaccagagccacgtggaccctggacccacaccaataccacacaattcctctagtcgatttgattgcaacagtgtgagtacggcaccccccgggtcccgacagtgggacttatgttgttggaagttaagaccaggctgtctgttctcgttttgcggcgaccagccagtgtgttacttccttctcctcacctcacctgaggctcaggatccaggtggcgaggaggaagccgaatccgccgctcgccagcctctgatccggaccgaagctccggagagtaagcccggatcatcgtctagtctatctttgcgagagcgttggaccgtgtttaagggactcctgtggtacattgtgccgcttgtagtggtgtacttcgctgagtacttcatcaatcaaggactcttcgagctgctgttcttctggaacacatctctgtctcatgctcaacagtacaggtggtaccagatgctgtaccaggccggggttttcgcctctcggagcagtctgagatgctgtcgcattcggttcacttgggctctggcgttactccagtgcttgaacttagtctttcttctggcagacgtctggttcggcttccttccctcaatctacctggtgttcctgatcatcctgtacgaagggctcttaggtggcgccgcgtacgtgaacactttccataacatcgccttggagaccagcgatgagcaccgtgaatttgccatggcagctacttgcatcagcgatactctgggaatttcactttctgggttgcttgcattacccctgcacgacttcctttgtcagctctcctag

SEQ ID NO: 23504 - DNA, 1155 bp, Artificial Sequence
  Description of Artificial Sequence: Synthetic coding sequence
atgctgagcgccgcccacgacatcctgagccacaagcggaccagcggcaaccagagtcacgtggaccccggcccaacacccatcccccacaacagctcttcccgattcgactgcaacagcgtatcaacagccgctgttctattggccgacatcctccccaccctcgtcatcaaactactcgccccgttggggctccatctgctgccatattcaccacgggtgctcgtcagcggcatctgcgctgcaggctcatttgttcttgtagccttctcacatagcgtgggcacttccctgtgcggagtcgtgttcgctagtattagcagtggtttaggcgaggtcacatttctgagcttaaccgctttctatcctagggcagtgatttcttggtggtcatctggcactggaggtgccgggcttcttggcgctcttagctacctggggctcacgcaggcgggcctgagtccacagcagactctgttgagcatgctcggaatccctgccctgctactggcttcttacttcctcctgttgactagccccgaggcccaagatcccggaggagaagaagaagccgaaagtgctgcccgtcagcccttgatccggaccgaggctcccgaaagtaagcctggatcctcttcatcactatccctcagggagcgctggacagtctttaagggacttctttggtacatagtgcccctcgtggtagtttatttcgccgagtacttcattaatcaggggttgtttgaactattgttcttctggaacacatctctgtctcatgcccagcaatataggtggtaccagatgctttatcaggcaggcgtgttcgccagtcgcagctccctccgttgttgtcgtattcgttttacctgggctctcgcattgcttcaatgcctgaatttggtatttctgctggccgatgtatggttcggcttcctcccatctatttacttagtattcctcattattctctacgaggggctgctggggggagccgcctacgtgaacacgtttcacaatattgcgctggagacttccgacgaacacagagagttcgctatggccgccacatgcatctcggacacactcggcataagcctgtccggcctcctggcactccctctacacgatttcttatgtcagctgagctag

SEQ ID NO: 23505 - DNA, 1317 bp, Artificial Sequence
  Description of Artificial Sequence: Synthetic coding sequence
atgggcggctgcgccggcagccggcggcggttcagcgacagcgagggagaagaaaccgttcccgagcctcggcttccacttttggatcatcagggggcccattggaaaaatgcagtcgggttctggctcctggggctctgtaataatttctcatatgtcgtgatgctttctgccgcacacgatattctttcacataaacgcacatccggtaaccagtcacacgtcgaccctggaccgacgccaatcccacataacagttcttctcggttcgactgtaatagcgtatccactgccgcagtgctgctggccgatatcctgccaaccctcgttatcaagctgctcgccccattgggactgcatctcctcccgtactccccacgggtacttgtttccggaatctgcgccgcaggttcctttgtgctggtggcattctcccactccgtcggaacatctctgtgtggagtagttttcgccagtatttcaagtgggttgggcgaggtgactttcttgagcctaaccgcgttctatccaagagcagtcatcagctggtggtccagcggtacaggaggggctggtttactgggggctctcagctacttggggcttacccaggcaggtttatcccctcagcagacacttctgtctatgctgggcatccccgccctgcttttagcctcatacttcttgctccttacaagtcctgaggcacaagaccctggtggggaagaagaggcggaatccgcagcccgtcagccgctgattagaacagaggctcccgagagcaagccaggaagcagctccagcctatccctcagagaaaggtggacagtctttaaaggcctgctgtggtacattgttccccttgtcgtggtatatttcgccgagtactttatcaaccaaggtctgttcgaactcctgttcttctggaacacgagtctctcacacgcccaacagtataggtggtaccagatgctctatcaagctggcgtttttgccagtcggagtagcctgcgctgctgcagaatacgatttacctgggcattggctttactgcagtgtcttaacctggtgtttctcctggcagacgtttggttcgggttcctccccagcatttatctcgtttttctgataattctgtatgagggtctcctcgggggtgcagcttatgtcaataccttccataatatagccctggaaacaagtgatgaacacagagagttcgcgatggccgcaacatgtattagcgatacccttggaataagtctgagcggtctcctggcccttcccctgcatgattttctgtgccaactaagttag

SEQ ID NO: 23506 - DNA, 1317 bp, Artificial Sequence
  Description of Artificial Sequence: Synthetic coding sequence
atgggcggctgcgccggcagccggcggcggttcagcgacagcgagggagaggaaacagtgcccgaacccaggctgccattgctcgatcaccagggcgcccattggaagaacgccgtcggcttctggctgctaggcctgtgtaacaatttttcatacgtcgtgatgctttccgccgctcacgacatcctgagccataagaggaccagcggcaatcaaagccatgtcgatcctggacctaccccaatccctcacaattcttcctctagattcgactgcaacagcgtgtctaccgccgctgtgttactggcggacatcctgccaactctggtcatcaaattgctggccccattaggcttgcatctcctcccatatagcccaagggtgctcgtctcaggtatttgcgcagctggctccttcgtgctggtggcattttctcattcagtgggcacgtccctatgcggcgttgtgtttgcttccatctcctcaggactgggagaggtaacgtttctctcactgaccgctttttaccccagagctgtgatctcttggtggtcatctggcactggaggggcaggcctgctcggtgctctgtcctatctgggattgactcaagccgggttgagcccccaacagacactattgtccatgctgggcatacctgctctgttgctcgcaagttatttcctgttactcacaagtccagaggcccaggatccaggaggggaggaagaagcggaatccgccgcgaggcagcccctgatacggactgaggcacctgagagtaaacctgggagttcgtcatcgctatcactgcgcgaacgatggactgtatttaaaggacttctgtggtacattgtgcccctggtggttgtctactttgcagaatactttatcaatcagggtcttttcgaactgctcttcttctggaatacctcattgagccatgcccagcaataccgatggtaccagatgttgtaccaggctggcgttttcgcatccaggtccagtttacgctgctgccggattaggttcacttgggccctggctctgttgcagtgtttaaatctcgtctttctcttagctgatgtgtggtttggtttcctcccgtctatttacttggtgttcctgataatactctacgagggtttgctgggtggcgccgcttacgtgaacacttttcataacatagccctggaaacaagcgacgagcacagggagtttgctatggccgctacatgcatcagcgatactctcgggatttccctgtccggattgctggccttgcccctccatgatttcctgtgccagctcagctag

SEQ ID NO: 23507 - DNA, 1017 bp, Artificial Sequence
  Description of Artificial Sequence: Synthetic coding sequence
atgtggacccaggcccagcggcggagccccaccaccgcccaccacgacttaacagcaacgctcagcttgcggcttccaagggtgttggtgtcgggaatctgtgcggccggatcattcgtgcttgtcgcatttagccattcagtgggcacttcactgtgcggcgtggtttttgccagcatttcatccgggctaggcgaggtcaccttcctgagtctgactgcattttacccacgcgcagtgatttcttggtggtcctccggcaccggcggcgccggcttactcggcgcattgtcctacttgggtctcacacaggcgggcctgtccccacagcagactctcttaagcatgctcggcatccctgcattgctgctagcgtcctactttttgcttctcacctcccccgaagcacaggacccaggaggcgaagaggaggcagagagcgcagcaaggcagccgctcatccgcaccgaggctccagaatccaaaccaggaagctcctctagcctctctctgagagaacgctggaccgtgttcaagggcctgctgtggtacatcgtgcctctcgttgtggtttacttcgccgagtactttataaaccagggcctctttgagttgttgtttttctggaatactagcctcagtcacgctcaacagtaccgctggtatcagatgctgtaccaagccggagtgttcgcttccagatcaagcctgagatgctgtcgtatcaggtttacctgggcactagcacttctgcaatgtctgaacctcgttttcctattagcagacgtgtggtttgggttcctcccctccatctatctggtgttcttgatcatcctatatgaaggtttgttaggtggcgccgcttacgttaatacttttcataatatcgctctggaaacatctgatgagcaccgggaatttgccatggcagctacatgtattagcgacacactcggcatcagcctgtctgggttgcttgccctgcctctgcacgattttttgtgtcagctgagctag

SEQ ID NO: 23508 - DNA, 1083 bp, Artificial Sequence
  Description of Artificial Sequence: Synthetic coding sequence
atgctgagcgccgcccacgacatcctgagccacaagcggaccagcggcaatcagtctcatgcggtattacttgccgacatcttgccaactctcgttatcaaactcctggcaccactcggcctacatctgctgccttactcgcctcgagtgctggtaagcggcatctgcgctgccggctccttcgtactggttgcgttttcacattccgtggggacatcactgtgcggagtagtttttgcctctataagttcaggtttgggagaagtaacgttcctatcactgacggccttctatccccgtgccgtgatatcatggtggtcaagtggcaccggcggggccgggcttctgggcgcattatcgtacctgggactcacccaagcaggtctcagtccacaacaaacactgctcagtatgctggggatacctgcgctgcttttggcatcctattttctgttactgacgagtccagaagctcaggatcctgggggggaggaagaggccgaaagtgcagctagacagcccctgatcagaacggaggctccagagtccaaaccaggctcttcatcttcactctctctcagagaaaggtggacagtgttcaaggggctgttatggtacatcgttcccctagtcgtggtgtactttgcagaatattttattaatcaggggctgttcgagttgttattcttctggaatacctccttatctcacgcacagcaataccgctggtatcagatgctttaccaggccggcgtatttgcatccaggtcatcactgagatgctgccggatcagattcacttgggcactagcgctcctacagtgtttaaacctggtgttcctgttagccgacgtgtggtttgggtttctgccctccatctacctcgtgtttctgattattctttacgaaggccttctcggaggagcggcttacgtaaatacttttcataacatagcccttgagacctctgacgagcatcgggaattcgctatggccgctacttgtatctcagatacacttggaatctcattgtcgggattgttagccctacccctccacgacttcctctgtcaactgtcctag

SEQ ID NO: 23509 - DNA, 1299 bp, Artificial Sequence
  Description of Artificial Sequence: Synthetic coding sequence
atggccgtgcccttcgtggaggactgggacctggtgcagaccctgggcgaaggcgcttacggggaagtacagcttgcggttaaccgggtcacagaggaggcagttgctgttaagatagtagacatgaagcgggccgttgactgtcccgaaaatatcaagaaggaaatctgcatcaataagatgctgaaccacgaaaatgtggttaagttttacggtcatcgtagggagggaaatatccaatatctgtttctggagtactgttcaggcggtgaactcttcgaccggattgaaccagatattggcatgcctgagccggacgcccaacgcttcttccaccagttgatggcaggggtggtgtatcttcacggtatcggaataactcaccgcgatatcaagcccgaaaatctgctgctcgatgaacgggataacctaaaaatcagtgacttcgggctggctaccgtctttaggtataataaccgcgaaaggcttctcaacaaaatgtgcggtactctgccctatgtcgcacctgagctgctgaagcggcgagaattccacgccgagcccgtcgacgtttggagctgtgggattgtgctgaccgcaatgctggctggagagttaccgtgggaccagcccagcgactcctgccaggagtacagtgactggaaagaaaagaaaacttatcttaatccctggaagaaaatcgattcggccccacttgccttgcttcataagatcttagtggagaaccctagcgctcggatcaccattcctgatattaaaaaggatcggtggtacaacaaacctctcaagaagggggccaaaagaccacgggtgacatccgggggtgtgtccgaatccccgagtggcttcagtaagcatattcagtcgaatctggacttctcaccagtgaattctgcaagtagcgaagagaacgtaaagtattctagttcccaacctgaacccagaaccggattgtcactgtgggatacttctccaagttacatagacaagttagtgcaaggcattagcttctctcagccaacatgtccggatcatatgcttctgaattcacagctgcttggaaccccggggagctcacaggtcacgatctcaaccaccgaccgtcggaacaataagttgattttcaaggtaaacctgctggagatggacgacaaaatcctggtcgactttaggttgtccaagggagatggtctagagttcaaaaggcacttcctgaagatcaaaggaaagctcatagacatcgtgagttcgcaaaagatctggctgccggccacttag

SEQ ID NO: 23510 - DNA, 1431 bp, Artificial Sequence
  Description of Artificial Sequence: Synthetic coding sequence
atggccgtgcccttcgtggaggactgggacctggtgcagaccctgggagagggcgcttatggggaggtccagctggcagtaaaccgggtgacagaagaagctgtcgctgtcaagatcgttgatatgaaaagggccgtggattgtcccgagaatatcaagaaggagatttgcataaataagatgctgaaccacgagaacgtggtaaagttttacggccatcgcagggagggcaatatccagtacctgtttcttgagtattgctcagggggcgagctgtttgaccgcatagagccagacatcggtatgcctgagccagatgcccagcgcttcttccaccagctgatggctggcgtcgtctacttacacggaataggaatcacacatagagacatcaaacccgagaacctgctacttgatgaaagggataatctgaagatctctgatttcggcctagctacggtcttccgttataataaccgcgagcgtttgctgaataaaatgtgcggcacgcttccctacgttgctcccgagctgttgaagcgtcgtgagtttcatgcggagccagttgacgtatggtcatgcggaatagtgttaaccgcaatgttggccggcgaattaccatgggatcagccttctgattcttgccaagaatacagcgactggaaagagaagaagacttacctcaacccatggaagaagatcgatagtgcaccccttgccttactccacaagatcttagtcgaaaacccctcagctagaatcaccatccccgatattaaaaaggatcgctggtacaataaaccacttaaaaagggcgcaaaaaggccccgtgtgacctcaggtggcgtaagtgagagtccctctggattctccaagcacattcagagcaacttggacttcagtcctgtgaactctgcttcctccgaagagaacgtgaagtacagctcttcccagcccgagccaagaaccggtctgtctctgtgggatacatcaccctcttatatcgataagcttgtgcagggaattagtttcagccagccaacctgccctgaccatatgttactgaacagccaactgctgggcacgccagggagcagccagaacccctggcaacgcctcgtgaaacgcatgaccaggttcttcacaaagctggatgctgacaagtcctatcagtgcctgaaggaaacatgcgagaagctgggatatcaatggaagaagtcatgtatgaaccaggtgacaatcagtaccactgacagacggaataacaagctgattttcaaggttaatctcctcgagatggatgacaagatcctggtcgacttcagactgagcaagggcgacggcctggaatttaagagacattttctgaaaatcaaaggtaaacttatcgacatcgtatccagccaaaagatctggctgcctgccacctag

SEQ ID NO: 23511 - DNA, 1431 bp, Artificial Sequence
  Description of Artificial Sequence: Synthetic coding sequence
atggccgtgcccttcgtggaggactgggacctggtgcagaccctgggtgagggagcctacggagaggtccaactggctgtgaacagagtgactgaggaagcagtcgctgttaaaatagtcgatatgaaacgggctgtggactgtcccgaaaacattaagaaggaaatctgtatcaacaagatgctgaatcatgagaacgtcgtgaaattttacggacatcgccgtgaaggcaatatccagtatctgtttctagagtattgctcaggcggagagctcttcgaccgtattgaacctgacatcggtatgcctgagccagacgcccagcgcttcttccaccagctgatggccggcgtagtctatttgcatggcatcggcatcactcacagagacatcaagcctgagaaccttcttctcgacgagcgagacaatctgaagatctctgatttcggtctagccacagtatttcgctataataatagggagcggctgctgaataaaatgtgcggtaccctaccctacgtggcaccggagctgctgaaacgcagagaattccacgccgagccggtggatgtctggtcttgtggaattgtcttgacagctatgttagctggggaactgccatgggaccagccatctgatagctgccaggagtattcagactggaaagaaaaaaaaacttacctcaatccttggaagaaaattgactctgcacccttagccttactgcataaaattctggtggagaacccaagcgcccggataacaatcccagacataaagaaggatcgatggtataacaaaccactgaagaagggcgctaagcgccccagagtgactagcggaggtgtgtcggaaagcccttcaggattcagcaaacatatccaatctaatctggatttttccccagtcaacagcgccagctccgaagaaaatgtgaagtactccagcagccaacccgagcctaggacaggcctatctctgtgggacaccagcccctcttacatcgataagctggtccaggggatcagcttctcccagccgacatgccccgaccatatgctactcaactcacagctgctgggcacacccggtagctctcagaacccctggcagagactcgtgaagagaatgacgcgcttcttcacaaaactagacgctgacaaatcctaccagtgcctcaaagagacttgcgagaagctcggctatcagtggaaaaagtcgtgtatgaaccaggtcaccatctctactaccgatagaaggaacaacaaactgatctttaaagtcaatctgctggagatggacgacaagattctggtggattttagactgtctaaaggcgacgggctggagtttaaacgacatttcctgaaaataaaggggaaactgatcgacattgtatctagccagaagatatggcttccggccacctag

SEQ ID NO: 23512 - DNA, 1431 bp, Artificial Sequence
  Description of Artificial Sequence: Synthetic coding sequence
atggccgtgcccttcgtggaggactgggacctggtgcagaccctgggcgagggtgcgtacggcgaagtacagttggccgtaaacagggtgaccgaagaggctgtggccgtgaagattgtagatatgaagcgagctgtggactgtcccgagaatattaagaaggaaatctgtataaataagatgttgaaccatgagaatgtggtaaagttctacggacaccgacgggagggaaatatccagtatcttttcttagagtactgctccggtggggagctcttcgacaggatagagcccgatatcggcatgccagagcctgacgcccagcgcttttttcatcagctgatggccggggtcgtgtacttacatgggatcggcatcacgcaccgggacattaagcccgaaaacctcctgctggacgaaagagacaatctgaaaatatcagacttcgggctggccacggtcttcagatataacaaccgtgagcgactcctgaacaagatgtgcggaacgctgccctatgtggctcccgaattgctaaagcggagggagttccacgcggagcccgtggatgtgtggtcatgcgggattgtactgaccgcaatgcttgcgggcgagctcccctgggatcagccttctgactcctgtcaggaatacagtgactggaaagagaaaaaaacttatttgaacccgtggaaaaagattgattccgctcctctggctctcctgcacaagatacttgtggaaaacccttcagctcgcatcaccattcccgacattaagaaggacagatggtataacaaacccctcaagaagggagccaaacgacctcgggtcacttcaggtggagtctctgagagccccagtggatttagtaagcatatccagtccaatctggacttttcacctgtaaactcagcttcctcggaagaaaacgttaaatactctagctcgcagcccgagccaagaaccgggctatcgctctgggacacttctccttcatacatcgataaactggtgcagggcattagctttagtcaaccaacatgccctgatcatatgctcctgaacagtcagctgctgggaactcctggtagttcgcagaatccatggcagcgactggtgaagaggatgacgcggttcttcactaaactggacgctgataaaagctaccaatgcctcaaagagacttgcgagaagctgggctatcaatggaagaagtcatgcatgaatcaggtaacaatcagtactactgatcgccgcaacaataagctcatcttcaaagttaacctgctggagatggacgacaagatcctcgtggactttagactgtccaagggtgatggactggaatttaagaggcacttcctgaaaataaaaggcaaactgattgacattgtttcatctcagaaaatttggttgcccgccacttag

SEQ ID NO: 23513 - DNA, 402 bp, Artificial Sequence
  Description of Artificial Sequence: Synthetic coding sequence
atggccgtgcccttcgtggaggactgggacctggtgcagaccctgggcgaaggtgcttacggtgaggtgcagttagcagtcaatcgcgtgacggaggaagcagtcgcagtaaagatcgttgatatgaaacgggctgttgattgccccgagaatatcaaaaaggagatatgcatcaacaaaatgctcaaccatgagaatgtggtcaagttttatggccatcgaagggaagggaacatacagtatttgttcctggaatactgctctggcggggagctgtttgacagaatagagcctgacattggcatgccagagccggacgcacagcgattctttcaccagctcatggctggcgtggtttacctgcacggaatcgggatcactcacagagatattaagccgtag

SEQ ID NO: 23514 - DNA, 513 bp, Artificial Sequence
  Description of Artificial Sequence: Synthetic coding sequence
atggccgtgcccttcgtggaggactgggacctggtgcagaccctgggcgagggcgcttatggcgaagtgcagctggcagttaatcgggtgaccgaagaagcagtggctgttaaaatcgtagatatgaaacgggctgtcgactgccctgaaaacatcaaaaaggaaatatgcataaataagatgctaaatcatgagaacgtcgtcaagttctatgggcacaggcgggaagggaacatacagtatctgttcctggaatattgctccggcggagagctcttcgacagaattgagcctgacattggaatgccagaaccagatgcccaacggttttttcaccagctaatggcaggcgtcgtatatttgcatggcattggcataactcaccgcgacatcaagcccgaaaacctgttattggacgagcgggataatctcaagatcagtgacttcgggttggctacagtgtttaggtataataaccgagagcgcttattaaataaaatgtgcggtacctag

SEQ ID NO: 23515 - DNA, 615 bp, Artificial Sequence
  Description of Artificial Sequence: Synthetic coding sequence
atggccgtgcccttcgtggaggactgggacctggtgcagaccctgggagaaggagcatacggcgaggtgcagctcgccgtcaaccgtgtcacagaggaagctgtggctgtgaagatcgtggatatgaaacgggcagtggattgcccagagaacattaagaaagaaatctgcattaataaaatgctgaatcatgagaacgttgtcaaattttacgggcatcggcgcgagggaaatatccagtatctgtttctggagtattgctcggggggcgagctcttcgaccggattgagcccgacatcggcatgccagagcctgatgcccaacggttctttcatcagcttatggccggcgttgtttatcttcacggcattgggattacgcatcgcgacattaagccagagaaccttctcctagacgaacgggataatctgaagattagcgactttggcctggcaaccgtgttccgatataataacagagaaagactattaaataaaatgtgtggtacgttgccttacgtggccccagaactgttgaaacggcgggaatttcacgcagaacccgttgatgtgtggtcttgcggaatcgtcctgactgccatgctggccgggtag

SEQ ID NO: 23516 - DNA, 129 bp, Artificial Sequence
  Description of Artificial Sequence: Synthetic coding sequence
atggccgtgcccttcgtggaggactgggacctggtgcagaccctgggagagggagcgtatggcgaggtccagctggccgtgaacagagttacggaagaggcagtcgccgtaaagatagttgacatgtag

SEQ ID NO: 23517 - DNA, 1431 bp, Artificial Sequence
  Description of Artificial Sequence: Synthetic coding sequence
atggccgtgcccttcgtggaggactgggacctggtgcagaccctgggagagggggcttacggtgaggtccaattagctgtcaacagggtcaccgaggaggcagttgcagtgaagatagtggatatgaaacgcgccgtggattgtcctgaaaacattaagaaagaaatttgtattaacaagatgctgaatcacgaaaacgtggtgaaattttacggacataggagggaggggaacattcagtatctattccttgagtattgctccggcggtgagctgttcgacaggatcgaaccagacatcggcatgcccgaacctgacgcacagagatttttccatcaactcatggctggggtggtctatctgcatggcattggcatcacccatagagatatcaaaccagagaatctactcttggatgagcgcgacaacctgaaaatctctgacttcggtttggccacagtcttccgatataacaacagggagcgcctcctgaacaagatgtgcggaactttaccatacgttgcccctgagttgctgaagaggagggagttccacgcagagcctgtggacgtgtggtcatgcgggattgtgctcacggccatgcttgcgggggagctaccctgggaccagccctcggactcatgtcaagaatacagtgactggaaagagaagaaaacctatctcaatccttggaaaaaaatcgactcagcgccactcgccctgcttcacaagattctggttgaaaacccttctgcgcgtatcaccatcccagacatcaagaaggaccggtggtataacaagccgctgaaaaagggcgccaagaggccacgggtgacctcagggggagtctctgaaagcccttcagggtttagcaagcatattcagagtaatcttgatttcagtccagttaactccgcttcttcagaggagaacgttaagtactcaagctcacagcccgagcccagaacgggcctcagtctgtgggacacctctccttcgtacattgacaagcttgtgcagggcatctctttctctcagccaacttgccccgatcacatgcttttgaacagccagctcctgggaactcccggaagctcccagaatccctggcagcgactcgtgaaaaggatgacaaggttttttactaaattagatgccgacaagtcctaccaatgcctgaaggaaacctgtgagaagctgggttaccagtggaaaaagtcttgcatgaaccaggtcaccatcagcacaaccgaccgccgaaacaataaactcatattcaaagtgaatctgctcgagatggatgacaagatcctggttgactttaggctctccaaaggagatggattagaatttaagaggcatttcctaaagattaaggggaagctcatcgatattgtgagcagccaaaagatttggctgcctgccacctag

SEQ ID NO: 23518 - DNA, 384 bp, Artificial Sequence
  Description of Artificial Sequence: Synthetic coding sequence
atggccgtgcccttcgtggaggactgggacctggtgcagaccctgggcgagggggcctacggtgaggtccagcttgctgtgaatcgggtgactgaggaggccgtagctgtgaaaatcgtcgacatgaaacgcgccgtggactgtcccgaaaatattaagaaagaaatctgcataaacaagatgctgaatcacgagaacgtggtaaagttctatggacataggcgcgagggaaacattcagtatttgttcctcgagtattgcagtggcggagagctctttgaccgcattgaaccggatattggcatgccagaacccgacgcccaacgatttttccaccagctcatggccggcgtggtgtacctccatgggattgggattacatag

SEQ ID NO: 23519 - DNA, 1329 bp, Artificial Sequence
  Description of Artificial Sequence: Synthetic coding sequence
atggccgtgcccttcgtggaggactgggacctggtgcagaccctgggtgagggagcctacggagaggtccagctggctgtgaaccgcgtgactgaggaggccgtggcggttaaaattgtcgacatgaagagggccgtggattgcccagaaaacatcaagaaggagatatgcattaacaaaatgctgaatcatgagaacgttgttaagttttatggacaccgcagagaaggcaacattcagtacctgtttttagaatattgttctggaggcgagctgttcgatagaattgaaccggatatcggaatgcctgaaccggacgcccagcgctttttccatcagcttatggccggcgtggtgtacctgcacggcattgggatcactcaccgagatattaaacccgagaatttactccttgatgaacgggataaccttaagatctcagattttggactggcaacagtctttagatacaacaatagagaaagactgctgaacaaaatgtgtggcaccctgccctatgtggcacccgaactgctaaagagaagagagtttcacgccgagcctgtggatgtatggtcctgcgggattgtgctaacagccatgttggccggggaattgccctgggatcagccatcagactcttgccaggagtatagcgattggaaagagaagaagacttatctcaacccttggaagaagatcgactccgccccactagccctccttcataaaattctggtcgagaatccttccgcgagaatcactatccccgatataaaaaaggaccgttggtataataagccactcaagaagggagctaaacgccctcgcgtaacatctggtggcgtgtccgaatctccttcaggcttttcaaaacacattcagtcgaacttagatttttctccagtgaacagcgctagctccgaagagaacgtaaagtattctagctctcagccggagccgagaacaggactaagcctctgggacacctcgccgagctatattgacaaactggtgcagggcatcagtttttctcagcccacgtgcccagaccatatgctcctcaatagtcagctgctgggtacacccggcagtagccagaacccttggcaaaggctggtgaagagaatgacacgattctttaccaaattagatgcagacaagagttaccaatgcctgaaagagacttgcgaaaaacttggctaccagtggaagaagagctgcatgaaccagggagacggcttggaatttaaaagacatttcttgaaaataaagggcaagcttattgatatcgtcagctcccagaagatttggctgccagctacatag

SEQ ID NO: 23520 - DNA, 1632 bp, Artificial Sequence
  Description of Artificial Sequence: Synthetic coding sequence
atgagccgggagagcgacgtggaggcccagcagagccacggcagcagtgcatgttcacagcctcatgggagcgttacacagagccagggaagcagctcacagtctcagggcatatcaagtagctccacttccacaatgcctaattcgtcccaatcatctcactctagttctgggacactttccagccttgagacggttagcacacaagaattgtattctatcccggaggatcaggagcccgaagaccaggagcctgaggagccaacgcctgcgccttgggcccggctgtgggccctgcaggacggttttgcgaacctggaatgtgttaacgataattattggtttggacgtgataaatcttgtgagtattgcttcgacgagccccttctcaaacgcaccgataagtacaggacttactctaaaaaacattttaggattttccgggaggtgggtccgaagaattcctacatcgcgtacattgaggaccacagtgggaacggaacctttgtcaacaccgagctggtggggaaaggcaaaagaaggccactgaataacaacagcgagattgccctctctctctctaggaacaaggtcttcgtcttctttgatcttactgtcgatgatcagtccgtctaccctaaagcacttagagatgagtatatcatgagcaaaacactgggttctggcgcctgcggtgaggtaaaactcgcctttgaacggaagacttgcaaaaaagttgcgatcaagattatttctaaacgtaaattcgccataggctcggcgcgggaggccgaccctgcgctaaacgtcgaaactgaaattgaaattctcaaaaaactgaatcacccatgcattattaaaatcaagaacttcttcgatgcggaggactactacatcgtgttggaactgatggaagggggagagctgttcgacaaggtcgtggggaacaaaagactcaaagaagctacctgtaaactgtacttctatcaaatgcttttggctgtgcaatatctgcatgaaaacggtataatccaccgggatcttaaaccagaaaacgttctgctgtccagtcaggaggaggactgcttaatcaagatcaccgacttcggccacagcaaaatcctgggagaaacgagtttaatgcgaaccttgtgcggaacgcctacgtatctcgctcccgaagtgctggtcagtgtaggtactgccggttacaaccgtgcagtggattgctggagcttgggagtgatcctgttcatctgtctgagcgggtatccaccattttctgaacaccgcacccaagtgagcctgaaggaccagataacaagtggtaagtacaatttcattccagaagtctgggccgaagtaagtgagaaggccctggacttggtgaaaaagttgttagtggtagacccaaaggctaggtttacaacggaggaagctctccgtcacccttggctccaggacgaggatatgaagcggaaatttcaggatcttctgagcgaagagaacgaaagcaccgctctgccccaggtgttagctcagccctcaacatccaggaaacggcctcgggagggggaggccgaaggggcagagaccactaaacgaccggcggtatgtgcagctgtgctatag

SEQ ID NO: 23521 - DNA, 1545 bp, Artificial Sequence
  Description of Artificial Sequence: Synthetic coding sequence
atgagccgggagagcgacgtggaggcccagcagagccacggcagcagtgcctgctcccagccccacggcagtgtgacacagtcccaggggtccagttcacagtcccagggaatttcttccagcagcacatcgactatgcctaactcttcccaatcttcccacagctctagcggaaccttgagcagcctggagacggtatccacccaagagttgtatagcatacctgaggatcaagaaccggaggaccaggaaccagaggaacccaccccagccccctgggccagactatgggcccttcaggatggcttcgctaaccttgaatgtgtgaacgataattattggtttggccgcgataagagctgtgagtactgcttcgacgaacctctcctgaagagaacagataagtatagaacctactcaaaaaaacacttcaggatcttccgagaggttggcccaaagaactcctacatcgcctacatcgaggaccacagcggcaacggaaccttcgtgaatacagaactggtgggaaagggtaaaagacgccctctgaataataacagcgaaatagccctgagcctgagtcgtaataaagtctttgttttctttgacctcacagtggatgaccagtctgtgtaccccaaagctctgcgggatgagtacataatgtccaagacgctggggagcggtgcatgtggcgaagtaaagttggcgttcgaaagaaagacctgtaaaaaggtggcgattaagatcattagcaagaggaaatttgccattggctcggcacgagaagctgacccagcactcaacgtcgagacagagatcgagatactcaaaaagcttaaccacccatgtattattaagattaagaacttcttcgatgctgaagactattatattgtcttggagctcatggaggggggggagctattcgacaaggtggttgggaacaagagacttaaggaggcaacgtgcaagctctacttttatcagatgttgctggcggttcagataacggatttcggccattccaagattcttggcgagacatctcttatgagaactctttgtggcaccccgacataccttgcccccgaggttctggtgtcagtaggcaccgccggatataaccgagccgtggactgttggagcctgggtgtgatcttgtttatttgcctcagtggctacccacccttctcagagcacagaacccaggtgtccttgaaggaccagattaccagcgggaagtacaacttcatacccgaagtctgggccgaggtgtccgagaaggccctggacctagttaaaaagcttctggttgtggatcccaaagctcggttcacaaccgaagaagccttacggcacccctggcttcaagatgaagatatgaaaagaaagtttcaagacctgctttcagaggagaatgagtcaactgctcttcctcaggtgctcgcccagccctcgaccagccgcaagcggccgagggaaggagaagccgagggagccgagacaacaaaaaggccagctgtatgcgccgccgtcttgtag

SEQ ID NO: 23522 - DNA, 681 bp, Artificial Sequence
  Description of Artificial Sequence: Synthetic coding sequence
atgagccgggagagcgacgtggaggcccagcagagccacggcagctctgcttgctcacaaccccacggctcagtgacacagagtcaggggagctcaagccaatcccaaggtatttcctctagctccacatccaccatgccaaatagctctcagagctcccattcatcttccgggacactgagcagccttgagactgtgtcgactcaggaactgtatagtattcctcccgaggtgctggtcagcgtgggaacggcagggtacaaccgcgctgtggactgttggtccttgggcgtgatcttgttcatctgcttgagcggttatccccctttctctgagcataggacccaggttagcctcaaggatcagattacatccggtaaatataacttcatcccagaggtttgggccgaggtcagcgaaaaggcgctggatttggtgaaaaaactacttgtggttgacccaaaggctaggttcaccacagaagaggctctgagacacccctggctgcaggatgaggatatgaaaagaaaattccaggacctcctcagtgaggagaacgagagcacagccctcccgcaggtcctggctcagccaagtacttctcgtaaacggcccagggaaggagaagctgaaggtgccgaaaccacaaagagacccgccgtgtgtgctgccgtgctgtag

SEQ ID NO: 23523 - DNA, 492 bp, Artificial Sequence
  Description of Artificial Sequence: Synthetic coding sequence
atgagccgggagagcgacgtggaggcccagcagagccacggcagctctgcatgctcacagccccacggctcggtaacccagtcccagggatcctcaagtcagagtcagggcattagcagctcttcaacatcaacaatgcctaatagttctcagtcgagccattcttcaagtggaaccctatccagtctcgaaactgtgagcactcaggagctgtacagtatacctgaggaccaggagcctgaggaccaagagcctgaggaacctacccccgctccttgggccaggctctgggcgctgcaggatggtttcgccaatcttggtgacgaagatatgaagcgaaaatttcaggacctgctgagtgaagaaaatgagtctaccgccctgccccaagtactggcccagccttcaactagccggaaaaggccccgagaaggcgaggccgagggcgcagaaacaacaaagcgtccggccgtgtgtgccgctgtgttgtag

SEQ ID NO: 23524 - DNA, 870 bp, Artificial Sequence
  Description of Artificial Sequence: Synthetic coding sequence
atgagccgggagagcgacgtggaggcccagcagagccacggcagctcggcgtgttctcaaccacatgggtctgtaacgcagagtcagggtagtagtagccagtcccaggggatcagtagttcctctaccagcacaatgcctaattcgagccagtccagtcactccagtagcggtacactgtccagcttggaaactgtgtcgacccaagagctctatagcatacctgaggatcaggagccagaggatcaagaaccggaggagccgacgcctgccccgtgggcccggctgtgggcgctgcaggacgggtttgcgaacctggaatgtgtaaatgacaattactggttcggacgcgataaatcctgcgagtactgcttcgacgaacctttgctgaaaaggacagacaaataccgcacatattctaaaaagcacttcaggatcttccgggaggtcggtcccaaaaatagctacatcgcctatattgaagaccatagcggcaatgggacttttgtgaatacagaattggttggcaaaggtaaacggagaccgctgaataacaattcagaaatcgccctgtcactgtctaggaataaagtattcgtgttcttcgacctgactgtggacgaccagagcgtgtaccccaaagccttgcgggatgaatacatcatgtctaaaaccctcggctctggcgcctgcggtgaggtgaagttggccttcgagcgcaagacctgtaagaaagtggcgatcaaaattatctcgaagaggaagttcgctattggtagcgcacgagaggccgatcctgccctgaatgttgagactgaaatagaaatcctgaaaaaattgaatcacgatggaagaggtagagccgtctag

SEQ ID NO: 23525 - DNA, 1359 bp, Artificial Sequence
  Description of Artificial Sequence: Synthetic coding sequence
atgagccgggagagcgacgtggaggcccagcagagccacggcagcagcgcgtgctctcaacctcatggctccgtcacccagagtcaaggttccagctcccaaagccaaggtatcagttcctcatctacctcaacaatgccaaacagctcacaatcaagccatagcagctccggaacactgagctctctggagacagtctccacgcaggaactttactctatacctgaagaccaggaacccgaggatcaggaaccagaggaaccgaccccagctccttgggcgcgactttgggctctgcaagacggatttgcaaatctggtgttcgtgttcttcgaccttacggtcgacgatcaaagcgtctacccgaaagcattaagggacgaatacatcatgtctaagaccttgggatcaggcgcctgcggggaagttaagctggcattcgagagaaagacatgtaagaaggttgccatcaagatcatatctaagaggaagtttgctattggatcagcacgcgaggccgatcccgccctcaatgttgagacagagatagaaatcctcaaaaaactgaatcacccatgtatcattaagatcaaaaactttttcgacgccgaggactattacatcgtgctggaactgatggagggaggggagctttttgacaaagtggttgggaacaagcggctgaaggaggccacttgcaaactgtatttctaccagatgctgctggccgtccagtatctgcatgagaacggcattatccacagggacctaaaaccagagaatgtgctgctgtcttcccaagaggaggactgcctgattaaaattactgacttcggtcattccaagattttgggtgaaactagcctcatgcggactctgtgtgggacacccacgtatctggccccagaggtgttggtgtctgtcgggactgccggatacaatagagcggtggactgttggtcgctgggcgtgatcttgtttatttgtctgagtggatatccaccctttagcgagcatagaacccaggtgagccttaaggaccagattactagcggcaagtataattttattcccgaagtctgggccgaagtgtctgagaaggctcttgacctggtcaaaaagctccttgtcgtagatcccaaagcccgcttcactacggaagaagctctgaggcatccctggctccaagatgaggacatgaaacggaagtttcaggatttattgtctgaagaaaatgaatccaccgccctgccccaggtcctggcacagcctagcaccagtcggaagagacctcgtgaaggcgaagcagaaggcgctgagaccaccaaaaggcctgccgtgtgtgcagctgttttgtag

SEQ ID NO: 23526 - DNA, 1761 bp, Artificial Sequence
  Description of Artificial Sequence: Synthetic coding sequence
atgagccgggagagcgacgtggaggcccagcagagccacggcagctccgcttgcagtcagcctcacgggtctgtgacgcagagccaggggagttcctcccagtcccaaggcatttcaagctcctcaacatcaaccatgcccaactcaagccaatcctcacatagttccagtggaaccctttcatctctggagactgtgtctacacaggaattatactctattcccgaggaccaggagcctgaggatcaagaaccggaggaacccacacccgcaccatgggccaggctctgggctctgcaagatggattcgccaacctcgaaaccgaatctggtcacgtgactcagagcgacctggagctgctcttaagcagtgaccctcccgcttccgcgagccaatctgccggcatccggggtgtcagacatcatccccgccctgtttgctccctgaagtgcgtgaatgataactactggtttgggcgagataaaagctgtgagtactgctttgacgaaccacttctgaagagaacagacaagtatagaacctattctaaaaagcattttaggattttcagggaagtgggacccaagaatagctacattgcttacattgaggatcatagtggtaacggcactttcgtaaataccgagctggtggggaaagggaagaggagacccctgaataacaattctgaaatagctctttcattatctcgtaataaggtctttgtgtttttcgacctgacagtggacgaccaaagtgtgtatcctaaagccttacgggatgagtacataatgtccaaaaccctcgggagtggggcgtgcggcgaagtcaaactggcattcgagagaaagacctgtaagaaggtcgcaattaaaattatctcgaaacggaagtttgctatcggcagtgccagggaggctgatccggcactgaatgtggagaccgaaatcgagattttgaagaagctcaatcacccatgcatcatcaagatcaagaatttcttcgatgccgaggattattacatcgtgctggagctgatggaaggaggagaactgtttgataaagttgtcggtaataagcgcctgaaagaggccacgtgcaaattgtatttttaccaaatgttactggcagtgcagtatctccacgagaacggcattatccatagagacctcaaacccgaaaacgtactgctctctagtcaggaggaggattgcctgataaagatcaccgatttcggtcatagcaaaattttaggtgagacatctttaatgcggacgctgtgcggcactcctacttatctggcacctgaagtccttgtgtccgtaggcactgcagggtacaatcgcgccgtggactgctggtcgctaggcgtcatactgtttatctgtctctcaggctacccaccattttctgagcaccgtactcaggtctcacttaaagatcagatcacgtccggcaagtataatttcattcctgaagtgtgggcagaggtgagcgaaaaggccctggacttagtgaaaaaactgcttgtggtggatcctaaagcaaggttcaccaccgaggaggcgctaagacatccttggctgcaggatgaagatatgaagcgaaagttccaggacttactgtcagaagaaaacgagtccaccgctttacctcaagtcctggctcaacccagcacgagtaggaaacgcccacgggagggagaggcagagggcgcagaaaccactaagagaccagccgtctgcgcagctgtactgtag

SEQ ID NO: 23527 - DNA, 1545 bp, Artificial Sequence
  Description of Artificial Sequence: Synthetic coding sequence
atgagccgggagagcgacgtggaggcccagcagagccacggcagctctgcctgttcacagcctcacggatcggttacacaatcacagggatcctcaagtcagtcccagggaatcagcagcagcagcacttccacgatgcccaattcttcgcaatccagccactctagttcgggcacactgtccagtctagagaccgttagcacccaagagctctacagcattcctgaggatcaggagccagaggatcaggagcccgaagagcctacacctgccccatgggccagactctgggcgttgcaggacggcttcgcaaatctggagtgtgttaatgataattactggtttggccgcgacaaatcctgcgaatactgttttgacgagccactgctcaaacgtactgacaaatatcgaacctattccaaaaaacacttcagaatattccgcgaagtcggccccaagaactcctatattgcctacatcgaagaccactccggaaatgggaccttcgtgaatactgagctggtgggcaaagggaaacgccgacccttgaataataacagtgagatagcattaagcctcagtagaaacaaggttttcgtattctttgacctgactgtcgacgatcagagcgtgtatcctaaggccctccgcgacgaatacataatgtctaagacacttggcagtggggcttgcggagaagttaaattagcatttgaacggaagacctgtaagaaagtggctatcaagataatcagtaaaagaaaatttgccattggtagtgccagggaagcagacccagccctgaacgtcgaaaccgaaattgaaattttgaagaaactgaatcacccttgcattatcaagatcaaaaacttcttcgatgcagaagattattatatcgtcctagagctgatggaggggggagagctgttcgacaaggtggtgggcaacaagcgccttaaagaagcaacctgtaagttgtacttctatcagatgctgttggctgtgcagattacagactttggacatagcaagattctcggcgaaactagcctgatgagaacactttgtggaaccccgacatatctcgctcctgaagtcctggtctctgtgggaactgctggatacaaccgcgccgtcgattgttggagcctcggtgtcatactgttcatctgcctatccggatatcctccgttctcggaacatcgcacgcaagtctcattgaaggatcagatcacgagtggaaagtataattttattccagaggtttgggcagaagtcagtgagaaagccctcgacctcgtcaaaaaactgctagtcgtggacccaaaagccaggttcaccacggaggaggcgctccgacatccttggctgcaggatgaggacatgaaaagaaagtttcaggacctgctctcagaagagaatgaaagcacggcgctacctcaggtgcttgctcagccgtccacctcaagaaaacggcctcgggagggagaggccgaaggagccgagactacaaaaagaccagccgtttgcgctgcagtcctgtag

SEQ ID NO: 23528 - DNA, 1359 bp, Artificial Sequence
  Description of Artificial Sequence: Synthetic coding sequence
atgagccgggagagcgacgtggaggcccagcagagccacggcagcagcgcttgctcccagccacatggaagcgtgacacaatcacaaggaagtagttcccagagccaaggtatctcatcctcttctacctctacaatgcccaatagcagtcaaagttctcactccagctcaggaactctgtcttctctggagacagtcagcacacaggaactatattctattccggaagatcaagaacccgaggaccaggagccagaggaacctacacctgccccgtgggccagactgtgggctttgcaggatgggtttgcaaacctggtgtttgtattctttgatctaactgtggatgaccagagtgtttaccctaaggcactgagggatgagtacatcatgagcaagaccctaggctctggagcctgcggggaggtcaaactggccttcgagcggaagacctgtaaaaaggtggcaataaaaattatctcaaagcgcaagttcgccattggcagtgctcgggaggccgatcctgcacttaacgtggagactgaaatcgagatacttaaaaagcttaaccatccttgcatcatcaaaatcaagaactttttcgatgctgaagactactacatcgtgctcgagctcatggagggaggcgaactcttcgataaagttgtgggaaataagagactgaaagaggccacgtgcaaattgtatttttatcagatgcttttggccgttcagtatttacatgagaacggcattatccacagagatctgaagccggagaatgttctgctgtcctcacaggaggaagactgcctgatcaagatcactgactttggccacagtaagattttaggtgaaacctccttgatgcgcactttatgtggcacaccaacatatctagcacctgaggtgctggtgtcagtcggtaccgcagggtacaatagggccgtggattgctggtctctcggggtgattctgttcatttgcctgtcaggctacccccccttctccgaacatcgcacgcaggtcagcctcaaagatcagataactagtgggaaatacaacttcattcctgaggtttgggccgaagtgagcgaaaaggcacttgatttagtcaaaaagcttctggtggttgatcctaaggccaggtttaccacagaagaggccttgagacacccctggctccaggacgaggatatgaaaagaaaatttcaggatctgctgagtgaagaaaacgaaagtaccgccctccctcaagtactggcacagccctccacgtcacgcaagcggcctagggagggagaagctgagggagccgagacaacgaaacgacctgccgtatgcgccgcagtgttatag

SEQ ID NO: 23529 - DNA, 1632 bp, Artificial Sequence
  Description of Artificial Sequence: Synthetic coding sequence
atgagccgggagagcgacgtggaggcccagcagagccacggcagctctgcctgcagtcagccgcatggtagcgtcacgcagagtcaggggtcctcctcacagtcacaggggatctcctcatcttccacatcaacgatgcccaacagttcccagagctctcacagctccagcgggacgctctcttcactggaaacagtgtccacgcaggaactgtatagtatcccagaagatcaggaaccagaagatcaggaaccagaagagcccacgccagccccttgggccagactgtgggcactccaggatggctttgcaaacttagagtgcgttaatgataactattggttcggccgcgacaaatcctgcgaatactgcttcgacgaaccgctgctcaaacggactgataagtacaggacttactcgaagaagcactttagaatttttcgcgaggtcgggccgaaaaactcctacattgcctacatagaagaccacagcgggaacggcacctttgtcaatactgaactggtaggcaagggcaaaaggaggccactgaacaataatagcgaaatagctttgagcctctccagaaacaaagtctttgtgttcttcgatcttaccgtggacgatcagtcagtgtaccctaaggcacttcgcgatgagtacattatgtcaaaaaccctcgggagtggggcatgtggtgaggtgaagctggctttcgagcggaaaacatgtaagaaggtagccatcaagatcattagcaaacgaaaattcgcaataggtagtgcacgcgaggctgaccccgcattgaacgtggaaaccgagatcgaaattctgaaaaagttaaaccacccctgcattattaagatcaagaatttctttgacgcggaggattactatatagtattagagttgatggaaggaggcgagctattcgataaagtagtgggtaacaagaggctgaaagaagccacgtgcaagctttacttttaccagatgctcctggccgttcagtatctgcatgaaaacgggataattcatagagacttgaaacctgagaacgtactgctctccagccaggaggaggattgtctcattaaaatcaccgatttcggccacagcaaaatcctcggggagactagcctgatgaggaccctgtgtggcacgcctacctatttggcaccagaggtcttagtgtcagtgggcacagctggttataatcgggcagtggattgttggtccctaggcgtgatcctcttcatctgtctctccggctatccccccttttccgaacaccggactcaggtgtctctgaaggatcagataacttccggaaaatacaatttcatccctgaagtgtgggccgaagtgagtgagaaggctctcgacctggtaaagaagctcctcgtcgtggatccaaaagcacggttcaccaccgaagaagccttgcgacacccatggctacaggacgaagacatgaagcggaagttccaagatctgttgtcggaggagaatgagtcaactgcccttccccaagtgctagcccagcccagcacatcccggaagaggcccagagaaggcgaagcagaaggagctgagactacaaagcgacccgccgtttgtgctgctgtactatag

SEQ ID NO: 23530 - DNA, 1632 bp, Artificial Sequence
  Description of Artificial Sequence: Synthetic coding sequence
atgagccgggagagcgacgtggaggcccagcagagccacggcagcagcgcatgttctcagccacatggctctgtaacacaatcacaaggatcaagctctcagtcacagggtatttccagcagttccacaagcactatgcctaactcaagtcagagctcccattccagctcagggaccctttcctctttagagacagtttctacccaggaactatattcaattccagaggatcaagaaccagaggaccaagagcccgaggaacctacacctgccccatgggccagactttgggcgctgcaggacggcttcgcgaatctcgaatgtgttaatgacaactactggtttggccgcgacaagtcctgtgaatactgctttgacgagccgctgctgaagcgcacagataagtaccgtacctattccaagaagcattttagaatcttccgcgaggtagggcccaagaattcttatatcgcttacatcgaagaccatagcggcaatggcacttttgttaacaccgagctcgtcggcaaagggaagcggcggccactgaataacaattctgagatcgctctcagcctgtctaggaataaggtcttcgtctttttcgacctgaccgtcgacgaccagtccgtgtaccccaaggctctgcgcgatgaatacatcatgagtaaaaccctgggtagtggggcatgcggtgaggtgaagcttgctttcgaaagaaaaacatgtaaaaaagtggctatcaagattatctccaaacggaaatttgccattggatctgctagagaagctgatcctgctctaaatgtcgaaaccgagatagagatccttaagaagcttaatcatccctgcattataaaaatcaagaacttcttcgacgccgaggattattacattgtactcgaactaatggaggggggagagcttttcgacaaggtcgtggggaacaaacgtctcaaggaggcaacctgcaagctctacttttatcagatgctgctcgccgtgcagtacctgcacgagaacggcatcatacatcgcgacctcaagcccgagaacgtcttgctgtcgagccaggaggaggattgcttgatcaagattactgacttcgggcatagcaagatccttggggagacatctctgatgaggactttgtgcggcacaccaacatacctcgcccccgaggtgttggttagcgtgggcaccgccggttataaccgtgctgtagattgctggtcccttggtgtgatccttttcatctgtttatcaggttatccccccttctccgaacatcggacgcaagtgtctctgaaggaccagatcacaagcggaaagtacaacttcattccagaagtatgggcagaggtgagcgaaaaggctttagatttagtgaagaaacttctagtcgtggatcccaaggcgcgattcacgaccgaagaagccctaagacatccttggttacaggacgaagatatgaaacggaaattccaggatctcctgtctgaggagaatgaatctaccgcactgccgcaggtgcttgctcaaccttccacatcccgcaagaggcctagagagggcgaggcagaaggcgctgagacaactaagcgtccagccgtgtgtgctgccgtcttgtag

SEQ ID NO: 23531 - DNA, 969 bp, Artificial Sequence
  Description of Artificial Sequence: Synthetic coding sequence
atgagcaagaccctgggcagcggcgcctgcggcgaggtgaagctggcattcgaaagaaagacctgcaaaaaggtggcgattaagattatctcgaagcgcaagttcgctatcggcagtgctcgagaagctgacccggcccttaatgtggagacagagatagagatcctcaaaaagctcaaccacccctgtattatcaagataaaaaacttctttgatgccgaagattattacatagtgctggagctgatggaaggtggcgaactgtttgacaaggtagttggtaacaagcgtttgaaagaagccacctgcaagctctatttttatcagatgctgttggcagtccagtatctgcacgagaatgggattatccaccgggatcttaagcccgaaaatgttctgctgagtagccaagaggaagactgcctcatcaagatcacagacttcggccattctaagatccttggcgagacctccctcatgcggacattatgcggaacacccacatatctcgcacccgaggtcctggtgtcagtcggtaccgctggatataaccgtgctgttgactgttggagtcttggtgtgatcctgtttatatgcctgtcaggttacccacccttttcggagcaccgtacccaagtgagtttaaaggaccagatcacctccggcaagtacaacttcatccctgaggtttgggccgaggtctcagagaaggcccttgacctagtcaagaaactgctagtcgtggacccaaaggctaggttcaccaccgaagaggccctgagacatccctggctgcaggacgaggacatgaaacgcaagttccaagacctgctcagcgaggagaacgagagcaccgcactcccccaggtgctcgcacaaccaagtacatcccgcaaaagacccagggaaggagaagccgagggcgctgaaaccactaagagacccgctgtctgtgccgctgtcctgtag

SEQ ID NO: 23532 - DNA, 624 bp, Artificial Sequence
  Description of Artificial Sequence: Synthetic coding sequence
atgagccgggagagcgacgtggaggcccagcagagccacggcagctctgcgtgttcccagccccacggttccgtgacacagtcccagggctccagcagtcagagccagggaatttcgtcgtcttctacatccaccatgcccaattcctctcagtcctctcattcatcatctgggaccttgtccagtttggagaccgtgagtacccaggagctgtactccattcctgaggaccaagaaccggaggaccaagagccagaagagcccactccagcaccctgggcccgcctatgggcactgcaagacggctttgctaatctggagtgcgtgaatgacaattactggttcggcagagataagtcttgtgagtactgtttcgacgaaccactcttgaaacgcaccgataagtatcgaacctactccaaaaagcattttagaatcttcagagaggtgggccctaaaaattcttacattgcctacatagaggaccacagcggtaacggcactttcgtcaataccgagcttgtggggaagggaaaacgtcggccccttaacaacaactctgaaatcgcactgtcactcagcaggaacaaggagaagatattgaaaatatatagtctatcgtag

SEQ ID NO: 23533 - DNA, 294 bp, Artificial Sequence
  Description of Artificial Sequence: Synthetic coding sequence
atgaaggtgagcgccgccctgctgtggctgctgctgatcgccgccgctttttcaccgcagggccttgcgggacccgcatccgtccccactacctgctgttttaatttagctaaccgcaagattcctctccagcggctcgagtcatacaggaggatcaccagcggtaagtgccctcagaaggccgtgattttcaagacaaagttggcgaaggatatctgcgcagatccaaaaaagaaatgggtgcaagacagcatgaaatacctggatcagaagtcccctaccccaaagccctag

SEQ ID NO: 23534 - DNA, 1692 bp, Artificial Sequence
  Description of Artificial Sequence: Synthetic coding sequence
atgagccggatcggcggcgccggcctgcccgccgccgccctgaccgggcccggccgattccgaatggcccgggaggaacctgcgcctgccgcgttggcggccgccgggcagcctggaggtgggcggggaggagaaagagccctgcagggccccggggtcgcgaggcgtggaaggccttctctcagtcgggcaaagcttcacgggctcagacacatgtgcgcgggacgcacagccgccggcggctcctttcagcgcagagccctctgggtgctggcgttctgtacaagttttggcctcctactttcttggagctctaatcgcctgctctactggctgagctttcctagccacacgcgagtgcaccgcgagtggagcaggcagttgcccttccccgccgtgacggtgtgcaataataatcctctgagattcccaagattgtccaaaggggacctgtattacgctggccattggctcgggcttctccttcccaaccgaactgctcggccgttggtgagcgaattacttcgcggagatgaacccagaagacagtggttccgtaagctggctgatttccgcttgttcctaccaccccgacatttcgagggcatttcggcggcttttatggatcgcctgggccatcaattggaagatatgttgctatcgtgtaaatacagaggagaactatgcggcccacataattttagttcagtgttcactaaatatggcaagtgctatatgtttaacagcggggaggatggaaagcccttgctcacaacagtaaaggggggaaccggaaatgggctcgaaatcatgctagatatccagcaagatgaatatttacctatctggggcgaaactgaggagaccacctttgaggccggggtaaaggtacagattcacagccagagcgagcctcccttcattcaagaattgggctttggggtggcccccggatttcagacattcgtcgctacccaggaacagcggctgacttatctccctccgccatggggtgaatgtaggagtagcgagatgggcctggatttctttcctgtgtacagcatcacggcttgcagaattgattgcgagacacgctacatcgtggagaactgcaactgtaggatggtccacatgcctggagacgcacccttctgtacgcctgagcagcacaaggaatgcgccgagcccgccctgggtctgctggctgaaaaggacagtaattactgcttgtgcaggacaccttgtaacctcactaggtataataaggagctgtccatggtcaagatccccagcaagacttcggcaaagtatctcgaaaagaagtttaataaaagcgaaaagtatatctctgaaaatatattggtcttggatatattcttcgaagctctcaattatgagactattgagcagaaaaaggcttacgaggtggccgctttgctgggcgatatcggaggacagatgggcctttttatcggtgcaagcattctgactatcttggagctgtttgattatatttatgagttaataaaagaaaagctactcgacttgctcgggaaagaagaagatgagggctcccacgacgaaaatgttagtacctgcgatactatgcccaaccatagcgagacaatttcccatacagtcaatgtgcccctgcagactaccttaggaactttagaagaaatcgcctgctag

SEQ ID NO: 23535 - DNA, 2328 bp, Artificial Sequence
  Description of Artificial Sequence: Synthetic coding sequence
atggtgggccccgaggacgccggcgcctgcagcggccggaaccccaagctgctacctgtccccgcacctgaccccgtcggccaagatcggaaggtaatccgggcaactggcggatttggcggaggcgtcggggccgtggagcctcccgaagaggccgatgaagaagaggaggccgacgaggaggaggaaaccccacccagacagctgctgcagagatacctggcagctgctggcgagcagttagagcccgggctgtgttattgccctctgccggcgggacaggccggcgctccccctccatctgccgctccccggagtgatgcctgtctgctgggatcgggaagcaagcataggggagctgaggtggcagatggtcgggcacctcgccatgagggaatgacgaacggagatagcggttttctacctggccgggactgtagagacttagaagaagcccgggggttggctagagcagggggaagagagagtcgacgcagacgaccctacggtcggcttcggttggagggaccaggggacgaggatgcagatggtgcaggaagtccctccgactgggccagccctcttgaggacccccttcggagctgttgcctggtagctgctgatgcgcaggaacccgagggagctggatcagattctggcgactcccctgcatccagttgttcctcaagtgaggacagcgaacaacggggtgtgggggcaggtgggccggaagagggcgctccacctgcaaccagtgcagagagaacaaatggaggtgcagagcctaggctgggatttagcgacatccactttaactccagaaatacattccaggtgtccagagggcagtcagcccgggaccaccttccacccgctggcccacccgtgcccctccccgccgctgagcaaggcccagctggcgccagtgcccgcgcccggcgctctggcggctttgccgacttctttacaaggaatctcttccccaaacgaacgaaagagctgaagtccgtcgtccattctgcgccagggtggaaactgttcggcaaggtccctccccgcgagaacttgcaaaagactagcaagataatccagcaggagtacgaggctagaaccggaagaacctgtaaaccccccccccagagcagccgcaggaagaactttgagtttgaacctctgagcaccactgcactcatcttggaggatcggccatctaacttacctgcgaaatcagtggaagaagcactgagacaccgacaggaatacgacgagatggtagcagaggccaagaagagagagatcaaggaagcccacaagcgcaaacggatcatgaaggagcgcttcaagcaagaggagaacattgctagtgcaatggtgatttggatcaacgaaatcctccctaattgggaagtaatgcggagcacgcgaagagtgcgagagttatggtggcaggggttgcctccctctgtgaggggcaaggtttggtccctggccgtcgggaacgaactgaatatcacccccgagttatacgaaatcttcctgagcagggccaaggagaggtggaagtcattcagtgagacatcaagcgagaatgacacagaaggtgtatcagtcgcagacagagaggcctcactcgagctcatcaaacttgatatctccagaacatttccaagtctctatatcttccagaaggggggaccctatcacgatgtcctccactctatcttaggcgcctacacctgctaccgtccagatgttggatacgtgcagggtatgtcgtttatcgccgccgtcctcattctcaacctcgaggaggccgatgcgtttattgccttcgccaatcttctgaacaagccttgccagctggcattttttcgggtggatcattccatgatgttgaaatactttgccacatttgaggtgttttttgaggagaatctgtcaaagttgtttctgcacttcaagtcctacagcctgaccccggacatctatttgatagactggatcttcaccctctacagtaaatcattgcccctggacctggcctgtcgagtgtgggatgtgttctgcagggacggagaagagtttctattccgcactggtctgggcatattgagactctacgaagatatcctgctccaaatggattttatacacatagcccaattcctaaccaaattgcctgaagacatcacaagcgagaagctgttttcatgcattgctgccattcagatgcagaattcaacgaaaaaatggactcaggttttcgcttccgtgatgaaggacatcaaagagggggataaaaacagctctccggccctgaaatcctag

SEQ ID NO: 23536 - DNA, 276 bp, Artificial Sequence
  Description of Artificial Sequence: Synthetic coding sequence
atgaaggtgagcgccgccgccctggccgtgatcctgatcgccaccgcactgtgtgctcccgcatccgccagcccatactcctccgatacaactccatgctgtttcgcctacatagcacgaccactcccccgggcccatattaaagaatacttctatacgagtggcaaatgttccaatccagcagtggttttcgtcactcggaagaatcggcaggtctgtgccaatccagagaaaaagtgggtgagagaatatattaattcactggaaatgtcttag

SEQ ID NO: 23537 - DNA, 276 bp, Artificial Sequence
  Description of Artificial Sequence: Synthetic coding sequence
atgaaggtgagcgccgccgccctggccgtgatcctgatcgccaccgccctgtgtgctcctgcgagcgctagcccatatagctccgacacgaccccctgctgcttcgcttatatagcaaggccccttccacgcgcccatataaaggaatacttctatacctcaggaaaatgttccaatccagcggtggtgtttgtgactaggaagaatcgtcaggtatgcgccaacccagagaaaaaatgggtgcgagaatatataaactctctggagatgtcctag

SEQ ID NO: 23538 - DNA, 300 bp, Artificial Sequence
  Description of Artificial Sequence: Synthetic coding sequence
atgaaggccagcgccgccctgctgtgcctgctgctgaccgccgccgcattctcacctcagggcttggcacagccagtgggaattaatacttcaacaacctgttgttacagattcattaataagaaaattcccaaacaaaggctggagagctataggcgaactacttcctcacattgcccccgcgaggccgttatctttaagaccaagctggataaggagatttgtgccgatcctacgcagaaatgggttcaggattttatgaaacacctcgacaaaaagacccagaccccaaagctctag

SEQ ID NO: 23539 - DNA, 330 bp, Artificial Sequence
  Description of Artificial Sequence: Synthetic coding sequence
atgtggaagcccatgcccagccccagcaacatgaaggccagcgccgcactgttatgcctgctgttaacggcggcagcatttagcccacagggccttgcccagccagtcggcattaatacatcaacaacctgttgttaccgattcattaacaaaaagatccctaaacagcggcttgaaagctaccgacgaacaacctcgagccattgtcctcgagaagcggtgatcttcaagaccaagctggacaaggagatctgtgcggatcccactcagaagtgggtgcaggattttatgaaacatctggataagaagacccagactcccaagctctag

SEQ ID NO: 23540 - DNA, 276 bp, Artificial Sequence
  Description of Artificial Sequence: Synthetic coding sequence
atgtggaagcccatgcccagccccagcaacatgaaggccagcgccgcacttctgtgcctactgctaacagctgccgcttttagccctcaggggttagcccagcctgagcgtcccaggacccatccacagtggactttcctgctggtggtcagtttacagctgggactgatcttacaacttccggccgcaacagacctatccatacgcaagtccttgtcccgagggtggcgagcaactgaagggcctcccgtcgcgaccgtgcctggcaagctgtag

SEQ ID NO: 23541 - DNA, 174 bp, Artificial Sequence
  Description of Artificial Sequence: Synthetic coding sequence
atgtggaagcccatgcccagccccagcaacatgaaggccagcgccgcccttttatgtttgctgctgaccgccgccgcattttctcctcagggcctggcgcagccagccagtaggcccaattggacacgacgttcggttctcacaccccatcggtcagggagccgaacgttatag

SEQ ID NO: 23542 - DNA, 297 bp, Artificial Sequence
  Description of Artificial Sequence: Synthetic coding sequence
atgaaccagaccgccatcctgatctgctgcctgatcttcctgaccctgtctggaattcaaggagtcccactcagcaggaccgttcgatgtacatgtatctcaataagtaaccagccagtgaaccccagatccctggagaagcttgagatcattcccgcatcccaattttgccctcgcgtggaaatcattgccacgatgaaaaagaaaggcgagaaaagatgcctgaacccagaatcaaaggccatcaaaaacctgctcaaggccgtctccaaggagagatccaagcggtcaccctag

SEQ ID NO: 23543 - DNA, 270 bp, Artificial Sequence
  Description of Artificial Sequence: Synthetic coding sequence
atgaacgccaaggtggtggtggtgctggtgctggtgctgaccgccctgtgtctcagcgacggaaagcccgtgagtctgtcatatcgctgtccttgtagatttttcgagagtcatgtggcccgggcaaatgttaaacacctgaaaatcctgaatacccctaactgcgcactgcagatagttgcccggcttaagaacaataatcgtcaggtgtgcattgatccgaaacttaaatggatccaggagtatttggagaaagctctgaacaagtag

SEQ ID NO: 23544 - DNA, 360 bp, Artificial Sequence
  Description of Artificial Sequence: Synthetic coding sequence
atgaacgccaaggtggtggtggtgctggtgctggtgctgaccgccttgtgtctgtccgatggcaaaccagtgagtctgagttatcgttgtccatgtaggttctttgagagccacgttgcccgggcaaatgtcaagcatctcaaaatcttaaatacaccaaattgtgctctccagatagtcgccagacttaagaacaacaacaggcaagtatgtattgatccaaagctgaaatggatccaggaatacctggaaaaggccctgaacaagggcaggagggaagagaaagtgggcaagaaagagaagattggaaagaaaaaacgacagaagaagcgcaaagcagcacagaagaggaagaactag

SEQ ID NO: 23545 - DNA, 282 bp, Artificial Sequence
  Description of Artificial Sequence: Synthetic coding sequence
atgaacgccaaggtggtggtggtgctggtgctggtgctgaccgccctctgtctgtcggatggcaagcctgtgtcactcagctaccgctgtccctgtcgcttctttgaatctcatgttgccagggcaaatgtcaaacaccttaagatactcaacactcctaactgtgcgctgcaaatagtggctcgtcttaagaacaacaatcggcaggtctgcattgatccgaagctgaagtggatacaggagtatcttgagaaggccctcaataaacggttcaaaatgtag

SEQ ID NO: 23546 - DNA, 423 bp, Artificial Sequence
  Description of Artificial Sequence: Synthetic coding sequence
atgaacgccaaggtggtggtggtgctggtgctggtgctgaccgccctgtgcctgagtgacgggaaaccggtcagtctctcttataggtgcccctgtagatttttcgaaagtcatgtggctcgggcgaatgttaaacatttaaaaatcttaaacactcccaactgtgctctccagatcgtagcccgcttaaagaacaacaaccggcaggtctgcatcgaccctaagctcaagtggattcaggaataccttgagaaagctctcaacaatttaatctccgcagctcccgcaggaaagagggtcatagccggagctagagcgctgcatccaagtccgccacgcgcctgccctacagccagggccctgtgcgaaattagattgtggcctccgcctgagtggtcctggccatcaccgggcgacgtgtag

SEQ ID NO: 23547 - DNA, 273 bp, Artificial Sequence
  Description of Artificial Sequence: Synthetic coding sequence
atgaacgccaaggtggtggtggtgctggtgctggtgctgaccgccttatgcctgtccgatggtaagcccgtaagtctgtcatatcgctgtccctgtagattctttgaatcccacgtagcccgggccaacgtgaagcatcttaagatcctcaatacaccaaattgtgctctccagatcgtggctaggctgaaaaataacaaccgccaggtttgcatcgaccctaagcttaagtggatccaagaataccttgagaaggcactgaacaactgctag

SEQ ID NO: 23548 - DNA, 330 bp, Artificial Sequence
  Description of Artificial Sequence: Synthetic coding sequence
atgaagttcatcagcaccagcctgctgctgatgctgctggtgagctcactgtcccccgtccagggggtgctggaagtttactacacttcgctgcggtgtaggtgcgttcaggagtcctcggtgtttattcctcggagattcatcgatcgaatccaaatactgccacgaggtaatggctgcccccggaaggaaataattgtctggaagaagaacaaatctattgtgtgcgtggatcctcaagcagagtggatacagcgcatgatggaggttctgcggaagcggtcttccagtacgctaccagtgcccgttttcaaaagaaagatcccctag

SEQ ID NO: 23549 - DNA, 1560 bp, Artificial Sequence
  Description of Artificial Sequence: Synthetic coding sequence
atgttcctgctgcccctgcccgccgccggccgggtggtggtgcggagactggccgtgcgacgctttggatctagatcactctcaactgctgatatgactaaggggcttgtgctcggaatttactccaaggagaaagaggacgatgttcctcagttcacaagcgccggcgaaaacttcgataagcttttagcgggtaaactccgggaaactctgaatataagtggaccgccattgaaggccggcaaaaccagaacgttctacggtctccatcaggatttcccttctgtggtccttgtcgggcttggcaaaaaagcagccggcatcgacgaacaggagaactggcacgaaggtaaagagaacatcagagccgcagtggccgctgggtgtcggcagatccaggacctggaactttcatcagtggaagtggatccctgcggggatgcacaagcggcagctgagggcgcggtgcttggcctctacgagtacgatgacttaaagcagaaaaaaaagatggccgtgtctgctaaactatatggaagcggagatcaggaagcctggcagaagggcgtgctctttgcttcaggacagaacctcgccaggcagttgatggagacccccgctaacgagatgacgcctacccgctttgcggaaataatcgagaagaatttaaaatccgcaagctctaaaaccgaggtacatattcgcccaaagagctggatcgaagagcaggctatgggttccttcttaagcgtggcaaagggatcagacgagccacctgtgttcctcgagatccactacaaagggtcaccgaatgcaaacgaacccccgcttgtcttcgtgggtaagggaataacgtttgactccggtggtatcagcataaaagctagcgccaacatggatctgatgagggcggatatgggaggcgctgctaccatttgctccgccatagtctctgcggcgaagctgaatctgccaattaatatcattggactggctcccctgtgcgaaaacatgcccagcggcaaagcaaacaagcctggcgatgttgttagagctaaaaacgggaagacgatccaggtagacaacaccgacgcagaaggaagactaatattggctgatgctctgtgttatgctcacacttttaaccccaaggtgattctcaacgcggcgaccctgaccggtgcaatggatgtagcactgggttctggcgccacaggcgtcttcactaacagttcctggctgtggaacaaactgttcgaagcctcaatcgagacaggagatcgggtctggagaatgcccctgtttgagcactatacgcgccaggttgtagactgccagttggctgacgttaacaatattgggaaataccggagtgcgggagcgtgcacagccgctgctttcctcaaggagttcgtgacacacccaaaatgggcacacttggacatcgctggggttatgacaaataaagacgaagtgccatatctgcggaaagggatgaccgggcgacccacccgcacattgatcgaatttctgttgcgcttttctcaagacaacgcatag

SEQ ID NO: 23550 - DNA, 378 bp, Artificial Sequence
  Description of Artificial Sequence: Synthetic coding sequence
atgaagaagagcggcgtgctgttcctgctgggcatcatcctgctggtgcttatcggggtgcagggaacgcccgtcgtgcgcaagggcagatgttcgtgcatctcaaccaaccaagggacgatacacctgcagagcctgaaagatctgaagcaatttgctccctccccttcctgcgaaaagatagaaataatagcgaccctaaaaaatggagttcagacatgtctcaatcctgactctgcagacgtgaaggagctgatcaagaaatgggaaaaacaggtctctcagaagaaaaaacagaagaacggaaaaaagcatcagaaaaagaaggtgctgaaagtgcggaaaagccaacgctcccgacagaaaaaaactacttag

SEQ ID NO: 23551 - DNA, 1083 bp, Artificial Sequence
  Description of Artificial Sequence: Synthetic coding sequence
atggaggacttcaacatggagagcgacagcttcgaggacttctggaagggtgaggatctatctaactacagttactcctcgacccttccaccattcctattagacgctgctccgtgcgaacccgagtcgctggagattaacaaatacttcgtcgtcatcatatatgcactggtatttctcctgtctctgctcggaaatagtttagtgatgctggtcatcctgtactctagggtcggacggtccgttaccgacgtatatttactgaacctggctctggctgatttgctgttcgccttgacactaccaatctgggctgcctctaaggtgaatggctggatcttcggtacattcctgtgcaaggtggtgagcctccttaaagaggtgaacttctacagcggaattctgctgttagcctgtatctcagttgataggtatctcgccattgtgcatgccacacggacccttactcagaagaggtacctcgttaagtttatttgtctgagtatctggggcctttcccttttgctcgccctacctgtgcttctcttcagacgcaccgtctattcttctaatgtatcacctgcatgttacgaggacatgggcaacaatacggccaattggcgtatgttgttgcgaattctcccgcagtcttttggattcattgttccgctgcttatcatgctgttttgctacggattcactctgcggaccttgtttaaagcccacatgggacaaaaacaccgcgcaatgagggttatctttgccgtggtgttgatctttcttttgtgttggctaccatacaatctcgtcttacttgcagacaccctcatgcgcacccaggtaattcaagagacatgcgaaagaaggaaccatatagatagagctctggatgcaactgaaattttaggcatcttgcactcgtgcctgaacccattaatttacgccttcatcggtcaaaaatttagacatggactgctcaagattctggctatacacggcctgatttcaaaggattcccttccaaaagactcacgcccctctttcgtcggttcctcttccggtcacacatcaactactctttag

SEQ ID NO: 23552 - DNA, 417 bp, Artificial Sequence
  Description of Artificial Sequence: Synthetic coding sequence
atggaggacttcaacatggagagcgacagcttcgaggacttctggaaaggagaagatctgtcgaactactcatactcatctacactgcctcccttcttgctcgacgcagccccctgcgaacctgagtccctcgagattaacaagtatttcgtggtcattatttatgcgctagtgttcttgctgtccctgctgggaaattctctcgttatgctcgtaatcctgtactcacgcgtcggccggtccgtgacagacgtctatttgctgaacttggcactagcagacctcctattcgctttgaccctgcctatctgggccgccagcaaggtcaacggctggatctttggtacattcctgtgcaaagtcgtttctttattgaaggaagtcaatttttacagcggcatactgttacttgcctag

SEQ ID NO: 23553 - DNA, 48 bp, Artificial Sequence; identical to SEQ ID NO: 10089
  Description of Artificial Sequence: Synthetic coding sequence

SEQ ID NO: 23554 - DNA, 519 bp, Artificial Sequence
  Description of Artificial Sequence: Synthetic coding sequence
atggaggacttcaacatggagagcgacagcttcgaggacttctggaaaggggaagaccttagtaattattcctatagttccacccttccaccattcctgctcgacgcagctccctgcgaacccgagtccctcgagatcaacaaatactttgtagtaataatatacgctctggtgttcttgctctccctgctgggcaatagcttggtgatgttggtcatcctctacagcagagtgggacggtccgttacggatgtgtatctcctgaaccttgctttggccgatctacttttcgcactgaccctgccaatttgggctgctagtaaggttaatggatggatctttggaacgttcctgtgcaaggtagtgtctctcctaaaagaggtcaatttttattcaggaattctgctgctggcctgcataagcgtcgatcgatatttagctattgtgcacgcgacaaggaccctgacacaaaagcgctatctcgtgaaattcatatgtctgagtatctggggtctgtag

SEQ ID NO: 23555 - DNA, 48 bp, Artificial Sequence; identical to SEQ ID NO: 10089
  Description of Artificial Sequence: Synthetic coding sequence

SEQ ID NO: 23556 - DNA, 606 bp, Artificial Sequence
  Description of Artificial Sequence: Synthetic coding sequence
atggaggacttcaacatggagagcgacagcttcgaggacttctggaagggagaggatttgtccaactactcatattcgagcaccttacctcctttcctattggacgccgctccatgcgaaccggagagccttgaaattaataaatactttgtcgtgatcatctatgccctggttttcttacttagcctcttaggcaatagtcttgtcatgctcgtgattttatactcaagggtagggcggtcagtgactgatgtgtatctcctgaaccttgcactggccgatctcctgttcgccctgactctaccaatctgggccgcatcaaaggtgaatggttggatttttgggacattcctctgtaaggtggtttctctgctgaaagaggtgaacttctacagtggcatcctactgctggcctgcattagtgtcgacagataccttgccatcgttcacgctacgaggacactgacccagaaacgctacctcgtgaaatttatctgcttgtcgatttggggactgtccctgcttcttgcgttgcccgtgctgctgtttcgaaggacagtgtacagctcaaacgtgagtcctgcttgttacgaggacatggggtag

SEQ ID NO: 23557 - DNA, 411 bp, Artificial Sequence
  Description of Artificial Sequence: Synthetic coding sequence
atggaggacttcaacatggagagcgacagcttcgaggacttctggaagggggaggacctttctaattattcttatagctctacgctgccaccattcttgctagatgccgctccatgtgaacctgaatccctggagataaacaagtatttcgtggtgatcatctacgcgctggtgttcctgctatcgctgctcggcaactcactcgtgatgctggtcattctgtactcacgtgtgggcagaagtgtgacagatgtctatctgctgaaccttgcactggctgatctgcttttcgcactcacattgcccatctgggcagccagtaaggttaacggatggatcttcggtaccttcctatgcaaagtggtctcccttctgaaagaagtgaatttctactcaggcatattgctgtag

SEQ ID NO: 23558 - DNA, 1059 bp, Artificial Sequence
  Description of Artificial Sequence: Synthetic coding sequence
atggagggcatcagcatctacaccagcgacaactacaccgaggagatgggcagcggggattatgactccatgaaagaaccttgctttcgagaggagaacgctaatttcaataaaatcttcctgcctaccatttattccattatcttcctgacaggcatcgttggcaacggacttgtgatccttgtgatgggctatcagaaaaagttgagaagcatgaccgataagtacaggctgcacctttctgtggccgacctcttatttgttatcaccctccccttctgggccgtcgacgccgtagctaattggtatttcggcaattttctgtgcaaggccgttcacgttatttacacggtcaatctttacagtagcgtcctcattctggctttcatttccttagaccgctacttggccattgtgcacgccactaatagtcagagacctcgcaaactactcgcagaaaaagtcgtgtacgtgggagtatggattcccgccctgctgcttaccatacctgattttatctttgctaatgtgtcagaggccgacgataggtacatctgcgaccgcttctaccccaatgatctgtgggtggtagtgtttcagttccagcatatcatggtcggactgatcctgccaggcatcgtaattctaagttgctattgcattatcatatctaaactgtctcactccaaaggacaccagaagcggaaagcgttgaaaactacagtgatactcatactggcttttttcgcttgctggctgccatattatatcggaatctcgatcgacagttttatcctccttgaaattatcaagcagggctgcgaattcgaaaataccgtgcataaatggattagcattacagaggccctggcctttttccactgctgcctgaatcctatcctgtatgcattcctgggagccaaattcaagacaagcgcacagcacgctctcactagcgtcagcagaggttcaagcctaaagatactgagcaagggcaagagaggagggcatagttctgttagcacggagagcgagtcgtctagcttccattccagttag

SEQ ID NO: 23559 - DNA, 1071 bp, Artificial Sequence
  Description of Artificial Sequence: Synthetic coding sequence
atgagcatccccctgcccctgctgcagatctacaccagcgacaactacactgaggaaatgggttctggggactacgactccatgaaggagccatgctttcgcgaggagaacgccaacttcaacaagatctttctccccacgatctactcaattattttcctcacggggatcgtcgggaatggccttgttattttagtgatgggctaccaaaagaaacttcgtagcatgacggacaaataccgtctacatctgagtgtggcagacctcctattcgtgatcaccttgcccttttgggcggtagatgcagtggccaactggtacttcggaaactttctgtgtaaggccgtacacgtaatttatactgtgaacttatattcctctgtccttattctggcatttatctccctcgatagatacctggccatcgtgcatgcaacaaacagccagaggccaaggaagctgctcgcggaaaaagttgtctacgtcggagtttggatacccgccctgcttctaaccatccccgacttcatattcgccaacgtctccgaggccgatgaccgatatatctgcgacagattctatccaaatgacctgtgggtggtagtgttccagttccagcacattatggttggactcatactgccgggcatcgttatccttagttgttattgcataattatttcaaagctgtctcattcaaagggacatcagaagcggaaagctctcaagaccactgtcatattgattctcgcctttttcgcgtgctggctgccatactacatcggcataagcattgactcgttcatcttacttgagataataaagcaaggctgcgaatttgagaataccgtgcataagtggatttcaattactgaagctttggccttcttccactgttgcctcaaccccattttgtatgccttccttggcgccaagtttaaaacgtccgcacagcacgcattgaccagtgtaagccgcggaagttccttgaagatattgtcaaaaggcaaacgcgggggccatagttccgtatctaccgaaagcgaatctagcagttttcactcttcttag

SEQ ID NO: 23560 - DNA, 669 bp, Artificial Sequence
  Description of Artificial Sequence: Synthetic coding sequence
atgccctggcagaccggcaccctgggcaccagctacgcccggcagtccatgagctccacacagagtacctccaccgccgtgtcaagtagctggatcccagccctcctcctgacaatccctgactttatctttgctaatgtgtcagaggccgacgaccgatacatatgcgacaggttttatcccaacgatctatgggtggtcgttttccagtttcaacatattatggtgggtcttattctgccaggaattgtgatcctgagttgctactgcattataatctctaagctatcccactccaagggccaccagaagcgcaaagcgctgaagacaacggttattctaatcctggcttttttcgcttgctggcttccctactacattggcatcagcatagattcattcatactgctcgagatcatcaagcaaggctgtgagtttgagaatacagtacacaaatggatctctattacagaggccttggccttctttcactgctgcctcaatccaattctgtacgccttccttggagctaaattcaaaacgtctgcccagcacgcccttacctccgtcagccgtggttcatctttaaaaatactctcaaagggcaaaagaggtgggcattcttccgtgtcaacagagagcgaatccagctcctttcactcctcttag

SEQ ID NO: 23561 - DNA, 2832 bp, Artificial Sequence
  Description of Artificial Sequence: Synthetic coding sequence
atgacccagcggagcatcgccggccccatctgcaacctgaagttcgtcaccctcctggtcgccctgtcttccgaactgccctttctcggtgcgggcgtgcaacttcaagataatggttataacgggctcttaatcgccattaatccccaagtgcctgagaatcagaatctcatatcaaatatcaaggaaatgatcacagaggcatccttctatctcttcaacgcgacgaagcggcgtgtcttcttcagaaacatcaaaattttgattcccgccacctggaaggccaataacaacagcaaaatcaaacaggaatcttatgagaaagccaacgtaattgtgactgattggtatggagcccacggcgacgacccttacacattgcaatatcggggatgcggcaaagaaggtaagtatatacacttcacccctaatttcctgctgaatgacaatctaaccgctggatacggatccagagggagggtcttcgtacatgagtgggcccacctacggtggggcgtgttcgacgaatataacaacgacaaaccattctatattaatggacagaaccaaatcaaggtgacaaggtgcagtagtgatatcactggaattttcgtgtgcgaaaagggcccatgtccacaggagaattgcataatttctaagttgtttaaagaggggtgtacttttatatataatagcactcagaacgccacagcaagtattatgtttatgcaaagtctgtcttcagtggtggaattctgtaatgccagtacccacaaccaagaggctcccaatttgcagaaccagatgtgcagtctgcggtccgcgtgggacgtcattacggactctgctgactttcaccattcctttcccatgaatggcacggagctaccgccacccccaaccttcagcctggtgcaggcgggcgataaagttgtgtgcctggttttggatgtgtcatctaagatggcagaagcagatagattgctgcagctgcaacaggcagccgagttttacctaatgcagatagtggaaatccacacttttgtgggcattgcttcctttgattctaagggggaaattcgggcacagctccatcaaatcaattctaacgacgatcgtaaactccttgttagctatctgcctacaaccgtaagtgccaagacagatatttccatttgtagcggactgaaaaagggattcgaggtggtagagaaactgaacggcaaggcctatggctctgtgatgattcttgtgacttccggggacgataaacttctcgggaactgtttgccaactgtcctgagcagtggcagtacaatccacagcatcgccttgggatcttccgcagccccaaatcttgaagaactttcgcgcctcactggaggactgaaattcttcgtgccagacatctccaatagcaactctatgatagatgctttcagccgaatcagttcagggaccggcgatatcttccagcaacacatccagctcgagtcgaccggagaaaatgtcaagccacaccaccaattgaagaacactgttacagtggataatacagtcgggaatgacacaatgtttctggtaacctggcaagcctctggaccaccggaaattattctttttgatccggacggccgaaagtactatacaaataacttcattactaacctgacttttcgcacagcttccctgtggatcccgggcaccgccaagcccggacattggacctacacacttaataacacccaccatagcttgcaggctttgaaagtgacagtgaccagcagagcatctaatagtgccgttccgcccgcaacagtggaggctttcgtcgaacgggattccctacattttcctcacccagtaatgatttacgctaatgtcaaacaggggttttatccaatccttaacgccacggttacggctacagtcgaaccggagaccggcgacccagtaaccctccggctgttagacgatggggcgggtgccgacgtcatcaagaacgacggaatttattcacgctatttcttttctttcgccgccaatggcagatattctctgaaagtgcatgtcaaccactcccccagcatctcaaccccagctcacagtatccccggatcccacgccatgtacgtgccgggctacaccgcaaacggcaacattcaaatgaatgccccacggaaatcggtgggaaggaacgaagaagaacgaaagtgggggtttagccgggtgtcgagcggcggaagctttagcgtgctgggcgtgccagcagggccacaccccgacgtgttccctccctgtaaaatcatcgacctggaagccgtgaaggtcgaggaagaactcaccctcagttggacagctcccggcgaagattttgatcagggacaggcaacctcctatgagatccgcatgtctaagtctctacagaatatacaagacgattttaacaacgcgatcctggttaatacctcaaagaggaacccccaacaggccggcattagggagatcttcacattctctcctcagatctctacaaacgggcccgagcaccagcccaatggagagacacacgaatcccatcggatctacgttgccatcagggctatggatcggaatagcctgcagtctgccgtctcaaatatcgcccaggctcccctcttcattccacctaattctgacccagtcccagcccgcgactaccttattctgaagggagtccttacggccatgggtttaattggcatcatctgcctgataatcgttgttacgcaccatacactgagccgaaagaaaagagcggataaaaaagagaacgggacaaaactgctatag

SEQ ID NO: 23562 - DNA, 423 bp, Artificial Sequence
  Description of Artificial Sequence: Synthetic coding sequence
atgacccagcggagcatcgccggccccatctgcaacctgaagttcgtaaccctcctggtcgccctgtcatccgagttgcctttcctgggcgctggcgtccagctccaggataacggatacaacgggttgctgatcgcaatcaatccacaggtccccgaaaaccagaacttgatcagcaacataaaggagatgataacagaggcctccttttacctgtttaatgccaccaagcgtagagtgttttttcgcaacatcaagattctgattccagccacatggaaggcgaacaataattctaagattaagcaggagtcatatgaaaaggcaaatgtgattgttaccgattggtatggcgcccatggggacgatcaaggagtagagaaaagagagaataccttcatctcccatctgataagctattag

SEQ ID NO: 23563 - DNA, 1233 bp, Artificial Sequence
  Description of Artificial Sequence: Synthetic coding sequence
atgaacgacgaggactacagcaccatctacgacaccatccagaacgaacgaacatacgaggttccagaccagccagaggaaaacgagtcccctcactacgatgacgtgcacgagtacctgcgacctgagaatgatttgtacgcgactcagttaaatactcacgagtatgacttcgtgtctgtctacactataaagggtgaggagacatcccttgcctcggtgcagtccgaggacaggggatatctgctgcccgacgagatctactcagagcttcaggaagctcatccaggcgagccacaagaggatcgggggatttccatggagggcctctactcttccacacaggatcagcagctatgcgctgcggagctgcaggagaatggctctgtgatgaaggaggatctcccctcccccagctcttttaccatccagcactccaaggctttctcaacgaccaagtatagctgctattctgacgccgaagggctggaagagaaggagggtgcccacatgaatccagaaatttacctgttcgttaaagcggggattgatggtgaaagcatagggaactgcccattttcccaaagactatttatgatcctgtggctcaaaggtgttgtgttcaatgtcactactgtcgatctcaaacgaaaacctgccgatcttcacaacctggcacctggtacccaccctcccttcctgacctttaacggcgacgtcaagaccgacgtcaacaaaatcgaggagtttctggaggagaccttaacaccagagaagtatccaaagctggcggccaaacatagggaatctaataccgcagggatcgatatattttccaagtttagcgcctatataaagaacacaaaacagcaaaataacgctgcactggaacggggtctaactaaggctctcaagaagctggacgactacctgaacacaccactgccagaggaaatcgacgccaacacctgcggggaagacaagggaagcagaaggaaattcctagatggggacgaattgaccctcgccgactgcaatctgcttccgaaactccacgttgtgaagattgtcgcgaagaagtacaggaactacgacattcccgccgaaatgacgggattgtggcgttacctgaaaaatgcctatgcccgggacgagttcacaaatacatgcgccgctgacagcgagattgaacttgcgtacgcggatgtggctaagcgcctttcccggtcctag

SEQ ID NO: 23564 - DNA, 756 bp, Artificial Sequence
  Description of Artificial Sequence: Synthetic coding sequence
atgaccgacagcgccaccgccaacggcgacgaccgggaccccgagatcgagctgtttgtaaaggccggcattgacggcgagagcatcggcaactgcccattttctcaaaggttattcatgatcctgtggttaaagggagtcgtcttcaacgtgacgactgtggatcttaagcgcaagcctgccgatttacataatctggctccgggcactcacccgccttttctgacgtttaacggcgacgtaaagaccgatgtaaataagatcgaggagttcctggaagagacactcacaccggagaagtatcccaagttggcagccaaacatcgggaaagcaacaccgcaggtatcgacatttttagcaaatttagtgcctacatcaaaaatactaaacagcagaacaatgcagcccttgaacgcggattgacaaaagccctcaagaagttagacgattacttaaatactcctcttcctgaggagattgatgcgaatacttgtggggaagacaagggttcccgcagaaagtttctcgatggtgatgagctgaccctggcagattgcaatctcctgcccaagctacatgttgtgaagattgtcgctaagaaatatcgtaattacgacatcccggctgaaatgaccggattatggagatacctgaagaacgcctatgctagggacgagttcaccaatacttgtgccgccgactccgagatagagcttgcctacgcggatgtagctaagaggcttagccgctcatag

SEQ ID NO: 23565 - DNA, 618 bp, Artificial Sequence
  Description of Artificial Sequence: Synthetic coding sequence
atgaccgacagcgccaccgccaacggcgacgaccgggaccccgagattgagttattcgtcaaggccgggatcgatggcgaatctattggcaactgtccctttagccaaaggctgtttatgatcctctggctgaagggcgtggtttttaatgtgactactgttgacctgaaacggaaaccagctgatttacacaacctcgcgccaggaactcaccctccctttctgactttcaacggcgatgtcaaaaccgacgtcaataagatcgaggaatttctggaggaaacactgacgcccgaaaagtacccaaagctcgccgcaaagcaccgagagtctaacacagcaggaatagatatctttagcaagttttccgcctacatcaaaaacaccaaacagcagaataacgctgcactggagcggggactcacaaaagctctgaagaagctcgatgactatcttaatacacctctgccagaagagatagatgcaaatacatgcggtgaggacaaagggagccggcgcaagttcctggacggcgatgagctgactcttgccgattgtaacttactgccgaagctgcacgttgttaaagagcaggtgcccttgaaaggcatgatttag

SEQ ID NO: 23566 - DNA, 5823 bp, Artificial Sequence
  Description of Artificial Sequence: Synthetic coding sequence
atggccagcggcctgggcagccccagcccctgcagcgccggcagcgaagaagaggacatggatgcactgctgaacaattcattgcccccaccccacccagaaaacgaagaagacccggaggaggacctatcagagaccgagacacccaagcttaagaagaagaaaaagcctaagaagccccgggaccctaaaatccctaaatccaaacgccagaaaaaagagcgaatgctgctgtgccggcagctcggcgacagtagtggcgaaggaccagaatttgtggaggaagaggaggaggtggccctcagatcagatagtgaaggcagtgactacaccccaggaaaaaaaaaaaagaagaagctcggccctaagaaggaaaagaagtcgaaatcaaagcgtaaggaagaagaagaggaggaagacgacgacgatgattcaaaggagcctaaaagcagtgctcagctgctggaggattggggcatggaggatattgatcatgtcttctctgaggaagattatagaactctcacaaattataaggcattctcacagtttgtaaggccgctaatagccgcaaaaaatccaaagatcgcagtgagcaaaatgatgatggttctcggcgccaaatggcgcgagttcagtactaacaatcctttcaagggctcctccggcgcatccgtcgccgctgccgccgccgcggccgtcgccgttgtggaaagtatggtaaccgcaacggaggtggccccacccccaccccctgtggaagtgccgattcggaaagccaagaccaaggaaggcaagggtccgaatgcgaggagaaagccaaagggcagtcctcgcgtaccagacgcgaagaaacctaagcctaaaaaggtagcaccccttaaaatcaaattaggcggcttcggcagcaaaagaaaacgttcctctagcgaggatgatgacctggacgtggagtcggactttgatgacgcatctatcaattcgtattcggtgagtgacgggtcgacttctaggtcttcacgcagccgcaaaaaattgaggacaactaaaaagaaaaaaaaaggggaggaggaagtgacagccgtggatggttacgaaaccgaccatcaggattattgtgaagtgtgccagcagggaggagaaatcattttatgcgacacatgcccaagggcatatcatatggtctgtctggatcccgacatggaaaaggcccctgaaggcaaatggtcatgtccccactgcgaaaaagaaggcattcagtgggaagcaaaggaagataatagtgaaggagaagaaatcctggaggaagtcggcggcgatctggaagaggaagatgatcaccacatggagttttgtagagtttgcaaagatggcggcgagctgttgtgctgtgacacatgtccaagttcttatcatatccattgtcttaatccgccgctgcctgagatccctaacggagaatggctgtgtccccgttgcacctgccccgcactgaagggcaaggtgcagaagatactgatatggaagtggggacagccaccctcacccacaccagtaccaaggccgcccgacgccgacccaaatactcccagccctaagcccctcgagggcagaccagaacggcagtttttcgtgaagtggcagggaatgtcttactggcactgttcctgggtgtctgagctacagctcgagctccactgccaggtgatgttccgaaattaccagaggaagaacgacatggacgaacctccttccggggattttggaggggacgaagaaaaatcccgcaaaaggaagaataaagaccccaaattcgctgagatggaggagcggttctaccgctacggcattaagccggaatggatgatgattcataggatattgaaccattctgttgacaaaaaaggccacgtgcactatttaatcaagtggagggatcttccatatgaccaggcctcttgggagtccgaagacgtggagattcaggattacgacttgtttaagcaaagctattggaaccaccgcgagctcatgcggggggaggagggtcgccccggtaagaagctaaagaaggtcaagttaagaaaattagagcggccccctgaaacccccaccgtggatcccacagtgaagtacgagagacagcccgagtacttagatgccacaggcggaacactgcatccttatcagatggaggggctgaactggctgcgattttcctgggctcagggaactgatactatactggctgatgaaatgggcctggggaagaccgtgcaaaccgcggtgtttctttactccttgtataaggagggccattccaagggccccttccttgttagtgcacccctgtctaccatcattaactgggagcgcgagttcgaaatgtgggcgcctgacatgtatgtggtcacatacgtgggcgacaaagacagtagagctatcatccgcgaaaatgaattttcttttgaagataacgctattagaggaggtaagaaagcgagccggatgaagaaagaagcctctgtgaaatttcatgttctactcacatcctatgagctcattaccatagatatggcaattctcggatccattgattgggcgtgcctcatcgtggacgaagcccatagacttaaaaataaccagagcaagttctttcgagtcctgaacggttactcgttacaacacaagctcctcctgaccgggactccactccagaacaatttggaagaactcttccatttgctgaacttcttgacacctgaacggtttcataatctggagggtttcctggaggaatttgccgatatcgcaaaggaagaccagattaagaagttgcatgacatgttgggaccacacatgctgaggaggctgaaagcggacgtgttcaaaaatatgccctcaaagacagagctgattgttcgcgtcgaactgtctcccatgcagaagaaatattataagtatattttaactcgaaacttcgaggcccttaatgcccgcggcggcggcaaccaagtgtccctgttgaacgtggtcatggatctcaaaaagtgctgcaaccacccctacttgtttccagtagccgctatggaggcccccaagatgccaaatggaatgtacgacggttcagccctgattcgtgcttcaggaaagctcctgctcctgcagaagatgttgaaaaaccttaaggagggaggacacagagtcctgatctttagccagatgacaaaaatgcttgatctcctggaggactttctcgagcacgaagggtacaagtacgagagaatagacgggggtatcaccggtaatatgaggcaggaggctatagatcggttcaacgcgcctggagctcagcagttttgtttccttctgagcactcgagccggtggtctgggtataaacctagccaccgccgataccgtcatcatctacgacagcgactggaatcctcacaacgacatccaggccttctcaagagctcacagaataggccagaacaaaaaagtcatgatctaccgattcgtgactcgcgcttctgtcgaagagcgaattacacaggtagccaaaaagaagatgatgctgacccacctagtggtccgccccggcctcggatcaaagacaggatccatgagtaagcaagagctagatgacatcctgaaatttggtacggaagagctgttcaaggacgaagccactgatggcggcggagataataaagagggagaagactcgtccgttattcactacgatgataaggccattgaaagactacttgacaggaatcaggatgaaactgaagacaccgaactgcaaggaatgaacgagtacctttcaagcttcaaggttgcccagtacgtggtccgcgaagaagaaatgggggaggaagaggaggtggaacgcgagatcattaaacaggaggagtccgtcgatcctgattattgggaaaagctgctgcgccaccattacgaacaacaacaggaagacttggcccgaaatctgggcaagggaaagcgtattaggaagcaggtgaattataatgatggctcccaggaggaccgcggcgtgtgcggccggcctcgccctcctcccatgggaagaagtacaagggcagttgggccagctcacctgccaagcctgcctcctgactggcaggacgaccagtctgataaccaaagcgattattctgtcgcaagcgaagagggtgacgaggacttcgatgaacgtagtgaggccccacgaagacctagccgtaagggactacgaaacgacaaggacaaaccactgcccccactcctagcgagagtgggagggaacatcgaggtacttggctttaacgcaagacagcgtaaagccttcttaaatgctatcatgagatacggcatgccgccacaggatgcctttactacacaatggctcgtgcgcgatcttagaggaaaaagcgaaaaggaatttaaggcatacgtgtctctgttcatgaggcatctgtgcgagcctggtgcagacggcgccgagaccttcgcagatggggttcccagagaaggcctgtctagacagcacgtgctgacccgcattggcgtcatgtccctgattaggaaaaaagtgcaagagttcgagcacgtgaatggacgttggagcatgcctgaactggctgaggtggaagagaacaaaaaaatgtcccaacctggtagtccatcacccaagacacccacaccatccactccaggcgacacccagcccaacaccccagcaccggtgccgcccgccgaagatggcatcaagattgaggagaattcactcaaagaagaggagagcattgagggcgaaaaggaggtgaaatctaccgccccagagactgcgatcgaatgcacccaagctcctgcccctgcctctgaagatgaaaaggtggtcgtggagcctcccgaaggggaggagaaagtggaaaaggcggaagtcaaggaacggacggaggagccaatggaaaccgaaccaaagggcgctgccgacgtggaaaaggtggaagagaagagtgcaatagacctgacaccgatcgttgtggaagacaaagaggagaaaaaggaggaggaagagaaaaaggaagttatgcttcagaatggggagactcccaaagacctcaatgatgagaagcagaaaaaaaatattaaacaaaggttcatgttcaatattgcagacgggggttttaccgagcttcactcactttggcagaacgaggagagggccgcaacagtgaccaagaagacttacgagatctggcacaggaggcatgactattggctcctcgcggggattatcaatcatgggtacgcccgctggcaggacattcagaatgatccacggtatgccattctgaacgaaccatttaaaggggagatgaaccgtggaaattttctcgaaatcaagaacaaatttcttgccaggcggttcaagttgctagagcaggccctagttattgaggagcagctgcgccgtgccgcctacttaaatatgtctgaagatccatctcacccgagtatggcgctcaacacgaggtttgctgaggtggaatgcctggccgaatctcaccagcatctgtcaaaagagagcatggccggaaataaaccggccaacgctgttcttcataaggtgctgaagcagctggaagaactgcttagtgatatgaaggctgatgttacgcggctgcctgccacgattgctcgaatccctcctgttgcagtgcgcctccagatgagcgaacgaaatatcctgtctaggcttgccaacagggcccccgaacccactcctcagcaggtagcacaacagcagtag

SEQ ID NO: 23567 - DNA, 5739 bp, Artificial Sequence
  Description of Artificial Sequence: Synthetic coding sequence
atggccagcggcctgggcagccccagcccctgcagcgccggcagcgaggaggaggacatggacgcgctgctgaacaattccctgccgcctccccaccccgagaatgaggaggatcccgaagaagatttatcagaaacggaaacacctaagctgaagaagaaaaagaaaccgaaaaagcccagagatcctaagatccccaaaagcaaaagacagaagaaggagaggatgctcctttgcaggcagttgggggattctagcggcgagggccccgaattcgtggaggaagaggaagaggtggcactccggtccgactctgaaggatctgattatactccaggtaaaaagaagaagaagaagttaggtcctaagaaggaaaagaagagcaagtctaagcggaaggaagaggaggaagaggaggatgacgatgacgacagcaaggagcctaaaagtagtgcccagctcctcgaggactgggggatggaagacatcgatcacgtctttagtgaggaagactataggacccttaccaattacaaagccttctctcagttcgtccgtcctttgattgcggccaaaaaccccaaaattgcagtgagcaagatgatgatggtactcggcgcaaaatggcgtgaattcagtaccaataacccattcaaaggcagttcaggggcctcagttgccgcagccgccgcagccgccgtggctgtggttgagtcgatggttaccgctacggaggtcgcccccccgccaccgcccgtcgaggtaccgattcggaaagcaaagactaaggaaggtaagggacctaatgccaggcgtaaaccaaagggatccccgcgggtacctgatgccaagaagccaaagccaaagaaggttgcgcccctgaagatcaagttagggggcttcgggtccaaacgcaagaggtcgagctcagaagatgacgacctggacgtggaaagtgactttgacgatgccagtataaactcatattctgtgtctgatggcagcacatccaggtcgtccagaagccgtaaaaagctcagaacaaccaaaaaaaagaaaaaaggggaggaggaagtcaccgcagtggatggctatgagactgaccatcaagattactgtgaagtctgccagcaaggtggagagattattctgtgcgacacctgtcctagagcctaccatatggtctgcttggaccccgacatggaaaaagcacctgagggaaagtggagttgtcctcactgcgagaaagagggtatccagtgggaagcaaaggaagataattctgaaggggaggaaatactggaagaggtgggaggagacttggaagaagaggacgaccaccatatggagttctgtcgagtgtgtaaagatggcggggagcttctctgttgtgacacttgcccatccagttatcatattcactgcctgaacccccctctacccgagatccctaacggcgagtggctgtgcccacgctgtacgtgccccgctttgaaaggcaaagttcagaaaattcttatctggaagtggggccaaccgccaagccccacacccgtgcctcgtcctcctgacgctgaccctaatactccttcgccaaagccattagagggaaggcccgagagacagttcttcgtgaaatggcagggtatgtcctactggcattgcagttgggtgtcggagctgcagctggagcttcactgccaggtgatgtttcgcaactatcaaagaaagaatgatatggatgagcctccgtctggcgattttggtggcgatgaggagaaaagcagaaagcgaaagaacaaagatcccaagtttgccgagatggaggagagattctaccgttatggtattaaaccggaatggatgatgatccacagaattctcaaccacagtgtcgacaagaagggacacgttcattatctaattaagtggagggatctaccttacgaccaggcgagttgggaaagcgaggacgtcgaaatccaggactacgacctgttcaagcaatcttactggaaccaccgcgagctgatgagaggcgaagagggtcgtcctgggaagaaactgaaaaaagtgaagctgaggaagcttgaacgccctcctgagacccctaccgtggacccaaccgtgaaatacgagcgccagccagagtatctagacgctactggaggcactcttcacccgtatcagatggagggcctcaattggttacggttttcctgggctcaaggcacagacacaatcctggctgacgagatgggtctggggaagacggtccagacagccgtcttcctgtatagcctgtataaagaaggccacagcaaagggccatttctcgtgtctgctccattgagcacgatcattaattgggagcgggagtttgaaatgtgggccccggacatgtatgtggtaacttatgtcggcgataaggactcccgtgctattatccgggagaatgaattcagcttcgaagacaacgctatcagaggcggaaaaaaagcgtccagaatgaagaaggaagcctctgtcaagttccacgtgttgctcacctcctatgaactgattactattgacatggccatcttggggtctattgattgggcgtgcttaattgtagatgaggcgcacaggctcaagaataatcagagcaaattctttcgcgtcctgaacgggtatagtttgcaacacaaactcttgctcaccggcaccccgctccaaaacaatcttgaggagttgtttcatctgcttaacttcctcactccagagaggttccataaccttgagggcttcctggaagaatttgctgacatcgccaaagaagatcagattaagaagctgcatgacatgctgggccctcatatgctcagaagactgaaagcagatgtattcaagaacatgcctagcaagaccgagctgatagtgcgcgtagaacttagccccatgcaaaagaagtattacaagtatattctgacgcggaactttgaagcactgaacgcacggggtggggggaaccaggtgtctctgctgaacgtggttatggacctgaagaaatgttgcaaccacccttaccttttcccagtggccgccatggaagcacctaagatgccaaatggaatgtacgatggatcagcccttattcgagcatctgggaaacttttgctattgcagaagatgttgaagaatctgaaagagggcgggcaccgggtgctgatatttagtcaaatgactaagatgcttgacctgctggaggacttcctggagcacgagggatacaaatatgagcgcattgatggaggcatcaccgggaatatgcggcaggaggcaattgacagattcaacgcgccgggggcccagcagttctgtttcttgctaagcacgcgcgccggcgggcttggaatcaatttggcgaccgcggatactgtgattatctacgattcagactggaatcctcacaacgatatacaggccttttctcgagctcacaggatcggccagaataagaaagtcatgatttatcgcttcgtgactcgcgcatcagtggaggagcgtatcacacaggtagccaaaaagaagatgatgcttacccacctggtggttcggccaggtctggggtccaaaaccggcagtatgagcaagcaagaacttgatgacattcttaagttcggtactgaggagctcttcaaggacgaagcgaccgatggaggcggggataataaggaaggagaggacagcagcgtgatacactacgacgacaaagctatcgaaagacttctcgatcggaaccaggatgaaacggaggataccgagctgcagggtatgaatgagtatctctcctccttcaaagtagcccagtacgttgtaagagaggaagaaatgggagaagaggaggaagtggagcgtgaaattatcaagcaggaagagtcagttgaccctgattactgggagaagcttttacggcaccactacgaacagcagcaggaggacctggcaagaaatttagggaaaggcaaaaggatccgcaaacaggtaaactataacgatggaagccaggaggatagagactggcaggatgatcagagcgataatcagtccgactactccgtggcctctgaagagggcgacgaagacttcgatgagcgttctgaggcgccacgtaggccctctcggaagggcctgcgcaacgataaagataaaccactacctccactgctcgccagggtcggaggaaatattgaagtgctgggtttcaacgcacgtcagcgaaaggcctttctcaatgcaataatgagatatggcatgcctccacaggacgcgtttactacccagtggctcgtgagagacctgaggggcaagtctgaaaaagaattcaaagcctacgtgagtctgtttatgagacacttgtgtgaaccgggtgctgacggggccgagacctttgctgacggcgtgccgcgtgagggcctgtcacgacagcatgtcttgacaaggataggtgtaatgtctcttattaggaagaaggtgcaggaattcgagcacgtgaacggtagatggagtatgccagagctcgctgaggtggaagagaataaaaaaatgtcccagcccggaagcccatctccaaagacaccaacccctagtacgcctggcgatacccagccaaacacgccagctccagtgcctcccgctgaagacgggattaaaatcgaggagaactccctgaaggaagaggagtctatcgagggggagaaggaggtcaaatcaactgcccccgaaacagccattgagtgtacccaggccccagcaccagcttccgaggacgagaaagttgttgttgagcctcctgaaggtgaggagaaggtcgagaaggccgaggtgaaagagcggactgaagaaccaatggagaccgaaccaaagggtgccgccgacgtggagaaagtggaggagaagtccgccattgatctgacgcctatcgtcgttgaagacaaagaagaaaaaaaggaagaggaggagaaaaaagaggtgatgctccagaatggcgagacacctaaagacctcaatgatgagaaacaaaagaagaatattaaacaacgcttcatgtttaacatcgccgacggcgggtttacagagttgcattctctgtggcagaatgaggaacgggccgcaaccgtgacaaagaagacctacgagatttggcacagacgccacgactactggttactggccggcattatcaatcatggctatgcccgctggcaggacattcaaaatgacccaaggtacgctatattaaacgaaccatttaaaggcgagatgaaccggggcaacttcctcgaaatcaaaaataaatttttagcaaggagattcaaactcctggaacaagccttggttatcgaggagcagctgcgcagggcggcatacttgaatatgtccgaagatcccagtcacccctccatggccctcaatactcgcttcgcggaggtcgagtgcctcgccgagtcacaccaacacctgagtaaggaaagcatggccggtaataagcctgctaacgccgtgctgcacaaggtgctcaagcaactggaggaactgctttccgacatgaaagctgacgtgacacgcctccccgccacaattgctagaatacctcccgtggccgtccggctgcagatgtcagagaggaatatcttgagccggctcgcaaaccgcgctcctgaacccacaccgcagcaggtggcacagcagcaatag

SEQ ID NO: 23568 - DNA, 5661 bp, Artificial Sequence
  Description of Artificial Sequence: Synthetic coding sequence
atggacgccctgctgaacaacagcctgccccccccccaccccgagaatgaggaagacccagaggaagacctgagcgagactgaaactcctaagctgaaaaagaagaaaaagcctaaaaagccccgagacccaaagataccaaaaagcaaacgccagaagaaagagctgggagatagcagcggagagggacccgagtttgtcgaagaagaggaggaagtggcactgagaagcgatagtgagggaagtgactatactcccgggaagaaaaaaaagaaaaagctgggcccaaagaaagagaagaaaagtaagtccaagagaaaagaggaggaagaagaggaggacgacgacgatgacagtaaggaacctaagtcctctgctcagctgctagaagactgggggatggaagatatcgaccatgtgttcagtgaggaggactatcgcacactaaccaattacaaggcattttctcagtttgtcaggccgttaatcgctgcaaagaaccccaagatcgccgtgagcaaaatgatgatggtcctgggtgccaagtggcgggaatttagcacgaataaccccttcaaaggctcatctggtgcttccgttgcagcagccgccgctgctgcagttgcagtcgtcgagagtatggtgacagccactgaggtggcgcccccacctccccccgtagaggtcccaattaggaaggctaagacgaaagaaggtaagggacccaacgcccgaagaaaaccgaagggtagccctcgtgtgcctgatgccaagaagccaaaacctaagaaggttgcaccactgaagattaagctgggcggctttggttcaaagcgcaagaggtcaagctctgaggacgatgacctggacgtggagagcgatttcgacgatgcatctataaattcctacagtgtcagtgatggctctacctcgcgttctagtcggtcaaggaaaaaacttcggactaccaaaaagaaaaaaaaaggggaagaagaggtgaccgcagttgacggctacgagactgaccaccaagactactgtgaggtctgtcaacaaggcggggagatcatattgtgtgatacgtgtccaagagcttatcacatggtgtgtctcgatccggatatggagaaggcaccagagggcaaatggtcctgtccccattgcgagaaggagggcatccagtgggaggctaaggaagataacagtgaaggagaggaaattctagaagaagtcggtggagacctagaagaagaggacgatcaccatatggaattttgccgcgtgtgcaaagatgggggcgaactcttatgttgtgacacttgccccagtagctaccacattcactgtttaaatcccccattgcctgaaatccctaacggcgaatggctctgccccagatgcacgtgtcctgccctgaagggcaaggtgcaaaaaatcttgatctggaagtggggccagccaccgtcgccgacccctgtcccacgcccccctgatgccgaccccaatactccctcccccaagcccctggagggacgccccgagcgccaattctttgtgaaatggcagggcatgagttactggcattgtagctgggtgagcgaactgcagctcgagctccactgccaagtgatgttccgaaattatcagcgcaagaacgacatggacgaacctccatctggagacttcggcggcgacgaagagaaatccagaaagaggaaaaacaaggatcccaagtttgccgagatggaagagcggttctatcgatacggaatcaagccagaatggatgatgattcacagaatcctgaaccattctgttgacaaaaaaggccacgttcattacctgataaagtggcgtgaccttccttacgaccaagcttcttgggaatctgaggatgtggaaattcaggattacgatttatttaaacaatcatactggaaccatcgcgaattgatgcggggggaggagggccgtccaggaaagaagctgaagaaggtgaaactgcgaaagctcgagaggccccctgagacccctacagtggaccctacggtcaagtatgagcgccagccagagtacctcgatgctaccggggggactctgcatccataccagatggagggactgaattggctcaggttcagctgggcgcagggaacagacaccattcttgccgatgaaatgggactcggcaagactgttcagacggcagtgtttttgtactctctttacaaggagggccattcgaaggggccctttttagtgagtgcgccattgagtacaatcattaattgggaacgggagtttgagatgtgggccccagacatgtacgtggtcacgtatgtcggcgacaaggactctcgggccatcattcgggagaacgagtttagcttcgaggacaacgccatccgcggcggcaagaaggcatcccgcatgaagaaggaggcttcggtaaaatttcatgtcttgctcaccagttatgaattgatcacaatcgatatggcaatcctgggctccattgattgggcatgcctcatcgtcgacgaggcccaccggctgaagaacaaccaatcaaaattctttagagtccttaacgggtacagccttcagcataaattgctcttgaccggaacgcctttacagaacaatctagaggagcttttccacctccttaactttcttacccccgagcggtttcacaatctggagggttttctcgaggagttcgcggatatcgccaaggaggatcagatcaagaagctccacgacatgctaggtcctcatatgctgaggagattaaaagctgacgtgttcaaaaacatgcccagtaaaaccgagcttattgtacgggtggaattatcccctatgcagaagaagtactataagtacatccttactagaaacttcgaagctctgaatgctcgtggagggggtaaccaggtctcactcctgaacgtggtcatggacctgaagaaatgctgcaaccatccgtatttattcccagttgccgcgatggaggcacccaaaatgccaaacggcatgtacgatggtagcgccctgattagggccagtggtaagctcctgctgctccagaagatgctgaaaaatctgaaggagggtggccaccgcgttcttattttctctcaaatgaccaaaatgttggaccttctagaagattttctggagcacgagggctataagtacgagcggatcgacgggggcattacagggaacatgagacaagaggcaatcgacaggttcaacgccccaggggcacagcaattttgcttcctccttagcacacgcgcaggtggcctcggcatcaatctggcaacagcagacactgtaatcatttacgattccgattggaatccgcacaacgatatccaggcgttctccagggcccatagaatcggtcagaataagaaagttatgatttataggttcgtcaccagagcctcagtcgaggagcggattacccaggttgcgaaaaagaagatgatgctgacacacctggtcgtcaggcccggtcttggaagcaaaactggttcaatgtccaagcaggaacttgatgacatcctgaaattcggtaccgaggaattgttcaaggacgaagctactgacgggggcggcgacaataaagagggcgaggattcaagcgtgatacattacgacgacaaagcaatcgaacgtcttctggacaggaatcaggatgaaactgaggacacagagctgcaagggatgaacgaatacctcagctcgttcaaggtggcgcagtacgtggttagagaggaggagatgggtgaggaagaagaagttgagcgcgaaataatcaagcaggaagaatccgtggatcccgattactgggagaagctcctccggcaccattatgagcagcagcaggaagaccttgcccggaacctaggcaaaggtaaaagaattcgcaaacaagttaattataatgacggcagtcaggaggatagagattggcaggatgatcagagcgacaaccagagtgactattccgtagcatccgaagagggcgatgaggattttgatgagcgctccgaggccccccgtcgtccatctcggaagggtctgagaaatgacaaagataagcctctccccccacttctcgctcgcgttggggggaacatcgaggtcttaggatttaatgccaggcagcgaaaagcattcctgaatgccattatgcgctatggaatgcctccccaggacgccttcacgacacagtggctcgtccgggatttgagaggtaaaagcgagaaggaatttaaagcctacgtatcactgtttatgcgccacctctgcgagccaggagccgacggggctgagacctttgccgatggtgtgccacgggagggactcagcaggcagcatgtacttacacgtatcggggtgatgtccctcatccggaaaaaggtccaggagttcgagcacgttaatggaagatggtcaatgcccgagctagctgaggtagaggagaataagaaaatgtctcaaccggggagcccctccccaaaaacacccactccctccactccaggcgacacacagcccaatactcccgcccccgtgccccccgcagaagatgggattaaaatcgaggagaattctctgaaggaagaggaatctatcgagggcgagaaagaggtaaagagtaccgccccggaaacagcaatcgaatgcacccaggccccagctccagctagtgaagacgaaaaagtggtggttgaaccacccgaaggtgaagagaaggttgagaaggcagaagtgaaggagcggactgaagaaccgatggagactgagccgaagggcgccgccgatgttgagaaagtggaggagaaatctgccatagatctaaccccaattgtagttgaagacaaagaggaaaaaaaagaggaagaagaaaagaaggaggtaatgctccagaatggagagaccccaaaggacttgaacgatgaaaagcagaagaaaaacattaagcagaggttcatgttcaacatagccgatggagggtttacggagctgcactctctctggcaaaatgaagagagagcagctactgtgacaaaaaagacctatgaaatatggcatcgcagacatgattattggttactagctgggattataaatcatggctacgctcgttggcaggatatccagaatgaccccagatacgccatccttaacgaaccatttaagggggaaatgaaccgcgggaacttcttggaaattaaaaacaaatttctggctaggcgattcaagcttcttgaacaggcattagttatcgaggagcagctccgcagagccgcatacttaaatatgagcgaggacccatcgcatccgtctatggcccttaacacacgcttcgccgaggtagagtgcctggcagagagccaccagcatctcagcaaggaatctatggcgggaaacaagccagccaacgctgtcctgcataaggtgctgaagcagttggaggagctgctgtctgacatgaaggccgatgtcacaagactgcctgcaacaatagctaggattccacctgtcgccgtaagactccagatgagtgagagaaacatcctgtcaaggctcgcaaaccgcgcccccgagcccactccgcagcaagtcgctcaacaacagtag

SEQ ID NO: 23569 - DNA, 5718 bp, Artificial Sequence
  Description of Artificial Sequence: Synthetic coding sequence
atggccagcggcctgggcagccccagcccctgcagcgccggcagcgaagaggaggatatggacgcactcctaaataattctctccccccaccccatcctgaaaatgaagaagaccccgaggaggacctgagcgaaactgagaccccgaaattaaagaagaagaagaaacccaagaaaccccgcgatcccaagattccaaaatccaagcgccaaaagaaagaacttggagactcctccggagaaggcccagaattcgtggaagaggaagaagaggtcgcattaagatccgacagcgaaggatctgactacacaccaggaaagaaaaagaaaaagaagcttggccccaagaaggaaaaaaagtcaaaatctaaaagaaaggaggaagaggaggaagaggacgatgatgacgacagcaaagagcccaagagctccgcccaactcctggaagattggggcatggaggatattgaccacgtgttttctgaagaagactaccgcaccctgactaattacaaggcttttagccagtttgtccgccccctgattgccgcaaagaaccctaagatagccgtgtcaaaaatgatgatggtgttgggcgccaaatggagagaattctcgacaaataacccgtttaaagggtccagcggtgccagcgtggcggctgccgccgccgctgctgtggctgtcgtggaaagcatggtcaccgctaccgaggtggcccctcccccacctcccgtcgaggttcccatcaggaaggctaaaactaaagaggggaaaggcccgaatgcgagaaggaagcctaaaggaagcccaagagtcccggatgctaagaaacccaagcccaaaaaggtggccccgctgaaaataaaactcgggggtttcggaagcaagaggaagcgatcttcaagcgaagatgacgacctcgacgtggaatccgatttcgacgacgcatccatcaattcctactccgtttctgacggttccacaagtaggtcttcccgttcacgtaaaaagttgagaacaactaagaaaaagaagaaaggcgaagaggaagtcactgctgtcgatggttacgagacggaccatcaggactactgcgaggtctgccagcagggcggtgaaatcatcctgtgcgatacctgccctagggcatatcatatggtgtgtcttgacccagacatggagaaagcccccgaaggtaagtggtcttgtccccactgcgaaaaggaaggtatacagtgggaagccaaagaggacaattccgagggagaggaaatacttgaggaagtgggcggagatctggaggaggaggacgaccaccatatggagttttgtagagtgtgtaaggatgggggcgagttattatgttgtgacacctgtccttcctcctaccacattcactgtctgaacccaccccttccagagatccccaacggagagtggttgtgtcccagatgtacttgccccgctctgaagggcaaggtgcagaagatcctcatttggaaatgggggcagccaccttctcctacaccagtacccagaccaccagacgccgatcctaacaccccatcccctaagcccctggaggggcggcctgaaaggcagttctttgttaagtggcagggcatgtcctattggcactgctcatgggtgagcgaattgcagcttgaactgcattgccaggttatgtttaggaattaccaacggaagaatgatatggatgaaccgccatccggcgactttgggggcgacgaggagaaaagtcggaagcggaagaataaagaccctaaatttgccgagatggaggagaggttctataggtatgggatcaagccggaatggatgatgattcacaggatcctgaaccattcagtagataaaaaaggtcacgtgcattaccttattaaatggagagaccttccctatgaccaggcttcctgggaatcagaggatgttgagatccaggactatgatctcttcaagcagagctactggaaccatcgggagctgatgcggggagaggaagggagacccgggaagaagctgaagaaagtcaaactgaggaagttggagagaccaccagaaaccccgaccgttgatcctacagtgaagtacgaacgacagcccgaatacctagatgctacgggaggcactcttcatccttatcagatggagggcttaaattggctacgcttttcttgggctcaaggaaccgataccatattagccgacgagatgggtctcggcaagacggtacagactgccgtgttcctttattccctctataaagaggggcattccaagggtcccttcctggtgtccgcccccctgagtactatcattaattgggagcgtgagttcgaaatgtgggctcccgatatgtacgtggtcacatatgttggcgataaggattctcgggctatcattagggagaacgagttctctttcgaagataacgccatccgtggggggaaaaaggcttcgaggatgaaaaaggaagcctcggtgaaattccacgtgctgcttactagctacgagctgattactattgacatggctatactgggttccattgattgggcctgcctcatcgtggatgaggcacacaggctgaagaacaaccagtctaaattctttagggtcctgaatggatactctctgcaacacaagttgctcttgactggaacgcctttacagaataatctggaagagttgttccacctgcttaacttcctcacacccgaacgcttccacaatctagagggatttttagaggaatttgctgatatcgccaaggaggaccaaatcaagaagcttcacgatatgctaggccctcacatgctccggcgcctgaaggctgacgtgttcaaaaatatgccttccaagaccgagctcattgtccgggtggagctgagtccgatgcaaaagaagtattataaatacattctcactcgtaacttcgaagcactcaatgctcgcggggggggtaatcaggtctcgctgctgaatgtagtcatggacttaaaaaagtgctgcaaccatccatacctgtttcctgtagcagccatggaggcccccaagatgccaaatggtatgtatgacggttccgcattaatccgcgcttctggaaagctgctgctgctgcagaaaatgctgaagaatcttaaggaggggggacatcgagttctgatcttttcccagatgacgaagatgctcgacctcttagaggattttctggaacatgaaggctacaagtacgagaggattgatggcggaatcaccgggaacatgcgacaggaggcaatcgataggttcaacgctcccggggcgcagcagttttgcttcctcttgagtacacgggctggaggtctcggtattaaccttgccacagcagacaccgtaatcatttatgattcagactggaaccctcacaatgatatccaagctttcagtcgagcccataggattgggcaaaataaaaaggtaatgatttatcgattcgttacgcgggctagcgtggaggaacgcatcacacaggttgcaaaaaaaaaaatgatgctgactcacctagtcgtaagacccggtctcgggtctaaaactgggagcatgtcgaagcaggaacttgacgacatactgaagttcggcacggaagagctattcaaggatgaggctactgacggcggtggagacaacaaagagggggaggattcctccgttatccactacgacgacaaggcaatcgagagactccttgatagaaaccaggacgaaaccgaggacaccgaactacaggggatgaatgaatacctgtcctcttttaaagtggcacaatatgtggtacgcgaagaggagatgggggaggaggaagaagtggagcgtgagattattaagcaggaagaatctgtggatccggattactgggagaagctgcttcggcatcactacgaacagcaacaggaagacctagcacgcaatctgggcaagggcaaacgcattaggaaacaggttaattacaacgatggctctcaggaggaccgggactggcaggatgaccagagcgataaccagagtgactattccgttgccagcgaggaaggagatgaagattttgacgaacggagcgaggccccgcgccggccctctagaaagggccttagaaatgacaaggacaagccacttccgcccttgttagcccgggtgggcggcaatatcgaagtactggggttcaacgcccggcagcgcaaggcatttctgaacgctatcatgcgctacggtatgcccccccaagatgcctttaccacccaatggctggtacgggatctgcgggggaagagcgaaaaagagttcaaggcctatgtttctctcttcatgaggcatctttgtgaacctggtgctgacggagcagaaacctttgccgacggcgtgcccagagaaggtctcagcaggcaacacgtgctgaccagaatcggcgtcatgtccctcattaggaagaaagtgcaggagtttgagcatgtgaatgggcgatggtccatgcctgagctggccgaagtggaagaaaataaaaaaatgtcccaacctggatccccctcaccgaagactcccactccatcaacacccggcgatacccagcctaacacacccgcccctgtgccgcctgctgaggacggcatcaaaattgaggaaaactcgctgaaggaagaggaaagtatcgagggggaaaaggaggtgaagtcaacagctcctgaaactgccatcgaatgcacccaggctcccgcccccgcgtctgaggacgagaaggtggtggtggaaccgcccgagggcgaagagaaagtcgaaaaagctgaagtgaaagagcgcaccgaggaaccgatggaaacagaacccaagggcgctgcggatgtcgaaaaggtggaagaaaagtctgcaatcgacctgactcccatcgtagtcgaggacaaagaagaaaaaaaggaggaggaggaaaagaaggaggtgatgctgcagaatggggaaacaccaaaggacctcaatgacgagaagcaaaaaaaaaacattaagcagcgattcatgttcaatattgccgatggaggatttactgaactccactcactctggcagaacgaggagcgggccgccactgtcactaaaaagacatacgaaatctggcaccggcgccatgactattggctcttagcaggaatcatcaatcatgggtacgccagatggcaggatatccaaaacgacccacgctatgccatacttaatgagccatttaagggcgagatgaaccgcggcaactttctggaaatcaaaaataaattcctggcaagacgttttaaattattagaacaggccctcgtgattgaggaacaactgaggcgcgccgcatatctcaacatgagcgaagacccctcacacccctccatggcccttaacacccggttcgcggaggtcgaatgcctagccgaatctcaccagcatctttcgaaggagagcatggctgggaacaaacccgccaacgcggtgttacacaaggttttgaaacagcttgaagaactgctcagcgacatgaaggcagatgtgactagactgccagcgacaatcgcccggatccctccagtagctgtgcgactgcaaatgtccgagcgaaacattttgtcccgcttagctaaccgggctcccgagcccacaccacaacaggtggctcaacaacaatag

SEQ ID NO: 23570 - DNA, 5814 bp, Artificial Sequence
  Description of Artificial Sequence: Synthetic coding sequence
atggccagcggcctgggcagccccagcccctgcagcgccggcagcgaggaggaagatatggatgctctgttgaacaattctttgcctcctccccaccctgaagaccccgaggaggacctgtccgaaactgaaactcccaagctgaaaaagaagaagaagccaaaaaagcctcgggaccctaagatcccaaagagcaagagacaaaagaaagagaggatgctactctgcagacagctgggcgacagtagtggcgaaggtcccgaattcgtggaggaggaagaagaagtggccctgcgatctgactccgaagggagcgactacactcccgggaaaaaaaaaaagaaaaaactggggccaaagaaggagaagaaatctaagtcgaaacggaaggaagaagaagaggaagaagatgacgacgacgacagtaaggagcccaagtctagcgcacaactgctcgaggattgggggatggaagacatcgaccatgtcttctccgaggaggactaccggaccctgaccaactataaggcatttagtcagttcgtgagaccacttatcgctgctaagaatcctaagatagcggtaagcaagatgatgatggtgctcggcgccaaatggagggaattcagtaccaacaatccctttaagggttcaagcggggccagcgtagccgctgccgcggcggctgctgttgcggtggtggaatcgatggtgaccgctacagaggtggccccaccccctccacccgtggaggtgcccattcggaaagcaaaaactaaggagggaaaaggtcctaacgcccggcggaaacccaaaggctcccctcgggtgcctgacgcgaaaaagcccaagccgaagaaagttgcgcccctgaagatcaagctggggggcttcggcagtaagagaaaaagatcatcctcagaggacgatgatctcgatgttgagagtgactttgacgacgcctcaatcaattcatacagcgtttcagatgggagcacctcccgcagctcccgctcgaggaaaaagttgagaacaactaaaaaaaagaaaaaaggcgaggaagaggtgaccgctgtggatgggtacgagacggatcaccaggactattgcgaggtctgccagcagggtggagaaattatcctgtgcgacacctgtccacgtgcgtatcacatggtatgccttgatcccgacatggaaaaggcaccggagggaaagtggtcatgtccgcattgcgaaaaggagggtatacaatgggaggcgaaagaggacaatagtgagggagaggaaattctagaggaagttggcggcgatctggaggaggaagacgaccaccacatggagttttgtcgcgtgtgtaaggacggcggtgagctcctatgctgcgatacgtgcccatcgagttatcacatacactgcctgaaccccccattgcctgagataccaaacggggaatggttatgcccacggtgcacgtgccccgctctgaaaggcaaagttcagaagatcctgatttggaaatggggccagcccccctcaccgacgcctgtgcccaggccaccagatgcagacccaaatactccaagtcccaaaccactggaaggaaggcctgaacgacagtttttcgtcaagtggcaggggatgtcgtactggcactgcagctgggtgtccgaactccagctggaactgcactgccaggtgatgttcagaaattaccagcgcaaaaacgacatggatgagcccccaagcggagacttcgggggagacgaggaaaagagccggaagcggaagaataaagatccaaagttcgccgagatggaggaacgcttttatagatacggaatcaaacccgaatggatgatgattcatcggatcctaaaccattccgttgacaagaagggccacgtccactatctgattaaatggagggatctgccttacgaccaggcatcttgggaatccgaggatgtggagattcaggactatgatctcttcaaacagtcttactggaatcatagagaacttatgcgtggagaagaggggcgacctggcaaaaagctgaaaaaggtgaagctccgaaagctcgagagaccccctgaaaccccaaccgtcgaccctaccgtgaagtacgagcggcagcccgaatacctggatgctacgggcggcaccttgcatccctaccaaatggagggtttgaactggctgcggttttcatgggctcaaggtaccgacacgatcttggccgatgagatgggcctgggtaagactgtccagaccgcggttttcctgtatagcttatacaaggaaggacattctaaaggcccattcctagtaagcgcccctctgtctacgattatcaattgggaaagggagtttgaaatgtgggcacccgatatgtatgtggtcacttatgtaggagacaaagattcccgagccattataagagaaaacgagtttagctttgaggacaatgccattcgcgggggcaagaaggcgagtcgcatgaagaaagaggcttccgtcaagtttcacgttttgctaacctcatatgagctgattaccatcgacatggcaatcctgggatctattgattgggcgtgtctgatcgtggatgaagcgcacaggctgaagaacaaccaaagcaaattcttccgcgtgctaaatgggtacagtttgcagcataagttactactgaccggaactcctttgcagaacaaccttgaggagctgtttcatttactgaattttctgactcccgaacgcttccataacctcgaagggttcctagaggagttcgcagatatcgccaaggaggaccaaatcaaaaagctccatgacatgctaggaccccacatgctgagacgactcaaagcagacgtatttaagaacatgcctagtaaaactgagcttatcgtcagggtcgaactgagtccaatgcagaagaagtactacaagtacattctaacgcgaaactttgaggctctgaacgctcgcgggggcggaaatcaggtatcgcttttgaacgtggtgatggacctcaaaaaatgctgtaaccatccctacctatttcctgttgctgctatggaagcgcctaagatgccaaatggcatgtatgatggttccgcactgattcgcgctagcggcaagctgctgctcctgcagaagatgctaaagaatctgaaggaaggtggtcatagggtgctcattttttcacagatgaccaaaatgctggaccttttggaggacttcttggaacacgagggctataaatatgagaggatcgacggagggatcaccggaaatatgaggcaggaggccatagataggttcaatgctccgggggctcagcagttttgttttttattgtcaactcgtgctggggggctgggcattaacctggccactgcggacactgtaattatatatgacagtgattggaatccacacaacgatattcaagcattctccagggctcacaggattggccaaaataagaaggtcatgatctacagattcgtgacacgtgcttcagtggaggagagaattactcaagtcgctaagaaaaaaatgatgctgactcatttggtcgtgaggcctggtcttggatctaagaccggctccatgtctaagcaagaactggacgatatcctgaagttcggcaccgaggaactgtttaaggacgaagcaactgacggtgggggggacaataaggagggggaagactcatccgttatacactatgatgacaaagctattgagagattgctggatcggaatcaagatgagaccgaagatactgagctccagggaatgaacgagtatctctcgtcattcaaggtagcgcagtatgtggtccgggaggaggaaatgggggaggaagaggaggtcgagagagaaattatcaagcaggaagagtcagtggatccagactactgggaaaagctactgcgacaccactacgagcagcagcaggaggatcttgcacgaaacctgggtaaaggcaaaaggatacgcaaacaggtaaactacaacgatggctcgcaagaagatcgaggagtgtgtggccggccacgtcctcctcctatgggcagatcaactcgcgccgtcgggccagcgcatttaccttctctgcctccagattggcaggacgaccaatccgacaatcagagcgactactctgtcgcatctgaagaaggcgacgaggactttgacgagcgttccgaggcaccccggcgcccttcccgaaaaggactacggaacgataaggataaacccctgcccccactgctggcacgcgtgggaggcaatattgaagtattgggattcaacgcacggcagcgaaaagccttcctgaatgctattatgcggtatggaatgccgcctcaagatgcttttactacacagtggcttgtgcgggatttgcggggaaaaagtgagaaagagtttaaagcttacgtgagtctctttatgagacatctgtgcgagcccggagcggacggagctgagaccttcgccgacggcgtgccacgggagggactttcccgccaacatgtcctcactcgaattggcgtaatgagtctaattcgaaagaaggtccaggaatttgagcacgtgaacggcaggtggtccatgccggaactggctgaagtagaagagaacaagaagatgtcccagccggggtccccctccccaaagactccaacgccctcaactcctggagatacacagcccaacacccccgccccagtccctcctgcagaagacgggataaagatcgaggagaatagcctgaaagaggaggagtctatcgaaggcgagaaagaagtgaagtcaacagctcccgagaccgcaattgaatgtacacaagctcccgccccagcctctgaggatgagaaagttgtggtggagcctcccgaaggcgaggagaaagtcgagaaagccgaagtgaaagagaggacagaggaaccaatggagaccgagcccaaaggcgcagctgatgtggagaaggtagaagagaagagcgcaatagatcttacccccatagtcgtcgaggacaaagaggaaaaaaaggaagaggaggaaaaaaaggaggtgatgttgcagaatggcgaaactccaaaggatctgaacgacgaaaaacaaaaaaaaaacataaagcagcggttcatgtttaatattgcagatgggggcttcacagagctccatagtctatggcaaaacgaggagagagcagctaccgtcactaagaaaacctacgagatttggcaccgacgccatgactattggttactcgccggtatcattaatcacggctacgccagatggcaagatatccagaatgatcctcggtatgcgatcctaaacgagccttttaaaggtgagatgaatcgcgggaacttcctagaaattaagaacaagttcctggcccggcggtttaaattacttgaacaggctcttgttatcgaggaacaattaagaagggctgcctacctgaacatgtcggaggacccgagccaccctagcatggcactgaacactcgcttcgcagaggttgaatgcctagctgagtcccatcagcatttgagcaaggaatctatggccggaaataaacccgctaatgctgtgctgcacaaagtcctcaagcagctggaggagttgctgtccgatatgaaggcagacgtcactaggttgccagctaccattgctagaatccccccagttgcggtgagactgcagatgtctgaacgcaatattctctccaggctggccaaccgggcccccgagcccaccccacagcaggttgcgcagcagcagtag

SEQ ID NO: 23571 - DNA, 1065 bp, Artificial Sequence
  Description of Artificial Sequence: Synthetic coding sequence
atggccagcggcctgggcagccccagcccctgcagcgccggcagcgaggaggaggatatggacgcgctgctgaataattctctgcctcccccacatcctgagaacgaggaggaccctgaggaggatttatctgaaacggagactcccaagctcaaaaagaagaagaagccaaaaaagccgcgtgatcccaaaatccccaagtcaaagcggcaaaaaaaggagcggatgttgttgtgtcggcagctgggggacagctctggagagggccccgagtttgttgaagaagaggaggaggtggctctccgctccgatagtgagggatcagactatacacctggaaagaaaaagaagaaaaaactaggcccaaaaaaagagaaaaagtcgaagagtaagcgcaaggaggaggaggaagaagaagacgacgatgacgattctaaggagccaaagagctccgcccaactgctggaggactggggtatggaagacatcgaccatgtgttttcagaagaggattaccggacacttacaaattacaaggccttctctcaatttgtaaggcctctgattgccgcgaagaacccaaagattgccgtttccaagatgatgatggtgctgggcgctaagtggagagaattttctactaataatccattcaagggcagtagtggcgccagcgtggcagccgccgcagctgcagcggttgctgtggttgagtctatggtgactgccacggaggtggctccacccccacctccagtggaagtacccatcaggaaagcaaaaaccaaggagggaaaaggccccaatgcccgaaggaaacctaagggctcccctcgcgtccccgacgccaaaaagccgaaaccgaaaaaggtggctcccttaaaaatcaagctgggaggcttcggctccaagcgaaagcggtcaagctcggaagatgacgacctggacgtcgagtctgattttgatgatgcctcaataaatagctattctgtgtccgatggatcaacttctagatcctctcgaagtcgtaagaaactgcgcacaaccaagaagaaaaagaagtag

SEQ ID NO: 23572 - DNA, 1065 bp, Artificial Sequence
  Description of Artificial Sequence: Synthetic coding sequence
atggccagcggcctgggcagccccagcccctgcagcgccggcagcgaggaggaagatatggacgccctgctaaataattcactgcctcctccccatccagaaaacgaagaggaccccgaggaagatttgtcagagacagagacccccaaattaaagaaaaagaaaaaacccaaaaagcctcgagacccgaaaattcccaagtctaaacgccaaaaaaaagaacgcatgctgctttgcaggcagctgggcgacagcagcggggagggccccgaattcgtcgaggaggaagaagaagtcgccctcaggagtgattcagaggggtctgattacactccagggaaaaaaaaaaagaagaagctgggacctaaaaaggagaaaaagtccaagtccaaacggaaggaagaggaggaggaagaggatgatgatgacgacagtaaagagccaaagagttccgctcagctgctggaagactgggggatggaagacattgaccacgtgttctcagaggaggattatagaaccttaaccaattataaagctttcagccagtttgttcgaccgttgattgctgccaagaaccctaagattgcagtctccaaaatgatgatggttctgggcgccaagtggcgggagttttctaccaataaccctttcaagggcagctccggagcctccgtcgccgcagccgccgctgccgcagttgctgtggtcgagagtatggtgaccgctacagaagtggccccacccccccctccagtggaggtgcccataaggaaggccaagacgaaggagggtaaaggccctaacgcccgccggaaacccaaaggcagcccgcgggtgccagacgccaagaagccaaagccgaaaaaggtcgcaccacttaaaatcaagctgggcggcttcggcagcaagaggaagagatcttcgtctgaggatgacgacctggacgttgagtctgacttcgacgatgccagcattaattcttatagtgtgtccgacggctcaacatctcggtcttccaggtctcgcaaaaaactcaggacaactaagaaaaagaaaaagtag

SEQ ID NO: 23573 - DNA, 2562 bp, Artificial Sequence
  Description of Artificial Sequence: Synthetic coding sequence
atgttcctgccccacatgaaccacctgaccctggagcagaccttcttctcccaagtgcttcctaaaaccgtcaaactgtttgacgatatgatgtacgagctgacaagccaggctagagggctgtcttcccagaacctggagattcagaccacccttaggaacatactgcagacgatggtgcagcttctgggcgctttgacaggatgtgtccagcatatttgtgcgacacaggagagcatcatcttagaaaacatccagagtcttccttccagtgtcctgcatatcattaagtcaacttttgtccactgcaaaaacagtgaatctgtctatagcgggtgccttcacttggtgagcgacttgctgcaggcgctgttcaaagaggcctactccttacagaagcagctgatggagctgttagatatggtgtgtatggaccctctggttgacgacaacgatgatatcctcaatatggtgatcgttattcattctttgttagacatctgcagtgtgataagttccatggatcacgccttccacgccaacacgtggaaattcataatcaaacagtcacttaaacaccagtccatcataaagagtcaactcaagcataaggacatcatcacctcactctgtgaggacatcctgtttagctttcacagttgcctacagctggctgaacagatgacccaatcagacgcacaagacaacgccgattacagactctttcaaaaaacactgaagctctgtcggttttttgctaacagccttctgcattacgccaaagagttcctgccatttctgagcgactcctgctgcaccctgcatcagctttatcttcagatacactcaaagttccctccctccctctatgcaacacgcattagcaaggcccaccaagaagaaatcgccggtgcttttttggtcacacttgacccactgatctcccagttactaactttccaaccttttatgcaggtggtgctggacagcaaactggaccttccctgtgagctacagttcccacagtgtcttctgctcgtcgttgttatggataagctgccctcccagcctaaggaggtccagacgctatggtgtacggacagtcaggtctccgagactaccacccgaatttcgctactcaaagccgtgttttactctttcgagcagtgtagcggggagctgagcctaccagtacacctacaagggttgaagagcaaaggcaaggctgaagtggccgtgaccctctatcaacacgtgtgtgtacatctatgtacttttattacgtctttccacccttccctgtttgccgaactggacgccgcactgctgaacgccgtgttgtccgccaacatgataaccagtcttttagctatggacgcctggtgcttcctggctagatatgggaccgccgagctctgtgcccatcacgtgactatcgtagcacatctcattaaaagctgtcctggggagtgttatcaacttataaatctgtcaatcctgcttaagagactgttctttttcatggctccgcctcaccaactggagttcattcagaaatttagtccgaaggaagccgagaacctgcctctctggcagcacatctctttccaggccctcccgcctgagttacgcgagcagactgtgcatgaggtgaccacggtgggcaccgccgaatgccgcaagtggctgtctcgaagccggacactgggcgaactggaatcgctcaataccgtgcttagcgccttgctggccgtttgtaactccgcaggggaggcgttggacaccggcaagcagacagctattattgaggtggtgagtcagctgtgggcattcctgaacatcaaacaggttgccgaccagccatatgtgcaacaaacgttcagtttgctattgccccttctggggttttttattcagacgctcgatcccaagctcatcctacaggccgtgaccctgcagaccagtctgctcaagctggagctgcctgactatgtcaggctggccatgcttgacttcgtctctagtctgggcaaactttttatacccgaagccatccaggaccgtatactgcctaatctgagctgcatgttcgcactgctcttagctgatagatcctggctcctggaacagcacactcttgaggcatttacccagtttgcggagggcactaaccacgaagagatcgtccctcagtgcctatccagtgaggagaccaagaataaagtcgtctctttcctggaaaagacggggttcgtggatgaaaccgaggctgctaaagtcgaaagagttaaacaagaaaagggtatcttttgggaaccattcgcaaatgtcaccgttgaggaagccaaacgtagctctctgcagccctacgccaagcgcgctcgccaggagtttccatgggaagaggagtacaggtctgctctgcacaccatcgcaggcgcactcgaggccacagagagcctgttgcaaaaaggcccagccccagcctggctgagtatggaaatggaggcactccaggaacgcatggataagctgaaaagatacatccataccttaggctag

SEQ ID NO: 23574 - DNA, 2562 bp, Artificial Sequence
  Description of Artificial Sequence: Synthetic coding sequence
atgttcctgccccacatgaaccacctgaccctggagcagaccttcttttcacaggtcctccctaaaactgtgaagctgtttgacgatatgatgtacgaacttacctcgcaggcccgggggttgtccagtcagaatctggagattcagacaacactcagaaatatattacagactatggtgcagctgctgggcgcacttacaggctgtgtccaacacatctgtgccacccaggaatccattatcctggaaaatatacagtcattgccatcatcagtactgcatatcatcaaatcaactttcgtgcactgcaagaattccgaaagcgtgtatagtgggtgtctccatctggtgtctgacctgctgcaagctttgtttaaagaggcgtactcactacaaaagcaacttatggagctcctggatatggtttgcatggacccgttggtcgatgacaatgatgatatcctgaatatggtgatagtgattcatagcttgcttgacatttgttccgtgatttcatctatggatcatgcctttcatgccaacacgtggaaatttattatcaagcagtcgttaaagcatcagagcatcatcaagtctcaactcaagcacaaggacatcataacttccctctgtgaggatattttattttcattccatagctgtttgcaactggccgaacagatgacgcagtccgacgcgcaggataatgctgattaccgcctcttccaaaagactctgaagctgtgtagattttttgctaattccctcttacattacgccaaggagtttctgccattcctgtcggacagctgctgtacactgcaccagttgtacctgcagatccatagcaaatttcccccgagcctttatgccacccgaatttctaaagcacaccaggaagaaatagctggcgctttcctcgtaacactggaccccctgatcagccaacttctgactttccaaccattcatgcaagtggtgctagattcaaagttagacctgccttgtgagttgcagtttcctcagtgcctactcctggtggtcgtcatggataagctgccttctcagccgaaggaagtgcagactctgtggtgcacagactctcaggtttccgaaaccacaacacggatcagtctgctaaaagctgttttttactcattcgagcagtgtagcggcgaattgtccctgcccgtgcatctccagggccttaagagcaaggggaaagcagaagttgcagtcacgctctatcaacacgtgtgcgtccacctctgtaccttcatcacatccttccacccctccctgttcgcagaactggatgccgccttactgaacgccgtattatctgccaacatgataaccagtctcctggccatggatgcttggtgttttctagcccgatacggtacggctgagttgtgcgctcaccatgtgaccatcgtcgctcaccttattaagtcatgtcctggggagtgctatcagttgatcaatttatctattcttctaaagagacttttctttttcatggctcctcctcatcagctggagtttatccagaaattcagccccaaggaggcagaaaatcttcctctctggcagcatataagcttccaagcactgcctcccgagcttagggagcagacagtgcacgaggttaccacagtggggaccgccgaatgtaggaaatggttgtcacgaagtcggaccttaggtgaactcgagagtttgaacacagtgcttagcgctctgctggcggtgtgcaacagcgccggtgaagccctggataccggtaagcagaccgccatcattgaagttgtcagtcaactgtgggcatttctgaatataaagcaagttgctgaccaaccctacgtgcagcaaaccttcagcttactgttgccacttctgggatttttcatacaaactcttgaccccaaactgatactgcaggcggtcacgctccaaacatccctgctcaagctcgaactgcctgattatgtgcggctcgccatgttggactttgtcagttcccttggaaagcttttcatcccggaagccatccaggaccgaattctgccgaacctgtcctgcatgtttgccctactgctggctgatagatcttggctgcttgagcagcatactctggaggcattcactcagttcgccgagggcaccaaccatgaagaaattgtgcctcagtgcctgtcttcagaggagaccaaaaacaaagttgtttctttcctggagaagactgggttcgtggatgagaccgaggctgctaaagtggagagggtcaagcaggaaaaggggattttttgggagcctttcgccaacgtgacggttgaggaagctaagcgctcctctctccagccttacgcaaaacgggcgagacaggagttcccatgggaagaggagtatcgtagtgctctgcacacgattgcaggagccttagaagccaccgaaagtttactccagaaggggcctgctcctgcgtggctctctatggagatggaagccctgcaggagcgtatggataaattgaagcgctatattcatacactgggctag

SEQ ID NO: 23575 - DNA, 993 bp, Artificial Sequence
  Description of Artificial Sequence: Synthetic coding sequence
atgatgtacgagctgaccagccaggcccggggcctgagcagccagaaccttgagattcagactactctccgtaatatcctgcagactatggtgcaactgcttggcgctctgacgggctgcgtgcaacatatttgcgcaactcaggagagcattattctagaaaatatccagtccctgcccagtagtgttctacatattattaaaagcacctttgtgcattgtaagaattcggaatctgtttactccggctgcctccacctggtttccgacctcctgcaggccctatttaaagaagcttactcgctccaaaaacaacttatggaattgctggacatggtgtgcatggatccactggtggacgacaatgatgatatcctcaatatggtcattgtgattcacagtctgctcgacatatgttccgtaatctcttcaatggatcacgcgtttcatgccaacacctggaagttcattattaagcaaagcctgaagcaccagagtatcattaaaagtcaattaaagcacaaagacattatcactagcttatgcgaggacattcttttttcctttcatagctgcttacaactagcagagcaaatgacacaatctgacgcgcaggacaatgccgattaccggctgtttcagaaaactctgaaactgtgtaggtttttcgccaattcactcctccactacgctaaggagttcctgccatttttgagtgactcctgctgtactctgcaccagctttatcttcagatccactcgaaatttccccctagtctgtacgcaacccgcatcagcaaagctcaccaagaagagatcgctggtgccttcctggttacactggatccattaatcagccagctgctaacgtttcaacctttcatgcaagtcgtcctcgattccaagctgggatatctgtatagtaaaccgttttccacagtactctcttccgtgttggtgaattctctgtaccttttcatttatagggattag

SEQ ID NO: 23576 - DNA, 1047 bp, Artificial Sequence
  Description of Artificial Sequence: Synthetic coding sequence
atgagccaggagggcgccgtgcccgccagcgccgtgcccctggaggaactgtcctcctggcccgaagagctgtgtaggagagaacttcccagcgtcttacccagactgttgagtctgagccagcacagcgatagctggatcgagcacatacagatattaaagataatagtggaaatgttcctcccacacatgaatcatctgaccctcgagcagacgttcttttcacaggtgctgcctaaaactgttaagctgttcgatgatatgatgtacgagctgacaagtcaggcaagaggccttagcagtcagaacctggagattcagacaacgctacgcaatatcctgcaaacaatggtccaacttctcggcgccctgaccggctgcgtgcagcatatctgtgctacccaggagagtatcatcttagaaaacatccagagtctgcctagctctgttctgcatattatcaagtcaactttcgtgcactgcaaaaattcagagtcagtctattccgggtgtctacacctggtctctgatcttctgcaggcactcttcaaagaagcctatagcctccagaagcaactgatggaactcctggacatggtatgcatggaccctttggtcgacgataatgatgatattctgaatatggttatcgttatacactctctgctggacatctgttctgtgatctcatccatggatcacgcctttcatgccaatacatggaaatttattattaaacagagtctcaaacaccagtccatcatcaagagtcaattaaaacacaaggacattatcacttccctgtgcgaggatatcctgttttcctttcactcttgcctacaactggccgagcagatgacacagagtgacgcccaggataacgctgactatcgacttttccagaagaccctcaagctctgtcgctttttcgcaaatagtctcttgcattatgccaaggagttcctgccgtttctcagtgattcatgttgcaccctccatcagctgtacctgcaaatccatcgatggtcctttgctctagctgtgtag

SEQ ID NO: 23577 - DNA, 2100 bp, Artificial Sequence
  Description of Artificial Sequence: Synthetic coding sequence
atgctgaagctgagcggcgagggcctgcgggacagctaccacagccgccgggaccagattgcactgaagaacttgcagtccgacgtgaccgaggcgaagtcagacttcactaaagaaaccctcgcctctcagaacacaaaaatgattagctctatcgtcatttcacaaatgatagacgagaataagtcgcgggaaaatcgcgcttcacttcccctcccttgtgctatcgctcagtctcgggcccatcacgccaaacagtcactggctaacagatcgggagtgaatattcacagggcattcgccctactgcccgggcggctcggaatacccgccccgtcagacgagcgtggtcctgaagccgagctgccaccaaaggaagagcggccctgtggaggtccaagacgaggtttcgcctccattactatcacggctcgacgcgttggaccaccggcacgggccctggtatggggtactgctggagactcactctgccctaaatgtcgggccgaggacactctgtttcaggccccgcctgcactggctaacggagcacatcccggtcggcatcagcgttcatttgcctgtactgaattttccagaaattcatcagtcgtgagactcaaagtcccagaagcccacaccgggctctgtgagaggcgcaaatactgggtaactcatgctgacgacaaggaaaccagcttttcccccgataccccgctgagcgggaaatctcccttggtcttctcatcttgtgtgcatcttagagtatcacagcagtgtcctgatagtatctactacgtagacaaatccctgagcgtccctatagaaccccctcagatcgcatcccccaagatgcatcgtagtgtcctgagcctcaaccttaactgctccagccaccgacttactgccgacggggtggatggattagtgaatcgggagcctatttcggaggccttaaaacaggagctgcttgagggtgatcaggatctcgtggggcagcggtggaatcctggtttgcaggagtcccatctgaaagagactccatccctgcggcgggtgcacctgggaaccggcgcctgtccgtggtcaggcagctttccgcttgagaacactgaactggccaacgtgggcgccaaccaggtgaccgtgcgaaaaggagagaaagaccataccacccactgccatgcttccgaccacgcaaatcagctctcaattcacatccccggctggtcataccgggccgtgcacactaaagtgttttctggatcttcaaagcgccaacagggcgaggtgtgcatgactgtcagtgctccccccgtagagcaaaagcctacgcgtcactttctgccaataggcgatagctctcccagcgacgattgtctgtccagggatctctcggagccgaccgagagaagacaccagtcttttctaaaacccaggattctttttccaggcttcctgtgccctcttcaagacgtctgtgcctcattacaagaggacaatggcgttcagattgagtctaagttccctaagggagactacacatgctgtgatttggttgtcaagattaaggagtgtaaaaaatccgaggaccccactacaccagagccttcgcccgcagctccctcccccgcccctcgcgatggcgccggctccccgggcctgtccgaggactgttctgagagtcagcagactccggcaagatcgcttaccctgcaagaggccctcgaggtgagaaagccccagttcatttccagatcccaggaaaggttgaagaaactagagcacatggttcagcagcgtaaagcccaacgaaaagaagacttacggcagaagcaaagtctcttgccaataaggacaagtaagaagcagtttaccattccccatcccctcagcgataatttgtttaaaccaaaggaacgatgcatatctgagaaggaaatgcacatgcggagcaagcgcatctatgataatttacccgaggtgaaaaagaagaaggaggaacagaggaagcgagtaatacttcagtctaatagactgcgtgcagaggtgtttaaaaagcagctgcttgaccagctgctccagagaaatgctgtgtag

SEQ ID NO: 23578 - DNA, 1959 bp, Artificial Sequence
  Description of Artificial Sequence: Synthetic coding sequence
atgatcagcagcatcgtgatcagccagatgatcgacgagaacaagtcccgcgagaatcgggcgtccctgccactcccctgcgccatcgcccaaagcagggcccatcacgccaagcagagcctggccaatcggtcgggggtgaacattcatagggccttcgccctgctgcctggtcgactgggcatcccggctcccagcgatgagcgcgggcccgaagccgaactgccccctaaggaagagagaccgtgtggcgggccgaggagaggatttgcttcgataaccataaccgcaaggagagtgggccccccggccagggcgctagtttggggcactgccggagattctctatgcccaaagtgtcgagccgaggataccctgtttcaggctccacctgccttagccaatggtgcccaccctggcagacatcagcgctctttcgcctgcaccgagttctcccggaattcttccgtcgtccgcctcaaagtgcctgaggcccacaccggcctgtgcgagcgtcgaaagtattgggtgacacatgcggatgacaaggagacgtcattcagtcctgatacgcccctaagcgggaagtctcccctcgtcttttcgtcttgtgtccatcttcgagtcagtcagcagtgccctgactccatctattacgtggataagtcccttagcgtgcccattgagcctccccagatagcatctcccaaaatgcaccgcagcgtgctgagccttaatctgaactgtagctcacatcgcctgaccgccgacggcgtggatggactcgtcaatcgggagcctataagcgaggccctgaaacaggaactgctcgagggagaccaggacctggtcgggcagagatggaaccctgggctgcaggaaagccacttgaaagagaccccaagcctaagacgggtacatctggggacaggcgcatgcccatggagcgggtcattccctctcgagaatacagaattagcaaatgtgggtgccaaccaggtcaccgttcggaagggcgagaaggaccacacaacacactgccacgccagtgatcacgccaatcaactttctatccacattccaggctggtcgtatcgcgccgtgcataccaaggtgttttctgggtcctccaagcgccagcagggggaggtgtgcatgaccgtctcagcaccgcccgtcgagcagaaacccacaaggcactttcttcctatcggggattcttctccgtccgatgattgcctgtccagagatctatctgagcccaccgaaagaagacaccaaagcttcttgaagccaaggattctattccccggattcctgtgcccactacaggatgtttgcgcatctttgcaggaagacaacggagtacagatcgaaagtaaattccctaagggcgactatacatgctgcgacttagttgtcaaaatcaaggagtgcaaaaagtccgaggatccaactacgccagaaccaagccccgccgctccttcccccgccccgcgggacggagcgggcagtccggggctttctgaggattgctccgagtctcagcagacaccggctcgctcgttaactctgcaggaagccctggaggttcggaagccacagtttatctctaggtcccaggaaaggctcaaaaaactcgaacacatggtgcagcaaaggaaagctcagagaaaggaagatctgaggcaaaaacagtccctacttccgattcgcacctccaagaaacagttcacgatcccgcaccccctatcggacaacctctttaagccaaaggagcggtgtattagtgaaaaggaaatgcacatgaggtctaagcgtatctacgacaatttgccagaggtcaagaaaaaaaaagaagagcaaagaaagagggtaattttacagagcaacaggttgagggccgaagtgtttaaaaagcagttgctggaccaactgcttcagagaaatgccgtctag

SEQ ID NO: 23579 - DNA, 1152 bp, Artificial Sequence
  Description of Artificial Sequence: Synthetic coding sequence
atgatcagcagcatcgtgatcagccagatgatcgacgagaacaagtccagggaaaatcgcgctagcctgcccctcccctgcgcaattgcccagagccgcgcccatcacgccaaacagtccctagcaaacagatctggggttaatatccaccgcgcatttgccctgctgcctggccgattgggcatacccgccccttccgacgaaagaggcccagaggccgaactcccccctaaagaggagagaccctgcggcggtcctcgacggggatttgcatctataactatcactgcccgaagagtcggcccccccgccagagcactcgtttgggggaccgcgggcgacagtctgtgtcctaagtgtcgagcagaagacactctatttcaagctcccccagcactggccaacggggcccaccccgggcgccatcagaggagctttgcctgcactgagttcagccggaattccagcgtagtgcgtcttaaagtacctgaggcccacacgggcctttgcgagcgacggaagtattgggtgacacacgccgatgataaggaaacctcattctcaccagacacccccctgtccggcaaaagcccactggtcttcagctcatgcgttcacttgagagtatcccaacagtgtccagatagcatctactatgtagacaaatctctgtcagtgcccatcgagcccccgcaaatcgccagtccaaaaatgcaccggagcgtcctctcactgaacctcaactgcagctctcataggttgacagccgatggcgtcgatggtctcgttaaccgcgagccgatctccgaagctctcaagcaggagctgttagagggggatcaagatctggtgggacagcgttggaaccctggcctgcaagagtcccatttaaaagagaccccgagcctgagaagagtgcatctggggacaggggcctgtccttggagcggttccttcccgctggagaatacagagctagccaatgtcggcgcaaaccaagttacagtccgaaaaggagaaaaggatcacacgacccattgtcacgcctccgaccacgcaaatcaactgtcgatccacatcccgggatggtcttatcgagccgatctgctgcaggaaggtcagcacaaacagctgtcaatgttccaaagatag

SEQ ID NO: 23580 - DNA, 1152 bp, Artificial Sequence
  Description of Artificial Sequence: Synthetic coding sequence
atgatcagcagcatcgtgatcagccagatgatcgacgagaacaagagcagagagaacagagccagcttgccgcttccgtgcgccatcgctcagagccgggcccaccatgctaaacagtctcttgcgaacaggtcgggcgtgaatatccatcgggcttttgctctgttgcccggaaggttgggcatcccagcaccttctgacgaacgagggccagaggcagaacttcctccaaaggaggaaaggccatgcgggggaccgagacgcgggtttgcttctatcactatcacagctaggcgggtgggacctcccgctcgggctttggtttggggaacagcaggagacagtctctgtcctaaatgccgtgccgaggatacactcttccaagcccctcccgcgctagcaaacggagcccaccccggccggcatcagaggagcttcgcatgcaccgaattctcaagaaacagcagtgtggtccggctcaaagtccccgaagcccatacaggcctttgcgaacgaagaaaatattgggtcactcacgcggacgacaaggagacctctttcagccccgatacaccacttagcggaaaaagccccctggtgttttcaagctgcgtgcacttgagagtttcccaacagtgtcctgactctatctactacgtcgacaaatcactcagcgttcctattgagccaccgcagattgccagcccaaaaatgcacaggtcagtgctgtcgctcaatcttaactgttcctctcacaggttaacggctgatggagtggatggcctggtgaacagggagcccatttctgaggccctaaagcaggaactcttggagggcgaccaggatctggtcgggcaaagatggaaccccggtctccaggaaagccaccttaaagagactcctagcttgcgccgggtgcacttggggaccggcgcttgtccgtggtcaggttccttccctctggaaaatactgagctcgctaacgtaggagccaatcaagtaaccgtgcggaagggcgagaaggaccacactactcactgccatgcaagcgatcacgctaaccagctgagtatccatatccccggctggtcttacagagccgatctgctgcaggaaggccagcataaacagttaagcatgttccagaggtag

SEQ ID NO: 23581 - DNA, 729 bp, Artificial Sequence
  Description of Artificial Sequence: Synthetic coding sequence
tgatggagcggcagcttccccctggagaacaccgagctggccaacgtgggcgcaaatcaggtgacagtacgaaagggcgagaaagatcataccactcattgtcacgcgtcagaccacgcgaaccaacttagcattcatatacccggatggtcctacagagccggcgattatacgtgctgtgatcttgtggttaagattaaggaatgcaagaagagcgaggacccaaccacacccgaacctagcccggcagctccctctccggctccacgtgacggggcggggtcccctggccttagtgaggactgcagcgagtcccagcaaacacctgcaagatcactgacactgcaagaggctctggaggtgcgcaaaccccagttcatttctcggagccaggaaagactgaaaaaattggagcacatggtacagcaaagaaaggctcaacggaaggaagatctgcgccagaagcagtctttgctacccattcgaacgagcaaaaaacagtttaccataccccatccactgagtgacaatctgttcaaaccaaaagagcgctgcattagtgaaaaggaaatgcacatgaggtccaagcgtatttacgataatttgccagaagtcaaaaaaaagaaagaggagcaacgaaaaagggttattctgcagagtaacagactccgagccgaggtgtttaagaaacaactgctagatcagttgttgcagcgaaatgctgtgtag

SEQ ID NO: 23582 - DNA, 1989 bp, Artificial Sequence
  Description of Artificial Sequence: Synthetic coding sequence
atgctgaagctgagcggcgagggcctgcgggacagctaccacagccggcgtgatcagattgccctgaagaaccttcagtctgatgtgactgaggcgaaatccgactttaccaaggagacgttggccagccaaaataccaaaatgataagctcaatcgttatctctcagatgattgacgaaaataagtctcgagagaatcgcgctagcctcccattgccatgtgccatcgctcaatctcgggctcaccatgccaagcaatccctcgccaatagatccggagttaacatccaccgggcctttgctctcctgccaggcagacttggaattcccgccccgtccgacgagaggggcccagaggcagaactgcccccaaaagaagaacggccttgtggagggccccgacgcggctttgccagcattaccattactgctcgacgagtcgggccacctgctcgggcgttagtgtgggggactgccggggattctctgtgtccaaaatgtagggccgaggacacgttgtttcaggctcccccagccctggccaacggtgctcatcctggccgccaccaacgctccttcgcctgtactgagttttccaggaacagctctgttgttcgtctcaaagtgccagaggcccatacgggtctatgcgagcgcagaaaatactgggtgacccatgccgacgataaggagacgagtttctctccagatacgcctctctctggaaagtctcctctcgtgttttcatcctgtgtacatcttagggtgagtcaacagtgcccagattctatttactacgtcgataaaagcctgtcagtccctatcgagcctcctcagatcgccagccctaagatgcacagaagtgtgctctctttgaacttaaactgttcatctcacagactgaccgccgatggagtcgacggcttggtgaatcgcgagccgatatccgaggctcttaagcaggagctgctggaaggagaccaggatctggtaggccagcggtggaacccaggactgcaggaaagccatctgaaggaaacaccatcacttcgccgagttcatctaggtacaggagcctgcccctggagcgggagcttccctctggagaataccgagctggccaacgtgggagccaaccaagtgacagttcgaaagggggagaaggaccatactacacactgtcacgcctcagatcatgcgaaccagttatctatacatatcccgggatggagctatcgggcagtgcacactaaagttttcagcgggagctccaagcgccagcagggagaagtttgtatgaccgtgtcagcaccacctgtcgagcagaaaccaacccgacactttttacccatcggggattcatccccaagtgatgattgtctctcaagggacttgagcgagcctaccgaacgaaggcatcagagttttcttaagccacgcatcttgtttcccgggttcttatgtcccctgcaggatgtttgtgcctctctacaggaggataacggagtccagattgagtcgaaattcccgaaaggagactacacctgctgtgacctggtcgtgaaaattaaggaatgtaagaagagcgaagaccctactactcccgagccctctcctgctgccccaagccctgctccacgcgatggcgcaggttctcccggtctatcagaagattgcagcgagtcccaacaaacccccgccagaagtctaacgttgcaagaggccttggaagtgagaaagccacaatttatctcgcgaagccaggagcggttgaagaagcttgagcacatggtgcagcagcggaaagcacaacgtaaggaagacctgaggcagaagcagagtcttctgccaatcaggacaagcaagaaacagtttacaataccgcaccctctaagcgacaatctctttaaacccaaagagcgatgcatatctgagaaggagatgcacatgcgctctaaacgtatctatgataacctccctgaggtgtag

SEQ ID NO: 23583 - DNA, 1809 bp, Artificial Sequence
  Description of Artificial Sequence: Synthetic coding sequence
atgctgaagctgagcggcgagggcctgcgggacagctaccacagccggcgcgaccagatcgctctaaagaacctgcagtccgatgtgacagaggccaagagtgatttcacgaaggagacactggcaagccagaatacgaaaatgatttccagcatcgtgatttcccagatgatcgacgagaataaaagtcgggagaatagagcttcactgcccctgccttgtgcaattgcgcagtccagagctcaccatgccaagcagtccctggccaaccgttccggcgtgaatattcaccgcgcctttgcactgcttccaggcagactgggaattcccgccccttcggatgagagaggcccggaagccgagcttccgccgaaagaggagcgaccctgtggaggcccacggaggggatttgcttcgatcacaataaccgccaggcgcgtcgggccacctgctcgcgccctggtgtggggaacagctggcgactcactctgtccaaaatgcagggctgaagacacattatttcaagcgcctcctgcactcgctaatggtgcgcacccaggtagacaccaacgtagcttcgcctgcaccgagttttctagaaactcttctgtggtaagattgaaggtgccagaagctcataccgggctgtgcgagagacgcaaatactgggtcacccatgcagacgacaaggagacaagtttctctcctgacacaccactctcaggcaagtcccccctggttttctcttcctgcgtacacttgcgtgtcagccagcagtgccctgactccatctactacgtcgacaaatctctctccgtgcctatagagcccccgcagattgcaagccccaagatgcatcgcagcgtactgtctctgaatctgaattgctctagccacaggttaacagccgatggagtcgacgggctcgttaatcgagaacctattagcgaggcactgaagcaggagctcctcgagggagatcaagacctcgtcggccagaggtggaatcctggactgcaggaatctcacttgaaagaaacccctagcctacgcagggttcatttgggcaccggggcctgtccatggtccggctcttttcctcttgagaacacagaactggccaatgtcggggcgaaccaggtgacagtcaggaaaggcgagaaggaccatacaacccactgccatgcttctgaccatgccaatcagttgagcatacatattcctggatggagctatagggcaggggactacacatgctgcgacctggtcgtgaagataaaggagtgtaaaaagtccgaggacccaactaccccggagccttcccccgctgcaccaagtcccgccccacgagatggggctgggtcccccgggctgtctgaagattgtagcgaatctcagcagacacccgctagatcattaacattacaggaagccctagaggtgaggaaaccccaattcatttcaagaagccaagaacgacttaagaaacttgagcacatggtacagcagaggaaggcccagcgcaaggaagacttgcggcagaagcagtcactcctgcctattaggacctcgaagaaacagttcaccattccgcaccctctctcagacaatctgtttaagcccaaagaaagatgcatatcagaaaaagagatgcatatgcggtccaaacgtatatatgacaacctgccagaagttaagaagaaaaaggaggagcaacggaaacgggtgatactccaatccaaccggctgagagccgaggtttttaaaaaacaactcctagatcagctccttcagagaaacgctgtgtag

SEQ ID NO: 23584 - DNA, 2391 bp, Artificial Sequence
  Description of Artificial Sequence: Synthetic coding sequence
atgcagcacagcggcatccccaccaagacccacccccagggctacgcagcccggtatactgagaccgcagtccaccgtacctttcagattaagaccttttccacagaactgaagaaccacgttatggtgatggatttcgtcaaatccaactggttccccagccagagaagggccaaggtgtgcatcatccatatgtgccaggggctcaagaccgctgaacagaccgccagccgctatgagatccacagccggctattttcaagtcctaaggaccacagcgcctgggaaaggaacgaaagtttaagtaacgcggggctccgcgactcctaccatagcaggcgtgaccagatcgctcttaaaaatctgcaatccgacgtgaccgaagccaaatccgacttcaccaaggagaccttagccagccaaaacactaagatgatctcaagtattgtgatatctcagatgattgacgaaaacaaatccagggagaatagggctagcttacctctcccttgtgccatcgcgcagtcccgggcccatcacgctaaacaatcattggccaacagaagcggtgtgaatatccatcgggctttcgcgttgctgcccgggaggctcgggatcccagctccttctgatgaacgcggtcccgaggcagaactgcctccgaaagaagaacggccttgcggcggaccgaggcgcggctttgcctcaataactattaccgcccgccgcgtgggcccaccagcaagggctctcgtttggggcaccgcaggcgactccctctgtccgaaatgtagggcagaagacaccctgtttcaggcgcctcctgccctggccaatggcgcccaccctggacgtcatcaaagaagctttgcctgcacggaattttcccggaacagctcagtagtgcgccttaaagtgccagaagcccatacagggttgtgtgagagacggaagtattgggtcacacatgccgacgacaaggaaacctcgttctctccagacactccgctgtcggggaaatctcccctcgtgttttctagttgcgtgcatctgcgggtttctcagcaatgccccgattctatctactacgtggataagtccctctctgtgcctattgaacctccccagattgcttccccgaagatgcaccggtcagtgctgagcctcaacctaaattgctcctcgcacagacttacggcagatggcgtcgacggcctggtgaatagggaacccatcagcgaggccctcaaacaggagttactagaaggagaccaggacctcgttggccaacgttggaatcctgggctacaggaatcgcacctcaaggaaactccatctttaaggagggtgcatctggggactggcgcttgcccatggagcggatctttcccccttgagaatactgaactggctaacgtgggcgccaaccaggtcaccgtacggaagggtgagaaggatcacaccacacattgtcacgcgtctgaccacgccaaccagctgagcatacatatccctggctggagctatcgggccgtccacacaaaagtattctctggcagctccaagagacagcagggagaagtgtgcatgactgtgtctgctcccccagtggaacaaaagccaactagacacttcctgccgattggcgattcatcacctagcgatgactgcctgtccagggatctctctgagcccaccgaaaggcgacatcagtcatttctcaaacccagaattttgttccctggatttctgtgtcctctgcaggatgtatgtgcgagcctgcaagaggataatggagtccagatcgaatcaaagttcccaaaaggagactacacatgttgcgacttggtggttaagattaaggagtgtaaaaagagcgaggatcctactacacccgaaccgagccccgctgccccgagtccggcaccccgtgacggggccggtagccccggcctgagtgaggactgttcagaatctcagcagacgcctgcacgctcgctgaccctgcaggaggctctggaagtacgcaagccacagttcattagtcggtcccaggagcgcctgaaaaaactggagcacatggtgcaacaaagaaaggctcagcgcaaggaggatctaagacagaagcagtccttactccctatacgtacctccaagaaacagtttacaatccctcacccactgtcagataacctcttcaagccaaaggaaaggtgcatttcagagaaagagatgcacatgcgctcaaagagaatttacgataatctccccgaggtcaaaaagaaaaaagaagaacagaggaagcgcgtgatactacagagcaacaggctgcgcgctgaagtattcaagaaacagctcctggaccagttactgcagcgaaatgcggtgtag

SEQ ID NO: 23585 - DNA, 786 bp, Artificial Sequence
  Description of Artificial Sequence: Synthetic coding sequence
atgagcaccaccacctgccaggtggtggccttcctgctgagcatcctcgggctcgcgggttgtatagccgctaccggcatggatatgtggtccacacaggacttatacgacaatcccgtgacctctgtgtttcaatatgaaggtttatggaggtcttgcgtgcgtcagtccagcggattcacagagtgtaggccctactttaccattctgggcctgcctgcgatgcttcaagcagtgcgtgcacttatgatcgtggggatcgttttaggggccatagggctgctggtcagcatctttgcccttaaatgtatcagaataggcagcatggaagatagcgcaaaggcaaacatgactctgaccagcgggattatgtttatcgtatcagggctgtgtgctattgcgggagtctccgtgttcgccaatatgcttgtgacaaacttctggatgtctaccgctaatatgtacaccggtatgggagggatggtgcagacagtacagactagatacacattcggcgctgccctgtttgtgggttgggtggctgggggtttaacgctcatcggcggagtgatgatgtgcatagcatgtaggggccttgcccccgaagagactaattacaaggcagtatcataccacgcctctggacacagcgtcgcttacaaaccaggtggtttcaaggcctcaacagggtttggcagcaacaccaaaaataagaagatatacgatggcggggccagaacggaggacgaggtgcagtcttaccccagtaagcacgactatgtatag

SEQ ID NO: 23586 - DNA, 786 bp, Artificial Sequence
  Description of Artificial Sequence: Synthetic coding sequence
atggccgtgaccgcctgccagggcctgggcttcgtggtgagcctgattggaatcgccggaattattgctgccacttgcatggatcagtggtccacacaagacctgtataacaatccagtgacagcagtcttcaattatcagggattgtggcgctcttgcgtgcgagaatcttccggttttactgagtgtcgtgggtacttcactctgttaggtcttcctgccatgctgcaggcagtgagggccctcatgatcgtggggatcgtcttaggtgccattgggttactggtgtccattttcgccctcaaatgtatcaggatcggaagcatggaagattccgcgaaagctaatatgacccttacaagcggcatcatgttcattgtctccggcctctgcgccattgccggcgtaagcgtcttcgccaatatgctcgtgacgaatttctggatgagcaccgcaaacatgtacacaggcatgggaggaatggttcagacagttcagacccggtacactttcggtgccgctctatttgtcggctgggttgccggagggctcaccttaatcggaggagtcatgatgtgtatcgcgtgcaggggtttggccccagaagaaacgaactataaggcagtttcatatcatgcctccggccacagcgtcgcttacaagccaggagggttcaaggcatccactggattcggttccaatactaaaaataaaaagatctacgatgggggtgctcggactgaggacgaagtacagtcctacccctccaaacacgactacgtgtag

SEQ ID NO: 23587 - DNA, 753 bp, Artificial Sequence
  Description of Artificial Sequence: Synthetic coding sequence
atgagcaccaccacctgccaggtggtggccttcctgctgagcatccttggcctggcaggctgtatcgcagctacgggcatggacatgtggagcacccaggacctttatgataaccctgtgaccagcgttttccaatacgagggcctctggcgatcctgtgtccgccaaagttcagggttcacagagtgccgcccttactttacaatcttgggcttgcccgcaatgttacaggccgtgagagcccttatgattgtcgctatattcgccctgaagtgtatcagaattggcagcatggaggatagtgccaaagccaatatgaccctcacctcagggatcatgttcatcgtgtccggcctgtgcgccattgcgggcgtgtccgtgttcgccaatatgctagtgactaacttctggatgtctactgccaacatgtacactggcatgggcgggatggttcagaccgtgcaaaccaggtatacgttcggtgccgctctgttcgtcgggtgggtggccggtggcctgaccttaataggcggagtgatgatgtgtatagcctgccgtggactggcccctgaggaaaccaattacaaggccgtgagctatcatgcgagcggccactctgtggcgtacaagccaggcggcttcaaggccagtaccgggttcggttccaatacaaaaaataagaaaatctatgatggcggcgcacgcacagaggatgaggtacagtcatacccttcgaaacatgattatgtctag

SEQ ID NO: 23588 - DNA, 3000 bp, Artificial Sequence
  Description of Artificial Sequence: Synthetic coding sequence
atgggccccgcccccctgcccctgctgctgggcctgttcctgcccgctttatggcggcgagctatcactgaggctcgggaggaggctaaaccctatcccctgtttccaggtccgtttcctggctccctccagacagatcacacaccactcttgagtttgccacatgcatctggttatcagcctgcgctcatgttctcacccactcagcccggcaggccccatacaggaaatgtggccattcctcaggtgacttcagtcgaatcaaaacccctcccccccctggctttcaaacatactgttgggcatattatactctccgagcacaagggtgtgaaattcaactgctcaatcagcgtgccaaatatctatcaggatacaacaattagttggtggaaggacggtaaggaactgctcggtgcacatcacgctatcacacagttttatcctgacgacgaggtaactgccatcatcgcatcattctccataacttcagtccagcgcagtgacaatggttcatatatctgtaagatgaagatcaacaatgaggagatcgtgtcagaccccatctatatcgaggttcaggggctgcctcatttcaccaagcagcccgagtcaatgaatgtaacgagaaatacagcctttaatctaacctgtcaggctgtggggcctccagaacctgtgaacatcttctgggtacaaaacagcagtcgggttaacgagcagccagagaaaagcccatcggtactaactgtgcccggcctcaccgagatggccgtcttttcatgtgaggcacataacgataagggcctgaccgtgtctaagggcgtgcaaattaacatcaaggcgatccccagtccccctacagaggtgagcattaggaactcaaccgcacattcaatccttatctcgtgggtgcccggctttgacgggtattccccatttcgtaactgcagtatccaggtcaaagaagctgacccccttagtaacgggtctgtgatgattttcaatactagtgcgctgccccacctttaccagattaagcagctacaagcactggccaattactctattggtgtatcctgcatgaatgagatcgggtggagtgctgtatctccatggatcctagctagtacaactgagggcgcaccaagtgtggcccctttaaacgtcacggtgtttctgaacgaaagttccgataacgtagatattcgctggatgaagcccccaaccaagcaacaggatggcgagctcgtcggatatcggattagccacgtgtggcaatccgccggaatctctaaagaactattagaagaagtgggtcagaacgggtcccgcgcccgtatcagtgttcaggtacataacgctacttgtactgtaagaatcgcagccgtcacaagaggaggagtaggacccttctccgatcctgtgaaaattttcatccccgctcatggatgggtagattatgctcctagcagtacgccggccccaggaaacgcagacccagtcctgatcatttttggctgcttttgcgggtttatattaattggactgatcctttatataagcctggcaatcagaaagcgcgtgcaggaaaccaagtttggcaacgctttcactgaggaagattctgagttggtagttaactacatcgctaaaaagtccttctgcaggagagccatcgagcttactctgcatagcttaggcgtgtccgaggaattgcagaataaacttgaggacgtcgttatcgatcgtaacctgctgattctgggaaagattctcggcgagggagagttcggtagcgtaatggaagggaatctcaagcaggaagacggcaccagcctgaaggttgcagtgaagacaatgaagttggacaatagctcgcagcgagagatcgaggaatttctgagtgaggcggcttgtatgaaagattttagtcatcctaatgttattcggttgctgggcgtctgtatagagatgtcctcacagggtatacctaagcccatggtgatcctgccttttatgaaatacggggacctgcacacatatttgctttacagtagactggaaactggtccgaaacatatcccacttcagacactcctaaagttcatggttgacattgccttggggatggaatatctgagtaacaggaattttctgcacagagaccttgccgctcggaattgtatgcttcgagatgatatgactgtgtgtgtggctgattttggtctcagtaagaagatttactcaggagattactaccggcaggggagaatcgctaagatgcccgtgaaatggatagcaatcgagtcactcgcggaccgagtctacacctcaaaatccgacgtctgggctttcggggtaacaatgtgggagatcgccactcggggtatgacaccgtaccctggcgttcaaaatcatgaaatgtatgattaccttctacacggacacaggctcaagcagcccgaagattgtctggacgaactgtacgaaatcatgtattcttgttggcgcaccgacccgcttgatagacctaccttttctgtgcttcgattacaattggagaagttattggagtccctgcctgatgtgaggaatcaggcggacgtgatatacgtcaacactcagctgctggagagctccgaggggcttgctcagggttccaccctcgcacccctggacctgaacatcgatcccgactctattattgctagctgcacaccacgtgcagccatcagtgtggtgacagctgaggtgcatgattccaagcctcatgagggcagatacatacttaatggcggctctgaggaatgggaagacctcaccagcgcgccttccgccgccgttaccgccgaaaagaactccgtcctcccaggagagcggttggtgcgcaacggcgtttcatggagtcattcatccatgttaccactcggctcatccctaccagacgaattacttttcgccgatgatagcagtgaaggatcggaagtgctgatgtag

SEQ ID NO: 23589 - DNA, 1671 bp, Artificial Sequence
  Description of Artificial Sequence: Synthetic coding sequence
atgaagccccccaccaagcagcaggacggcgagctggtgggctaccggatcagccatgtctggcagtccgcaggtataagtaaggagctgctagaagaggtcggccaaaatggtagcagagcacgcataagcgtgcaggtccacaatgctacctgtacggttcgcatcgcagcggtgactagaggcggcgtgggacctttcagtgacccagtgaagatttttatcccagctcatggcgaatcttatacccatgctcagatcgccagaaacttacataaagtgcgacccgcctacatatctttgaccatttgttcatctctgctgcaggcttccgttagccacatttttcaaacaatgaccgggctgttagtttctacaaggctgggccgattatgcccactttttaattcaggagcctggcagaggcggagttgcgcccaccacctctggttgttactatggatccttataggcctgatcttgtatatctctctagctatcaggaagagagtccaggaaacaaaattcgggaatgcttttaccgaagaggacagtgagctggttgtcaattacatcgcaaagaagtcattctgccggcgggctattgagcttaccctccacagcctgggggtgagcgaggagctgcaaaacaaactcgaggacgtggtgatagatcgaaacctgctcatactgggaaagatcttaggggaaggagagttcggatccgtaatggaggggaatcttaaacaggaggatggcacttcacttaaggttgcagtcaagaccatgaagctcgataattcttcgcagcgcgagattgaagaatttctaagcgaagctgcgtgtatgaaggacttctcccacccaaacgtgatacggttgctcgggactagcgagaagtgtcggtgggtcgccaagagagcccttctaatttgctccgtcccaaaggagaagatttccggcgttgacaagaactgcctacagattcatatccctctgcagactctgctgaaattcatggtagacatcgcattagggatggaatatctttctaacagaaatttcttgcatagagatctggccgccaggaactgcatgctaagggacgatatgacagtttgtgtcgcagacttcgggctttccaagaaaatctattccggggactactatcgacaggggcggatcgcaaagatgcctgttaagtggattgctatagagtcccttgctgatcgcgtgtatactagtaagagcgacgtttgggcattcggcgtgacgatgtgggagatcgcgactcggggcatgacaccgtaccctggcgtgcagaaccacgagatgtacgactatctgctccatgggcacaggctcaagcagcccacagcttggatgaattgtgatcaagtcgggatgtgtagaggggtggaacctactgatacccctgctcaggaaccattcctgatgtgggaaatagtgtacgaatgcaccctagcaggagagcctatccccgacagaccaaccttcagtgtgttgaggctgcaactcgagaagttgctggagagcctgccagacgtgagaaaccaagctgatgtcatctacgtcaacacccaactacttgaatcatctgaagggctggcattgcatccctgctcaaccggcctagagcaccgcccatag

SEQ ID NO: 23590 - DNA, 2472 bp, Artificial Sequence
  Description of Artificial Sequence: Synthetic coding sequence
atgaagatcaacaacgaggagatcgtgagcgaccccatctacatcgaagtgcaagggttgcctcacttcacaaaacagcccgaatcgatgaacgtaactagaaacaccgccttcaacctgacatgccaggccgttggcccccctgagccagtaaatatcttctgggtgcagaactcttccagagtgaacgaacagcccgagaaaagccccagcgtgttgaccgttcctggcctcacagaaatggccgtgttttcttgtgaggcccacaacgataaggggctcaccgtgagcaaaggggttcagatcaacattaaagcaatcccatccccccctacagaggtcagtatccgaaactcaaccgcacactcgatactgatcagctgggtccctgggtttgatggttactccccgttccgaaactgctcaattcaagttaaagaggcggatccactgtccaatggtagtgtgatgatattcaacaccagcgccctgcctcatttatatcaaataaagcagctgcaggccttggccaattactccattggggtctcatgtatgaacgaaatcggatggtcggcagtgtccccgtggattcttgctagtacgactgagggcgccccaagcgtagctccattgaatgtgacagtcttcctgaatgaatccagcgataatgtggacatccgttggatgaaacccccaaccaagcagcaggacggcgagttggtgggttatcgtatttctcatgtttggcaaagcgctggaatcagtaaagagctgctggaggaagtaggtcaaaacggatcacgtgctaggatttcagtgcaggtgcataacgcaacctgtaccgtgaggattgctgctgttaccagaggaggtgtgggaccgttctcggatcctgtaaaaatctttattcccgcacacgggtgggtggattacgcgccaagctccacgcccgcaccagggaacgctgaccccgtcctcatcattttcggatgcttttgcgggttcatactgattgggctgatcctgtacatttccctagcgatccgcaaacgtgtgcaggaaactaaattcggcaatgccttcaccgaggaagattcagaactcgtagtgaactacatcgccaaaaagagcttctgtcgaagagctattgaactgactcttcacagcttgggagtctcggaagagctgcagaacaaactagaggatgtcgtgattgatagaaatctgctgatcctcggcaagatattgggagagggggagtttggctcagtcatggagggcaaccttaaacaggaggacgggactagcctgaaagtggctgttaagacaatgaaattagataattcctctcaacgcgagattgaggaattcctatctgaggcagcctgcatgaaagatttttcccaccctaacgtaattaggctgctgggtgtatgtatcgaaatgagttcacaaggcatccctaagcctatggttattctcccctttatgaaatacggggacctacacacctacctgttatactctaggctcgaaaccggcccgaagcacatccccctgcagacacttctcaaatttatggtggatatcgcactgggaatggaatatctatctaatcggaacttcctgcacagagacctggccgctcgcaattgcatgttacgtgatgatatgacggtgtgcgtagctgactttggactgtcaaagaaaatctattctggtgattattacaggcagggccgcatcgcgaaaatgccagtcaaatggatcgcaatcgaatctctggcggaccgggtctatacatctaaatctgatgtctgggctttcggggttactatgtgggagattgctacgcgtggcatgaccccctatccaggcgtgcagaaccacgagatgtatgattatctgctccacggacaccgacttaagcagcctgaggactgccttgatgaactgtacgaaattatgtacagttgctggcggactgaccctctagataggccaacattttcagtcctgaggctgcagctggagaaactacttgaaagcctgccagacgtgaggaaccaggccgacgtcatctacgttaacactcagctcctggagtcatcggaaggactggctcaggggtcaactctcgccccactggatttaaacatcgatccagactcaataattgcttcctgcacccctcgcgcagctatctccgtggtcactgccgaagtccacgactcaaagccccatgaagggcggtacatattgaatgggggcagcgaagagtgggaggatttaacatctgcaccgagtgccgccgtcacagcagagaagaattccgtgttaccaggtgagcggttagtgcggaatggggtatcctggtctcattcctccatgttgcccctggggtcctcccttcccgatgaattgctgttcgcggatgattcctcggaggggtctgaggtgctgatgtag

SEQ ID NO: 23591 - DNA, 3000 bp, Artificial Sequence
  Description of Artificial Sequence: Synthetic coding sequence
atgggccccgcccccctgcccctgctgctgggcctgttcctgcccgctctctggcgccgggccattaccgaagccagggaggaggccaagccatacccgttattcccaggccccttcccgggcagtctccagacagaccacacacccctcctgagtctccctcatgcatctggttatcagcccgccctcatgttcagtccaacccagcccggccgacctcatactggaaacgtcgctatcccccaggtgactagtgtggagtccaagccactcccaccactggcttttaaacacacggtgggacatatcatactctcagagcataagggggttaaatttaactgttcaatctctgtccctaacatatatcaggacaccaccatcagctggtggaaggacggcaaggaactgctcggggcccaccatgccataactcagttttatccagatgatgaagttacagccattattgcaagtttttctattacctcagtgcagagatcagataacggatcatacatttgcaagatgaagattaacaacgaagagatcgtctcagatcctatttatatcgaggtccagggtttgccacacttcacaaaacagcccgagtccatgaatgtcactcggaatactgctttcaacctgacatgtcaggctgtaggtcccccagagcccgtgaacattttttgggtgcagaactctagtagggtgaacgaacagcctgagaagagcccctcggtgcttactgtgccgggcctcacagagatggcagtgttctcgtgtgaggctcacaacgacaaaggacttacagtctctaagggggtgcagattaatatcaaagccataccgtcacctccgaccgaggtttccatcaggaatagtacggcccactccatcctgatctcctgggtgcccggtttcgacggctattctccatttcggaattgctcaatccaggtgaaagaggcggatccactctccaatggcagcgtgatgatctttaatactagcgccctcccccacctatatcagatcaagcagttgcaagccctggcgaattattccattggggtgagctgtatgaatgagatcgggtggtccgcagtttccccctggatactagcctctacaactgagggcgcgcccagtgtagccccactgaatgtaaccgtttttctgaacgagtcatcagacaacgtagacattagatggatgaagccacctacgaaacagcaggatggcgagctggtaggatatcgtataagccatgtgtggcaatctgcgggcatctcaaaagagcttcttgaggaagtaggacagaatggtagtcgcgctcgcattagtgtgcaggtgcacaatgctacctgtaccgtccgtattgccgcagttactaggggcggggtgggacccttttccgatccagtgaaaatctttattcccgcacatggttgggtagactatgccccgagctcaacgcccgcccccggcaatgcggaccctgtgctgatcatctttggttgcttttgcggctttatcctcatcgggttaatcctttacatatcactggccatccgcaagcgcgtccaagaaaccaagttcggaaatgcctttaccgaggaagattccgagctggttgtgaattacattgcgaagaagagcttttgcaggcgtgcaatagagctgacattacatagccttggcgtctccgaagagcttcagaataagcttgaagacgtggttattgaccgtaacctcttgatactcggcaaaattttaggtgagggtgaattcggctcagtaatggagggaaaccttaagcaggaggatggcacaagcttaaaagttgccgtaaaaaccatgaaacttgacaactcgtcccagcgcgagatcgaagagtttctgagcgaggctgcctgcatgaaggatttctctcacccaaatgtcatcaggcttctcggagtgtgcatcgagatgagcagtcagggtatccccaagcctatggttattctccccttcatgaagtacggagatctacatacttatctgctttattcccgactggagaccggccccaagcacatacctctgcagacccttctgaaattcatggtggatatcgccttgggtatggaatatcttagtaacagaaactttctgcaccgggatctggcagctcgcaattgtatgctgcgggacgacatgacagtttgtgtagcagacttcggtctttctaagaaaatctattcaggagactactaccgtcaggggagaatcgccaagatgcccgtgaaatggattgcaatcgagtccttggcagaccgagtttatacatccaagtccgatgtgtgggcttttggtgtgaccatgtgggaaatcgctacaagaggcatgaccccataccccggagtgcagaatcatgaaatgtatgattacctcctccacggccacagactaaaacagccagaggactgcctagatgaactgtatgaaatcatgtatagctgttggcgtaccgacccattggaccgccctacattttccgtcttgagactgcagctggaaaagcttctcgaatctctgcccgacgtgcgtaatcaggccgatgtgatctatgtcaatacccagctgctggaatcttcagagggtcttgcacaggggtcaaccttagctccgctggatctgaacattgaccccgatagtatcatcgccagctgtacccctcgggctgccatatcagtcgtgacggccgaagttcatgactccaagccccacgagggccggtacatcctgaacggaggatccgaagagtgggaggacttgacatcagcccccagcgcagcggtgaccgcagagaaaaactcagttctgccgggcgaaagattggtgcgtaatggagtgtcttggtcccactctagcatgttacctctggggagttcactccctgacgaattactctttgcggacgacagcagcgaggggtccgaggtgttgatgtag

SEQ ID NO: 23592 - DNA, 501 bp, Artificial Sequence
  Description of Artificial Sequence: Synthetic coding sequence
atggccagcggcgtggccgtgagcgacggcgtgatcaaggtgttcaacgatatgaaggtgcgtaagtcaagcactcccgaagaggtgaagaaaaggaaaaaggccgtgctgttctgtctgtctgaggataagaagaacataatcttggaagagggaaaagaaattctcgtgggtgacgtcggacagacggtggacgacccatacgcaactttcgtgaagatgctgcccgataaagactgtaggtacgccctctacgatgctacatacgagaccaaagaaagtaagaaggaggaccttgtgtttatattctgggcccctgagtccgcaccgctcaagagcaaaatgatttatgcctccagcaaggacgcgattaaaaaaaaactgaccggcatcaagcacgagctgcaggctaactgctatgaagaagttaaagaccgatgtacattggccgagaagctaggcgggagcgccgtcatcagtctggaaggaaaacccttgtag

SEQ ID NO: 23593 - DNA, 501 bp, Artificial Sequence
  Description of Artificial Sequence: Synthetic coding sequence
atggccagcggcgtggccgtgagcgacggcgtgatcaaggtgttcaatgatatgaaggtccgaaaatcaagcacccctgaagaagtaaagaaacggaagaaagcggtgctgttttgcctgtccgaggataaaaagaatattattctggaggagggcaaggaaatccttgtaggagacgtagggcaaacggtagacgacccctatgccacatttgtcaaaatgctgccagacaaagactgtcggtatgcgttatatgatgctacctatgaaactaaagagagtaagaaggaagatttggttttcattttctgggcccccgaaagcgcccccctcaagtccaagatgatttatgcgtcctctaaggatgcaattaaaaaaaagctgacaggtattaaacacgagctgcaagcaaattgctacgaggaggtgaaagatcgctgcacactggctgaaaagctgggcgggagtgcagtgatctctctcgagggaaagcctctttag

SEQ ID NO: 23594 - DNA, 276 bp, Artificial Sequence
  Description of Artificial Sequence: Synthetic coding sequence
atggccagcggcgtggccgtgagcgacggcgtgatcaaggtgttcaatgacatgaaagtaaggaaaagcagtactccagaggaagtgaagaagaggaaaaaagctgtgctgttctgccttagcgaagacaaaaaaaacatcatcctggaagagggcaaggagatccttgtaggtgatgttggacagaccgttgacgacccttatgctacatttgttaagatgctcccagacaaggactgcaggtacgctctctacgacgcaacatatgagacgtag

SEQ ID NO: 23595 - DNA, 4101 bp, Artificial Sequence
  Description of Artificial Sequence: Synthetic coding sequence
atgctgagcttcgtggacacccggaccctgctgctgctggccgtgaccctctgtcttgcgacgtgccagagcttgcaggaagaaacggtgagaaagggaccggccggagacaggggccctagaggagagcggggacctccagggccacctggaagggacggagaggacggtcccacagggccgcctgggccccccggcccaccaggcccgccgggcctgggcggaaatttcgcagcccagtacgatggcaagggagttgggttgggacctggccccatgggactgatgggacccagaggacccccaggagcagcaggcgcccccggcccccagggatttcagggccccgctggtgagcccggtgagcccggccagactgggccagcaggcgctcgcggcccagcagggcctcccggcaaggctggcgaagatggtcaccctggaaagcccggcaggcccggcgaaaggggcgtggtgggaccacagggagctcgtggcttcccaggaaccccgggtctccctggctttaagggcatccggggccacaatgggctagacggcctaaaggggcagcctggcgccccaggggtcaagggggaacccggtgcaccaggggagaatgggacgccaggtcaaacgggggcacggggactgcccggggagaggggcagagtaggcgctccaggacctgccggtgcacgaggcagcgatggatccgtaggccccgtggggccagctggcccaatcggaagtgccggcccaccaggttttcccggcgctcctggcccgaaaggcgagattggagctgtgggcaacgcaggccccgctggtcctgcagggcctcgcggggaagtcgggctgcctggtttgtccggcccggtcggaccccccggcaaccccggagctaacggtttaacaggtgccaaaggggcagccggtttgcccggtgttgccggggcaccaggcctgccgggacctaggggaatccctggccccgtgggtgccgccggcgcgactggcgcccgggggctcgtgggcgagcccggccccgcagggtccaaaggggagtccgggaataaaggagagccgggaagcgccggtccccagggccccccgggccctagcggtgaggaggggaaaaggggacccaatggtgaggcgggctccgctgggccccccggccctccagggctgaggggctcaccgggtagtcgcggccttcccggagctgacgggcgggccggcgtcatggggcccccagggagccgtggagccagtggaccagctggagtcagaggaccaaacggtgatgcggggaggcccggtgagccaggactgatgggtccacgaggtctgccgggtagccctggcaacatcgggcccgcaggaaaagaaggccctgtgggactaccaggcattgacgggcggccaggcccgattgggcccgccggcgcccgcggagagccagggaacataggattcccaggccctaagggtcctactggcgatcctgggaagaacggggacaaaggtcatgccggactcgcaggtgcacggggagcccccggcccagacggaaacaatggggctcaaggaccaccaggcccacagggcgtgcaaggaggaaaaggagagcagggtccccccggtcctccaggctttcaggggctgcccggaccgagtggccccgccggcgaagtcggtaaaccaggtgagagaggccttcatggcgagttcggccttcctgggcccgcgggaccgagaggggagcgcggtcctcccggagaatccggcgccgctggacctactggtcctatcggctctaggggaccctccgggccccccgggcccgacggcaataaaggcgaacccggggtagtgggtgcggtcgggacagctgggccctccggcccatccgggctccccggtgaacggggcgccgctggaatcccaggaggaaaaggggagaaaggcgagccaggcttaaggggggaaattgggaacccggggcgtgatggagccaggggggctcctggagcagttggagctccaggcccagcgggggctacaggagatagaggcgaagccggtgccgcaggtcctgcagggcccgcagggccccgaggttcgcccggggaacgcggagaggtgggccccgcagggcctaacggatttgctggaccagccggcgccgcaggtcagcctggtgctaaaggtgaaaggggagccaaggggccaaaaggggagaatggggtcgtaggccccaccggacccgtgggcgcagcagggccagccggtcctaatgggccccctggtcccgccggctctcgtggtgatggcggaccccctgggatgactggttttccgggcgcagctgggcgtactgggccacctggcccaagtgggatctcaggccctcccggcccacccggccctgccgggaaggaagggctgagaggccccagaggggaccagggccccgtaggtaggacaggcgaggttggggccgtgggtcccccgggcttcgctggcgaaaaaggacctagcggagaagctggaacagcgggtcctccagggaccccagggcctcagggactgttaggagccccggggatcctgggcctgcccggctcccgaggggagcgtggcctgcccggagtggcaggggctgtgggagaacccggtcccctgggaattgctgggccacccggagccagaggtcccccaggtgcagtcggatccccaggggtcaatggcgctcccggagaggctggacgcgacggtaacccaggtaacgacgggccaccaggcagggatggtcagcccggtcataaaggagagaggggttacccgggaaacatcgggccggttggagccgctggcgcacccggtccacacggcccagtcggcccagctggcaaacacggcaacagaggggagactgggccctccggccctgtggggcccgcgggggctgtaggcccacggggcccttccggcccacagggcattcgaggcgacaaaggtgaacccggcgaaaaaggacctcgcggtctgcccggtttgaagggccacaatggccttcaaggcctgccaggcatcgccgggcaccacggcgaccagggggctccaggctcagttggacctgccggtccgcggggacctgctggtcccagtggaccagccgggaaggatggtcgaacaggccaccccgggactgtaggtccagctgggattagagggccgcaagggcatcagggaccagccggcccacccgggcccccaggacctcccgggcccccgggggtgtccggcggcggatacgacttcggatatgacggagacttctaccgcgccgaccagcctcggtccgctccatcattgaggcctaaggactatgaagtcgacgctactctgaaatccctcaataatcagattgagacactccttactccagagggtagccgaaagaaccccgcccggacatgccgtgacctgcgactgtctcatccagaatggtcatcgggctactactggatcgatcccaatcagggctgtaccatggatgctattaaggtatattgtgacttttctactggagagacctgcatccgcgcgcagccagagaatatccccgccaagaactggtatcggtcatccaaagacaagaagcacgtgtggttaggcgaaacaatcaatgctggttctcagtttgagtacaatgtagagggggtgacatctaaggagatggctacccagctggcatttatgagacttctggctaattatgcctcgcagaatattacctaccactgcaagaactctatcgcttatatggatgaagagacgggaaatttaaagaaggcggtcatcctccaagggtcaaacgatgtggaactggttgccgaagggaattcgcgttttacatacactgtgcttgtggacgggtgctcaaagaaaactaacgagtggggcaaaaccattattgaatacaaaactaataagcccagcaggctgcctttcctggacatcgcaccattagacataggaggcgcagaccaggaattcttcgtggacattggaccagtatgctttaagtag

SEQ ID NO: 23596 - DNA, 4104 bp, Artificial Sequence
  Description of Artificial Sequence: Synthetic coding sequence
atgctgagcttcgtggacacccggaccctgctgctgctggccgtgaccctctgccttgccacatgccagtgcactctaggcggccagacactgtccaagttccccccgtatcttcacattgagcgctccgagcagggcccacccggacccccaggccgagatggagaagacggacccactggccctcccgggccccctggaccccctggtcctccaggcctaggcgggaactttgctgcccagtatgatggaaaaggggtgggtctggggcccggacccatgggcctgatgggccctcgcggaccccctggtgccgcgggggctcccgggccgcaaggcttccagggccctgcaggggagccgggcgagcctggccagaccggacctgctggggcacgcggcccagccggaccaccaggaaaggccggagaggacggacatccaggcaaaccgggacgcccaggcgaacgcggagtggttgggccccagggcgccagaggattccctggtacacctggacttcctggttttaagggaattcgaggacataatggcttggatggactgaagggacagcccggcgcccccggcgtaaaaggggagcctggggcccctggggaaaacggaaccccggggcagactggcgcacgcggtttgccgggggagcgcggccgggtgggtgccccaggccctgcaggagcccgcggatctgacgggagcgtgggacccgtggggcccgctgggcctatcggttctgcagggcctcccgggtttcctggtgcgccaggccctaaaggggagattggcgccgtcggtaacgccggccctgccggtccagcgggcccaaggggcgaggtgggcctcccagggttatcaggtccagtgggcccccctggcaatcccggggccaacggtctaacaggggccaaaggggccgcgggtctgccaggggtagccggcgctccaggtcttcccggacccagggggatcccaggccccgtgggtgccgcgggggccacaggtgctcgcggtctggtgggcgaacctggccccgccgggtctaagggcgagagcgggaataagggcgagccgggctcagctgggcctcagggcccacccggcccatctggcgaggaaggcaagaggggtcccaatggtgaagcgggatccgctggccctccaggaccacctgggttacgcggctcacctggcagtcggggactgcctggagcggatgggcgggccggggtgatggggcctcctggaagcagaggggcgtctgggcctgccggagtgcgcgggcctaacggcgatgctgggagaccaggtgaacccggactgatggggcctagaggcctgccaggcagccccgggaacatcgggcccgctgggaaagaaggccctgtcgggctcccgggcattgacgggagacctggccctataggcccggcgggagctcgcggcgagcccgggaacatcggctttcccggacccaaaggtccgacaggggacccgggaaaaaatggtgataaagggcatgccggtctggccggagccaggggcgccccaggacccgacggaaacaatggagctcaaggaccccccgggccccagggagtgcagggcggcaagggagaacaggggccaccgggtcccccaggcttccaaggtttacccggcccctcagggcctgccggtgaggtgggtaaacccggggaacgaggactgcatggagagttcgggctgccggggcccgccggaccccgcggcgaacgtgggccacccggcgagtctggagccgcaggcccaaccggccccataggcagccgcgggcctagcggacctcccggacccgatggaaacaaaggtgagccaggcgtggttggcgcagtgggcaccgcaggtccaagtgggcctagcggcctgcccggtgagcggggggcagccggaataccaggcgggaagggagagaaaggtgagcctggtctgcggggtgagatcggcaacccaggacgagacggcgcccgaggcgcccctggcgctgtgggagctcctggtccagctggtgcaaccggagacagaggagaggcgggagccgccggcccggctggcccggccggacctcgcggtagccccggtgagcgaggggaggtcggacctgcggggccgaatggctttgcagggcccgcgggggccgccggccagccgggcgcgaagggtgagcggggtgcaaaagggcccaagggggagaacggagtcgtgggcccgaccggacccgttggagccgcaggacccgcagggcccaatggtccgcccggacccgctggatctagaggggacggtggcccacctggaatgaccggatttcccggcgcggccgggagaacgggccctcctggccccagcggtatctccggcccccccggccctccgggccctgctggcaaggagggcctgcggggaccaaggggcgatcaggggccagtcgggaggaccggagaggtgggtgctgtcggaccgccaggatttgcaggcgagaaaggtcctagtggcgaagccgggaccgccgggccacctggaacacctgggccccagggtctattgggcgccccaggaatcttgggactgcccggctctcggggagaaagggggctgcccggtgtggctggtgctgtaggggagcccgggcccctcggcatcgccggacctcctggggccaggggacccccaggagccgtgggcagtcctggcgtgaacggggccccaggagaagctggacgggatggaaatcccggcaatgacgggccccctggtcgagacggccagccgggacataaaggagagcggggctatcccggcaacatcggcccagtgggcgccgcgggagcacccgggcctcacggtccggtcgggcccgccggcaagcacgggaataggggggaaacgggcccctcgggacccgttggacctgcgggagccgtgggacctcgggggccttccgggccgcagggaatcagaggtgacaaaggagaaccaggagaaaagggccctaggggcctgcccggtttaaaaggccacaacggactgcaagggctccctggcattgcagggcaccatggggaccagggtgctcccggcagcgtcggcccagccgggcctagaggccccgcaggaccgtctggccccgccggaaaagacggacgtaccggacacccaggaacagtaggcccagcgggcattcgcgggcctcagggtcaccaggggcccgccgggcctccgggccctccagggcctcctggcccccctggggtgtctggtggcgggtatgacttcggttatgacggagatttctatcgcgccgaccaaccccgatctgctcctagccttcgccctaaggattacgaagtggatgccaccctcaagtctctgaataatcagatcgagacactccttactcctgaagggtccagaaagaacccagctcggacttgcagggacttaaggttgagccaccctgagtggagttccggctactactggatcgaccccaaccagggctgtaccatggacgccatcaaggtgtactgtgatttctcgaccggtgagacttgcatccgggcacagccagaaaatatccccgctaagaattggtaccggagcagcaaggataagaaacatgtgtggctgggcgaaaccatcaacgccggctcccagttcgagtacaacgtcgaaggcgtgacatccaaggaaatggcaacccagctggctttcatgcgcctgctggccaattatgccagccaaaacatcacttaccattgcaagaatagtattgcgtatatggatgaagagaccggcaatctgaagaaggctgtgattctgcagggctcaaacgatgtggaattagtagcagaaggcaattccagattcacttataccgtgctcgtcgacgggtgctccaagaaaacaaatgagtggggaaaaactatcatcgaatataaaaccaacaagccctccaggcttcccttcctcgatatcgcccctctcgacatcggcggggctgaccaagaatttttcgtcgacatcggcccagtgtgttttaagtag

SEQ ID NO: 23597 - DNA, 4401 bp, Artificial Sequence
  Description of Artificial Sequence: Synthetic coding sequence
atgatgagcttcgtgcagaagggcagctggctgctgctggccctgctgcaccccaccatcattctggcccagcaggaagccgtcgagggaggatgtagccacttagggcagagctacgctgaccgtgatgtgtggaaacctgaaccttgtcagatctgtgtatgcgatagcggcagcgttttatgcgacgacatcatctgcgatgatcaggaactggactgtcctaatcccgaaataccttttggtgagtgttgtgccgtgtgccctcaacctcccacagcgccaactcgacctcctaatggtcaaggaccccagggccctaaaggggacccgggtcccccaggaatcccgggccgaaatggcgacccaggcatcccgggacagcccgggtctccagggagcccgggcccacccggaatctgcgaaagctgccctactggtccacagaattatagccctcagtacgactcttacgatgttaagtctggggtcgctgtcggggggctggccggataccccggtccagccggacccccgggcccacccggtcccccagggacttcaggccaccccggctcaccggggagtccggggtatcaaggtccacctggtgagccaggtcaggctggaccatctggcccgcctggcccacctggtgcaatcgggcctagcggcccggcgggcaaggatggcgagagtggtaggccaggtcgcccaggagagcgcgggcttcccgggccaccgggaataaagggccccgcgggcattccagggttccccggcatgaaaggccataggggcttcgacgggcgcaacggggaaaagggtgagacaggtgcccccggtctgaagggagaaaatggcctgccaggcgagaacggcgccccaggcccgatgggcccaaggggtgccccaggcgagagggggcggccaggtctaccaggtgccgcaggcgctagggggaatgatggcgcccgggggtccgacggccagcctggccctcccggcccacccggcactgccggattcccaggatcgcccggggctaagggcgaggtggggcccgcaggatcacctggctcaaatggggcccctggacaaagaggagaaccagggccacaagggcacgccggggcacaaggccctcctggccctcccggaattaacggttcaccaggaggcaagggtgagatgggcccagccggcattcctggcgcccccggactgatgggcgcccgggggccccccgggccagctggcgcaaatggtgcacctggcctgcgcggaggagccggtgagcctggcaaaaatggcgcgaagggagagcccggcccccggggagaaaggggggaggcagggattccgggcgttcccggcgcaaagggggaagacggtaaggatggctcgcctggtgagcctggggccaacgggctgccgggcgctgcaggggagagaggggcaccgggatttagagggcctgccgggcccaatggaattcccggagaaaaggggcccgctggtgaaaggggggcacccggccccgccgggcctcgaggtgctgccggggagcctgggcgcgacggggtgcctggcgggcccggaatgagaggcatgcccggctctccggggggtcccggctcagacgggaagccaggacccccaggctctcagggggaaagtggccgccctggtccccccggtcccagtggcccccgtggacagccgggggtgatgggatttcccggcccaaaaggaaatgatggtgcgcctggaaagaatggcgaacggggggggcctgggggccctggtccccagggacctccagggaagaatggggagacgggcccccagggcccaccgggacccacgggtccagggggtgataaaggtgacaccgggccacctgggccccagggcctacagggtttacccggaaccggcggtccaccaggcgaaaacggaaagccgggtgaacccgggcctaaaggggatgccggagcccctggggcccctgggggcaagggggatgctggggcccccggggaacggggaccccctggtctggccggtgcaccagggctgcgagggggagccggcccaccagggcctgagggcggcaagggagccgccggaccaccaggacccccaggtgcggccggaacccccggactacaaggcatgcctggagagcgagggggcctggggagtccaggtccgaagggggataaaggtgagccagggggacctggggctgatggggtgccgggcaaagacggaccccggggtcctacaggcccgatcgggccacctggaccggcgggccagcccggtgacaagggggaaggtggtgctcctgggctgcccgggatagctggtccgcgggggtccccaggagagagaggggaaacaggccctccaggtccggcagggttccctggcgccccgggccagaacggggaacctggcggcaaaggagagagaggcgctccaggcgaaaaaggggagggcggaccgccaggagtggctggccccccaggcgggagtggcccagccgggccccctggtcctcaaggcgtgaagggcgagagagggtctccgggcgggcccggcgctgcaggctttccaggcgcccgaggcttacctggcccgcctggcagtaatggaaatcccggtcccccgggcccctcgggctccccagggaaagatggcccacctgggcctgccgggaacaccggcgctccgggctcacctggcgtcagcggccccaagggtgatgccggccagccaggtgagaaaggctcgcctggtgctcaggggccacccggagccccaggacctcttggaatcgcaggcatcacaggcgcccgaggacttgccggtccaccaggaatgcctgggcccagaggcagtcctggccctcagggagtcaaaggcgaatcaggcaagccaggggctaatggactctctggagaacggggtcccccaggaccgcagggcctgcccggacttgccggaacagccggcgaaccgggcagggatggcaacccgggctcagacggcctgccgggaagagatggtagtcctggcggcaagggagataggggggaaaatggaagtccgggcgctccaggtgcccccggtcacccaggtcctccaggccccgtgggccctgcagggaaatccggggacaggggcgaaagcggcccagcaggaccagccggcgcccctgggccagcggggagcagaggtgctccgggcccgcagggccccagaggagacaagggggagaccggagaaaggggagcagcaggtatcaaaggtcacagggggttcccaggtaatcccggcgcgccaggctccccaggccccgccgggcagcagggagctattgggtctccagggcccgcaggaccacgcgggcccgttggaccgtctggcccccccgggaaggacggaacgtctggccatcctggtccaatcggcccgcctgggcctcgtggcaatcgtggggagcgcggatctgaaggcagcccaggacaccccggacaaccaggccctccaggcccgcccggcgccccaggaccttgttgcggcggggttggtgccgcggcgattgctggaatcggaggtgagaaggccggaggcttcgcgccttactacggtgatgagcccatggacttcaagatcaacacagacgagatcatgacatctctcaaaagtgtcaatggccagattgaatccctgatcagtcccgatggtagcaggaagaatcctgccaggaattgtagggacctgaagttttgccatccggaacttaagtccggtgaatattgggttgaccctaaccaggggtgtaaactggatgccattaaggtcttctgcaacatggaaacaggtgaaacatgtatatctgcaaaccctctcaatgtccctcgtaaacattggtggacagactctagtgctgaaaagaagcacgtctggttcggggaaagcatggacgggggatttcagtttagctatgggaaccctgaattgcccgaagacgttctggatgtgcatctcgcatttctgagacttctgtcctccagagcttctcagaatattacatatcactgcaagaattctattgcctatatggatcaggcatccggcaatgtgaagaaggcattgaaactcatgggcagcaatgagggcgaatttaaagccgaagggaattcaaagtttacctacaccgtcctcgaggacgggtgtactaagcatacgggtgaatggtccaaaactgtttttgagtatcggactcggaaggctgttagattgcccatagtggacatagctccttatgacattggaggaccagatcaggagtttggagttgacgttggacccgtgtgctttttgtag

SEQ ID NO: 23598 - DNA, 3492 bp, Artificial Sequence
  Description of Artificial Sequence: Synthetic coding sequence
atgatgagcttcgtgcagaagggcagctggctgctgctggccctgctccatcctacaatcatcctggcccaacaggaagccgttgagggcggctgctcgcacttggggcagagctacgccgatcgggacgtttggaagccagaaccttgccagatctgtgtatgtgattccgggagtgtcctgtgtgacgatatcatttgtgatgaccaggagctggactgccccaatccagaaattcctttcggtgaatgttgcgccgtgtgcccccagccgccaactgctcctacgagaccacctaatggccaagggccccaggggccaaaaggagatcccgggccccccggtattccgggtcgcaacggtgatcctggaatcccgggacagcctggttcccctggaagcccaggcccacccggcatatgcgagtcttgtcccaccggtcctcagaactactctccacagtacgattcttacgatgtaaaatccggcgtggcggtaggaggtctcgctgggtaccctggacccgcaggcccacctggtccacccggccctcccggcacatccggacatccaggttctcccgggtcccccggatatcaaggacctcctggtgaacctggccaggcgggaccttctggtccccccggccccccaggggccatcggaccctccggccccgcaggtaaggatggcgagtcagggcgccccggacgccccggcgagcgtggcctgcctggtcccccaggcattaagggaccagcaggcattccaggtttcccaggcatgaaagggcatcggggattcgacggacgcaacggcgagaaaggagagaccggcgctcccggcctgaaaggagaaaacgggctgccaggtgagaacggagcaccggggccaatgggtccccgaggtgccccaggagagcggggccgaccaggacttcccggtgccgcgggcgcgcggggaaacgacggggcaagaggtagcgatggccagcccggcccccccggaccccctggaacggccgggtttcctggctctcctggagctaagggagaggttggacctgcgggaagtcctggaagcaacggcgccccgggacagcgcggagaaccaggaccacaggggcatgccggggcccaaggcccccctggccctccagggataaacggatccccaggaggtaaaggcgagatgggcccggccggaatccctggcgcacccgggctcatgggggcgcgggggccaccggggcctgcaggcgcaaatggagctccaggcttacggggcggggctggtgagcctggcaagaatggcgccaaaggggagcccgggccgcggggcgaaaggggagaagccgggatccctggagtgcctggagccaagggagaagatggaaaggacggctctcccggagaaccaggggcaaatgggctaccaggtgctgccggtgagcgcggtgcccctggattccgaggaccagctggccctaacgggattccgggcgagaaggggcctgctggggagcggggagctccaggccccgccgggcctaggggggcagccggcgagccagggcgggacggggtgcctggggggcccgggatgcggggaatgcctggtagtcccggcggacctgggtccgacgggaagcccggcccacccggcagtcaaggtgaaagcgggcggcctgggcctccgggcccgagtggtcctcgggggcagcctggcgtgatgggctttccaggccccaagggcaatgatggcgccccaggcaaaaacggggaaaggggcggtcccgggggccccggtccacaagggccccctggaaaaaatggtgaaaccggccctcagggccctccgggaccgacaggaccagggggcgacaaaggtgacacaggtccacctggacctcaaggtctccagggactgcctggcacaggagggcctccaggtgaaaacgggaaacccggcgagcccggccctaagggagacgccggcgcccccggggcccccggcgggaagggggacgccggcgcgcctggtgagcgtgggcctccagggttggccggagcccccggactccgaggtggagcggggccgccaggcccggagggaggtaagggagccgcaggccctcccggcccgcccggcgctgcggggactcccggtctccaaggcatgccaggggagaggggcggcctcgggagtcccggcccaaagggcgacaaaggcgaacctggcgggcctggtgccgacggtgtgccaggcaaggatggcccccgggggccaaccggacccataggcccgccaggacccgcaggacagcctggtgacaaaggggagggcggagcccctggccttcccgggattgccgggcctcggggcagcccgggtgaaaggggggaaaccggtcctccagggccagctggcttccctggcgcacccggtcagaatggagagcctggcgggaagggcgaaagaggagccccaggtgaaaaaggtgaaggcggccccccaggattgtttggaccacctggaaaggacggaacctctgggcatcctggcccaatcggccctcccggacctagaggaaatagaggagagcgtggttcggagggtagccctgggcacccgggacaaccaggaccgccaggacccccgggagcccctggcccgtgctgtgggggcgtgggcgcagctgccatcgcaggaattggaggagagaaagccggtggcttcgcaccgtactatggcgatgagccaatggactttaagattaacaccgacgaaatcatgacatcgctgaaatcagtgaacggtcagatcgaaagccttattagccctgacgggagcagaaagaaccccgctaggaactgcagagatcttaagttctgccaccccgagcttaagagcggggaatactgggtcgaccccaaccagggctgtaagctggatgccattaaggtattctgcaatatggagacaggcgagacctgcatttccgcaaatcccctgaacgttcccagaaagcactggtggaccgactcatccgccgagaaaaagcacgtgtggtttggagagtctatggatggagggttccagttttcttatgggaacccagagctgcctgaggatgtgttggatgttcatcttgccttcttgagactgttgtccagcagagccagccagaacatcacataccattgcaaaaacagcatcgcctacatggatcaggcgtccgggaatgtcaagaaggctctgaagctcatggggtcaaatgaaggcgagttcaaagcagaggggaatagcaagtttacctatacagtgctcgaagatggctgtaccaagcacactggtgagtggtctaagaccgtttttgagtaccggactagaaaagctgtgcggctaccaattgtggatatcgcaccctacgacatcggcggtcccgaccaggaatttggcgtggatgtggggccggtgtgcttcctttag

SEQ ID NO: 23599 - DNA, 5139 bp, Artificial Sequence
  Description of Artificial Sequence: Synthetic coding sequence
atgggccgggaccagcgggccgtggccggccccgccctgcggcggtggcttctcctgggtacagtgacagtgggctttctggcacagtccgtcctggccggagtaaagaaattcgatgtaccttgtggcggcagggactgctctggggggtgccaatgctacccagagaaagggggaagggggcagcctggccctgtggggccccaggggtacaatggcccccctggcctccagggcttccccggattgcagggacgcaagggcgataagggcgaaagaggtgctccaggcgttacaggacctaagggcgatgtcggagctagaggagtatccggctttccaggcgctgatgggattcctggccaccccggacagggagggcccaggggtcgaccaggatacgacgggtgcaatgggacacagggcgactccggcccccagggcccaccaggctccgaggggttcaccggccctcctggccctcagggtccaaaaggacaaaagggagaaccctatgcccttccaaaggaggaaagagatagatatcgcggagagcctggcgagcccggattggtgggtttccaggggcctcccggtcggcccggccacgtcgggcagatgggccccgtgggagcgccaggcagaccgggacccagcagcgacgaaagtttcaagaataagttgaaaaacaaaggcttgaattactatactgtgaactccatgcagggagatgtgggtcagcccggcccgaacggcatcccctccgacaccttgcacccaattattgcacctacaggggttaccttccaccccgaccaatataagggtccagtggggtggagagggagaccttgggtagctggtatttctttgaagggcgaagaaggcataatggggtttcctggcctgcggggttatccaggtctgagtggggaaaagggttcacccgggcagaagggctcaagagggttggacgggtaccaaggacccgacggtcctagaggtcccaaaggagaggccggagatccgggcccccctggcttacccgcgtattctcctcatcccagcttggccaaaggagccagaggagatcctggttttcctggcgcgcagggggagccgggttcacaaggggagccgggagaccctgggctaccaggtccaccaggattgagcattggtgacggcgatcagaggcggggcctgcccggggagatgggtcccaaaggctttattggggatcccggcatcccggccctatatgggggcccccccggaccagacggcaaacgcggaccgccgggtccccccgggcttcccggccctccgggtccagatggttttcttttcggacttaagggagccaaaggtcgcgcaggcttccccggactgcctggctctccaggggcaagaggccccaaggggtggaagggcgatgctggcgaatgtcgctgtaccgaaggcgatgaagcgattaagggactgccaggactgccaggccctaaggggttcgccggtatcaacggcgaaccggggcggaaaggagatcgtggcgatccgggacaacacggattaccagggtttccagggctgaaaggggttcctgggaacatcggcgcacctgggccaaaaggggccaagggcgactcacgaacgatcaccaccaagggcgagcggggacagccgggagtgcccggcgtacctggcatgaaaggcgatgacggcagccctggtagggacggactggacggcttccctggcctgcctggtcccccaggggacggtattaagggccccccaggtgatcctggttatccaggtattcccgggacaaaagggactcccggtgaaatgggaccacctggactcggacttcccgggctcaagggacaacgcggcttccctggagacgcggggcttccagggccacctggttttcttggccctccaggacccgccggcacaccaggccagattgattgtgatacagacgtgaagcgggctgtagggggggaccgccaggaagcaattcagcctggatgcatcggaggccctaagggattacccggtctccccggacctccaggaccaaccggcgcaaagggcctccggggaatcccaggatttgccggcgctgacggcggtcctggcccacgcggattgcctggcgatgctggacgcgagggattcccaggtcccccggggtttatcggacctagaggcagcaaaggtgccgttggtctgccaggcccagacgggagtcccggccctataggtcttccaggtccagacggtcctcccggagaaagaggcctgcccggagaagtgctgggtgcccagccaggtcctcggggtgacgctggtgtgcccgggcagccaggtctcaaagggctccccggagatcggggacctcccggattccgaggctcgcagggcatgccagggatgcccggactgaaggggcagccaggtctcccaggcccatccggccagcccggtctgtacggcccccccggcctacacggctttccgggtgctccgggccaagaggggcctctgggactgcctggcatcccagggcgcgagggcctgcctggagataggggagatccaggcgatactggcgcgcccggacctgtcggcatgaaggggctgagcggcgatcgaggtgacgccggttttacgggcgaacagggacatcccggtagtcccggttttaaggggattgacgggatgccaggcacccccgggcttaagggggatcgggggagtccgggtatggatggattccagggcatgcctggtctgaaggggaggccgggattcccgggatccaaaggagaagcagggttttttggaatccctgggctaaagggtctggccggtgaaccaggtttcaagggaagccggggcgatccgggcccgcctggacccccacccgtgattctccctgggatgaaagatatcaaaggagaaaaaggcgacgaagggcccatggggcttaaggggtatctgggcgctaaaggcatccagggcatgccagggattccggggttgagtggaatcccaggtctgcctggacgtcctgggcacattaagggagtgaagggagatataggcgtgcctggaatcccgggacttccgggcttccccggggttgccggtccaccgggcattacaggttttcctggtttcatcgggagccgcggcgacaaaggcgcccccggccgggctgggttgtatggcgagattggcgccactggagatttcggcgacatcggggacaccattaacctgccgggaaggccaggcttgaagggcgaacgcggaaccaccggcatccccggattgaagggattcttcggagaaaaaggcacagagggagacatcggcttcccggggattaccggggtgaccggcgtgcagggcccccctgggctgaagggacaaacaggatttcctggactgactgggcctcctggtagccagggagaactagggcgcatcgggctacctgggggtaagggcgacgacgggtggccaggcgcccctggactgccagggttcccgggcttgcgtgggattagaggtttgcacggcctgccggggacgaaggggttcccgggctctcccgggagcgacattcatggcgatcccggcttccccgggccaccaggtgaaagaggcgaccccggagaggcgaatactttgccaggccccgttggagtcccaggccagaaaggagaccaaggagctcctggcgagcgggggcctcccggttctcccggactgcaaggcttcccaggcattacgcctccttccaacatctccggagctcctggcgacaagggcgcccctgggatttttggcctcaaaggctacaggggcccaccaggaccaccaggctccgccgctcttccagggagcaagggggatacaggcaaccccggtgccccaggcactccaggcactaagggatgggcaggagattccggccctcagggtcgaccaggagtgttcggccttccaggagagaaaggtccgcgtggagaacagggttttatggggaacacaggcccaaccggcgctgtgggtgatcgtggtcccaaggggcctaaaggagatcctgggttcccaggcgccccaggtactgtcggggcaccaggtatcgccggcattccccagaagatcgccgtgcagcccggaacagtcggaccacagggacggcgaggccccccaggtgcaccaggggaaatggggcctcagggaccacctggggagcctggctttagaggggcacctgggaaagcaggcccacagggacgtggcggcgtgagtgctgtccccgggttccgcggagatgaagggcccatcgggcaccaagggcccattggccaggagggagcaccagggaggcccgggagtcctgggttacctggaatgcctgggcggagcgtgagtatcggttacctcctggttaagcattcccagacagaccaggagcctatgtgccccgtcggaatgaataaactgtggtcagggtattcgctgctgtatttcgagggtcaggagaaggcccataaccaggatcttggactggccggatcttgcctggcacggttttcaacaatgccatttttatattgcaaccctggggatgtctgttactatgctagtagaaatgataaaagttattggctgtccaccacagctcctctccctatgatgcccgtagccgaggatgaaattaaaccttacatctctcggtgcagcgtctgcgaagcccccgccattgcgattgcggtgcattctcaggacgttagtattccccattgccctgccggttggcgcagcctatggatcggttacagttttctgatgcataccgcggccggggatgaggggggcggacaaagcctagtctcacctggatcatgcctggaggatttcagggctaccccgtttatcgagtgtaatggaggccgcggaacctgtcattactatgccaataaatacagcttttggcttacaacgatccctgagcagtcttttcagggctcgccatctgctgatactctcaaggccggtctgataagaacgcacataagccgctgccaggtgtgtatgaagaacctctag

SEQ ID NO: 23600 - DNA, 5139 bp, Artificial Sequence
  Description of Artificial Sequence: Synthetic coding sequence
atgggccgggaccagcgggccgtggccggccccgccctgcggcggtggctattgctgggcaccgtgaccgtgggattcttggcccagtcagtactggccggagtcaagaagtttgatgtcccttgcggtggccgggactgctcggggggatgtcagtgttacccggagaagggcggccgaggccagcctggcccggtcgggccacagggttataacgggccacctggactacaggggttcccaggcctgcaggggagaaaaggcgataaaggagagcggggtgcacccggcgtgaccggacctaaaggggatgtgggggcacgtggcgtgtctggcttccccggcgcagatggcattcctgggcaccccggacaaggggggcctagaggacgcccaggttacgacggatgcaatggaactcagggggacagcggccctcagggtccgccgggaagcgagggctttactgggcctccaggaccacagggacctaaaggccaaaagggcgagccatatgcgcttcctaaggaggagcgcgatcggtataggggcgagcccggggagcctggccttgtggggttccaggggccgcccgggcggcccggacacgtggggcaaatggggcctgtcggcgcccctggccggccgggccctccagggccccctgggccgaagggtcaacaagggaaccgcggtttgggcttttacggcgtgaaaggggaaaagggggacgtgggtcagcccgggcccaatggaattccaagtgatacattgcaccccataatcgcccctaccggagtgacattccaccctgaccaatataagggcgaaaagggcagtgaaggcgaaccgggaatccgaggaatttccctgaaaggcgaagagggcataatgggttttcccggcctcagaggttatcctgggctctcgggcgagaagggttcccctgggcaaaagggatccagagggctcgacggctaccagggacccgacggccccaggggccctaaaggcgaggctggtgacccagggcctccaggactacctgcttactctcctcatcctagccttgccaagggagcccgtggcgaccccggctttccgggggctcagggggagcctggcagtcaaggtgaaccaggcgatcccggactacctggtccacccgggctgagtatcggagacggagatcagcgcagaggcttgcccggtgaaatgggccccaaaggatttatcggtgatccagggattccagcactctacggggggccccctggcccagacgggaagcgcggccctccaggtccccctggactgcctgggccgcccggccccgacggtttcctgtttgggctgaaaggggcaaagggcagggccggatttcccgggcttccagggtcaccaggagcaagaggtcctaaaggctggaagggtgacgcgggtgagtgcaggtgcacagaaggtgatgaggcaatcaaggggctgccagggttgcctggtcccaagggattcgcaggcatcaatggagaacccggtcgtaagggcgataggggcgatccaggacagcatggccttccaggatttcccggtttgaagggggtgcccggaaatattggcgccccgggtccgaagggggcgaaaggcgatagtaggacaatcacaacaaagggtgagcggggccaacctggagtacccggtgtccctggcatgaaaggggacgacgggtcccctggaagagacggtctcgacggtttccctggcctgcccgggcctcctggtgacggcattaaaggtccccctggcgaccccggctacccaggcatcccaggtacaaaaggaaccccaggcgaaatggggccaccaggactcgggttgccggggctgaaaggccagagaggcttccctggagacgccggtcttccaggccctcccggatttctcggcccacctggtcccgcgggcaccccagggcaaatcgactgtgacaccgatgtcaaaagggccgttgggggggacagacaggaggccattcaacccggttgcataggggggcctaagggattgcctggcctgccagggcctcctgggcctaccggagctaagggattacgtgggattcccggctttgctggggccgacggcggccccggcccccgcggcctcccaggagatgccggaagagagggatttcctggaccccccggctttatcggtccacgtggaagcaaaggggctgtcggccttccaggcccagatgggtctccgggccctatcgggctgccaggccccgacggaccacccggcgaacgcggtctccccggagaggtccttggtgcacagcccggacctagaggcgacgcgggggtcccgggtcaacccgggttaaagggactgccaggcgacagaggcccgcctgggttccggggatctcagggtatgcctggcatgcccggcctgaagggtcaaccaggattacccggtccaagtgggcagcccggtctatacggccctccaggactgcatggatttccaggtgcccctggccaggagggacccctggggctccccggaatacccggcagagagggactcccaggggaccgcggcgacccgggagatacaggagctcctggacccgtggggatgaaggggttgtctggtgaccggggagatgccggtttcactggggaacagggccaccctggctcccccggatttaaagggattgatggcatgcccggaactcctggcctcaagggggatcgaggcagccctggaatggatgggttccaagggatgcctggcctaaagggccgtcccggatttcctggctctaagggtgaagcaggcttttttggtatccctggactgaagggtctcgcaggggagcccggcttcaagggcagtcgtggcgacccggggccacctggccccccacctgtgatccttcctggaatgaaggatatcaagggtgaaaagggcgatgaggggccaatgggcctgaagggctacctcggcgccaaaggaatacagggaatgcctggaatccccggtctcagtggcattccgggtctgcctgggaggccagggcatatcaagggggtcaaaggcgacattggcgtccctgggatccctggcctacccgggtttcctggcgtggcaggacccccgggcattaccgggttccccgggttcatcggctcgagaggcgataagggcgcgcctggccgagcgggcctttacggagagatcggggccacgggagactttggtgatatcggcgatacgattaacctcccgggaaggcccggtctgaaaggggagcggggcacgaccggcattcctggactgaagggtttttttggagaaaaggggacagagggcgatattggctttcccggcatcacgggggtgacaggggtgcaggggccaccaggcttaaaaggacagaccgggttccctggcctgactggacctcccggatcgcaaggcgagttagggaggattgggttacctggcggaaagggcgacgacggatggcccggggcgccgggcctgcctgggttccctggtctgagaggtatcaggggacttcacggcttacccggcaccaaggggtttccggggagtccaggaagtgatatccatggagatccgggcttccctggacctcctggtgagcgaggagatcccggcgaggccaatacactccccggcccagtgggggttcccggccagaagggcgaccagggagctccgggagagcgcggcccaccggggtccccagggctccaggggtttccaggcatcacccctcctagcaatatctcaggggctcccggggataaaggcgcccctggcattttcggcctgaaagggtatcgcgggccaccaggcccccccggcagcgctgctctgcccggctccaagggtgacacgggaaatcccggtgcgcctggcacccctgggaccaagggctgggccggcgacagcgggccccagggccggcctggggtttttggcctcccgggagagaagggacctcgcggagagcagggctttatgggcaacacaggacctacaggagccgtgggtgacaggggtcctaagggccctaaaggcgaccctggattccctggtgcacccggcaccgtgggggcccctggaattgcaggcatccctcaaaagatcgctgtgcaacccggcacagtgggcccgcaggggaggcggggacccccaggtgcacctggggagatgggtccccagggccccccgggcgaacctggtttcagaggtgcacctggtaaggctggtccgcaggggcgcgggggggtgtctgctgtcccgggtttcagaggcgatgaggggccgattggtcaccaggggccaatcggacaggaaggtgcccctggccggccaggctcccccgggctacccggaatgcctgggcgcagtgtttccatcggctacctgctcgtaaagcactcgcagactgaccaggagcccatgtgccccgtgggcatgaataaactatggagcggctattctctgctgtatttcgaaggacaggagaaggctcacaatcaggatctgggactcgctggttcttgcctggctagatttagcaccatgccattcttatattgtaatcctggcgacgtctgttattacgcaagccgcaacgacaagtcttactggttgagtaccaccgccccactgccgatgatgcccgttgccgaagacgagattaagccatatatttcacgctgcagtgtgtgcgaagctcccgccatagcaatcgccgtgcattcacaggacgtgtccattcctcattgccctgccggctggcgctctctgtggatcggctacagctttctgatgcataccgccgcaggggatgaaggcgggggccaatctcttgtatctcccggcagctgtctggaagattttcgggctactccgttcatcgaatgcaatggagggagagggacatgccactattatgccaataaatactcattctggctcacaacaatacctgaacagagtttccaaggctctccaagtgctgacacactaaaggccgggttaatccgtacgcacatctctcgctgtcaagtctgtatgaagaatttatag

SEQ ID NO: 23601 - DNA, 318 bp, Artificial Sequence
  Description of Artificial Sequence: Synthetic coding sequence
atgggccgggaccagcgggccgtggccggccccgccctgcggcggtggctgctgttgggcactgtaacagtgggctttctcgcacagtcagtgctcgcgggagtgaagaaatttgacgtcccctgcgggggacgggactgcagcgggggttgtcagtgctatccagagaagggcgggaggggacagcccgggcctgtggggcctcagggctataatgggccacccggccttcaagggttccctgggcttcagggtaggaagggagacaaaggggagcgaggtgccccgggagttacggggccaaaaggagacgtgtag

SEQ ID NO: 23602 - DNA, 4497 bp, Artificial Sequence
  Description of Artificial Sequence: Synthetic coding sequence
atgagcgcccggaccgccccccggccccaggtgctgctgctgcccctcctgctcgtgctgctcgctgccgctccagccgctagtaaaggctgcgtgtgtaaggataaagggcagtgtttctgtgacggagctaagggcgagaagggcgaaaagggattccctggcccacctggctcacctggacagaagggctttacgggccccgagggtttacccggcccccagggccccaaatctttcagagctattccgtcttattccggtggtaaatcactgcagggcattagtgggttaccaggattttcaggctctccagggctgccgggaacgcctggcaatactgggccttacgggctggtaggggttccggggtgtagcggctctaagggcgaacagggcttccccggactccctggcaccttgggctatcctggtattcctggaattcacaacctgaagatatttaagggagctccagctaaggaggaggacatcgagctggatgctaaaggtgatccgggattgccaggagccccaggtcctcaggggttaccaggaccccctgggttccctggccctgtgggtccgcccgggcctccaggcttttttggcttccccggggcaatggggccgcgggggccgaagagctttgtattaagctcacgaatatccaccaaaggcgagaaaggagtaaagggcctcaccggtcctccgggccctcctgggactgtaattgtcactttgacaggcccagataacaggacggacctgaagggtgagaaaggcgataaaggagccatgggcgagcctggtccgcccggcccttctgggctgcccggggaatcttacggcagtgagaaaggggcacctggggatcctggtctacagggcaagcccggcaaagacggagtcccgggttttcctgggtcggaaggggtgaagggtaacagaggcttcccaggcctcatgggtgaggacggtataaaagaggaaaaaagagatgtagctattgtttcattttctagtaaaacagaatattatgacacctaccaggagaagggcgatgaaggaacgcccggcccgccagggccaaggggcgctaggggcccccaggggaaaaacaagttccggtgtatccccgggagtcagggttcttcccggcccgggctcaggggggcccccgggtggccagggctcaagggcagcaagggcgagagggggcgcccaggcaaggacgccatgggcactcccggctctccaggctgcgctggatcaccaggactccctggcagccctggccccccgggtcccccaggagatatcgtttttagaaaaggccctcctggcgaccatgggttaccaggctaccttggcagccccgggattccaggcgtggatgggcctaagggggagccgggtcttctttgcacccaatgtccctacattcccggaccgcctggcctgcctggcttgccaggactgcatggggtgaagggcataccagggcgccagggagcagctggtctgaagggctcacccgggagcccgggaaatacaggactgcctggtttccctggattccctggagctcagggcgatcccggcctgaagggagagaagggtgagaccctccaacccgagggacaggtcggagttcctggcgacccagggctccgcggccagcccggacgaaaagggctagacggcattcctggcactcccggcgtaaaagggctgcccggcccaaagggagagctggccctgtccggtgaaaaaggtgatcagggaccaccaggggatccggggagtcctggctctccagggcctgccggaccagccgggccacctggctatggcccacagggggagccaggcctccagggaacccagggggtgccaggcgcccctggaccacctggcgaagccggtccacggggggagctctctgtttcaacgccagtccccggacctcctgggcctcctggccctccggggcacccaggtcctcaggggccacctgggatcccaggctctttaggtaagtgcggcgacccaggcttgcccggcccagatggtgagcccggcatccctggcatcggctttcctgggcctcctggcccaaagggagaccaggggttccccggcaccaagggaagcctgggctgcccgggcaaaatgggcgaacccggcctccctgggaagcccggcctgccaggtgcaaaaggtgagcctgctgtggccatgcctggcggacccggaacccccggatttcctggcgagagaggtaattctggagagcacggcgagatcggattaccaggcctgccaggcctgccaggcacaccagggaacgaaggcctggacggacctcgaggagatcccgggcagcccgggcccccaggcgagcagggaccaccaggaagatgcattgagggaccaaggggtgcccagggcttgccagggctaaacggcctgaagggacagcaagggcggaggggtaaaactggaccgaaaggtgatcctggcattcccggacttgacagatctggattccctggcgagaccggttccccgggtatccctggacaccagggggagatggggccactgggacagagaggatatccaggcaatcctgggatcctgggaccgcctggcgaggacggggtaatcggtatgatgggatttcctggcgcgatcggcccgccagggccgccaggaaacccggggacacccggccagagaggctccccaggaatcccaggagttaaaggccagagagggacgcccggggcaaaaggtgagcaaggggacaagggtaacccaggaccatcagagattagtcacgttattggggataagggtgaacccgggctgaagggctttgctggcaacccaggcgaaaagggaaaccggggtgtgccaggaatgccggggttgaaaggcctgaaaggactaccgggccccgccggaccaccaggaccaagaggagatcttgggagcactggaaatcccggggaaccaggactaaggggaatccccggaagcatggggaacatgggaatgcccggcagtaaaggaaaacggggcacactcgggtttccagggagggcaggtcgcccagggttgccagggatccacggtctccagggggacaaaggggaaccaggatactctgaggggacaagaccaggtccacccggaccaaccggcgaccccggcctgcctggtgacatgggaaagaagggggaaatgggacagccaggaccaccaggccacctcggccccgccggccccgaaggcgccccagggagtcctgggtcccctgggctgcctgggaagcccggcccgcacggggacctgggctttaaaggaataaagggcctgctgggccccccggggattaggggccctcccggacttccaggatttcctgggagtcccggacctatgggcatacgcggtgatcagggcagagacggaatcccagggccagctggcgaaaagggcgagactggcctgttacgggcacctcctgggccgagggggaatcctggcgcacaaggggcgaaaggagatcggggcgctccggggtttcccgggctccccggcagaaagggggccatgggtgatgccggcccaagaggacctacaggtattgaaggcttccctggacctcctgggctcccgggtgctattatccccggccagactgggaataggggtcccccgggatccaggggtagtcctggagcaccgggacctcccgggccacctggaagccacgttatcggtatcaagggggacaaaggaagtatggggcaccccggccccaaaggtccgcctggcacggctggggacatgggaccacccggcagactcggcgcccccggaacccccggtctgcctggacccagaggcgatccaggattccagggttttcccggagtgaagggagagaaagggaaccctggcttcctgggatctatcggaccacccgggccaataggccccaagggaccaccaggggtcagaggggatcccggaactcttaagataatatcgctacctggcagcccagggcctccagggacccctggagaaccagggatgcagggagaaccggggcctcccgggcctccaggcaacctgggaccctgcggcccacgtggcaagccaggcaaggacggcaagcctggaacccctggccccgctggagagaagggtaacaaaggatcgaagggagagcctgggcccgcaggctccgacggtctgccaggattgaaggggaagcgaggcgattctggaagtcctgccacctggaccactcgtggtttcgtttttaccaggcactcccaaactactgcaatcccctcatgccccgaagggactgtgccgctgtatagtgggttttccttcctgttcgtgcagggcaaccaacgcgcccatggacaagacctagatgcgctgttcgtcaaagtgctcagatcaccctag

SEQ ID NO: 23603 - DNA, 4914 bp, Artificial Sequence
  Description of Artificial Sequence: Synthetic coding sequence
atgagcgcccggaccgccccccggccccaggtgctgctgctgcccctcctcctggtgctgctggccgcagcacctgctgcttccaagggctgtgtgtgtaaagacaaaggccagtgtttctgcgacggagcaaaaggagaaaagggagaaaagggtttccccggccctcccggatcccctgggcagaaaggcttcaccggcccggagggtctgcctgggccacagggacctaagtcctttagagccatcccaagctactcaggcggtaagtcactgcaaggcatcagtgggctgccagggttctccggcagcccaggtctgcccgggacacctggcaataccggaccctatggattggtcggggttcctgggtgttcaggatccaaaggcgaacagggcttccctggactgccgggcactctcggatacccaggtatcccgggtatccataacttgaagatatttaagggtgctcccgctaaagaggaggacatcgaattggatgccaagggagatcccggactcccgggagccccaggccctcaggggctcccgggcccacctggttttccaggcccagttggacctccgggaccacctggttttttcggttttccgggggcaatgggaccccggggccctaaatccttcgtgctctcttcgaggatatccacaaaaggggaaaagggcgtcaaagggttaacaggccctccagggcctcctggtaccgtgatcgttactctcaccggccctgataacaggactgatttaaagggtgagaagggcgataaaggggctatgggagagccaggaccgcccggtccatctggcttgccgggagaaagttacggttctgaaaaaggtgccccgggggatcctggactccagggcaagcctgggaaggacggagtccctggttttcctggatctgaaggagttaagggcaataggggcttcccgggtttgatgggcgaagacggaatcaaagaggagaagcgggatgtggcaatcgtctcctttagttctaagaccgagtactatgacacttaccaggagaagggcgatgagggcactcctgggccgcccggacctaggggcgctagaggtcctcaggggaagaacaaatttcgctgcattcccgggtcccagggatcttctcgccccggcttgcgcggagcccctggttggcccggacttaagggaagcaaaggggagagaggacggcccggcaaagacgccatggggacccctgggtcacctggctgcgcaggctcccccgggctgcccggtagtcctgggcctccaggtccacccggggacattgtgtttcgaaagggaccgccaggcgaccatggcctgccagggtacctgggatctccggggatcccaggggttgatggtcctaagggtgagccaggcctcctgtgcacccaatgcccctatatacctggccctcccggcctgccgggactccccggcctgcacggggtcaaaggcatcccaggccggcaaggcgccgccggattgaaaggctctccgggttcccccggcaatacgggcctgcccggcttccctgggtttcctggcgcccagggtgaccccggattaaagggagaaaagggcgagaccttgcagcctgagggacaggtgggcgtgccaggcgatcccgggcttcgcggtcagcccgggagaaagggcttggacggcattccgggcacccccggggtcaaggggttgccaggccctaagggagagcttgccctgtctggtgagaagggtgatcagggcccccccggcgatcctggatcgccaggatccccaggccctgcagggccagcgggtcccccaggctatggtcctcagggggaaccaggcctgcagggaacacaaggtgtgcccggcgcacccggaccgccaggggaggctggtccacgcggcgaactgtcagtgtccacaccagtgcctggcccaccaggccccccaggcccacccgggcatcccggtccgcaggggccccccgggatacctggcagtttgggaaagtgcggcgacccaggccttcctggaccggatggggaacctggcatccccggcattggtttcccgggccctcccggtcctaagggagaccaggggtttccaggcactaagggatctctcggctgtcctgggaaaatgggagaacccggcttgccaggtaagccgggtttgccgggggctaagggcgaacccgcagtggctatgccgggcgggcctgggacccccggttttcctggtgaacgcggcaattctggcgagcatggcgagattggactacctggcttacccgggctccccggcacaccaggcaacgagggccttgatggacctaggggcgacccagggcaaccaggtccccctggtgaacaaggcccccctgggcgttgcatcgagggtcctcggggggctcagggacttcctggactgaatggactgaagggacagcagggaaggagaggcaaaactggtcctaaaggggaccccggaattcccggactggaccgcagtggctttcctggcgaaaccggtagcccaggaattcctggtcatcagggcgagatggggcctttagggcaaagagggtacccaggcaaccctggcattctcggcccacccggcgaagacggtgttattggcatgatgggttttccaggggctattgggccccccggtccgcctgggaatccaggcactccgggtcagcgagggagcccgggcattcctggcgtcaaaggtcagcgggggaccccaggcgccaagggggagcagggggataaggggaacccagggcctagcgagatcagccatgttattggtgacaaaggggagcccgggctgaaagggtttgctggcaatcccggggaaaagggtaatcgtggagtcccaggaatgcccggtctcaaaggactgaagggactgccaggaccagccggacctcctggtcccaggggggacttgggatctacggggaaccccggcgagcctggcctgcggggtatccccggctcaatgggaaacatggggatgccagggtccaagggcaaaagaggaacgttggggttccctgggagagcaggacgtccaggcctgccaggcatacatggtttgcagggcgataagggagagccaggatacagcgagggcacccgacctggacccccaggtccaacgggcgatcccggtctcccaggggacatggggaaaaagggagaaatgggtcaacccgggccccctggtcacctcggacccgccgggccagagggtgcaccaggctcgcctggaagcccaggccttccaggcaaacctggccctcacggggacctggggttcaagggcattaaggggttactagggccccctggtatacgcggaccccctggcttgcccggcttcccgggaagccctggccctatgggaatacgcggggaccagggacgcgacggtatcccaggacccgcgggagaaaaaggcgagactggcctgttgcgcgctcctcctggtccgcgaggcaaccctggggcccagggggcgaaaggagaccggggtgctccaggcttcccgggtctgccaggtcggaagggagcgatgggcgacgcaggcccaagaggccctacaggtatagaaggcttccccggccctcccggtctccctggtgcgattattccaggccaaactgggaacagaggcccacctggctccagaggctctccgggggcccccggccctcccgggccccctggtagtcatgtaatcgggatcaagggagacaagggctcgatgggccaccccggtcctaagggacctcccggcacggcgggagacatggggccaccaggaagactgggggcacccgggacccctggcctacccggccctcgtggggacccggggtttcagggcttccccggagtgaagggtgaaaaaggtaatcctggttttctgggctccatcgggccgcccggccccatcggcccaaaaggccctcccggagttagaggagatcccggcacactaaaaataatctctctgccaggatcccctggcccacctggcactccaggagaaccggggatgcagggcgagcctggacccccgggaccacctgggaacctaggcccatgtgggccacgtggcaaaccgggtaaagacgggaagccaggcaccccaggaccagctggtgaaaagggaaataagggttcaaaaggagaaccaggcccggcaggttcagatggcctcccaggactaaagggaaagcgaggtgacagtgggagtcccgccacatggacaacgcgaggtttcgtgttcacacgccattcccagacaacagctattccgagctgtcctgagggaaccgtgccattatattccgggttttctttcttattcgtgcaaggcaaccagcgcgcacacggacaggacttgggaaccctgggaagctgcctgcagcgctttacaacaatgccgttcctcttttgtaatgttaatgatgtatgcaactttgcctcaagaaacgactatagctactggctcagcactcctgccctgatgcccatgaacatggcccctatcaccggccgtgccctcgaaccatacatcagcagatgcacagtgtgcgaggggcccgctatcgcgattgctgtacattcacaaaccacagatatccctccctgcccacatggatggattagtctgtggaaaggcttttcatttatcatgaaggcatatagtattaactgcgaaagctggggaatcaggaaaaacaataagagcctgtccggagtccacgaagagaagacactcaagctcaaaaagaccgccgagctgcttttttttattctgaagaacaaggtcatgactgagcacgcagtaatttag

SEQ ID NO: 23604 - DNA, 4485 bp, Artificial Sequence
  Description of Artificial Sequence: Synthetic coding sequence
atgagcgcccggaccgccccccggccccaggtgctgctgctgcccctactgctcgtgctgctggccgccgctccggccgccagtaagggttgtgtttgcaaggataaaggacagtgcttttgcgatggggctaagggagagaaaggtgagaaaggcttccccggtccacctgggtcacccggtcagaaaggcttcaccgggccagaggggctccctggcccccagggacccaaaagcttcagggctattccaagttactccggaggcaagtcactgcaggggattagtggcttgcctggcttctcaggaagtccgggcctccctggaaccccgggcaataccggcccctacggcctggtcggggtgcctgggtgctctgggtcaaaaggtgagcaggggtttcctgggttacctgggaccttgggctaccccgggataccggggatccataacctgaagatttttaagggggcaccagccaaagaggaagatatcgagctggatgccaagggagatccaggattgcccggagctccaggaccacaagggctgccgggccctcccggtttcccgggccccgtgggtccacctgggcccccgggtttttttggcttccctggggccatgggaccacgcgggcccaaatccttcgtgctgtcaagccgcatctctactaagggcgagaagggagtaaaaggcctgaccggcccccccggtccccccgggacagtgatcgttactctcaccgggcctgacaaccggactgatctcaagggcgagaagggggacaagggggccatgggtgagccgggtccacctggaccatcagggcttcccggcgagtcatacggctctgagaagggtgctcctggggaccctgggctccaaggaaagcccggtaaggatggtgttcccggctttcctggctcagagggggttaagggcaatcgcggatttccaggcttaatgggtgaggatggaataaaagaggaaaagagggacgtggctatagtgtcattctcgtccaaaactgaatactacgatacttatcaggaaaagggggacgaggggacacccggaccacccggtccacggggagctcgaggtccacaagggaaaaataagtttaggtgtatccctggaagtcaggggagtagcaggccagggttaagaggagctccggggtggcctgggctgaagggaagcaaaggagaacgagggagaccaggaaaagacgccatggggacacctggtagccccggctgcgcgggctctcccggactcccagggtcgcccggacccccgggaccccctggcgatatagtgttccgcaaaggcccacctggagatcatgggctgccaggttaccttggttcacccggaatccccggcgtggatggccctaagggggagcccggtctcctttgtacacaatgcccatacatccctggaccaccaggcttgcctggattgcccggcctgcacggagtgaagggcatccctggccgtcagggtgctgccgggctgaaaggcagccccgggagcccaggtaacactggactgccgggattccctggattccctggcgcacagggggatcccggtttaaagggtgagaagggagagactcttcagccagagggtcaagtaggggtgccgggagaccctggcctgagagggcaacctggccgaaaaggattagacggcattcccggaaccccgggggtcaaggggctgccaggacctaagggtgaacttgctctcagtggcgagaagggtgatcagggccccccgggagaccctgggtcacccggtagccccggccccgctggaccggccggcccacctggatatggcccccagggcgaacccggtctgcagggcacccaaggagtacccggggctcccggaccgcctggtgaggctggacctcgcggtgagctgtctgtcagtacgcctgtgcctggcccgcccggccccccagggccaccaggacacccaggtccacaaggacccccaggcattcctggtagcctggggaaatgcggtgacccaggcctgccgggacctgacggcgaacctggaatcccggggatcggtttcccgggcccacccggccctaagggcgatcagggctttccaggtactaagggaagcctagggtgtccgggcaaaatgggcgagcctggtctccccgggaaaccaggattaccaggcgctaagggagaacccgcggtcgcaatgccaggcggacccggaacgccaggtttcccgggcgagagaggcaactcaggcgaacacggtgaaatcggactgcctggcctgcctgggttaccgggaacccctggaaacgagggcctcgacggaccaaggggagatcctggacaaccaggccctcccggcgaacagggaccaccaggtcgctgcattgaagggcctcgaggagcacaagggctgccgggactgaacgggctgaagggccaacagggacggaggggcaagaccggcccgaagggcgatccaggcattccggggctggacagaagcgggtttccgggcgaaaccgggtcccccggtatccccggccaccaaggggaaatgggaccactggggcagagaggctaccctgggaatcctggcattctgggaccaccaggcgaagacggggtgatcgggatgatgggtttccccggcgctattggtccacctggacctcccggcaacccgggcacacccggtcagagaggctcccctggcattccaggggtgaagggacagagggggacaccaggcgctaaaggcgagcagggtgataagggtaaccctgggccctctgagatttcacacgttatcggagataaaggggagccaggactgaaggggttcgccggcaaccccggcgaaaagggcaacagaggcgtgcccgggatgcccggccttaagggcctcaaggggcttccaggacccgccggcccgccaggaccaaggggcgatctcgggagcaccggaaatccaggggaaccgggattaagagggattccaggatccatgggtaacatgggaatgccaggctccaaggggaaacggggcaccctgggatttccagggcgcgctggtcggcccgggctccccggcattcacggactgcaaggcgataagggcgaaccgggatatagcgagggcacacgcccgggtcctcccggtccaacaggcgatcccggcctacctggcgacatgggaaagaagggagaaatgggacagcctggccccccgggccatttgggccctgctggacccgaaggggctccagggtctcctggctcgccagggttacccggcaaacctggccctcatggtgatctgggctttaaggggatcaaaggccttctgggcccccccgggattcgtgggccacccggactccctggcttccctgggagtccaggaccaatggggattcgcggagatcagggccgtgacggtatcccaggccccgcgggggagaagggagagaccggactcctccgcgcacctcctggtccccgcggtaaccccggcgcacagggtgcaaaaggcgaccgcggtgcccccggcttccctggattgccggggcgcaagggcgctatgggggacgcagggccgagggggccgacaggcatcgaggggtttcctggcccaccagggttacctggggccatcattcccggtcagaccggcaaccggggtcctccaggatcccgggggtcccctggtgctcctggacctcctggcccccccgggtcacacgtgatcggcattaagggtgacaagggctcgatgggtcaccccggacccaaagggccaccgggaaccgccggcgacatgggtccacctggcagactaggcgcccccgggactcctggactgcccggaccacgaggagatccaggattccaaggatttccaggagtaaagggcgagaaagggaacccaggatttctaggctccataggacccccaggtccgattggtcctaaaggccccccaggcgtgcgcggcgaccccggcactctaaagatcataagtcttccaggctcaccaggaccaccaggcacccctggagaacccgggatgcagggcgaacctggtccgcccggtccccctgggaacctgggtccttgcggccctcgtggcaagccagggaaagatggtaagcccggcaccccagggcctgcgggagagaagggaaacaaagggtctaagggggagccaggcccggctggctccgatggtcttccaggcttaaaggggaagagaggtgattccggcagtcctgcaacatggactacccgggggtttgtcttcaccaggcactctcagacaacagcaattccatcatgtcctgaagggactgtgccactttattccggcttctccttcctgtttgtgcagggtaaccagcgcgcccacgggcaggatcttgaatcactgttccaccagctgtag

SEQ ID NO: 23605 - DNA, 4275 bp, Artificial Sequence
  Description of Artificial Sequence: Synthetic coding sequence
atgagcgcccggaccgccccccggccccaggtgctgctgctgcccctcctgctggtgctactggcagccgcacctgcagcaagcaagggctgtgtatgtaaggataagggccagtgtttttgtgatggtgctaagggtgaaaagggagagaaaggtttcccagggcctcccgggtctccaggccagaagggattcaccggacccgaggggcttccaggcccgcaaggaccaaagtctttccgggccataccaagctattcaggagggaagtccctgcaggggatctcagggcttcccggcttcagcggttcaccgggactgcctggcacccccgggaacactgggccttatggtctcgtaggggttcccggttgtagcggatcaaagggagagcaaggattcccggggctgcctgggaccctcggttacccagggatcccaggtattcacaaccttaaaatattcaaaggagcacccgctaaggaagaagatatcgagctggacgctaagggcgatcctgggctcccgggagcccccgggccacaggggctgccaggacctccgggattccccggccctgtggggcctcccggcccacctggtttctttgggtttccgggagctatgggaccccgcggaccgaaaagtttcgttctgtcctccaggatttccacaaagggtgaaaaaggcgtgaaagggctcacggggcccccgggacctcccggaaccgtgatcgtgactctcaccggcccagacaatcgcacagacttgaagggcgagaagggcgataagggcgccatgggtgaaccaggtcctcctggaccttcaggcttacccggcgagtcttacggctctgaaaaaggggctccgggagatcctggcctgcaagggaagccagggaaagacggagtgcctggtttccctggttcggagggtgtgaagggcaaccgcggattccccgggctgatgggggaagacggaataaaggaggaaaaacgcgacgtggccattgtgtcattttcctccaagacagagtattatgatacgtatcaagaaaagggcgacgaggggacgccggggccacctggccctcgtggcgctagagggccacagggtaaaaataagtttagatgcattcctggctcccagggcagctcaaggcctggcctgagaggtgctccagggtggccgggccttaaggggtcgaagggcgaaagggggagacccggcaaggacgctatgggcacccctgggtccccaggatgcgccggctccccgggcctgcccggctctccaggcccccccggcccacctggggacatcgtattcaggaagggaccaccaggggatcacggcttgcccggttatctaggtagcccgggtattcctggagtcgacggtccgaagggcgagccaggcctactgtgcacacagtgtccgtacatacccggccctcctggattgcctggactgccgggcctgcatggagttaaaggcattccaggcagacagggcgctgccggtctgaaaggcagcccaggaagccccggaaatacaggcttgccaggatttcccggtttccctggggctcagggcgatcccggacttaaaggagagaagggcgaaacactccaacccgaaggccaggtgggcgtgccaggcgaccccggcctcagaggacagccggggaggaaaggcctggatgggatcccaggaacacccggtgtgaaggggcttccaggaccaaagggcgagctggccctgtctggggaaaaaggtgaccaaggcccacccggggaccccgggtcccccggtagccctggtcccgccggacctgccgggccaccgggttatggcccccagggcgaaccgggactgcagggcacccagggtgtccccggcgctccagggccacccggcgaagctgggccacgcggtgagctctccgtaagcacgcccgtccctggacctcccggtccacccggacctccaggccaccctggccctcagggccctcctggaattcctgggtccctcggtaagtgtggcgatccagggctgccggggccagatggcgagcctggtattcccggaattggatttcctggcccgccgggcccgaaaggagaccaggggttcccaggcaccaaagggtccctcggttgtccaggaaaaatgggagaacccggactaccgggcaagccaggcttaccaggcgcaaagggggaacccgccgtggccatgccaggagggcctggcactcccggatttccaggcgagcggggtaactctggcgaacatggtgagatcggcctccctggcctgcccggacttccagggacgccaggcaatgaagggctagatggaccccgcggggaccctggtcagccaggtccgccaggtgaacaaggcccccccggcaggtgcattgagggcccgagaggcgctcagggactgcctggactaaatggcctgaaaggacagcagggccggagaggcaagactggtccaaaaggggacccggggattcccgggctggacagatcaggctttcccggcgagacaggcagcccagggattcctggacatcagggggaaatgggcccactcgggcaaagaggctaccctggcaacccggggattctgggccccccaggtgaggatggcgtaatcggtatgatgggcttccccggtgcaattgggccgccggggcctccaggcaaccctggtacacctggtcagcgagggtcaccaggtattcctggggtgaagggtcaacgagggactcccggagccaagggcgagcagggagataagggcaatccaggcccttcagagattagccatgtgataggtgataaaggagagcccgggctgaagggcttcgcaggaaatcccggcgagaagggcaataggggggttccaggcatgccaggcctaaaaggactcaaagggttgccaggccctgccggccctccgggacccaggggcgacttggggtctaccggtaacccgggggagcctggactgcggggaatccctggctcgatggggaacatgggtatgcctggcagcaagggtaagagaggaacactgggtttcccaggcagagccgggcgacctggtttgcccggcattcatggactgcagggagataagggcgagcccgggtactctgagggcactaggccagggccgcccggacctactggagacccaggcctcccaggtgacatgggaaaaaaaggggaaatggggcaacccggccctcccggccatctgggccccgcaggtccagagggagcccccggaagccctggctctccaggactgcctggcaagcctggcccgcacggggacttgggctttaaaggcatcaagggactattgggaccgccaggcattagagggccaccaggccttccaggattccctggtagtccagggccgatgggaatcaggggcgatcagggtcgagatggaatccccggccctgctggtgaaaagggcgaaacaggcctacttcgggccccgcctggtccccgcggaaatcctggtgctcaaggggcaaagggggaccgcggcgctcctggcttccccggactgcccggcagaaagggggccatgggggacgctggcccacggggacctaccgggatcgaaggattccccggccctccaggactgccgggtgccatcattcccggacagacaggcaataggggccctccaggcagcaggggatcaccgggcgcccccgggccccccgggccccccggttcacatgttatcgggatcaaaggggacaagggctccatgggccaccccggacccaagggacccccaggcaccgctggagatatggggccccccggacgcctgggtgctcccggcaccccgggcctgccagggccacgaggcgaccccggtttccaggggttccctggagtgaagggcgagaaaggtaacccaggctttttaggctccatcggcccgcctggccctatcggacctaagggtccacccggtgtacgaggcgacccaggcacactgaagattatctctctgcctggctctcctgggccccctgggacacccggggagcccggtatgcagggcgaaccaggacctcccggacctccaggcaacctgggcccctgcggcccacgcggaaaacctggaaaggatggaaagccagggacgcctggccccgcaggagagaaaggtaacaaaggctctaaaggcgagccagagtccttgtttcaccaactgtag

SEQ ID NO: 23606 - DNA, 5013 bp, Artificial Sequence
  Description of Artificial Sequence: Synthetic coding sequence
atgagcgcccggaccgccccccggccccaggtgctgctgctgcccctcctgctggttctgctggctgcagccccggcagcctcaaaaggttgcgtctgcaaggataaagggcagtgcttttgtgacggggccaaaggggagaagggcgaaaaaggcttcccaggtccccctggaagtccggggcagaagggttttactgggcccgaagggctgcctgggccacaggggcctaagggattcccagggcttccagggctgactggcagcaaaggggtgcgggggatctctgggctgcctggctttagcggttctccaggcctgcccggcaccccagggaacaccggaccttacggtctggtaggcgtgccaggctgcagcggatccaaaggagaacaaggattccccggattgcccgggaccctggggtatcccggtatccccggagcagccggacttaaaggccagaagggagctccagcaaaggaggaagacatagagcttgatgccaaaggcgatcccgggttaccaggcgcccccgggccccaaggcctacccggcccgccagggtttccaggccctgtggggccacccggtcctccaggcttctttggctttcccggagcgatgggacccagaggccctaagggccacatgggagagagagtcattggccacaagggcgaaaggggcgtcaaggggctaacaggaccacccggacctccaggcaccgtgatcgtgacactgaccggaccagataaccgcacagacctgaaaggagaaaagggtgataagggggccatgggcgaacctggcccacctggaccctcaggcctgccaggggagagttacggcagcgaaaaaggagcccccggtgatcccggactccagggaaagccaggaaaagatggggtgcccggcttcccagggtctgagggggtgaaaggcaataggggttttcccggccttatgggcgaggatggcattaaaggacaaaagggcgacatcggtccgcccgggttccgggggcccaccgagtactacgatacctaccaggagaaaggcgacgaggggacacccgggccccccggccctaggggcgctagagggccacaggggccgtctggcccgcctggcgtccccggttcaccgggatctagtcgcccagggctgcgtggcgccccgggttggcccgggctcaaaggaagtaagggagaacgtggcaggccaggtaaggacgcaatgggcacacccggtagcccaggttgtgccggcagccctggattgcctgggtcgcccgggccccctgggccaccaggcgatattgtgtttcgcaaaggcccgccaggtgaccacggtctccccggttatctgggttcaccaggcatccctggggtcgatgggcctaagggtgaacctggccttctgtgcacccagtgtccatacatcccaggcccgcccgggctcccggggctgcctgggctgcatggtgtaaagggaattcctggcaggcagggtgccgcgggactgaagggcagtcctggcagcccaggaaataccgggttacctggcttcccgggatttcccggagcccagggagacccaggactgaaaggagagaaaggcgaaaccctccagcccgaggggcaggtgggggtcccgggcgacccaggattgcgcggccagccaggacgcaaagggcttgacggaattcccgggaccccaggggtgaaaggcctgcccgggccaaaaggggagctcgcactcagcggagagaagggggaccaggggccccctggtgaccccggttcccctggcagtccagggcccgctggcccagcaggtccacccgggtacggcccgcaaggagagccaggcctgcagggaacccaaggagtgcctggagcgccaggcccccctggcgaagccggtcctagaggagaactgtcagtgtccactcctgtgcctggtccgccaggtccacctggacctcctggccacccaggaccccaaggccccccaggaatcccaggtagcctcggtaagtgtggggacccagggcttcccggtccagatggcgagcctggaatccccggcatcggctttccaggaccacctggacctaagggtgatcaaggcttccccggaacaaaaggatctctcggatgtcccggaaaaatgggtgagcccggactgcccgggaagcccgggctacccggggctaaaggtgaaccagccgtggccatgcccggaggacctgggaccccggggtttccgggggaacgtggaaatagtggagagcacggcgaaataggattgccaggactgcctggattgcctgggactccaggaaacgaaggcctggatggccctcgcggcgatcccggtcagccagggccccctggtgaacaaggtccgccgggcagatgcattgagggacctaggggtgcccagggacttcccggattgaacgggttgaaaggccagcagggccggcggggtaagacaggaccaaaaggagaccctggaatccctggacttgaccggagcggattccctggagaaacgggcagccccggtattccaggtcaccagggtgagatgggccctctgggccagcgcgggtatcctggcaatcctgggattctaggcccccctggcgaagacggcgtgatcggcatgatggggttccctggggccatcggtccacccgggcctcccggaaatcccggtactccggggcagaggggctcacctgggatcccaggggtaaagggacagcgcgggacgccaggagctaagggcgagcaaggcgacaaaggaaacccaggcccttccgagatttcccacgtgattggggacaagggtgagcccggtctgaagggcttcgccggcaatcccggtgagaaaggcaaccgcggagtgccaggaatgccaggattaaagggattgaagggtctccctgggcctgcaggacctccagggcccagaggtgacctgggcagtacaggaaatccaggggaaccgggactgaggggaatccccgggtctatgggtaacatgggcatgccaggttcaaagggaaaacgggggaccctagggtttccggggcgggctgggagacccggtctcccaggcatccatggcttgcagggagacaagggggagcccgggtacagcgaaggcacgcggccgggtcctccaggtccgactggagaccccggtttgcccggggacatgggcaagaaaggagagatgggtcagcctggaccccccgggcatctgggacctgccgggccagagggtgcgcccggatcaccaggcagtccaggactgcctggcaaacctggccctcatggggatctggggttcaaaggcattaaagggctactcggcccacctgggatcagaggtccccccgggctgccaggttttcccggctcacccggacccatgggaattcggggcgaccagggacgtgatgggataccagggcctgctggagagaagggcgaaaccggcttgcttcgggcacctccgggcccgagaggcaaccccggggcacagggagcaaaaggggataggggcgcccctgggtttccgggcttacccggccggaaaggtgctatgggggatgcaggacctcgtgggcctacaggtatagaggggtttcctgggccgcctggactaccaggagccatcattcccggacagaccggtaataggggtccacccggaagtcgcgggtcccccggcgctcccggccctcctggacctcctgggagccatgttatcggtattaaaggagacaaaggctccatgggccatcctggcccgaaaggccctccgggcactgctggagatatgggaccccccgggcgcctgggcgccccaggaacaccaggcctacccgggcccagaggggatccaggatttcagggatttcctggcgtgaagggggaaaaaggcaatccaggctttctgggttcaatcggccctcctggcccaattggccccaaaggtcctccaggcgtgcggggtgaccccggcaccctgaagatcatcagtctgccaggatctccaggcccccccggaacccccggggaacctgggatgcagggagaacccggccctcccggaccacccggcaacctgggcccttgcggacctcgaggaaaaccggggaaggatggcaagccggggaccccaggccccgccggcgaaaaggggaataagggatcgaagggagaacctgggccggctggatccgacgggctaccagggctcaaggggaagaggggcgatagtggatcgccagcaacttggacaacccgaggcttcgttttcactaggcattctcagacgacagcgatccctagctgccctgaaggcaccgtgcccctgtactcaggcttttcgttcctgttcgtccagggtaaccagagagcccacggccaagacctaggaaccctgggctcctgtctacagaggtttaccacgatgccattcctattttgcaatgtaaacgatgtctgcaattttgctagtagaaatgactacagttattggttgagcacgcccgctctgatgcctatgaatatggcccccattaccggcagggcgctggaaccctatattagtagatgcaccgtgtgtgagggtccggcgatcgcaatcgcggtacacagtcagactacagatattcctccctgcccccacggatggatcagtttgtggaagggcttctccttcatcatgttcacttccgctggctctgagggcacaggacaggcattggctagcccgggttcctgtcttgaggaatttcgcgcctctccatttctcgagtgtcacggacggggaacctgtaattactattcaaacagttattctttttggctggcctctctgaatcccgagaggatgtttcggaaacccattccgtccaccgtgaaggccggcgagctggagaaaatcatatctagatgccaggtttgcatgaagaaacggcattag
